United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 27

SEQ ID NO: 150643 - protein, 17 aa, Glycine max
  Coding DNA Sequence Number=SeqID_58958
MPLRGRIASRFLSPWVK

SEQ ID NO: 150644 - protein, 92 aa, Glycine max
  Coding DNA Sequence Number=SeqID_58959
SIDIAIVKEFYTNLYDPEDKSPKQVRVRTPIVMGSCRNMPFCGRAKARLTDALSKGGKVRRVATNVYLWKTSEKPKEIGQNENSKFGSCIYV

SEQ ID NO: 150645 - protein, 55 aa, Glycine max
  Coding DNA Sequence Number=SeqID_58960
MEGIVGASTETGRITLRGTKGRGSSTGILLKRVRSRLGGQPRNMEESDRAYALTR

SEQ ID NO: 150646 - protein, 56 aa, Glycine max
  Coding DNA Sequence Number=SeqID_58961
MLEKPKRGFANFSDKGSGVVYVRGRKCGEEVEQQLSQASSTCPGELLPQPEITLLA

SEQ ID NO: 150647 - protein, 132 aa, Glycine max
  Coding DNA Sequence Number=SeqID_58962
MQWRFQSQKRCKDKLKLTRNKHRTMGFVLYRNRKPSWKILLRSKGSSQCGVATENNGGLWWLIVAVGDGESAWDVRNGFGRKKGEEMVFFLSYTKAKAENAQVRNALGNRSFAHTPDIFSKIPMVISWTSVL

SEQ ID NO: 150648 - protein, 159 aa, Glycine max
  Coding DNA Sequence Number=SeqID_58963
YGATRHPLDPDKSNRALGFPALITGLCQSFGVPVAPTKVIRPPITRAFIEKYCTQRQAQGDAPQAAGAPPPPHQAGPAGSFDMDQYLRHLMSLSMQSQGFASFSCPTPDQFRAEVAWPGDWPEAQAGEVPPKVPGNGEEAHEDEEMADLLDFLGGSGAT

SEQ ID NO: 150649 - protein, 89 aa, Glycine max
  Coding DNA Sequence Number=SeqID_58964
MELASHRTVGSSRCGVSTENNGGLWWLMVAVGDGERAWNIGNGFGRKKGEGMAFFLSYLDYKAQNKQVSNALGNRNVAHTPDIFSKIPL

SEQ ID NO: 150650 - protein, 150 aa, Glycine max
  Coding DNA Sequence Number=SeqID_58965
  Subcellular localization annotation: CTP_CleavageSite=38; ConfidenceScore=5.55e-01
MPISPCGSISWSMPSRHRDRTHKTPSGPGKVQQGPGVSSSGYGPLSVLQGARTPPARSRHHSSTEYLSPPARASGPPTNRAFIKKCCAPRQAQGETPQQHWDGRQQETDAPPSPLEFTSAHPQKGLSIAYTTWPTNRRPSPKPNDAPSCS

SEQ ID NO: 150651 - protein, 91 aa, Glycine max
  Coding DNA Sequence Number=SeqID_58966
MGLFQLYGVPVAPQQGVGRDTTTAWGWPTAGNRRTGATSKAPHLIYKGWSVAYDPWPTGRRPSPKPKVSKSTRSVTNKSSRVQLKTLKKRY

SEQ ID NO: 150652 - protein, 151 aa, Glycine max
  Coding DNA Sequence Number=SeqID_58967
  Gene Ontology: Mol. function=RNA-directed DNA polymerase activity; Biological process=RNA-dependent DNA replication
  Homolog annotation: Hit_ID=A5AMK2; Match level="QueryCoverage=47%, HitCoverage=9%, E-value=1e-10, Identity=45%"; Hit description =Putative uncharacterized protein
  Pfam annotation: Domain name=Retrotrans_gag; Domain location=66-144; Score=3.3; E_value=0.026; Accession=PF03732.8; Description =Retrotransposon gag protein
MAGAGDNGGVYHQLDGFQRLLLDAMTTQMQRLLNRNNEVLYRRIERLEHQMNPNVGRPYGGNRREMKIQHAFSYNDYPEKQKIDTWTEMRRVVRKRYAPTSYSRTMRQKLQRLSQGSLIVEDKEMEMALVRANIEENTKAMHDGFTNKISF

SEQ ID NO: 150653 - protein, 134 aa, Glycine max
  Coding DNA Sequence Number=SeqID_58968
MAPTRHPLDPDKSNRALGFLALITGLCQSYGVPVTPSIVIRLPITRAFIEKYCTPRQAQGDSHQVADAPPPPRQADPAGRPTIVGRCRYISVSTGSASVREEPAGSPNEAEESRMDEDMIDLLGFLGGSGATWP

SEQ ID NO: 150654 - protein, 163 aa, Glycine max
  Coding DNA Sequence Number=SeqID_58969
MAPTRHPLDPDKSNRALGFPALITGLCQLFGVPVAPSKEIRPPITRAFFEKYCTQRQVQGDALQAADAPPPHQAGLTGLFDTEQYLRHLVRQQAANHRAHSQGFTSFPCSTPDQFRAEVAWPGDWSEARAGEAPAEAPDEADEAREDEEMTDLLDFLGGSRAT

SEQ ID NO: 150655 - protein, 184 aa, Glycine max
  Coding DNA Sequence Number=SeqID_58970
  Subcellular localization annotation: CTP_CleavageSite=14; ConfidenceScore=5.11e-01
MNVGALISGQITLRAQSNSSRLGFPSLITALRMARGVTLDSMIFESFSLAINFTYIKKNYWNLDDPTASFPGTRKARARGSKGPSSATPQTSTTPAPIPLAPSLHSLAQHQPIMSMEEFSLQVAWPGVQPSSHGGGEASTAQEPQADLETTLVAQEDDLEAIPPESFVPETDPEANPVVAEANP

SEQ ID NO: 150656 - protein, 189 aa, Glycine max
  Coding DNA Sequence Number=SeqID_58971
  Gene Ontology: Biological process=transposition, DNA-mediated
  Homolog annotation: Hit_ID=Q1J7G7; Match level="QueryCoverage=21%, HitCoverage=71%, E-value=4e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPRSFKAIKSLFASVIKVKLHLLLQQVGQWNGYFAKIPYKAPVESCMTKKRSHLSHTRGAERHPPIGESAEG

SEQ ID NO: 150657 - protein, 182 aa, Glycine max
  Coding DNA Sequence Number=SeqID_58972
  Gene Ontology: Biological process=transposition, DNA-mediated
  Homolog annotation: Hit_ID=Q1J7G7; Match level="QueryCoverage=25%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPANAHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 150658 - protein, 273 aa, Glycine max
  Coding DNA Sequence Number=SeqID_58973
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFSSNNVTPLKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150659 - protein, 75 aa, Glycine max
  Coding DNA Sequence Number=SeqID_58974
PNSQKGPQWSRQLSQHALLRASEARLTGALSKGGKMRGVATNEGISTSHVDKSGALAPTYPPSKRKSDLRSSSLR

SEQ ID NO: 150660 - protein, 76 aa, Glycine max
  Coding DNA Sequence Number=SeqID_58975
MPDIRRQCQRSAPASEYLGRTVVVFHVWDCRNLPFGGRVTRDSQVRLPRKEYAWSRHQRLFEENVRKTGKDVVYKF

SEQ ID NO: 150661 - protein, 146 aa, Glycine max
  Coding DNA Sequence Number=SeqID_58976
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=71%, E-value=1e-24, Identity=69%"; Hit description=LacZ protein
MKHFTDTLISANILVELEHEGTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 150662 - protein, 72 aa, Glycine max
  Coding DNA Sequence Number=SeqID_58977
MGIKSPAEDLLCIQEQYNSYPVQKNNEFTFCSFMSQGNFNGGLPENAPDRQVFKIKADEFEYRTQGTNVSLN

SEQ ID NO: 150663 - protein, 61 aa, Glycine max
  Coding DNA Sequence Number=SeqID_58978
  Subcellular localization annotation: CTP_CleavageSite=54; ConfidenceScore=5.47e-01
MAFALANRRGSASITLPLASFSAYTCAKSSTNFCSWVMDWFNSSLYCPMIPSMLCSVASKC

SEQ ID NO: 150664 - protein, 69 aa, Glycine max
  Coding DNA Sequence Number=SeqID_58979
MMTKVMTKSSKINQRMSSRYSRFKRKVDFKNQESRFKISRIKNQEIKISRIKIQEIKIQDSRFKNQEKA

SEQ ID NO: 150665 - protein, 183 aa, Glycine max
  Coding DNA Sequence Number=SeqID_58980
  Homolog annotation: Hit_ID=UPI00006A2D9E; Match level="QueryCoverage =89%, HitCoverage=87%, E-value=3e-15, Identity=16%"; Hit description =UPI00006A2D9E related cluster
MSSPSEGYMPSPSEDCIGLHVLTFVGLHALAIRGLHVLTFVGLHALTFRGSHVLTFRGLHALAIRGLHVLTFRGLHALAIRGLHVLTFRGLHALAIRGLHVLTFVGLHAFTFGGLHVLANRGLHALTFRGLHVLTFRGLHVLAFKGSCTFTFVGLHALTFKGLHVLTFRGLHVLAIRGTCPHL

SEQ ID NO: 150666 - protein, 91 aa, Glycine max
  Coding DNA Sequence Number=SeqID_58981
MQPIMSMEEFISQLAWLRVYRSPLGGGEASAAQEPVLEEDEPIPPKPFVYETDPASALEEVASPKLVPQSSPSQAPVLEDPEPSAPAPIPD

SEQ ID NO: 150667 - protein, 100 aa, Glycine max
  Coding DNA Sequence Number=SeqID_58982
  Homolog annotation: Hit_ID=Q6WAY4; Match level="QueryCoverage=89%, HitCoverage=16%, E-value=8e-07, Identity=33%"; Hit description =Putative uncharacterized protein
MAEVSTEAIASLTQYYDRPLRCFTFGDFQLSPMVEEFEEILGFPLGGRKPYLFSGFYPSLARISKIIQISVQELDHRKQVENGVVGVLRKCLEAKARILE

SEQ ID NO: 150668 - protein, 27 aa, Glycine max
  Coding DNA Sequence Number=SeqID_58983
MDKSLKVEKDEWREKERMSIKFCASKE

SEQ ID NO: 150669 - protein, 120 aa, Glycine max
  Coding DNA Sequence Number=SeqID_58984
MQDLEAATTPEEEPRSSEASSSFPIADHSHIEPVEDPIMAQEPRRVTLEDYSSSIVLQFFTSIAQPEVQAQTITYPPSLIHLIQNNLFHGLPNEDPYAHLATYIETCNTIRLAGVPADAI

SEQ ID NO: 150670 - protein, 117 aa, Glycine max
  Coding DNA Sequence Number=SeqID_58985
  Homolog annotation: Hit_ID=Q47062; Match level="QueryCoverage=45%, HitCoverage=39%, E-value=6e-10, Identity=54%"; Hit description=URF 4
FVGQCCGFLHHHHATDKLRDVADFAVADVEVFNRSQSVNTVVGIRWNFPGLQKFPDNAAEDGRRRKPGCGDDQKRIADYCWSAADPAGVLHRLPRPSAATAAGAKAPDHEAAAASAL

SEQ ID NO: 150671 - protein, 123 aa, Glycine max
  Coding DNA Sequence Number=SeqID_58986
MARTRGLGRVIGRVVGRNRPADQDAADVPERRRPTASARRLRVHQMTTEGRDLVEDVAGMTDDVPEHASEAPEMRADAQGADSGEGSDGDDAAEGFHGGPRDPSVLTSFAEHVAHVVWSGHVF

SEQ ID NO: 150672 - protein, 165 aa, Glycine max
  Coding DNA Sequence Number=SeqID_58987
MAPTRHPLDPDKSNRALGFPALITGLCQSFRVPVAPSKRQAQGDAPQAADAPPPHQAGPAKSFDTEQYLRHLVRQQAANHRAHVQTHDCLYQMSLSLQSQRFTSFPCPTPDQFRAEVAWPGDWPEAWAGEAPAEAPAEAPDEADEAREDEEMTDLLDFLGGSGTT

SEQ ID NO: 150673 - protein, 169 aa, Glycine max
  Coding DNA Sequence Number=SeqID_58988
MEVSVGIAPTRHLVDPEKSNRALGFPALVMGLCQSYRVPVPPARIASVRHPVDPEKFNRVLGFPGLITGLCQFYGVPVAPNKVIRPLLTGLSSRITASPGRRKARHHSSGQQVTSTTSRVHLSSSTKWLERCLRHMADQQATKSIAKAQDIKEALLGGNLVPFKSLLVI

SEQ ID NO: 150674 - protein, 86 aa, Glycine max
  Coding DNA Sequence Number=SeqID_58989
MASYGGFTSDSPQILASLHQLDFAPYASRPYNAQWNAPGLLHDKHTLRSSRILGEMEVDVPWLGLWLPLNYQVDMGASQHRTPELG

SEQ ID NO: 150675 - protein, 49 aa, Glycine max
  Coding DNA Sequence Number=SeqID_58990
MEVEEPWLGLWLPFHYRVDMRAGFVADLGVAFVDDWVFLADRVVGNEKG

SEQ ID NO: 150676 - protein, 37 aa, Glycine max
  Coding DNA Sequence Number=SeqID_58991
DASVSLASPSRRRVVSYPNFVRGPLLDDKRPFFGPCE

SEQ ID NO: 150677 - protein, 163 aa, Glycine max
  Coding DNA Sequence Number=SeqID_58992
HHHLIPLGDVHGALHRARHRRDGRLGFTLRNKIAGARLGRDQLEVFKDLISLLYGADAHAVLLAQRAHRRQTFAAAIQPLFNAFCQEIGQMLIARHAVSFVFTIQIVKPVQIAADFQDDNPTGTVRRASWNFSRIVLKDRLSCLSGSRKRCVTGIASTVPAAS

SEQ ID NO: 150678 - protein, 98 aa, Glycine max
  Coding DNA Sequence Number=SeqID_58993
  Homolog annotation: Hit_ID=Q6UUU1; Match level="QueryCoverage=81%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLIPRLTTQFR

SEQ ID NO: 150679 - protein, 108 aa, Glycine max
  Coding DNA Sequence Number=SeqID_58994
  Subcellular localization annotation: CTP_CleavageSite=57; ConfidenceScore=5.14e-01
MCGISCQCQDLHAILLKFQPARINLTLHLTLQSPTMLNGTPRGFSVTSTRCVSSRILGEMEVDEPWLGLWLPLNYQVDMGASFLTAKIHFLVGVFGLCERWCSSLEVR

SEQ ID NO: 150680 - protein, 102 aa, Glycine max
  Coding DNA Sequence Number=SeqID_58995
MEEGECAASANQNYLWKKFTCTEIVRNVWSAWASNILEGRSRLLLLLLRAGPSEIRVIPPSRVVSVAGEHKLQAAQLLQVAAWKGKGLYGGQQRSTNHKPLR

SEQ ID NO: 150681 - protein, 47 aa, Glycine max
  Coding DNA Sequence Number=SeqID_58996
MENCTKDEKGELHYAITTHGSKLEGEGLMNENAIHGAPKRIENGELH

SEQ ID NO: 150682 - protein, 105 aa, Glycine max
  Coding DNA Sequence Number=SeqID_58997
MATTKLTKLMDSSRKIANLLGCGNHKPKQECCSVWVSEVVVEKHGCRLKHVIINVIPIERSSSSYTSEPRSRVMCLCNVEAPLVTSWTEDNSWKLFMVVVYIRVM

SEQ ID NO: 150683 - protein, 236 aa, Glycine max
  Coding DNA Sequence Number=SeqID_58998
  Homolog annotation: Hit_ID=A5BEV8; Match level="QueryCoverage=97%, HitCoverage=35%, E-value=7e-16, Identity=28%"; Hit description =Putative uncharacterized protein
VESAHWSLKRLLQNSVGDICSVWEAMNNMMTLQHTQIKASFETSTHVVGHVFKVTLFKKILGMVSRQKSFTLWICHEEYPRYFMCIFSDQGLCGTQVTITEEMETISKRFEQLDVFGKVHLKSKLQEIAYPGMNSMCPPPEKDSIENIIDVKADGNYGYQAIAVLLGMGEKSWSLVRNHLHKELTSWSEEYINLVGGIQRFEELKLSLYVDGLTMVTMDKWMNITNMGYALLHDTT

SEQ ID NO: 150684 - protein, 139 aa, Glycine max
  Coding DNA Sequence Number=SeqID_58999
  Gene Ontology: Mol. function=nucleic acid binding; Biological process= DNA integration
  Homolog annotation: Hit_ID=A5BSC1; Match level="QueryCoverage=61%, HitCoverage=5%, E-value=7e-20, Identity=39%"; Hit description =Putative uncharacterized protein
MEKSDKKTFKDKKGKKAYITWEDNDIDSSSDSENEIINLSLMAKDYESKEEDSLKQNWYIDSGCSKHMTGDASKFTHISHKNSGHVTYGDNNKGHRTNNVYMINLDKAPNQAQCFLSKEDESWLWYRRIGHINMEQRKE

SEQ ID NO: 150685 - protein, 275 aa, Glycine max
  Coding DNA Sequence Number=SeqID_59000
  Gene Ontology: Mol. function=protein binding
  Homolog annotation: Hit_ID=A4W697; Match level="QueryCoverage=85%, HitCoverage=49%, E-value=1e-100, Identity=75%"; Hit description =Putative uncharacterized protein
RYGVVSCYNSLPLAGGGSTLVRLNLKAIAEHSTSLDDFFTRTLPHYCQQQIAIIDARCDFLYQQSGFFENSFLVKEGLIDADRFVPMFGLYGLAEAVNALCEKAGIAGRYGKDEQANALGYRISEQLAARGSALIRVPRRARVCPTATSRIPSATLLAVAPHHQYYHSGISDILTLDETVKRNPQAVAQLCLGAFNAGMREFTANVAGNALVRVTGYMVRLSDLEKYREAGSRTNTTAATCAAKPAIIRGRSAAATTVETAFPTALMKPLAFRPD

SEQ ID NO: 150686 - protein, 114 aa, Glycine max
  Coding DNA Sequence Number=SeqID_59001
MSKSCGFGMTGPLDESISCFLIRVDPWVLVPIAFRGLHILAFRGLHVLTLRGLHVLANRGLHALTLRGLHVLANRGLHALTLKRTTRPRQQRAACPHLQRTTHPRLERAPRPHL

SEQ ID NO: 150687 - protein, 77 aa, Glycine max
  Coding DNA Sequence Number=SeqID_59002
GHADILIARFPNPSYGVKMGSSRCRVSTENNGGLWWLMVAMGDEESAWDVRNGFGRKKGEGMAFFLSYTKAKAETLK

SEQ ID NO: 150688 - protein, 170 aa, Glycine max
  Coding DNA Sequence Number=SeqID_59003
  Homolog annotation: Hit_ID=Q6UUU1; Match level="QueryCoverage=50%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALLLVLPFGLPFAPAGLYARTPVQSDRCALSGNYRLESNPERHAKHHWQQPL

SEQ ID NO: 150689 - protein, 168 aa, Glycine max
  Coding DNA Sequence Number=SeqID_59004
  Homolog annotation: Hit_ID=Q6WAY3; Match level="QueryCoverage=78%, HitCoverage=6%, E-value=6e-08, Identity=29%"; Hit description =Gag/pol polyprotein
MVPRVMLGNDYEPRMGLGKNNGGRTSLVSTRGNRGKFGLGYKPTQADIRKSVAGRKSRSQGLQLGRLVEGGSPCHINRRFISVGLGHEGQVVAICDEDSLSGSDLDPTIGFKQEVDQMESEEDEDVGLPPELEKIVAHEDQEMGPHQEETELVDLGNDSGKKEVKIGT

SEQ ID NO: 150690 - protein, 164 aa, Glycine max
  Coding DNA Sequence Number=SeqID_59005
  Gene Ontology: Biological process=transposition, DNA-mediated
  Homolog annotation: Hit_ID=Q1J7G7; Match level="QueryCoverage=20%, HitCoverage=47%, E-value=8e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDVYLKHDAGHDIPRDSKSALDIAKGIAQLAELTIDATQL

SEQ ID NO: 150691 - protein, 325 aa, Glycine max
  Coding DNA Sequence Number=SeqID_59006
  Homolog annotation: Hit_ID=Q84VI1; Match level="QueryCoverage=100%, HitCoverage=47%, E-value=1e-124, Identity=74%"; Hit description =Envelope-like protein
MATSPKETSAPGSPAVPSSPHQEQPEFNIQPIQIIPGQASVPEKLVPRRQQGVKIAENPSLATSPREVDTEMDKKIRSIVSSILKDASVPEADEDVPTSSNPNVFVPDVNKDVPTSSAPNAEALPSPSEEESTEEEDQASEETPAPRAPEPAPGDLIDLEEVESDEEPIANRLAPGIAERLQNRKGKTPLKRSGRIKTMAQKKSTPITPATSRRSKVAIPSKKRKEISFSSSDSDDDVELDVSTSKRAKKSGRKVPGNVPDAPLDNISFHSIGNVEKWKYVYQRRLAVERELGRDALDCKETMELIKAAGLLKTVTKLGDCYEGL

SEQ ID NO: 150692 - protein, 90 aa, Glycine max
  Coding DNA Sequence Number=SeqID_59007
MVGYTPSSFADLVFAGQRIEVGLKRGESDHSTLINAKKPGANEEGENEGETHDATAIPTWPNFPPAQQCHYSANISSTHYPPPSHLQSYP

SEQ ID NO: 150693 - protein, 145 aa, Glycine max
  Coding DNA Sequence Number=SeqID_59008
  Homolog annotation: Hit_ID=A8GII4; Match level="QueryCoverage=23%, HitCoverage=9%, E-value=6e-08, Identity=85%"; Hit description =Aldo/keto reductase
MALAFVRQQPFVACTLLGATTVDQLKINIDSLDVKSIPGLPFRRLNTARAQPGCAPFHRRCDHHSALIASANTTPNPTPTPTTGTPSFTTSEYSASISNMAAFSPRFCTAIALPAPTECLPRSCSNALSGTTKKPPSMPMIANKT

SEQ ID NO: 150694 - protein, 197 aa, Glycine max
  Coding DNA Sequence Number=SeqID_59009
LDWLAKLKIVNEENFEAPEEDEEVRALKTELGKARLAKEKFKLVATDIRKECAGLREENAAIAKALEQETKRARKEEHGRDKFRGALWGQQQSKRNLSQRLCETETNMLAIITKYQEELSLAMAHEHRVVDEYAQMYAKKEARGRVIDSLHQEATMWMDRFALTLNGSQELPRLLAKAKAMADTYSAPEEIHGLLDY

SEQ ID NO: 150695 - protein, 163 aa, Glycine max
  Coding DNA Sequence Number=SeqID_59010
MGDQEETQEQMKADMSALKEQMASMMEAMLGIRQLMEKNVATAAAVSSAAEADPTLLATAHHPPSNIVGRGRDTLGHDGNPHLGYNRAAYPYGLSPNYSPLVLQDDAGPIASPVLEREPPQQPDEVHKDLQDYARRDVEFYPPIPEGTAPSMLPQPNITTQPI

SEQ ID NO: 150696 - protein, 80 aa, Glycine max
  Coding DNA Sequence Number=SeqID_59011
MITKDDDKGDDKKLKGQSKNELKMFKIESRTLQDSRGKLNLRIKIQEIKVQESRFKNQEKAIQESRKSLTKISMKSAFER

SEQ ID NO: 150697 - protein, 453 aa, Glycine max
  Coding DNA Sequence Number=SeqID_59012
  Gene Ontology: Mol. function=signal transducer activity; Cellular component=membrane; Biological process=signal transduction
  Homolog annotation: Hit_ID=UPI00005F964F; Match level="QueryCoverage =39%, HitCoverage=33%, E-value=1e-48, Identity=56%"; Hit description =COG2199: FOG: GGDEF domain
  Pfam annotation: Domain name=GGDEF; Domain location=21-175; Score =195.6; E_value=1.2e-55; Accession=PF00990.12; Description=GGDEF domain
AQVKRALLTGIGLVQDKIGRLKSEVQSDPMTSLLNRRGLSAVLDYFDTMQQSFAVLALDIDHFKRVNDNFGHDVGDEVIKQVARTLRQSARQTDVVCRNGGEEFLMLLPATAPDEARVIAERVRTSIAGGWIDPVGQITISIGIASWQPTHGSQEQILKQADDALYQAKNAGRNCVVIAGQEALASTVIEHDIVVVRGFKIVEHLLHFAIAANQEADAVNAVVGFPHKGFLTPDAKLLANLMIFIRQQGEVEQFFLDKARQFFRLVDHRPAWCSPASWLSGRNRPERAVPGTAKAPGGVYLRVISLHGMPARQSVWRNNPEPDSDGAVRVVVLRTADGKPAQTVRWHDSPGCARSSEYRAPAARHGSGHRRRDARVGALHHDQQLQLGTLHRQGRFNQGNGVPAAGEQHNKGELVAQHRQAAVFNIATTAADVAGNGIDDTRTINAQSGDHQM

SEQ ID NO: 150698 - protein, 119 aa, Glycine max
  Coding DNA Sequence Number=SeqID_59013
MSELTHHINCVALSCPLSSSGNHVGANCINEANARAMSAGLLRITPGARRSVYWLTMLACAGCSSEVSVAEKKAAPVLSRICEYRTHYSASSLLTPTLGRHCGDGSLELGRNFPRKLQE

SEQ ID NO: 150699 - protein, 87 aa, Glycine max
  Coding DNA Sequence Number=SeqID_59014
MAASDITIPRDRAHIPTKKSLLELTSQDALLAQNKLFSKQLEALTETLSGYFLFQHGQPYNSQQGQWRNHPGNQFNKDQGGPSTRPQ

SEQ ID NO: 150700 - protein, 160 aa, Glycine max
  Coding DNA Sequence Number=SeqID_59015
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRDESKRQGLNLSGSWQQGHSATYNTLVAYLSRLQRILLRRSMGIALQGV

SEQ ID NO: 150701 - protein, 205 aa, Glycine max
  Coding DNA Sequence Number=SeqID_59016
MTTLTQTWMTLLLSNILPSDHNSNLPLPKCMPPTRHPLDPDKSNRALGFPALIIGLCQLFGVPVAPSKVIRPPITRAFIEKYFMQRQAQGGGLQTPNALPPPPQADPTGSFDTKRYLWHLVHQQAANHRAHVQTHDSLYQLSLSLKSQGFASFPCPTPDQFRAEVAWPGDWPEAHAAEAPGEPDEAREDEEMSDLLGFLGGSGAT

SEQ ID NO: 150702 - protein, 69 aa, Glycine max
  Coding DNA Sequence Number=SeqID_59017
MSQNLTNCATIPSLTSGMLRKCTDRATMFPFDFRHVAELHGLPNDGCQVSQRGHAKVTSQQIDGPRTKL

SEQ ID NO: 150703 - protein, 65 aa, Glycine max
  Coding DNA Sequence Number=SeqID_59018
  Subcellular localization annotation: CTP_CleavageSite=39; ConfidenceScore=5.57e-01
MASSSSLTLSQSLHTPVFSLRLRVKGGALSEFTLAQRLCAAHPSSRFFCALSQRMVRLADGSPST

SEQ ID NO: 150704 - protein, 146 aa, Glycine max
  Coding DNA Sequence Number=SeqID_59019
QMFSKKEGMMRIMKLVKYRLKAQVEKDEGPSGEGQSPRVEKDEGPEAETLSRLLIVAEGPSSHHLQENCYSLHGFPEKVAKVAQTEKSESKFSDKEYQEYLKLKSEKSSSQASPSSVPCYSTACISQSIDGSSPWILDSGASDHIS

SEQ ID NO: 150705 - protein, 78 aa, Glycine max
  Coding DNA Sequence Number=SeqID_59020
MTEIVCAKDDVNLRVSTGLLAAIDKGMTEIVCAEDDVNLCVSTGLLAAIDKGCRRRRQYDRNYGAADKSEALAPMYPQ

SEQ ID NO: 150706 - protein, 192 aa, Glycine max
  Coding DNA Sequence Number=SeqID_59021
  Subcellular localization annotation: CTP_CleavageSite=33; ConfidenceScore=5.18e-01
MDMNVGALISGQITSIAQSNSSRLGFPTLITALCKARGVNSDSLVFERLSPVINLAYIRKNCWNPYDLTISIRGARRARTRPAEPPSTSTAPIPALEQFTELVAWPGTQSSLRREDEGPTAQVSQHVEDDSSEATIPEPFVRGMEAEETQEAAATLERSLEVASESPAQGEDIPSPQPATDPSTLVLDLSED

SEQ ID NO: 150707 - protein, 147 aa, Glycine max
  Coding DNA Sequence Number=SeqID_59022
MGAYPSENVNNSTPILIESQQPQSNHAHVSQPMGETHEIPHHNLADFEPCLGYATEGQVVGGIPLQNTLEGPQFHPQPQPFYGKMVGYTPSSFADLVFIGERIKVVLERGKYVHPALMNAKTGANEEDENEGETIAMSAIPTRSNFP

SEQ ID NO: 150708 - protein, 64 aa, Glycine max
  Coding DNA Sequence Number=SeqID_59023
THLLLEVASPLSLPFSIPLPFIFQEAKESIDEEDPRPTSSNGACIMRQDQFQDSPLSVLRCHEA

SEQ ID NO: 150709 - protein, 92 aa, Glycine max
  Coding DNA Sequence Number=SeqID_59024
MSGHRVRHRGSCSFTSALDFYLALYSNSSILGQEQLQYSRAGCQDIVSDIVDPATSILHLTFYLALCIVQPDLIPCHNVGHYVQQLQLSFIV

SEQ ID NO: 150710 - protein, 210 aa, Glycine max
  Coding DNA Sequence Number=SeqID_59025
MAKFDPKVVLEFYANAWPTEEGVRDMCSWVRDQWIPFDTDALSQFLGDPLVLGEGQQCEFSQRRNMADGFDEEDFTRTAARRRVQIMRTSMTTLTQTWMTLLLSNVLPSDHNSDLPLPKCQLVYAILTRMSVHVAQVIADAIYLFGGMSPTKHPLDPNKFNRALGFPALITGLCQSFGVPVTPTKVIRPLITRAFIEKYCTPRQAQGDAP

SEQ ID NO: 150711 - protein, 91 aa, Glycine max
  Coding DNA Sequence Number=SeqID_59026
  Homolog annotation: Hit_ID=A5AVU1; Match level="QueryCoverage=72%, HitCoverage=4%, E-value=1e-12, Identity=50%"; Hit description =Putative uncharacterized protein
MKPEMSLKMKEEVKKQFDTGFLSVAQSLEWVANIILIPKKDGKLQSYKDGTRGYGNDNLHHTMGNLLLQGDVIWAKERWGNVPMSHGGIIP

SEQ ID NO: 150712 - protein, 94 aa, Glycine max
  Coding DNA Sequence Number=SeqID_59027
PLWDALYCVATCPSRASEGEAHGCTFQRRKDARSRHQRLFVENVGKTEGNRSKMKILSSGVVFTLEEGISTSHVDKSGAFAPTYPPSKRKSDLR

SEQ ID NO: 150713 - protein, 109 aa, Glycine max
  Coding DNA Sequence Number=SeqID_59028
  Subcellular localization annotation: CTP_CleavageSite=38; ConfidenceScore=5.19e-01
MPISPCGSISWSGRSRHSDRAHKTPSGPGEVQQGPGVSSSGYGPVSVLQGARTPRQGIAPAGHPVDPKKSKRILGFPALITGLSQFYGVPVTPSKVIRPPSNRAFIKKN

SEQ ID NO: 150714 - protein, 175 aa, Glycine max
  Coding DNA Sequence Number=SeqID_59029
MCVDYRDRLNRPVPRRAANFPYSHDKSISSVITRQLSLYFPSWTVSPATPDKDAPRGSTGKAYYRSSPMMGDRLFKVMSFGLKKPASLSRDGAQDPNPSKKHLVKIAEVLAQQVLRRLSIKGPMPSVPLGSNSRRTHCLGFIVREKGDRGTEKGRPSSEMPNLVLRGKSEASWDA

SEQ ID NO: 150715 - protein, 213 aa, Glycine max
  Coding DNA Sequence Number=SeqID_59030
  Gene Ontology: Mol. function=motor activity; Cellular component=cell projection
  Homolog annotation: Hit_ID=UPI00006A2D9E; Match level="QueryCoverage =97%, HitCoverage=92%, E-value=8e-16, Identity=15%"; Hit description =UPI00006A2D9E related cluster
LHVLAFRGLHVLPFRGLHVLAIGGLHVLTFKGLHVLALRGLHAIAFRGLHVLPFRGLHVFAIRGLHIVTIRGLHTLTFRGLHVLAFRGLHALAFRGLHALAFRGLHALAFRGLHVLAFRGLHILAFRGLHALAFRGPHVLTFRGLRALTFRGVHVVALRGLHAIAFSRTAWLHIVTIRGLHALTFRGLHVLAFRGLHVLPFRGLHVLAIGGLH

SEQ ID NO: 150716 - protein, 302 aa, Glycine max
  Coding DNA Sequence Number=SeqID_59031
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPPPEHSLPGALPRHPFRTSFTEPNCMNIFDKNADAAASDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150717 - protein, 125 aa, Glycine max
  Coding DNA Sequence Number=SeqID_59032
MPPGHPPWYLQVALGSYHFGKGGWKTFPGVTTANWLAMRDGKRSSYVIEGWGEFLKWPRREVPYGVGISTGRVVFGVITWGASLWVGALGCTGAELEAIPGVSREARVMLRSYLMGIHEVAFVGV

SEQ ID NO: 150718 - protein, 341 aa, Glycine max
  Coding DNA Sequence Number=SeqID_59033
  Homolog annotation: Hit_ID=Q2HW90; Match level="QueryCoverage=92%, HitCoverage=61%, E-value=1e-40, Identity=34%"; Hit description =Putative uncharacterized protein
MGTNQNGKRFYQVKVKSLDVSGLKELGRLMGPLQRQAFRKVYGKILDLTVAEVFTEAVVSLAQYYDQPLRCFTFGDFQMVPTIEEFEEILGCPLGGRRLYLFSGFLPSLSKIAAVVGGSARELDRMKQTRNGVVGLPRKYLEGKARDMASQEKWGPFVDILALLIFGVVLFPNVDGLVDLATIDAFLAYHHSKESPVVAILADLFDTFDRRCEKNSARIVCCLPALCVWLVSHLFQQDTRHPCPLQSYRSCAEKGRVDWDQHLAGIRGNAINWFPHWKEGKEGVLFLCGDYPNVPLIGTRGCINYNPALAIRQLGYPMRGAPTEESLSPFLVRDLGAQSLK

SEQ ID NO: 150719 - protein, 31 aa, Glycine max
  Coding DNA Sequence Number=SeqID_59034
MVPSKDGPWRQWPAAAVVEDVPFCFFDDSSI

SEQ ID NO: 150720 - protein, 85 aa, Glycine max
  Coding DNA Sequence Number=SeqID_59035
MELQCLNQNEETDKRKRSIALQASSSMQEEEEKEESDNEEDFSLFVKKFHKFIKNRRMERSHNFNNGNRSQEVSPTLKCYKCNQP

SEQ ID NO: 150721 - protein, 144 aa, Glycine max
  Coding DNA Sequence Number=SeqID_59036
  Homolog annotation: Hit_ID=O64612; Match level="QueryCoverage=72%, HitCoverage=7%, E-value=6e-07, Identity=33%"; Hit description =Putative reverse transcriptase
MSFILRHAKRNRLLTLDKTTFLNKGSLCPLCSNEAESNAHLFFSCRKSLQVWAHIRDLAPFHRRFTSLQCITNSLIRGRSTSGVQGKFRCLAIAITVYCIWLSRNKLIFEDYQFSVIEVISKIKFLMDNIDAFMSQPHSSLDRD

SEQ ID NO: 150722 - protein, 474 aa, Glycine max
  Coding DNA Sequence Number=SeqID_59037
  Homolog annotation: Hit_ID=Q2HW90; Match level="QueryCoverage=44%, HitCoverage=40%, E-value=3e-25, Identity=36%"; Hit description =Putative uncharacterized protein
MASQEKWGPFADVLALLIFGVVLFPNVDGLVDLAAIDAFLAYHHSKESPVVAILADLFDTFDRRCEKNSARIVCCLPALCVWLISHLFRQDTRHLCPLQSYRSCTEKGRVVWDQHLAGIGGSTIDWFPRWKEGKEGVLFSCGDYPNVPLIGTRGCINYNPALAIRQLGYPMRGAPTEESLSPFLVRDLGAQGLKVIQRIHKAWRSPLRKDKELRGIRNGVIGGYHGWLRIHTRGLGWLSKLKVVDEEKFEAPEEDEEVRALKLELGKARLAKEKFKSAATHIRKECTELQEENAATARALEQETKRARKEEHGREKFRGALWGSNNDLKLRREERDRSRVHGMILKEELVACARSKRSLAQHLEATEQSMLAIIGQYKEELNQSMAHEQKLVEDFAQVYAEKEARGRVIDALHQEATMWMDRFALTLNGSQDLPRLSAKAKAMAEVCTAPEEIHGLINYCQHMIDLMAHIIRNR

SEQ ID NO: 150723 - protein, 112 aa, Glycine max
  Coding DNA Sequence Number=SeqID_59038
APVAIMFLSAVPSCSATDGVVRNGTKLPAGHTKCKAWGAKTVSSEVLHVADVEKSCTGVSRICEYGLLWELSPPLPALELTPTRRHCGIRGIMALQGSEFPGRIYCEDYLTG

SEQ ID NO: 150724 - protein, 65 aa, Glycine max
  Coding DNA Sequence Number=SeqID_59039
MESPTAATYPSTGERHEAHGCVFHGRKMRGVATNVYSRKTSEKPERCSLRTLSVKGSGVVFTNGE

SEQ ID NO: 150725 - protein, 80 aa, Glycine max
  Coding DNA Sequence Number=SeqID_59040
MGEMLATQLAQASKVTSSRSNRLLEESSGGPKWAWLLFAPPFLLNTPPAFFGEPCGLHNHPLFYLRNVTEPHELCNDASF

SEQ ID NO: 150726 - protein, 264 aa, Glycine max
  Coding DNA Sequence Number=SeqID_59041
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150727 - protein, 189 aa, Glycine max
  Coding DNA Sequence Number=SeqID_59042
  Gene Ontology: Mol. function=helicase activity; Biological process =viral genome replication
  Homolog annotation: Hit_ID=Q9LTU4; Match level="QueryCoverage=99%, HitCoverage=13%, E-value=1e-60, Identity=55%"; Hit description =Helicase-like protein
MDRLYFDGIAICSHVGFPNLFITFTCNPNWPEIHKLLTPLNLTPIDRPEIISRIFKLKYEQMLSYITKNHLLGKVVGYMYTVEFQKRGLPHVHLLLFLHANNKYPSPNDIDHIISTEIPSQKDDPELYKLVQNHMVHGPCGILRPASPCMKEGKCSRFYPKKFRATTIIDGDGYPVYRRKNTGRTITKN

SEQ ID NO: 150728 - protein, 216 aa, Glycine max
  Coding DNA Sequence Number=SeqID_59043
MASRKLASKRSRKDKAAEGTSSAPEYDSHRFRSAEHQQCYEAIKGWSFLRERRVQLRDDEYTDFQEEIVRRRWASLVTPMAKLDPDIVLEFYANAWPTEEGVRDMRTWVRGQWIPFDADALSQFLGYPLVLEEGHECEYGQRRNRSDGFNEEAIVQLLCIPGQDFARTAAGRWVRIMRTNMTTLTQIWMTLLVSNIQPSDHNSDLPYRSVSWCTPS

SEQ ID NO: 150729 - protein, 82 aa, Glycine max
  Coding DNA Sequence Number=SeqID_59044
LDSRERVYPVQVIEVTSSEEDPEEDLEELPSEPAVDALDFLEGDEDPLLEVDSPEEVMSASKADSTEDSGPGEMAISGGSSS

SEQ ID NO: 150730 - protein, 55 aa, Glycine max
  Coding DNA Sequence Number=SeqID_59045
MEGSQQNAHYPKEKLSKIITHKWKFGNLLEVPNTLPLKGLFVTKLESNEKDIKAS

SEQ ID NO: 150731 - protein, 113 aa, Glycine max
  Coding DNA Sequence Number=SeqID_59046
  Homolog annotation: Hit_ID=Q1SN17; Match level="QueryCoverage=66%, HitCoverage=21%, E-value=3e-11, Identity=38%"; Hit description =Transposase, putative
GQYKYRKKEFVRRDTDTRKCGCPFKLREKPVHGGEGDDTEMQHLMRLLERDQYIHWHRLKDEVVVHSTYKTNRYRLRLLDFVGVTPTGMTFSAGFAYMEGERVNNLVWALERF

SEQ ID NO: 150732 - protein, 182 aa, Glycine max
  Coding DNA Sequence Number=SeqID_59047
  Homolog annotation: Hit_ID=Q6WAY3; Match level="QueryCoverage=41%, HitCoverage=3%, E-value=6e-07, Identity=43%"; Hit description =Gag/pol polyprotein
MNFAARKPIEFTPIPVSHADLLPYLLDNSMVAITPTKVHQLPFFREYNSNAMCACHGEAPGHSIEHCRGLKRKVQGLIDAGWLKFEENRVIFNFHRNWVQAIGLFAQATCAPEFGLPRPFNRRLLVLHVGGASVKQQESSTTRDPRSLNPFSEIRREEEISLKRDGLYNEDQSKFLIKYASG

SEQ ID NO: 150733 - protein, 261 aa, Glycine max
  Coding DNA Sequence Number=SeqID_59048
  Gene Ontology: Mol. function=motor activity; Cellular component=cell projection
  Homolog annotation: Hit_ID=UPI00016621D1; Match level="QueryCoverage =50%, HitCoverage=40%, E-value=2e-13, Identity=37%"; Hit description =UPI00016621D1 related cluster
GLHVLAIRGLHALTFRWLHALAFVGLHALTFRGLHVLIFRGLHVLTFRGLHVLAFRGLHVLSFRGLHVLAIRGLHVFSFRGLHVLTFRGLHVLTFRGLHALAFVGLHALTFRGLHILTFKGLHVLTFRGQHVLALTFWRTTCPHLQRTTRPRLQRTTGLRALTFQRITSPHLQRTTRPRLQRTITSLALIQRDTCPELQRTTRHPLIWRRANYASTTRGGGYHAATVHTGARFHPCHCKETSAYHAHQHDNSYTDMDDVAT

SEQ ID NO: 150734 - protein, 114 aa, Glycine max
  Coding DNA Sequence Number=SeqID_59049
MGNNTNGGWEWKLSWRRALFGSEIQMADNFLGELSQQQIQPNREDRCSWKHDQTGYYSTKSGYDLIWEAQMGANQNLDFVDIWKLKIPNVEEEPAHLEIWRQTLEHILISGPPT

SEQ ID NO: 150735 - protein, 94 aa, Glycine max
  Coding DNA Sequence Number=SeqID_59050
MVKLMCGIHNHELAKSLVGYPYAGRLTKAEKTLIADMTKSMGTLVDCPSEQQFDECLKKFERPLEENEHVIGSMTKNVSQIVRLIVKECIDCIP

SEQ ID NO: 150736 - protein, 217 aa, Glycine max
  Coding DNA Sequence Number=SeqID_59051
  Gene Ontology: Mol. function=triacylglycerol lipase activity; Cellular component=chloroplast stroma; Biological process=lipid metabolic process
  Homolog annotation: Hit_ID=A7PUL5; Match level="QueryCoverage=57%, HitCoverage=24%, E-value=3e-43, Identity=69%"; Hit description =Chromosome chr7 scaffold_31, whole genome shotgun sequence
  Pfam annotation: Domain name=Lipase_3; Domain location=14-164; Score =125.5; E_value=1.6e-34; Accession=PF01764.16; Description=Lipase (class 3)
AQYANRLSPRVGRFINAAGTTGFPTGKRAVSATQLMKVKVEAGFLDLYTDREPGCGYCKYSAREQVLGEVKRLMEKYADEEVSVTIAGHSLGSAMAILSAFDIVETGVNVGKDGRKAHVSVFSFSGPRVGNVRFKERLEGELGIKVLRVHNAHDMVPQSPGRPAGMQAWHWPSFYNVVTGKTLALPNLIALQHIPLSPAGVIAKRPAPIALPNSCAA

SEQ ID NO: 150737 - protein, 206 aa, Glycine max
  Coding DNA Sequence Number=SeqID_59052
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPRFLAVSCRTDDDPDGAWQHGNEANCGTGMQAWHWPSFYNVVTGKTLALPNLIALQHIPLSPAGVIAKRPAPIALPNSCAA

SEQ ID NO: 150738 - protein, 168 aa, Glycine max
  Coding DNA Sequence Number=SeqID_59053
  Gene Ontology: Mol. function=5'-nucleotidase activity; Cellular component=cytoplasm
  Homolog annotation: Hit_ID=Q1H096; Match level="QueryCoverage=97%, HitCoverage=66%, E-value=1e-62, Identity=68%"; Hit description=5' -nucleotidase surE
  Pfam annotation: Domain name=SurE; Domain location=1-105; Score=26.7; E_value=8.3e-12; Accession=PF01975.8; Description=Survival protein SurE
MPDMVISGINDGANMGDDTIYSGTVAAATEGYLLGIPSFAVSMSQHQPSHFETAAHIIVDLVRQYNHSEFTEPTLLNINVPDLPLQAIKGRQITRLGKRHKAEPVIQLQTPRGETVYWVGAAGQPNDGGEGTDFHAVAQGYVSISPIQVDLTKHSQIATMQQWLQSKN

SEQ ID NO: 150739 - protein, 90 aa, Glycine max
  Coding DNA Sequence Number=SeqID_59054
MAAQLIHDRVVMECLEVHLEQPARTLQQPVEWILPTPTPYRLVEPVQVIEVSSSEEDLEEDPEELPPEPAMDALDLPEDDEDPLPDVDSP

SEQ ID NO: 150740 - protein, 104 aa, Glycine max
  Coding DNA Sequence Number=SeqID_59055
MEENHTMILKSLGVTICNQIGHIKANYPSNEEWSEISDKKRFDERRTKKAYIAWDDNDSSDGSEKEINLLTQDYESDETSLKEEKQGEKHDPHLENLDTLILKK

SEQ ID NO: 150741 - protein, 135 aa, Glycine max
  Coding DNA Sequence Number=SeqID_59056
  Homolog annotation: Hit_ID=A5AWL4; Match level="QueryCoverage=52%, HitCoverage=10%, E-value=5e-08, Identity=40%"; Hit description =Putative uncharacterized protein
MSLATLFGKLQEHEMELIRLNQHEENDRKKKGISLKASSSNQEESDKENSIEIDEDDDLSLFVKRFNKFLRKSEKKNFSEKKAKKAYITRDDNDLESSENSENEVINLSLMAKSYESDEEMHLLICIENQSNLQN

SEQ ID NO: 150742 - protein, 40 aa, Glycine max
  Coding DNA Sequence Number=SeqID_59057
MWTLRKIGEMLAAQLAQASSARPGEPGCFLQKQQPSGGIF

SEQ ID NO: 150743 - protein, 79 aa, Glycine max
  Coding DNA Sequence Number=SeqID_59058
MEIEFHSPAPPLESFIFMTYLPCPPLQASPAPALFSRFQKKELIDESPGLTPPLTDFTGLNFQFCYSTRGLSLTSYSSL

SEQ ID NO: 150744 - protein, 84 aa, Glycine max
  Coding DNA Sequence Number=SeqID_59059
MAGAGDNGGVYHQLDGSQRLLLEAMTTQMQRLLNRNNEELYRRIERLEHQMNSNARRPYGGNKRVNDESNRIEGQDRIEGVKLN

SEQ ID NO: 150745 - protein, 257 aa, Glycine max
  Coding DNA Sequence Number=SeqID_59060
  Homolog annotation: Hit_ID=Q6WAY4; Match level="QueryCoverage=83%, HitCoverage=38%, E-value=4e-27, Identity=36%"; Hit description =Putative uncharacterized protein
MGTNQNGKRFYQVKVKGLDVTSLKELGRLMGPLQRQAFRKVYGKILDLTVAEVFTEAVVSLAQYYDQPLRCFTFGDFQMVPTIEEFEEILGCPLGGRKPYLFSSFLPSLSKVATVIGDSAKELDRMKQIRNSVVGLPRKYLEGKARDMASQEKWGPFADVLALLIFGVVLFPNVDGLVDLAAIDAFLAYHHSKESPVVAILADLFDTFDRRCEKNSAWIVCCLPALCVWLISHLFRQDTRHPCPLQSYRSCAEKGIL

SEQ ID NO: 150746 - protein, 87 aa, Glycine max
  Coding DNA Sequence Number=SeqID_59061
MWSCLRREIFAIRPLGPSRFFLQKAVASGGSNLARLGELGGKLLPYFAIDRGRSEEGRGSAFLALLILSKLLRIIVSVKKIQAEALS

SEQ ID NO: 150747 - protein, 152 aa, Glycine max
  Coding DNA Sequence Number=SeqID_59062
  Homolog annotation: Hit_ID=Q9KHC4; Match level="QueryCoverage=32%, HitCoverage=10%, E-value=2e-10, Identity=71%"; Hit description=SocE
DAGSRQARQGAFSGCWRLSGLAELCGIRADCTESAPYAAPFAIQAAQLLGRAIGAGLFAITPAGERGMCCKAIKLGNARVFPVTTFRETCRASCINESANARGEAVCVLGALPLPRSLTRCARSFGCGEAVSAHSKAVIRLSTESGDNAGKN

SEQ ID NO: 150748 - protein, 52 aa, Glycine max
  Coding DNA Sequence Number=SeqID_59063
MLQPYGINIGLKEHSNPVTPKAYTPKTPSGPLPPDLDIAHELYNTHDLTLVF

SEQ ID NO: 150749 - protein, 102 aa, Glycine max
  Coding DNA Sequence Number=SeqID_59064
  Gene Ontology: Mol. function=RNA-directed DNA polymerase activity; Biological process=RNA-dependent DNA replication
  Homolog annotation: Hit_ID=A5BMW4; Match level="QueryCoverage=91%, HitCoverage=18%, E-value=2e-11, Identity=41%"; Hit description =Putative uncharacterized protein
MRDTVEFLPYRDLDDLVQLCIRVEQQLKRKPTSKSYGSHSYPKKDQDSGSCCNYCSTRFVSKFFLAISPHPKPYKLQWLNEQGEMIVNQQVKVPFSLLHWNI

SEQ ID NO: 150750 - protein, 164 aa, Glycine max
  Coding DNA Sequence Number=SeqID_59065
MTKYFNSICLAALEYLSFSEKNNVAELSQYIFSSIAVATYPSAGGRRETRGMRVPRKEYARSRHQRLFEENVGKTGKDAIYELFMKGSGVVFTHGEGISTPHVRPKGRQPLIECANMTLIFTFPFMSLYPLYPFYIFLFFVVDRGCFPLLLRIPQFGDEKIRPT

SEQ ID NO: 150751 - protein, 318 aa, Glycine max
  Coding DNA Sequence Number=SeqID_59066
  Gene Ontology: Mol. function=oxidoreductase activity, acting on single donors with incorporation of molecular oxygen, incorporation of two atoms of oxygen; Cellular component=integral to membrane; Biological process=electron transport
  Homolog annotation: Hit_ID=Q7VU29; Match level="QueryCoverage=17%, HitCoverage=17%, E-value=5e-17, Identity=70%"; Hit description =Putative uncharacterized protein
FVLGGNQAFVHEAAHGVQQQGQGFGVQGHDVSLSGVRGGGAQGRMPPTTHHPVQHRQHGAAGGGHVQRPERAFGHALRDQVAQALLVAVAQPGGVLALGQRHAGIADQHGDELGVVLLEIAGVADHEGAQAGGAALGARHVLADALVQAAQHRQDDGVVDVLLGGEVVIDGGLGHANGGGQVRHRTAVVAAAREQLGGFGQDPFARRRQVAMREPGEAASRQAMPDRGRSRSIDSGSALAAHPFPPCKRGLGAQPETTRDAVMPHSLVTDLYGQMSLPVISAPMFIVSNPKLVVAQCTSGIVGSFPALNARPQSLGIL

SEQ ID NO: 150752 - protein, 96 aa, Glycine max
  Coding DNA Sequence Number=SeqID_59067
  Homolog annotation: Hit_ID=Q9SJS1; Match level="QueryCoverage=58%, HitCoverage=7%, E-value=1e-07, Identity=51%"; Hit description =Putative Athila retroelement ORF1 protein
MDGEPARRVTLEDFSNTATPQFFTSIARPEVQAANISYPYFLIQLIQGNLFHGLPSEDPYAHLASYIEICNTVKIAGVPEDAERQNDGCTLSKATT

SEQ ID NO: 150753 - protein, 69 aa, Glycine max
  Coding DNA Sequence Number=SeqID_59068
MDHFKCLKESMTMLTKLSYPIREFVFTFEDGISTSHVCPKGQILKREIRMMDMTKSKGKDPLEGLGGPI

SEQ ID NO: 150754 - protein, 80 aa, Glycine max
  Coding DNA Sequence Number=SeqID_59069
VPLYCQEVKKTKFHQKVYPEDMINQSNGHLKARRAAFPLLENKNGSPYKLGGKEKAQARGTKQWVPDLVFLQAKASSLNP

SEQ ID NO: 150755 - protein, 70 aa, Glycine max
  Coding DNA Sequence Number=SeqID_59070
MFLHGKMPRKWVFRPYLASTYQTPLIHGEGMMQSYSARALDRRLQEDWARDAREDLRILMSLRIDFGPMG

SEQ ID NO: 150756 - protein, 20 aa, Glycine max
  Coding DNA Sequence Number=SeqID_59071
VFDRSSTFFIRSSSFFSLQR

SEQ ID NO: 150757 - protein, 54 aa, Glycine max
  Coding DNA Sequence Number=SeqID_59072
MSHHSPKRIKVIPEWSTPPSVEGRSPEYEKPRDLRSNPFQGGGDDAILPPKGIG

SEQ ID NO: 150758 - protein, 70 aa, Glycine max
  Coding DNA Sequence Number=SeqID_59073
MWHLNESFMQLCMILKTSRQNKSSTVSQPTLQREGDARLMGASSKKGKCAESPPKFIRGKRRKNRKGCGL

SEQ ID NO: 150759 - protein, 153 aa, Glycine max
  Coding DNA Sequence Number=SeqID_59074
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPATAASTKVRQ

SEQ ID NO: 150760 - protein, 102 aa, Glycine max
  Coding DNA Sequence Number=SeqID_59075
  Homolog annotation: Hit_ID=Q51617; Match level="QueryCoverage=45%, HitCoverage=66%, E-value=1e-15, Identity=91%"; Hit description =Putative uncharacterized protein
MVMAALHNSSYCHAIRKMLFCDCIYQGYCLMSGYIFECVSRGPFVSRVSVMTVKTSDTCSSRRRSQLVCKRMPGADKPVRARQRVLAGVGAGLTMRHQSRLY

SEQ ID NO: 150761 - protein, 52 aa, Glycine max
  Coding DNA Sequence Number=SeqID_59076
MGTNQNGKRFYQVKVKGLDVTSLKELGRLMGPLQRQAFCKVYQKILDLTAAE

SEQ ID NO: 150762 - protein, 82 aa, Glycine max
  Coding DNA Sequence Number=SeqID_59077
DLVQKALNEGRLKFGEKPKVAQANAETSKAAETLYAEPQEIMMVEAMELSQVQVQGISEEDYNEQMKVVYPQAEEDLIDFLN

SEQ ID NO: 150763 - protein, 223 aa, Glycine max
  Coding DNA Sequence Number=SeqID_59078
  Homolog annotation: Hit_ID=A6FJQ2; Match level="QueryCoverage=17%, HitCoverage=84%, E-value=6e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIHLLRDCYIENKREYISCGSVQVEGTSTWLFKENKGGYIPCGSLACKGFYKVERNLKNHKLLGDWIRETCRASCINESANARGEAVCVLGALPLPRSLTRCARSFGCGERYQLTQRRLIRLSTESGDNAGKN

SEQ ID NO: 150764 - protein, 214 aa, Glycine max
  Coding DNA Sequence Number=SeqID_59079
  Homolog annotation: Hit_ID=A2Q5X7; Match level="QueryCoverage=98%, HitCoverage=25%, E-value=1e-14, Identity=26%"; Hit description =Ovarian tumour, otubain, putative
MAEIETISKRFEELDVCGKFTLKTKLWEIAYPDQNSMCPPPVKVNTKGAPKKPMSRNPRLTKHDPSYWEYVDAFESMQNRNSSVRQSTSSSEQPNRRTMMPMLDQFQPFMHNFIDKIVDVKADEDYTQLFGGTKRFEELRMSLHVDGLTKVTTDKWMDITDMGHVIASRYNVIVVSLSKQQSMTFFPLRSESLTYSSLHRIICISHVYDNHFVE

SEQ ID NO: 150765 - protein, 20 aa, Glycine max
  Coding DNA Sequence Number=SeqID_59080
MALRFKSKVMEGVTVVTPAS

SEQ ID NO: 150766 - protein, 194 aa, Glycine max
  Coding DNA Sequence Number=SeqID_59081
  Homolog annotation: Hit_ID=A5AF98; Match level="QueryCoverage=55%, HitCoverage=33%, E-value=1e-08, Identity=32%"; Hit description =Putative uncharacterized protein
MKDKKDEEEKLEKQKKKKDSKALSSKAKGKEKEEKDSSKKIVKKENHFATKGDIKRALLLKKYFYLLLSWETSLSTAIPLELEVIPQVKELLDEGLVHKSLNPCALLVPKIGIIRHQSPMIGGMMNLLSGATLFCKITHAPNIFMICVHMDSLGSDQGLPMDPKRIKVILEWPTPPSIKEIWGFNILTNFYKRC

SEQ ID NO: 150767 - protein, 141 aa, Glycine max
  Coding DNA Sequence Number=SeqID_59082
  Gene Ontology: Cellular component=integral to membrane
  Homolog annotation: Hit_ID=A7QJI3; Match level="QueryCoverage=95%, HitCoverage=33%, E-value=6e-34, Identity=46%"; Hit description =Chromosome chr8 scaffold_106, whole genome shotgun sequence
MESRITQSTSGEQGSVQEHLHGELPTGQCSFLQTVFNATNVMTGVGILSTPYALKEAGWMSMIILYTELYSCCVELITLEGDNLTVLFPGTSLDLGSFKLDFVHLFGILAALIIILTVWLKDLRIISILSAGGVFATLLGQ

SEQ ID NO: 150768 - protein, 175 aa, Glycine max
  Coding DNA Sequence Number=SeqID_59083
MWVFHIGRQIDWAHLVRYRMHKALRLNAPLPYPHLVTLFLQHFDIPLDSEPYVPIKRSFLIGAAVIASFGYRKEHDGSWLERIPLFFKEFWAGSMVFKPLLVKGLMLWSYKWTCDSMRWIQGSPRVAIIKKGEIVEASFMLMNQVDSSSFDDNKDDDKKPKRMISRLIQQVQDQD

SEQ ID NO: 150769 - protein, 244 aa, Glycine max
  Coding DNA Sequence Number=SeqID_59084
MIMRGQDICSSQEETTSSLSSSGSEDEVRGEESKGSLEINLVTYVNPKERTSLNLTIIPHPKPYKLQWLNEQGEMIVNQQVKAKGKEKKENDSSKQNVKKENNFATKGDIKRALLLKQSFYLFLSRETSLSTFIPLELEVIPQVKELLDEGLVRKSLTSCALLVPKIGIMRHRIPMIGGMMNVLNGATLFWKITDASNIFMIHMHRDSLAVEGRSQELQESLDLRSNPFQGGGNDAILPPKDIG

SEQ ID NO: 150770 - protein, 162 aa, Glycine max
  Coding DNA Sequence Number=SeqID_59085
MDQYIKDIGNFVQKEQETLLEALERLQEIIRSFSHHGFSPQRLVHIFYGGVSSHNWTSLDATCEGNLILKPLTNDLKCRSKDFDFDVLMMPYDCDVLIPYENALLKFNSRQKSKNTRYNIKKISSDLGRELQIEIAKGLAKKFKLKCLFQEIYSLVIDYQRM

SEQ ID NO: 150771 - protein, 51 aa, Glycine max
  Coding DNA Sequence Number=SeqID_59086
MREIPKELHCQMRQIKGKRKIKDKIVVVIIKKGKNVNHEDFDDIKKNLFEK

SEQ ID NO: 150772 - protein, 91 aa, Glycine max
  Coding DNA Sequence Number=SeqID_59087
  Gene Ontology: Mol. function=transferase activity
  Homolog annotation: Hit_ID=Q4A3R5; Match level="QueryCoverage=93%, HitCoverage=75%, E-value=3e-09, Identity=43%"; Hit description =Capsule O-acetyl transferase
MMTTKDDEQKAQVNQRTSQENQEQVKSSRIKKNSRLKKKAYKQVSRFKIQDLKNQDQDSRIKNQDSRSQESRSRIKTQDLRMKKRFNQDKY

SEQ ID NO: 150773 - protein, 25 aa, Glycine max
  Coding DNA Sequence Number=SeqID_59088
MDICLRVIGDPMNGVQRGWGSQPTL

SEQ ID NO: 150774 - protein, 143 aa, Glycine max
  Coding DNA Sequence Number=SeqID_59089
MNLYGTTEVKVEDFSNEPPQLSQINLEETYNEDMVKEEEGINAFPSYVASQYLDVVENGKGKRPKYEHDDDPITCLEPSWVEETVDVVISKMSRCPKPRYVSCQINSLGCPLTCIPYHSGVTIFVNQCSPTSKFSLPPSYDPN

SEQ ID NO: 150775 - protein, 62 aa, Glycine max
  Coding DNA Sequence Number=SeqID_59090
MVASSSTKKKKNLFPQPPLNDNEEEENENDWKKKQKAYEEEQKKTAGTRSKNAGKVGERVSR

SEQ ID NO: 150776 - protein, 88 aa, Glycine max
  Coding DNA Sequence Number=SeqID_59091
MAVQTKQERRSKDDDENREKKQKTKGNNETKTTIQSTGISPAAKVPTGEIEQNEARDHEKKEGRKKERMGKRRKEEQEIGGKCERMRE

SEQ ID NO: 150777 - protein, 108 aa, Glycine max
  Coding DNA Sequence Number=SeqID_59092
  Subcellular localization annotation: CTP_CleavageSite=24; ConfidenceScore=5.06e-01
MIDPSVSLTSKSFTPPPPREGHVRGVMAVVVAIICKKLINTLSKESSRLFATFCKTNSNVDLKNLAESAVLRAIRGGVVVLQRRGEDAKRSVGGTKREGFVVVVGKVK

SEQ ID NO: 150778 - protein, 126 aa, Glycine max
  Coding DNA Sequence Number=SeqID_59093
  Subcellular localization annotation: CTP_CleavageSite=32; ConfidenceScore=5.01e-01
MQKQNTGKGRQTTTSSWQRRVMGLGLTRDGVVGQIVSRSLKLMVWLILKCFTHKSFIPMKCFLNRWAQKRFEFPSKAKMMLSGAISGRTHTFFLHTPNPCSPMVLDLKVERVQKNLYGTDIPVAHI

SEQ ID NO: 150779 - protein, 97 aa, Glycine max
  Coding DNA Sequence Number=SeqID_59094
  Homolog annotation: Hit_ID=A6FJQ2; Match level="QueryCoverage=39%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVDSRGSPHENPRAFSCIFGPIFLESSIQCPWGGWIKLLTARGKILIT

SEQ ID NO: 150780 - protein, 61 aa, Glycine max
  Coding DNA Sequence Number=SeqID_59095
YILCGTSRGYIYLGIVILRTREGTSLVDQFKWRINGSGMEKEEREETPLQGEDESRKSSPP

SEQ ID NO: 150781 - protein, 313 aa, Glycine max
  Coding DNA Sequence Number=SeqID_59096
  Gene Ontology: Mol. function=nucleic acid binding
  Homolog annotation: Hit_ID=Q3I6J5; Match level="QueryCoverage=28%, HitCoverage=42%, E-value=4e-10, Identity=33%"; Hit description=Gag
  Pfam annotation: Domain name=Retrotrans_gag; Domain location=89-210; Score=36.3; E_value=1.1e-07; Accession=PF03732.8; Description =Retrotransposon gag protein
MTLFHSPPPSHKLSNPTTQVPKNVVIVDAKARACSGPGAIDGHNGEESLITVIMETEEEVDSNEIIPFNMSFSKRVIEIQGASVVIMCHMFPLSLKSITLKWFQSLPLRSINLWLNLREKFRSSFATNKERPKTVVDVRLIRQGPDESLKEYISRFNKEARSVGNIQTRCSVDAGKGCAAYIPVGQLHLMPIGFKMKSNMVSEQALTLGPLIRFRCDKHPPFVVHAPSPISAGREGGVLGKYPSLTSTASILGALTLGPLIRFRCNKHPPFVVHAPSPISAGREGGVLGKYLSPTSAASILGVQLIYLLGNFT

SEQ ID NO: 150782 - protein, 236 aa, Glycine max
  Coding DNA Sequence Number=SeqID_59097
MGDCLEEMICDLGQESFQQAQARMYDTLQSDSKKPLYSGKTIGVNVEDDDSTLESCLTLFSKKMSRNVNGEEEVDDILANRNDHDEGELINIVHMVTPPSSPPPPPESATPSSSSSSKKTRKATQLRSLATRPIEVKRTVVHVDPVTRKVDGERWRQIKLNLTSKWALTHSKEGEDDKVYEKYEIRKEIVASFVRAIEILHGRNKKLVEEKQKKRLEEVTQFGSTDTVIDPPPPIR

SEQ ID NO: 150783 - protein, 144 aa, Glycine max
  Coding DNA Sequence Number=SeqID_59098
MWDNNVGGCHIEWPDIDGQICSQGRIKDVVNKIGDSIPSKSILQTVDEDPSHNRSWVNHRRSPSPLSLFLLPTIVTRKRCFRGTILSRPTKLPSKKLKVVDLKDDSRPTRTCLVPTNKLSGPPMWMSSGLEIDCIIMSEDWEAF

SEQ ID NO: 150784 - protein, 117 aa, Glycine max
  Coding DNA Sequence Number=SeqID_59099
MTSDHLGFDFDLVKGLANQSGDAPFLPCGTSYSRTSSLRADHGFDEPLETVNLGFDKPKAGLGYDKPFLPSCVLAFPLGDLSLLHLKLATLGRQAERLKAKPWYCIFLMLRAWWSLP

SEQ ID NO: 150785 - protein, 159 aa, Glycine max
  Coding DNA Sequence Number=SeqID_59100
  Homolog annotation: Hit_ID=UPI00006A2D9E; Match level="QueryCoverage =64%, HitCoverage=81%, E-value=6e-09, Identity=16%"; Hit description =UPI00006A2D9E related cluster
MKGPLDESISCFLIRVEPWVLVPIAFRGLHVLDFKGLDVLNFRGLDRDTRPRLKGLHVLTFRGLHVLAFRGLHVLTLRGLHVLTFRGLNVIAFRGLHTLAVRGLHALAFRGLHVLAFRGLHVLTFRGLHALTVRGLHALAFRGLHILAFRGLHILTFRG

SEQ ID NO: 150786 - protein, 136 aa, Glycine max
  Coding DNA Sequence Number=SeqID_59101
MIANFMVSKVLIDQETSYFSLIGRKTLNELGAIISTPYLKMKFPTLTGEIVTVKLSKPNLSLGDSSQLMSVDEGFPIQILAFYEASMADQDDVLNVDLRDDTVEKGPEPIKGLVKLQLGPKPEQYTQLSSELTTHE

SEQ ID NO: 150787 - protein, 255 aa, Glycine max
  Coding DNA Sequence Number=SeqID_59102
  Homolog annotation: Hit_ID=A2Q454; Match level="QueryCoverage=78%, HitCoverage=98%, E-value=2e-32, Identity=37%"; Hit description =Retrotransposon gag protein
  Pfam annotation: Domain name=Retrotrans_gag; Domain location=113-202; Score=13.5; E_value=0.0026; Accession=PF03732.8; Description =Retrotransposon gag protein
MPPRKNIASGEPAAKKHGDMRVEFVAGEEVADNQTRLLNLMSTFSKGFEEEGKGKSGGNPRLKPVEGDDLTKFCQLMKKIELPSFYGDDPAEWIARAKIYFNVQEMREAVRVSLAQLCMEGVMIHFFHSLLNEYENLSWEDLKREMLESYGGRGEGSVYDQLASLKQSGSMEDYIRSFECLIAQGLKDEIRARMRILHVVNPLSRGRMMNIARAIDVEISGQSKVWQGRGEICGDGRAQPGNRPISSILGKTGPR

SEQ ID NO: 150788 - protein, 224 aa, Glycine max
  Coding DNA Sequence Number=SeqID_59103
  Gene Ontology: Mol. function=nucleic acid binding; Cellular component= nucleus; Biological process=regulation of transcription, DNA-dependent
  Homolog annotation: Hit_ID=A9P7X7; Match level="QueryCoverage=49%, HitCoverage=30%, E-value=6e-23, Identity=54%"; Hit description =Putative uncharacterized protein
  Pfam annotation: Domain name=DUF822; Domain location=5-176; Score =170.4; E_value=4.7e-48; Accession=PF05687.4; Description=Plant protein of unknown function (DUF822)
MTGGGSMGRLPTWKERENNKRRERRQRAIAAKIYTGLRAQGNYKLLKHCDNNEVVKALCAEVGWIVEEDGTTYQKVQLPLNFSDLLSVTGCKRPSASEIEGTTTNISCLLSFVSTFLCVPVMLEYKIMSFYISCLLVRQSFLHNDPKNFANVGGDVSTTMIITPGPVVDFLISNQNVRDPFSLDWAKALKSSNYGSEPMLHNCEISISPNFTEVEGRVLQAPRW

SEQ ID NO: 150789 - protein, 202 aa, Glycine max
  Coding DNA Sequence Number=SeqID_59104
  Gene Ontology: Mol. function=transferase activity, transferring phosphorus-containing groups; Cellular component=intracellular; Biological process=peptidyl-histidine phosphorylation
  Homolog annotation: Hit_ID=A0MP01; Match level="QueryCoverage=54%, HitCoverage=30%, E-value=1e-49, Identity=90%"; Hit description =Mitochondrial pyruvate dehydrogenase E1alpha-kinase 3
  Pfam annotation: Domain name=HATPase_c; Domain location=32-188; Score= 37.3; E_value=5.4e-08; Accession=PF02518.17; Description=Histidine kinase-, DNA gyrase B-, and HSP90-like ATPase
MWQGMLVRMHVLCVIVNMAVPQMFAFTGILILLFPHLHLMVFELVKNSLRAVQERFMDSDEVAPPIRIIIADGIEDVTIKVSDEGGGIPRSGLPRIFTYLYSTAGISLSVEHELSDIGTMENVTMAGYGYGLPICRLYARVMLGPMTRCRALNWIPQAALAEYYAQRSTPGGFLISEGTLISPTAPGYFTYLFPLLFFSTIS

SEQ ID NO: 150790 - protein, 788 aa, Glycine max
  Coding DNA Sequence Number=SeqID_59105
  Gene Ontology: Mol. function=oxidoreductase activity; Biological process=aromatic compound metabolic process
  Homolog annotation: Hit_ID=A7P5K6; Match level="QueryCoverage=42%, HitCoverage=68%, E-value=9e-66, Identity=43%"; Hit description =Chromosome chr4 scaffold_6, whole genome shotgun sequence
  Pfam annotation: Domain name=DUF1723; Domain location=499-543; Score =29.8; E_value=9.8e-06; Accession=PF08330.1; Description=Protein of unknown function (DUF1723)
MAFLVLSRAPPPIALLGFPNVREKEKGLKPPFCTAFNHATNSEKKVTFTLTKDESFYFIAAHWVDLHGLLYNALPSNVFLWGHLFLSFHFADDKGPVIVKAKVLETNKVVGIVGDLLVAADGVLEFSNVENSKTITGIRKVYPDDKGPVIVKAKVLETNKVVGIVGDLLVAADGVLEFSNVENSKTITGIIKVYPDLEKCLYFDLASSTHTVLYELQNKKPEPKVKGTSVTMKVNSDVIQKMHQEAEKVWIPELFLKSRSRTCDSSLTSMILFKKMFELAEHRSGADVGEYIELHPPIRRTVVAAYHAVEVLADAEGDVAHPTTPHCFRNTNMSILDAAVLGKCIEKWVAEKLESALEEYQFIRLPVTSKQVLHARHLGRALRMSPLIFAAFAAEPTASARRQREVAAVVKHAPHVGDAAKEVFQHVEEVIDDAEGFPSEPRDLSMLTAYTDHVAVIVWNGELSSHGKKVQKFGRFAAKIEGLVVVTRLTLLIACSLDTGDWGLISTFVKRWHKETSNFHLPVGEVTITLDDLLKVSKDEARAETVQYHGTYIRLSCLREIYDSKCEAKHWIVAARAYLLHLLGVVALVHMYNNLNDACKSGDQQLAGYITLLQSFPSIVDTFTDPDYDERCLTVTTVQFDLISCFSGHIRWGPIVVIHRPKRVVQKFRYAQTIPPHSLGSRLSFEDIDNRLMHFSEYLAPGSAQTFTCMQDETYVEPYMLEFPVAASSMEEAPTHAPSDVEQPRHAAACQAIAQRLEHLLNLRIVTEGKEAYDVYVRSRRRRHTDHA

SEQ ID NO: 150791 - protein, 110 aa, Glycine max
  Coding DNA Sequence Number=SeqID_59106
MEVTILQKLGQKMDRVTSLLHLLPNTFRTVDVLVTSSFTLTKMSWTIKEHALRRPYLTRARVRVMAEVDGGARADKGRHGGHVRENGHNDGGHDEHEEDNGSQCGYNCRY

SEQ ID NO: 150792 - protein, 132 aa, Glycine max
  Coding DNA Sequence Number=SeqID_59107
  Subcellular localization annotation: CTP_CleavageSite=64; ConfidenceScore=5.78e-01
MATPPSSPPPPPPPTKATSQSSSTLKRKRKATRLRSLATRPAGADRPVVHVDPTTGKTEFDIPEASDVRTKKKILQIVGERWRQFKSDLTSKWALAVDKDSVDDIVCEKYGISKEKWAQFCQSRRDPSWEDV

SEQ ID NO: 150793 - protein, 1425 aa, Glycine max
  Coding DNA Sequence Number=SeqID_59108
  Gene Ontology: Mol. function=nucleoside-triphosphatase activity; Cellular component=integral to membrane; Biological process=transport
  Homolog annotation: Hit_ID=A7P5L1; Match level="QueryCoverage=91%, HitCoverage=97%, E-value=0.0, Identity=66%"; Hit description =Chromosome chr4 scaffold_6, whole genome shotgun sequence
  Pfam annotation: Domain name=ABC2_membrane; Domain location=1109 -1281; Score=90.7; E_value=4.5e-24; Accession=PF01061.15; Description= ABC-2 type transporter
  Pfam annotation: Domain name=ABC2_membrane; Domain location=513-699; Score=128.3; E_value=2.3e-35; Accession=PF01061.15; Description=ABC -2 type transporter
  Pfam annotation: Domain name=ABC_tran; Domain location=176-411; Score= 56.9; E_value=7.1e-14; Accession=PF00005.18; Description=ABC transporter
  Pfam annotation: Domain name=ABC_tran; Domain location=874-1064; Score=104.5; E_value=3.2e-28; Accession=PF00005.18; Description=ABC transporter
  Pfam annotation: Domain name=PDR_assoc; Domain location=704-748; Score=41.7; E_value=2.7e-09; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1109 -1281::513-699::176-411::874-1064::704-748
MEGRNISRVDSARASGSNIWRNNNMDVFSTSEREDDEDALKWAAIERLPTYLRIQRSILNNEDGKGREVDIKQLGLTERKILLERLVKIAEEDNERFLLKLRERMDRVGLDIPTIEVRFEHINVEAQVYVGGRALPSMLNFFANVLEGFLNYLHIIPSPKKPLRILQNISGIIKPRRMTLLLGPPGSGKTTLLLALAGKLGKDLKHSGRVTYNGHELEEFVPQRTSAYISQYDNHIGEMTVRETLAFSARCQGVGQNYALNQSFELLHFTEILAELLRREKQAKIKPDPDIDSYMKAAALGRQRTSVVTDYILKILGLEVCADIMVGDGMIRGISGGQKKRVTTGEMLVGPIKVLFMDEISTGLDSSTTFQIINSIRQSIHILNGTALVSLLQPAPETYELFDDIILLTDGQIVYQGPRENVLEFFESMGFKCPERKGVADFLQEVTSKKDQWQYWVRKDEPYSFVTVKDFAEAFQLFHIGQNLGEELASPFDRSKSHPNVLTTKKYGVNKKELLRACASREFLLMKRNSFVYIFKVTQLIYLAIITTTLFLRTKMHRDTVEDGGAYMGALFFAVTVAMFNGISELNMAIMKLPVFYKQRDLLFYPAWAYSLPPWILKIPITLIEVAIWEGISYYAIGFDPTFGRDVIVANTAGSFALLIVLVLGGFVISRENVHKWFLWGYWSSPLMYGQNAIAVNEFLGHSWRKVTPNSNETLGVLILKTRGFFPEAYWYWIGVGALIAENFTWISFPTTDLLGSSAAFRKDQASGLSQEKLLERNASTAEELIQLPKGNSSSETNIVEEANIPSRSFSGRISDDKASGSGRRGMVLPFQPLSLTFDEMKYSVDMPQEMKKQGVFEERLELLKGVSGVFRPGVLTALMGVSGAGKTTLMDVLAGRKTGGYIEGSITISGYPKRQETFARISGYCEQFDIHSPNVTVYESLLYSAWLRLPREVDRATRKMFIEEVMELVELNSIREALVGLPGENGLSTEQRKRLTIAVELVANPSIIFMDEPTSGLDARAAAIVMRTVRNTVNTGRTVVCTIHQPSIDIFDAFDELLLLKLGGEQIYAGPLGRHCSHLIQYFEAIQGVPKIKEGYNPATWMLEVTSAGTEASIKVNFTNVYRNSELYGSKEQDLFNAMGSMYAAVTFIGVQNGASVQPIIAVERTVFYRERAAGMYSALPYALAQALMYGIIVYAMMGFDWTTSKFLWYLFFMYFTFLYYTFYGMMTMAITPNAHVAAILSSAFYAIWSLFSGFVIPLSWYYWICPVAWTLNGLVASQYGDNRDKLENGQRVEEFVKSYFGFEHDFLGPSSSPFHPQDLSSFFATCDCLLRPVTTISSSPSLLLGFTTAIGVRDCREVEHPPLESDINARYVMQAPLELVGLGSSSSMDSFASWKMNGSGMEKEEGEETPLQGEDESRRSSPP

SEQ ID NO: 150794 - protein, 134 aa, Glycine max
  Coding DNA Sequence Number=SeqID_59109
  Subcellular localization annotation: CTP_CleavageSite=49; ConfidenceScore=5.04e-01
MASKKRKAPSTPTQATFDRFRWPDQEPNLSPSGRCGASAAQEPASKEPAAAAAEGEDELSPTEPFYFDAGIHMAQEEDASIDQTPEPSPVPIPNDATPFAPAPELEQPIFQDSPAAQVLDLNEHAQEQTQEQDI

SEQ ID NO: 150795 - protein, 68 aa, Glycine max
  Coding DNA Sequence Number=SeqID_59110
MGCMTGPFLGRIASNRPRFLKVDMEEGRHSLGCHQSSDLAMVYLRWANVYPTLNGNGPSMVNKGHLKV

SEQ ID NO: 150796 - protein, 99 aa, Glycine max
  Coding DNA Sequence Number=SeqID_59111
MYPLDFRIVIIKKGEIVEAMTSKIILMMPKNQELSKFQRIRSQKASRIKFQRIKIHEQSSFKIQSSFKNQDSRTIKIKIQESREDSIKISTKKVFQNIE

SEQ ID NO: 150797 - protein, 143 aa, Glycine max
  Coding DNA Sequence Number=SeqID_59112
MEEMFRFRNEVCQAGQNCNKHKANTKVNLHKSNKSHMPDKRQPLPKGPKYKRYTPLTANRTTILEEAFNLGVPIWLPQTKPFRPWSDTTKCCRYHRDTKQSPSKSKTRRTSRGATQEPGSKHKKNRRPRQTKTLGIVVSQPTS

SEQ ID NO: 150798 - protein, 112 aa, Glycine max
  Coding DNA Sequence Number=SeqID_59113
MASSYMQERMNIMTPLHRLDKTLGKHVLGLSLDKPKVTLGKPSSLLNSISIVTQGLSKTQDLPLVSKPKVCPWYKNLRSTLDTYFHKNPSTPVVLSHAATTTTTVKGPSSTK

SEQ ID NO: 150799 - protein, 164 aa, Glycine max
  Coding DNA Sequence Number=SeqID_59114
MWYHSSGNSLSMSTRHSYLGKLGSKYRGHHIVHRKHPSMVINLSLKISIIVTAPSRTYITYIVTMTFLASPTSHLNVFRISLVENIVFLENQHTQGQSYILIIGFLDPNYAASNGGSWWALVVVGGEEEGVRVWILLNKLVSLNRSSLLALNVTVCAQCNFLLG

SEQ ID NO: 150800 - protein, 109 aa, Glycine max
  Coding DNA Sequence Number=SeqID_59115
MDGPQTKLGYDTGAVTSFGYRKDQNGQWLKKDAFPPQDERTPSPPPQRDDSALMTEVLSKLRGLRTYVGEHFNSLDTRFAGMDIRLTQLEEDVGYIRQSCDLPPPPPPS

SEQ ID NO: 150801 - protein, 104 aa, Glycine max
  Coding DNA Sequence Number=SeqID_59116
  Subcellular localization annotation: CTP_CleavageSite=47; ConfidenceScore=5.56e-01
MQRLTLSSAPFCQPRASKPVDTQRLTSSSTPLSSRDGESDEMRRYPSDSKSGSMQRLTSSSTPIVNQKQASPLTRRDLRHLLHLSSRDGESDDMRRYPSGYPYK

SEQ ID NO: 150802 - protein, 142 aa, Glycine max
  Coding DNA Sequence Number=SeqID_59117
MKADMKAMKDQMAAMMEAMLSMKKIMESNATAVATTSVATEGDLTHPSGLNQVNPPISDMVGRGGEALGSTSSPYVGQSKNSFPPYNLPPNYTSSNVAHTPNENVNNSTPILIESQQPQSDHAHVSQPVGEAHGAPQDHNLS

SEQ ID NO: 150803 - protein, 100 aa, Glycine max
  Coding DNA Sequence Number=SeqID_59118
MTTNGRHEPSLLVAGPSHGEKCFNQSDILRIHLKDSVEDNIPILSFIVFLRSHWRGQNFKMTSLCSRTRNSRSPLCFDRELCVWTNECERERSLSNIERS

SEQ ID NO: 150804 - protein, 145 aa, Glycine max
  Coding DNA Sequence Number=SeqID_59119
  Gene Ontology: Mol. function=prephenate dehydrogenase (NADP+) activity; Cellular component=monolayer-surrounded lipid storage body; Biological process=tyrosine biosynthetic process
  Homolog annotation: Hit_ID=A7PGN4; Match level="QueryCoverage=57%, HitCoverage=52%, E-value=4e-33, Identity=75%"; Hit description =Chromosome chr17 scaffold_16, whole genome shotgun sequence
  Pfam annotation: Domain name=Oleosin; Domain location=40-134; Score =0.6; E_value=0.00016; Accession=PF01277.8; Description=Oleosin
MVEMSCAEHDWHAAGSQFITHTTGRFLEKLELERTPIDTKGYETLLSLVENTAGDSFDLYYVWVPAGTLVFIVTAGFLSVCGFGVALVAALSWMYRYFRGLHPPGSDRVDYARTRIYDTASHVKDYARDYRGYLQSKVKDAAPGA

SEQ ID NO: 150805 - protein, 60 aa, Glycine max
  Coding DNA Sequence Number=SeqID_59120
MPKDRGTCLDFRDCHHQKGRDCRQMIKLNVLMMPKVHMRLKALFKTKKLKIFKMDDQDSL

SEQ ID NO: 150806 - protein, 100 aa, Glycine max
  Coding DNA Sequence Number=SeqID_59121
MATIALSSRYGSKLAYDTGIWGESYRLFAAKFISWLVFWFVPKVVFIIGSAVDRLCGLRMAFVDNWVVGKEEEWQSQHGFLPLSHPLHLPQFSHSSKQDD

SEQ ID NO: 150807 - protein, 96 aa, Glycine max
  Coding DNA Sequence Number=SeqID_59122
  Homolog annotation: Hit_ID=A5BKB8; Match level="QueryCoverage=71%, HitCoverage=19%, E-value=1e-28, Identity=89%"; Hit description =Putative uncharacterized protein
MAIWYSLEFCRLIDFLKDPMFSRQRILKEAPERVRAPSCPDPVAPRGAVGESGCLGIQPQSGGKFRPRLNTGERPIANKYHEGKMKRTLKGESKSA

SEQ ID NO: 150808 - protein, 61 aa, Glycine max
  Coding DNA Sequence Number=SeqID_59123
MPNIVNLMCFNFNYSEAYALSESHALSEVLSPLSELGEFGGESEKHMRAQLAQRGVGLFMF

SEQ ID NO: 150809 - protein, 106 aa, Glycine max
  Coding DNA Sequence Number=SeqID_59124
  Gene Ontology: Mol. function=protein dimerization activity; Biological process=DNA integration
  Homolog annotation: Hit_ID=A3B418; Match level="QueryCoverage=59%, HitCoverage=9%, E-value=8e-13, Identity=57%"; Hit description =Putative uncharacterized protein
VPVGRPSLFPPLWLIHGVNAPILQERNKMAPHRAEDLVFVHSNLRLLSRNTPQYHQEETKMWDVAGDDFGSLDDCGILEIVSLSLDEPELEGVFFNDDDHLGDERP

SEQ ID NO: 150810 - protein, 168 aa, Glycine max
  Coding DNA Sequence Number=SeqID_59125
IAPTRHPVDPEESNRALGVPAPLARSCHRDIRVAPIRHQVDPEKSNKALGFPALITGLCHSYRVPVPPTRSCHHDIGIAPARHPVDPKKSDRVLGFPALITDLCQFYGVPVAPSKFIRPPINQAFIKKYCAPRQAQGETSQQPRDGRQRATNALPLPLEFTSTHPQKG

SEQ ID NO: 150811 - protein, 153 aa, Glycine max
  Coding DNA Sequence Number=SeqID_59126
  Pfam annotation: Domain name=G-patch; Domain location=20-64; Score =33.4; E_value=8e-07; Accession=PF01585.14; Description=G-patch domain
KHCLRRFLLWATLPVRYSSDGGPGARVMLGKGYELGMGLGRNNDGRTSLISTRGNHGKFGLGYKPMQADIRKSVAGRKSGSQGSQLGQKVEGGPPCHISRSFISEGLGHKGQVVVICEDDSPSGSDLVRPCPPGFRLGNWRVEQCPDIYETSI

SEQ ID NO: 150812 - protein, 147 aa, Glycine max
  Coding DNA Sequence Number=SeqID_59127
  Subcellular localization annotation: CTP_CleavageSite=14; ConfidenceScore=5.02e-01
HAFVKWWSQFDTSKAAPDQVKNWFQSNPEFLKPADPETSLVLNQKSQLAAFLASSKSKESLAQNLKEVLQLLQQEVEEEPSKKEAESSETNDDQEDDSFYQNEDDCFVLVLLCEAPFQIVPESDLPCPVTDPVRLCRRFGFFVFENL

SEQ ID NO: 150813 - protein, 229 aa, Glycine max
  Coding DNA Sequence Number=SeqID_59128
  Gene Ontology: Mol. function=protein serine/threonine kinase activity; Cellular component=beta-catenin destruction complex; Biological process=protein amino acid phosphorylation
  Homolog annotation: Hit_ID=Q53VM1; Match level="QueryCoverage=36%, HitCoverage=17%, E-value=3e-38, Identity=89%"; Hit description =Ser/Thr protein kinase
MTVKTSDTCSSRRRSQLVCKRMPGADKPVRARQRMRKEKIPHQAPFAIQAAQLLGRAIGAGLFAITPAGERGMCCKAIKLGNARVFPVTTLLVDYLFAYCNILYSFQAKCLETGESVAIKKVLQDRRYKNRELQVMRTVDHPNVVKLKHYFFSTTDKDELYLNLVLEYVPETVYKVSKHYVRMHQHMPMYRARIRNHVGKPVVPAALMNRPTRGERRFAYWALFRFLAH

SEQ ID NO: 150814 - protein, 84 aa, Glycine max
  Coding DNA Sequence Number=SeqID_59129
MTGPLNESISCFLIRVDPWVLVPSPSEDYRSLPLEGCTPSPSEDYRSSPLEDHTSLPSEDCMSSPIEVYMSSPSEDYTSSPSEG

SEQ ID NO: 150815 - protein, 182 aa, Glycine max
  Coding DNA Sequence Number=SeqID_59130
  Gene Ontology: Mol. function=RNA binding; Cellular component =cytoplasm; Biological process=translation
  Homolog annotation: Hit_ID=A8ANH5; Match level="QueryCoverage=43%, HitCoverage=77%, E-value=7e-32, Identity=83%"; Hit description =Putative uncharacterized protein
  Pfam annotation: Domain name=DinI; Domain location=117-180; Score =90.3; E_value=6.1e-24; Accession=PF06183.4; Description=DinI-like family
RELESLYGRINREGFTVVALSLYWKNAWCKVKVGVAKGKKQHDKRTDLKEREWQLDKARIMKNAGRSEIWYTQFNTIGADSGFDGICETQAPTVYPTSKKESDMYVELVYDKRNVQGLAGAQKIILTELTRRVHRIFPDAEVKVKPMQTNALNSDCTKTEKERLNRMLEEMFEESDMWLVEE

SEQ ID NO: 150816 - protein, 58 aa, Glycine max
  Coding DNA Sequence Number=SeqID_59131
MLQSIHQGQILRLQTLQVVALPRFILSVEQFIEKLSWLGTLPSIVRKGEDPSAQVPQQ

SEQ ID NO: 150817 - protein, 100 aa, Glycine max
  Coding DNA Sequence Number=SeqID_59132
MEADMEAMKEQMAAMMEVMMSVKKIMEANAVAIAATSVVAKVNPTSPSGINQMNHPTSDMVSRDLGSTDGPHDVQIRNKHAFPPYGLPLKYTPANVAYTP

SEQ ID NO: 150818 - protein, 56 aa, Glycine max
  Coding DNA Sequence Number=SeqID_59133
MAPKTCSASDKCTGSHNLILMKHHPQIPLVRLNSTRTALRHTYSTNLSHPNSLVKA

SEQ ID NO: 150819 - protein, 194 aa, Glycine max
  Coding DNA Sequence Number=SeqID_59134
VVEPTKPAHRPDHHVDDPLYLMTLTIPQLFLKPLQVMWDATVFGVFNDNFSLYIKHEDLFEIAHDVNVSTSLLYNYGFCKHMTETSMQARNVDVYGFLKPRSIQRSEQSQFESESYIKNWMQNSKRDVYLGAYLNGAHWQMVVILPKENVVIWFCSLHNRPDNYLKGIINSALKGFDDTPQSKSETAAKWIVVK

SEQ ID NO: 150820 - protein, 261 aa, Glycine max
  Coding DNA Sequence Number=SeqID_59135
PMLGRSLDSCGSRISSSLLGCTLFANKSATNVHVVYLEALRDLSMTERYAWGVAALVDCDEEDREEHSHAVVQGVPVPTPDSGCLLDPLWRASGGPGLPHQIMLFRSLALGPVAVYYRPERVVRQFGYTQTIPAPPIDSWVSYDNIHNRWMHYEDHIVPAGEVCVVSGACFSDYIDWFFRISHPFMTPGHTLDPLPHGHAPQPRVVPQAPQTDIPHVPEPGASSTSAEEPRHAVEVCDDIAKRSECHLSLGVVTPGSSTHE

SEQ ID NO: 150821 - protein, 70 aa, Glycine max
  Coding DNA Sequence Number=SeqID_59136
EDETEPEEKRKREDETEHVGRGGAEEEEVVVVVEGRGKGGRKGKREKGKKGREGWGGERRDKGEEEGVVG

SEQ ID NO: 150822 - protein, 41 aa, Glycine max
  Coding DNA Sequence Number=SeqID_59137
MADSPRSHSNTHQKERNIANKQENSKIKSDMLSDKRKITGN

SEQ ID NO: 150823 - protein, 75 aa, Glycine max
  Coding DNA Sequence Number=SeqID_59138
MRHSSELESGGHMNENAIHGAPKKGENGGLLEGPHLGNHETQLQTRKWRTHERKRNSWGSEKGLAGPNSPPGFST

SEQ ID NO: 150824 - protein, 105 aa, Glycine max
  Coding DNA Sequence Number=SeqID_59139
MASCIRKWAWMRVSEEESSATRCCIVDCRLMTALRYCLASWRVLLNRGAVWSEGEISSHLEMMARAVSMFSSISESEKVLVGEEEGGEGDVLKKNRPSQGPQQNE

SEQ ID NO: 150825 - protein, 164 aa, Glycine max
  Coding DNA Sequence Number=SeqID_59140
  Homolog annotation: Hit_ID=A6FJQ2; Match level="QueryCoverage=23%, HitCoverage=84%, E-value=3e-11, Identity=92%"; Hit description=50S ribosomal protein L5
MTVIRLTHAAPGDGHSLSVSGCREQTSPSGRVSGCCRMRKEKIPHQAPFAIQAAQLLGRAIGAGLFAITPAGERGMCCKAINLGNARVFPVTTLSENVNIVLDGLPDEFESLITLVSGKFESLSVDEVATLLLAHETRLSCKKALTLINLTKADKSSFSLILLN

SEQ ID NO: 150826 - protein, 158 aa, Glycine max
  Coding DNA Sequence Number=SeqID_59141
LPSPLRGLHVLALRGLRRLTIRGLHALTIRGLHVLTIRGLHALTIRGLHVLALRGLHALILVTLTVERTTRQRAARPRLERTTCPHLQRTTRPRLERATRPHLGGLHVLALRGLHALTLGTSYPHCQRATRPHLERTTRPRQQRAARPHLQRATRPRL

SEQ ID NO: 150827 - protein, 185 aa, Glycine max
  Coding DNA Sequence Number=SeqID_59142
LGFPTLITALCRARGVVSESLTFERLSPVINLTYIRKNCWNLEDLIVSIRGARRARARPAELPSTSAASTPAAPCVPAQTDSHLQVVAPPGSIPSVEQFREMVAWPGTQPSLHRQVRDTEPPAPVVDLPSPQHIANPSTLILEIPEDPTTPVLAMDTSPPATPVFHLTDEEDVKTQDTLDQSQEF

SEQ ID NO: 150828 - protein, 186 aa, Glycine max
  Coding DNA Sequence Number=SeqID_59143
  Pfam annotation: Domain name=Transposase_23; Domain location=31-99; Score=-1.4; E_value=0.0017; Accession=PF03017.5; Description =TNP1ENSPM transposase
MQSQGLAPPPDPLVGPFGPRVSTKGSCVDPSGNDPETVTLTDLARLVAMGRVYEGSPVVHNTPLLPGQVKVSVEEVTDANAPVPVPTDEVSLVGQALHTFLAWPTHLVAVSPAKPPPKPDPEVDDPLYLMKLTIPELFLRPYQVRWDATVFEVFNLDFSLYIKHEDLSEIAHDGQRLNISVLQLWI

SEQ ID NO: 150829 - protein, 30 aa, Glycine max
  Coding DNA Sequence Number=SeqID_59144
GQTQLSVVRCQDEVGGRNPSRYLGMDASRG

SEQ ID NO: 150830 - protein, 28 aa, Glycine max
  Coding DNA Sequence Number=SeqID_59145
MCIQKEEGEMGVNYFKSFWVGTIVIEIN

SEQ ID NO: 150831 - protein, 53 aa, Glycine max
  Coding DNA Sequence Number=SeqID_59146
MTKARQKGVRKEKREELATQLTQASSARPDELGCFLQKAVPPSGGIPERPKWA

SEQ ID NO: 150832 - protein, 69 aa, Glycine max
  Coding DNA Sequence Number=SeqID_59147
  Subcellular localization annotation: CTP_CleavageSite=34; ConfidenceScore=5.24e-01
MGIASRSFYINGAFMFKLESVATYPSAGGRRVTRGMRVPRKEYARSRHQRLFEENVGKTGKDAIYELLS

SEQ ID NO: 150833 - protein, 18 aa, Glycine max
  Coding DNA Sequence Number=SeqID_59148
MPTNRRPSPKPKDTPSCS

SEQ ID NO: 150834 - protein, 50 aa, Glycine max
  Coding DNA Sequence Number=SeqID_59149
MAVRLLPAAGHPQAAVALRRTDRDSYLELANSKTPVGLLRVHRCLAGTSP

SEQ ID NO: 150835 - protein, 46 aa, Glycine max
  Coding DNA Sequence Number=SeqID_59150
MNKGKEPLEGLGGPMARARTKKAKEALQQLQVEKLRIVNCTMFQEE

SEQ ID NO: 150836 - protein, 83 aa, Glycine max
  Coding DNA Sequence Number=SeqID_59151
MVSPQGRNTWKVDDLVPYMEKIMILSEEQERITELASHGLARQFPAQEFHILQSSVETQDIGRRREAVEAEEYSQQMAERGHG

SEQ ID NO: 150837 - protein, 143 aa, Glycine max
  Coding DNA Sequence Number=SeqID_59152
DLIEAQRSNLHRSPRSKLPSERCNLHKRLTNLADGTIDVALVKEFYANLYSSEDPSPKQTRVRGHLEGETLPTYSRYCRFPIDHREIEVALCIPGRGFIMNAEGYPGRILRKDLTTLAQVWSVLSYSNLAPTSHTSDLTVDRA

SEQ ID NO: 150838 - protein, 137 aa, Glycine max
  Coding DNA Sequence Number=SeqID_59153
MIGKWVCFYVGLVLLKRHPSGFYQTLDLVFKGQALFGGVARGFPMVCAGCVRVIPLWERRLVDPSKRYHSHLAGNEGWQEVFVRHWDRGECWPRGKISYRVGTGAKVGIAGRASWGWSRSLGGLPLDGCRRPSLYGC

SEQ ID NO: 150839 - protein, 63 aa, Glycine max
  Coding DNA Sequence Number=SeqID_59154
MDFLHRIFEEDSEDSVAIKVFLLVWGSNDKQRRLTAVTGGLGWWKIRLVALSRSPLLALSTRI

SEQ ID NO: 150840 - protein, 247 aa, Glycine max
  Coding DNA Sequence Number=SeqID_59155
  Gene Ontology: Mol. function=structural molecule activity; Cellular component=mitochondrion; Biological process=iron-sulfur cluster assembly
  Homolog annotation: Hit_ID=Q7WFC7; Match level="QueryCoverage=42%, HitCoverage=85%, E-value=4e-50, Identity=95%"; Hit description =Putative iron-binding protein erpA
  Pfam annotation: Domain name=Fe-S_biosyn; Domain location=18-107; Score=118.3; E_value=2.3e-32; Accession=PF01521.11; Description=Iron- sulphur cluster biosynthesis
MNAVTETVDLQAAPPAPLVFTDSAAAKVKDLLAEEGNPELKLRVFVQGGGCSGFQYGFTFDEVVNEDDTVLDKAGVQLLVDPMSFQYLVGAEIDYKEDLEGAHGVAPRWRRATPARPQKKPFGFPRGFLSCGRRASGGIQGAQDARATRTGDAGQAGGAARQEGLGQPGERQRLHLLRRDAQRVGGMHRALQAIRQLTHQSGVAGAAAADIEFAHVRAGASMALATVRAVRRCRVACTSCGAGLGPS

SEQ ID NO: 150841 - protein, 91 aa, Glycine max
  Coding DNA Sequence Number=SeqID_59156
SIFVMLVRGTEPMENASNAAFIRFLAFCWPFAHMFFPALSPDSVDNRITAFEKRKSAQYANRLSPRVGRFINAAGTTGFPTGKRAVSATQL

SEQ ID NO: 150842 - protein, 375 aa, Glycine max
  Coding DNA Sequence Number=SeqID_59157
  Gene Ontology: Mol. function=transporter activity; Cellular component= integral to membrane; Biological process=transport
  Homolog annotation: Hit_ID=A2WAS8; Match level="QueryCoverage=14%, HitCoverage=13%, E-value=2e-23, Identity=98%"; Hit description=Major facilitator superfamily (MFS_1) transporter
GRQCRLRARAAARRARDHSARPAQHRVVLGGRARRDDRAHADRPLVQEASVDEEEGRGGRPPDAVARPRDGRDRRAGAARAAQIHLFVFLAAVAAGTLIGGPVGDRIGRKYVIWVSILGVAPFTMLLPYANLFWTSVSDRDHRRRAGVGVRRDPRLCDGADARQARGRDEHHVRLQGVLVPAADRRADGVPAEPRKQPAQEGMTKRPRRRRRRMQRQEPLEDAGRIAARDRRQEVRERLRRMIVGRIGNRAHQRERHVVLGAHLCDCRAFHLDRERIRQRLAQRDDFVLARHEAVAADDQPAMQRRAGQTETLGELLALFRDEQRARGLQASRECRVGREPRDAEQRHFVARKQRRRVEIVLQQHIGHDDVAEPH

SEQ ID NO: 150843 - protein, 94 aa, Glycine max
  Coding DNA Sequence Number=SeqID_59158
  Pfam annotation: Domain name=G-patch; Domain location=1-42; Score =7.4; E_value=0.024; Accession=PF01585.14; Description=G-patch domain
MAARVMLGNGYEPGMGLGKNNGSKTSLVSTRGNRGNFELGYKPTQADIRKSVVERKSRGQGSQLGQQVEGAPPCHISRTFITKTRGSSRHDMRG

SEQ ID NO: 150844 - protein, 69 aa, Glycine max
  Coding DNA Sequence Number=SeqID_59159
MKKKKKNMILEKGRSGKAVDKGVEVPYPVVPSKKEKDRHLARFFDIFRKLEITMPFGEALQQMPLYSNF

SEQ ID NO: 150845 - protein, 124 aa, Glycine max
  Coding DNA Sequence Number=SeqID_59160
MKLFFHTHETSQCIPTEENTQEIHFMGNQQRQGYTQGGFLGFQQGPYNQQGQTTKLEETLTQFMQVTMSNHKSTESTLKNLEAVMTRSKRFVEAEDEESVVYKEQMGEKTGAEAKENDVKGKEN

SEQ ID NO: 150846 - protein, 182 aa, Glycine max
  Coding DNA Sequence Number=SeqID_59161
  Homolog annotation: Hit_ID=Q6WAY6; Match level="QueryCoverage=86%, HitCoverage=30%, E-value=3e-18, Identity=33%"; Hit description =Putative uncharacterized protein
MARVAKVVKISVQELDHVPFIDTIALLIFGVVLIPNVEGLVDLAAIDAFLAYHHSKESPTIIILADLYDMPTCPLQGHRLCAKKGKANWEQLLASVAGASINWFPYWKEGRAGVLFSCEGFPNVPLMGTRGCINYNPALALRQLGYPMRGAPLEGSITHFIAWGFSDPNVRVLRGVCKAWDA

SEQ ID NO: 150847 - protein, 144 aa, Glycine max
  Coding DNA Sequence Number=SeqID_59162
MVALKDQVASIMEAMLSMKRMMESNTAAVATTSTATEANPTHPSAINQANQPAPNMVGQGGEGQQPQPVGGAREEPREHAQGDFDPYFIFTVEGLVWGPPSAVEGREILDLIEERLRVVKGFGDYPFADMTKLSLVPDVAQVGA

SEQ ID NO: 150848 - protein, 230 aa, Glycine max
  Coding DNA Sequence Number=SeqID_59163
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=26%, HitCoverage=40%, E-value=2e-23, Identity=87%"; Hit description=LacZ -alpha
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPTATLVSARFPPWRHLPSGCGSARNRGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 150849 - protein, 83 aa, Glycine max
  Coding DNA Sequence Number=SeqID_59164
MRPSPYSYQEELIGANLIGRSVGTKQVAIQATRGINRNTQLQDVQFVVDLMNLDVISLMKSKLHMKLIIWGISPEEISIQVDF

SEQ ID NO: 150850 - protein, 156 aa, Glycine max
  Coding DNA Sequence Number=SeqID_59165
MAKRQLCVLSHQSSKRDNTTAKRVWHPGKGKALLSGLKLNWRILPERNVKIYHTEFDEFKAELERRNLHKRLANLQEESIDVVVVKEFYANLYSLEDQSPKQVRVRGHLIRIDADSLNTFLETPVVLEEGETLPTYSKFTKMKIDPQEFDARLYIP

SEQ ID NO: 150851 - protein, 97 aa, Glycine max
  Coding DNA Sequence Number=SeqID_59166
MQLNIFIDGLRTQSKQLLDAFVGGKIKLKTPMEAMELIENMAASDRAILRDRAYTPTKRSLLELTVQDATLGQNKLLARQIEALTETLSKLPQQLQA

SEQ ID NO: 150852 - protein, 74 aa, Glycine max
  Coding DNA Sequence Number=SeqID_59167
  Subcellular localization annotation: CTP_CleavageSite=32; ConfidenceScore=5.15e-01
MSAFIYSGTSSTSPITLTLAQIFNMVHDILVKVKLEVTGTSTVLNVFGSKQSSDVTQFIFCPNFLQGGYFHTST

SEQ ID NO: 150853 - protein, 117 aa, Glycine max
  Coding DNA Sequence Number=SeqID_59168
MAYYDPLQRHALVPTPNALLGTQWNVPGAIPDMDELLGVDLRHQFSAEADQVEDRRHRGRRNLDRHAQKWKQPYGSSQSISFLILVDFGRPFARIVLGVGISVNEPSEGGIVASFPR

SEQ ID NO: 150854 - protein, 255 aa, Glycine max
  Coding DNA Sequence Number=SeqID_59169
  Homolog annotation: Hit_ID=Q6WAY6; Match level="QueryCoverage=72%, HitCoverage=33%, E-value=2e-09, Identity=28%"; Hit description =Putative uncharacterized protein
MGTRGCISYNPVLAIRQLGYPMRGAPLEDELAPVISRGFNKTNVETLQKVRKAWEVLQKKDKELRGSNNGPIGGYRKWLKAHVQGLDWLPSLRTAKREEVEAPEEDEEVQALRTELKKAQTVKERFKSTALKIRKENAKLRDINIATTKALEQETKRARREDHGRNKFRGALWGSNSELKLRREERDQSRVDSLILKDELKVCSRSKRTYDRLNGLMQSYPARALGRRLQVDWARDPREGPRVLMSLRVDFEPMD

SEQ ID NO: 150855 - protein, 131 aa, Glycine max
  Coding DNA Sequence Number=SeqID_59170
MGTNQTDKRFYQVKVKSLDTTSIKELGRLMEPLQMQAFRKTYGKILELTLAEKTHIFHPGCLPLFEQNCNCGQGFNKRFGPHKTDSERHSGPTTEVPRRQGEGYGQSRRLGPVYGCVSFANFWGRPLSKRG

SEQ ID NO: 150856 - protein, 98 aa, Glycine max
  Coding DNA Sequence Number=SeqID_59171
  Homolog annotation: Hit_ID=UPI0000498F17; Match level="QueryCoverage =47%, HitCoverage=54%, E-value=2e-15, Identity=82%"; Hit description =beta-galactosidase
  Subcellular localization annotation: CTP_CleavageSite=45; ConfidenceScore=5.58e-01
MTGLLPQTVTQPPSHIPMRTALPQLTFALKSGNRVTRMGASRANPCMQAWHWPSFYNVVTGKTLALPNLIALQHIPLSPAGVIAKRPGPNRLSNSCAG

SEQ ID NO: 150857 - protein, 134 aa, Glycine max
  Coding DNA Sequence Number=SeqID_59172
  Gene Ontology: Mol. function=helicase activity; Biological process =protein amino acid phosphorylation
  Homolog annotation: Hit_ID=Q2A9E0; Match level="QueryCoverage=100%, HitCoverage=8%, E-value=5e-26, Identity=46%"; Hit description =Putative uncharacterized protein
  Pfam annotation: Domain name=DUF889; Domain location=34-134; Score= -49.6; E_value=4.1e-08; Accession=PF05970.5; Description=Eukaryotic protein of unknown function (DUF889)
MAHKFCFEALDQSLRDIVRKKPNSHQIFGGKVIVFGGDFCQILPVIPRGNCSDIINATINSSYLWHSCEILTLTKNMHLQSNVESIDQQETAAFAKWILDIGDGIIGDQNDGCAKVQIPSQLLITEYDDPINAI

SEQ ID NO: 150858 - protein, 116 aa, Glycine max
  Coding DNA Sequence Number=SeqID_59173
  Homolog annotation: Hit_ID=A6FJQ2; Match level="QueryCoverage=32%, HitCoverage=84%, E-value=7e-11, Identity=89%"; Hit description=50S ribosomal protein L5
MRCEIPHKMRKEKIPHQAPFAIQAAQLLGRAIGTGLFAITPAGERGMCCKAIKLGNARVFPVTTLGYIYLGLTENKREYISCGSILVEGTSTRLFKENKGGYIPCGSLLVKGFLQG

SEQ ID NO: 150859 - protein, 90 aa, Glycine max
  Coding DNA Sequence Number=SeqID_59174
MSSPLGGDFLFSEGEVVVGCDVIDDSPKALYGDVLGYVSFIQDFYQQSSMRLRAHEQFQKGDSNWGFVELFNDFELALLDNAEELPGLLE

SEQ ID NO: 150860 - protein, 166 aa, Glycine max
  Coding DNA Sequence Number=SeqID_59175
MASYGGELLLDSSSPRSDVSSLSSFSIPLPFIFPEAKEFINEEDPKPTSSNGAYITSHQNHILRASSSLSLEVQAVHLASLTLAQRTCTGHLLPVSSMRSANHASPSGSCAQPEEDDSANCKNQTSPNLLILPEIEMEMLLNTQKWDTKYLLPKFTKSSYNTTKEL

SEQ ID NO: 150861 - protein, 80 aa, Glycine max
  Coding DNA Sequence Number=SeqID_59176
MVAINPTKVPQPPFFQGYNSNATCACDGEAPGHSIEYCMTSKRKVQSLINVAWLKFEENHLLNPNTEKRHHTWGNFESCC

SEQ ID NO: 150862 - protein, 80 aa, Glycine max
  Coding DNA Sequence Number=SeqID_59177
MTQPPPRERTLREMAAPDFTYEILCIQYPDEDVPYVLKTGLIHLLPKFHGLAGLSNMEKSMIDAASGGALGDMTLLKPKI

SEQ ID NO: 150863 - protein, 153 aa, Glycine max
  Coding DNA Sequence Number=SeqID_59178
GLQVLTIRGLHALTSRGLHVLALRGLHALTLGTTYPHRQRLQRLALRGLHVLTIRGLHALTSRGLCPRLERATRPHLGGLHVLAFKGSCAFTFVGLHALTFRGLHVLTIRGLHALTSRGLHVLALRGLHALTSWVLVTLTVERTTRPRLERTT

SEQ ID NO: 150864 - protein, 44 aa, Glycine max
  Coding DNA Sequence Number=SeqID_59179
KLYNKLPLPIVSYPADSSSRHLKIPFHPYSSIPISLYHAKTKET

SEQ ID NO: 150865 - protein, 180 aa, Glycine max
  Coding DNA Sequence Number=SeqID_59180
  Gene Ontology: Mol. function=helicase activity; Biological process =viral genome replication
  Homolog annotation: Hit_ID=Q2R1R7; Match level="QueryCoverage=98%, HitCoverage=11%, E-value=3e-40, Identity=47%"; Hit description=AT hook motif-containing protein, putative
MECRHCNAKMWYDERISKDRNTTGPKFSLCCGDGKVELPLLQSPLKYLERLLFDGKASDSKNYQCNIQTYNMMFAFTSAGIKLHKSINESRGPPTIRIQGQPCHRIGSLLPMPGKQPKFSQLYIFDMHNEVENRINAMSQHVEIQPEIVSTLSQMLDEYNVHAKSFRMARDRLADSQVDN

SEQ ID NO: 150866 - protein, 113 aa, Glycine max
  Coding DNA Sequence Number=SeqID_59181
  Subcellular localization annotation: CTP_CleavageSite=40; ConfidenceScore=5.00e-01
MTSIYVRGRGCHTSNRPPQQGPNIFQRTTKLEETQTQFMKVTMSNHKSTESALKNLEIQVGQLAKQLAEKSSNSFGANTEKNPKEECIAVMIRNKKSLVVEDEDRVALEKQML

SEQ ID NO: 150867 - protein, 284 aa, Glycine max
  Coding DNA Sequence Number=SeqID_59182
  Gene Ontology: Mol. function=transferase activity, transferring glycosyl groups; Cellular component=chloroplast; Biological process =aromatic amino acid family biosynthetic process
  Homolog annotation: Hit_ID=A8GF80; Match level="QueryCoverage=99%, HitCoverage=85%, E-value=1e-118, Identity=75%"; Hit description =Anthranilate phosphoribosyltransferase
  Pfam annotation: Domain name=Glycos_transf_3; Domain location=23-274; Score=504.0; E_value=1.8e-148; Accession=PF00591.12; Description =Glycosyl transferase family, ab domain
RPEEIAGAASALLADARPFPRPDYTFADIVGTGGDGSNSINISTASAFVAATCGLKVAKHGNRSVSSKSGSSDLLAAFGINLDMPAQQARQALDDLNVCFLFAPQYHSGFRHAMPVRQQLKTRTLFNVLGPLINPARPPLAVIGVYSPELVLPVAQTLKVLGYQRAAVVHGGGMDEVALHSATQVAELRDGEITSYQLTPEDFGFSFQPKEALAGGTPEENRDILTRLLQGKGQPAHEQAVAVNVAMLLKVFGNEDLRDNAERAMAAIRSGQAYERVVALAARG

SEQ ID NO: 150868 - protein, 100 aa, Glycine max
  Coding DNA Sequence Number=SeqID_59183
MNKGKSDLSHLLSGQKHTTDKIGLGYNKQIKFYKKTKFASSKKVNPNKVSKKKNIVHPKSKAKTCHYCMKIGHTSYKYHVRRFDVPRGVPKSKRLTMIFG

SEQ ID NO: 150869 - protein, 142 aa, Glycine max
  Coding DNA Sequence Number=SeqID_59184
  Homolog annotation: Hit_ID=Q6WAY6; Match level="QueryCoverage=65%, HitCoverage=16%, E-value=4e-10, Identity=36%"; Hit description =Putative uncharacterized protein
EGKEGVLFSCGDYPNVSLIGKRGCINYNPALAIRQLGYPMMGAPTEESLSPFLVRDLGAQSLKVIQRVHKAWRSPLRKDKELRGIRNGVIGGYHGWLRVHTRGLDWLSKLKVIDEENFEAPEEDEEGVQRVTRGKRGHCKSP

SEQ ID NO: 150870 - protein, 257 aa, Glycine max
  Coding DNA Sequence Number=SeqID_59185
  Homolog annotation: Hit_ID=A5AMK2; Match level="QueryCoverage=39%, HitCoverage=13%, E-value=3e-08, Identity=34%"; Hit description =Putative uncharacterized protein
  Pfam annotation: Domain name=zf-CCHC; Domain location=155-172; Score =22.6; E_value=0.00058; Accession=PF00098.14; Description=Zinc knuckle
MYKDNWTQPWPMGSEIYPKVHENPRAFFSSSSPIFLEPLAHGSSDWSLPREDCITHPRPHSHWREKERKPQEANINLLYFHRKDNVEANLDWEIRVEQQLKRKSTSKSYGYHSYPKKDQGQGILGVTPSKPKDDKGKTIENQPLKASMQEKTTSIKCFKCLGRGHITSQCPTKKTMIMRGQDIYSSQDEATTSPSSSESEEAKGEESNKEIYPQEEGQPLMVKEDCKETLVSIATPLRLEFIPQVKELLDEGLVRKS

SEQ ID NO: 150871 - protein, 105 aa, Glycine max
  Coding DNA Sequence Number=SeqID_59186
  Homolog annotation: Hit_ID=Q84VI1; Match level="QueryCoverage=61%, HitCoverage=9%, E-value=4e-15, Identity=70%"; Hit description =Envelope-like protein
THVPDIVSTSVSTSGKAAASGAVSKDALIAELKDTCKVLEATIKATTEKKMELERLIKRLSESGIDDEEAAEEEGEAAEEEEEAAEEEEDAAEETESDDDSEATP

SEQ ID NO: 150872 - protein, 429 aa, Glycine max
  Coding DNA Sequence Number=SeqID_59187
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=56%, HitCoverage=34%, E-value=8e-60, Identity=44%"; Hit description=DNA polymerase
  Subcellular localization annotation: CTP_CleavageSite=33; ConfidenceScore=5.03e-01
MLFKTHGVRHNVPYTTYSRTRSTSTCILLNRIQSNSSKTLIFPHPKLLIPSLEYREPVSVQDTALLSHSVMSLLVSYVYPVLLGYAKANIIFYFKNREVGDIAKPLNKQSIPLTFDDGSPISKSEIYASVFSSIFKLIDIYDGFGVVRIAIRAHFEENIPGPLQPLKEELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRIFPTFEERSCQMLKSFIFRVAAITRQNRSAKTIYFHNLGRFDSIFLLKHLALYHPNYTVTPLMRDNRLYEVAVYSKKRLLFTFRDSLHLLPGKLDDLAKNLCPELGSKGSISYEDVRLESLSIMKESLLEYMEQDILLLGGIMQSFQDIYYKAYQADIVK

SEQ ID NO: 150873 - protein, 58 aa, Glycine max
  Coding DNA Sequence Number=SeqID_59188
MENWVTALCNNFARLQTRNNIHGAPKKSGEWRIGEQHYAITSRGSRLVGGGCMNSARQ

SEQ ID NO: 150874 - protein, 81 aa, Glycine max
  Coding DNA Sequence Number=SeqID_59189
MNFATRKPVEFTPVPVSYADLLPYLLDNSMVAITPTKVHQPSFLREYDSNATCACHGEASGRPIEHCRALKRKVRGLIDAG

SEQ ID NO: 150875 - protein, 78 aa, Glycine max
  Coding DNA Sequence Number=SeqID_59190
MREELATQLAQACENFTYCATMGAKYLEARYTINSWGSELDGGGRMNSARQSIHGAPDSMVEDARTALGNQFVGLRTR

SEQ ID NO: 150876 - protein, 165 aa, Glycine max
  Coding DNA Sequence Number=SeqID_59191
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
  Subcellular localization annotation: CTP_CleavageSite=31; ConfidenceScore=5.60e-01
AQYANRLSPRVGRFSNAAGTTGFPTGKRAVSATQVMNRRERRERTKARQREGTCLSIAGNRKGYQQSYMRENWRDHKDVTSFYFTWFPDDATEEDLWGGGQTPIREEVGLVFGMQAWHWPSFYNVVTGKTLALPNLIALQHIPLSPAGVIAKRPAPIALPNSCAA

SEQ ID NO: 150877 - protein, 175 aa, Glycine max
  Coding DNA Sequence Number=SeqID_59192
VLSQRALLRASEGEAHGCAFQRRKDARSRHQRLFVENVGKTEENRSKMKILSLGVVFTFEEGDHFKALDLKNDPFYLQNRGEACRPARPGEPGCFLQKKQPSGGIFWKAQLSKKLRKLTDCAKTPLFDFRHITEFHGSRKPASFRFLRRLGTSFIVQQRTPSISESGLTKDCLSS

SEQ ID NO: 150878 - protein, 187 aa, Glycine max
  Coding DNA Sequence Number=SeqID_59193
  Subcellular localization annotation: CTP_CleavageSite=7; ConfidenceScore=5.25e-01
MNCVFVHATSIHEFGAMRNNCFVQFSILAFFRSPMNLLPSAVHVSSTFESGAPQSYCIALFANSPFSTFIQRPINSLPSVVHVSSTFESGAPRSYCVALFANSPFSIFIRRPMNSLPSTVHVSSTFESGAPRSYCVALFANSPFSIFIRRPMNSLPSAVHMSSTFESGAPRTLFMCPPPSSLEPGIL

SEQ ID NO: 150879 - protein, 31 aa, Glycine max
  Coding DNA Sequence Number=SeqID_59194
ACSELQNKERETRLKRAIKGISKFFKSKNYG

SEQ ID NO: 150880 - protein, 230 aa, Glycine max
  Coding DNA Sequence Number=SeqID_59195
  Homolog annotation: Hit_ID=Q28658; Match level="QueryCoverage=39%, HitCoverage=38%, E-value=4e-07, Identity=34%"; Hit description=Small proline-rich protein 3
  Pfam annotation: Domain name=Cornifin; Domain location=47-228; Score=- 49.6; E_value=0.076; Accession=PF02389.6; Description=Cornifin (SPRR) family
LYVLAFGGLHVLVFKRLHALASRGLYVLAFRGLHVLASRGLYVLCLQRATRPRLHRAVHPCLQRATRPHLQRAVCPRLQRAACPRLQRVARPHLQRAARPRLQKVVRPLPSEGYTSSPSEGCTSSPSEGYTSSPSEGCMSLPSEGCMSSPPEGFTSSPLEGCTCSSSEGYTSSPLEGCTYSPSEGCMSSPSEGCPSSPSEGCTSLPLEGCTSSPLEGCTFSPSEGYTFWP

SEQ ID NO: 150881 - protein, 48 aa, Glycine max
  Coding DNA Sequence Number=SeqID_59196
  Homolog annotation: Hit_ID=A0ST23; Match level="QueryCoverage=83%, HitCoverage=81%, E-value=1e-14, Identity=92%"; Hit description =Putative reverse transcriptase
MGTELEFVIMLTDRFPVGKPVVPAALMNRPTRGERRFAYWALFRFLAH

SEQ ID NO: 150882 - protein, 19 aa, Glycine max
  Coding DNA Sequence Number=SeqID_59197
MWLIPVMITNLVHGSRMTV

SEQ ID NO: 150883 - protein, 16 aa, Glycine max
  Coding DNA Sequence Number=SeqID_59198
MAVRLLPTAGHPQATV

SEQ ID NO: 150884 - protein, 116 aa, Glycine max
  Coding DNA Sequence Number=SeqID_59199
  Homolog annotation: Hit_ID=Q9FLX0; Match level="QueryCoverage=44%, HitCoverage=4%, E-value=2e-11, Identity=61%"; Hit description =Arabidopsis thaliana genomic DNA, chromosome 5, P1 clone:MXC20
  Subcellular localization annotation: CTP_CleavageSite=51; ConfidenceScore=5.11e-01
MVNSLLPKSLKNLSSLVCIFLCPRMVNSLLPKGCFSLTNTAIGIDVPARTMQMLKKMKKQPLLFVELLFWKTRMECHYINAEYLLSELGHLKKESANWNNTQGDEEIGSSPAKVWT

SEQ ID NO: 150885 - protein, 58 aa, Glycine max
  Coding DNA Sequence Number=SeqID_59200
MVSRDIILFDNNIVAIGTQHQKRKTLDEASLLSSESETQHGHRSTSTSYVSHRLGYKA

SEQ ID NO: 150886 - protein, 347 aa, Glycine max
  Coding DNA Sequence Number=SeqID_59201
  Homolog annotation: Hit_ID=Q6WAY6; Match level="QueryCoverage=97%, HitCoverage=64%, E-value=4e-33, Identity=30%"; Hit description =Putative uncharacterized protein
MGSSQKPSLKKRFYQVKVKSLGITSLKELGQLMGQLQWQAFRKAYGKIWDLAMVEVSTESIASLAQYYDQSLRCFTFGDFQLSPMEVDRQKQVENGVVGIPRKCLDAKARILAGRSEWAPFIDVLALLIFGGVLFPNVDGLVDLAVIDAFLAYHNHKESSVVAMLADLYETFDRRCEKSSTRIVYCTSALYVWLVSHFFRQEVRHACPLEGHHSCTEKGGANWDQLLSNKEGASVNWLPRWKEGRTRVLVSCGGFPNVPLMGTRGCISYNHVLTIRQLGYPMRGPPLEEELAAVISRGFNETNVEILQKVRKAWEVVQKKDKELRGSNNGPIGGYRKWLKAHVQGLD

SEQ ID NO: 150887 - protein, 165 aa, Glycine max
  Coding DNA Sequence Number=SeqID_59202
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRDGHSLSVSGCREQTSPSGRVSGCWRMRKEKIPHQAPFAIQAAQLLGRAIGAGLFAITPAGERGMCCKAIKLGNARVFPVTTLETKWVVLDLHGSEHYLLLPTFEYTSGTELEFVIMVIAVSFGKPVVPAALMNRPTRGERRFAYWALFRFLAH

SEQ ID NO: 150888 - protein, 258 aa, Glycine max
  Coding DNA Sequence Number=SeqID_59203
  Homolog annotation: Hit_ID=Q6WAY4; Match level="QueryCoverage=98%, HitCoverage=43%, E-value=5e-35, Identity=35%"; Hit description =Putative uncharacterized protein
MEVVVSLTQYYDQPLRCFTFGDFQLVPTVEEFKEILGCPLGGRKPYLFFGFLPSLSKIAIVVRDSARELDREKQTQNSVVGLPRKYLEGKARDMANQEEWVPFMDVLALLIFGVVLFPNVDGLVDLAAIDAFLAYHHSKESPVVAILADLFDTFDRRCEKSSAQIICCLPALCVWLVSHLFHQDIRHPCPLRSHRLCVEKRRVDWDQHLAGIGGRTINWFPRWKEGKEGVLFSCGDYPNIPLIGTRGCINYNPALAIR

SEQ ID NO: 150889 - protein, 160 aa, Glycine max
  Coding DNA Sequence Number=SeqID_59204
EQATQGSFIPNGRQDVLTAAIGRREHLGSVRAVGADVPQLFLPASRRIATADPANQGPARGVHHRKIDAAAHGIIQPDAVPDAILGTCTASRASGNDHETGDSDRCSLYIEEDPARLVALGRVYEGSTIVHNTLLLPDQVKVGVEEVTDADAPIPVPIDE

SEQ ID NO: 150890 - protein, 106 aa, Glycine max
  Coding DNA Sequence Number=SeqID_59205
  Subcellular localization annotation: CTP_CleavageSite=42; ConfidenceScore=5.11e-01
MKCFHQEVLRPQAGAGRNTTTAWGWPAAGNGRTAITSRVHLSSSTKSHSRTHLVVHDPRNLNKTSTSLEGHPLYPRTAGQTLTYIMTNRSTSLEPKSQLIINLDPG

SEQ ID NO: 150891 - protein, 71 aa, Glycine max
  Coding DNA Sequence Number=SeqID_59206
MVPGNRLPRGCNRLPGLETKAAGFHVLKLCDSSLASGNRLPRLCNRLPGMKSLEIPLLLACSGHETYCVAA

SEQ ID NO: 150892 - protein, 245 aa, Glycine max
  Coding DNA Sequence Number=SeqID_59207
  Homolog annotation: Hit_ID=Q84VH5; Match level="QueryCoverage=83%, HitCoverage=39%, E-value=6e-67, Identity=95%"; Hit description =Envelope-like protein
MDLITVAGLLKTVTKLGDCYESLVREFIVNIPSDITNRKSEEYQRVFVRGKCVRFSPAVINKYLGRPTDGVVDITVSEHQIAKEITAKQVQHWPKKGKLSAGKLSVKYAILHRIGAANWVPTNHTSTVATENLLYPCITNCLRGHMSQTLSRQAAASGAVSKDALIAELKDTCKVLEATIKATTEKKMELERLINRLSESGINDGEAAEQEDEAAEEEVEAAEEEEEAAEEEEDAASDDDSEATP

SEQ ID NO: 150893 - protein, 76 aa, Glycine max
  Coding DNA Sequence Number=SeqID_59208
MEIDFDKIQSVPTRKEGQISSKTLTCLNLRRSEYRQLPQQLHSLKGLQHKVLALLFFPSFLLPLSVGRVGLDIPRP

SEQ ID NO: 150894 - protein, 203 aa, Glycine max
  Coding DNA Sequence Number=SeqID_59209
MVQKKDKELRGSNNGPIGGYRKWLKAHMQGLDWLPSLRTAKREEVEAPEEDEEVQALRAELEQAQTVKERFKSVALKIRKENAELRDINIATTKALEQETKRARREEHGRNKFRGALWGSNSELMLRREERDQSQVDSLILKDELMVFSRSKRNLSQRLCETETNMLAIINKYQEELNLAMTHEHRVVDEYAQVYAEKEARGR

SEQ ID NO: 150895 - protein, 57 aa, Glycine max
  Coding DNA Sequence Number=SeqID_59210
MKTKGMQCPMCAVKKVIWTFRLPVTKDEINIQRMCDDMMQMRKSATGGCTQDGNILK

SEQ ID NO: 150896 - protein, 192 aa, Glycine max
  Coding DNA Sequence Number=SeqID_59211
MATMMEPMMSVKKIMEANAVAIAATRVVAKVNLMSPSGINQMNHPTSDMVGKDLGSTGSPHNVQIQNEHAFLPYGLPLNYTPPKVAYTPNKNVNNSTPIPIESQQPQSDHAHVSRPMEETHEIPHHDLANFEPCLGYAAEGQAVGGIPLQNPLEGPQYHPQLHLLHSTAVKNPYDYGRNGKVGSSRGKAQGH

SEQ ID NO: 150897 - protein, 17 aa, Glycine max
  Coding DNA Sequence Number=SeqID_59212
MDNPSLVFKNPLQQETL

SEQ ID NO: 150898 - protein, 55 aa, Glycine max
  Coding DNA Sequence Number=SeqID_59213
MGAKHLTRTKEWSHVIEQRSPDEIRGADNRKGADNRKGADNRKVSPRVIGPAASG

SEQ ID NO: 150899 - protein, 26 aa, Glycine max
  Coding DNA Sequence Number=SeqID_59214
MDVCDNLSPFAQFMGCPKRLIKTGPN

SEQ ID NO: 150900 - protein, 159 aa, Glycine max
  Coding DNA Sequence Number=SeqID_59215
  Subcellular localization annotation: CTP_CleavageSite=37; ConfidenceScore=5.09e-01
MAKFDIAEATKVKTKVMSTVATRWRQFKSTLTSKFVFAKTEGQQTQDVVTKYGLDPEAWKQFEETRLTPNWEKLLDQKRKRIQEEALLSENPASVDEPSSPIKRHVKWKVARTRAVGNMTSDSAQEIADKIDSLEEQVTQGSFVPHGRQDILNTATWPT

SEQ ID NO: 150901 - protein, 102 aa, Glycine max
  Coding DNA Sequence Number=SeqID_59216
MGSILPELCGVGLQWKDPHYIRVRKFGNRVYIADGLKHFRRDMGIYEGVMITFAAPDINWKFDIHLSPPLHAQTCDRPVHSAREYVFTVDVDNRMIARLYPL

SEQ ID NO: 150902 - protein, 137 aa, Glycine max
  Coding DNA Sequence Number=SeqID_59217
MSLKLPYYPELVRVFYSNLKIQDGVIRSKVHGISMIIDQSLFFSLTKLPSQGAPFEGTIVDEWKFDYSSHDARRMRSFAIGAGAVTSFGYQLWGLRTYVGERFDSLDGRFEGMDTRITQLEEDMTYLHRCFDLPPPS

SEQ ID NO: 150903 - protein, 175 aa, Glycine max
  Coding DNA Sequence Number=SeqID_59218
MTTAPRAPGLLVLATNTNPGASCAKELKSVKCDSRGPGDESREHRVLNASAPEAIRPRARLPGCHTSFPQRKHVTMLLRGVYADLPRAPASWLVEIWVHGRLRRDKMVDEPRSRPITCEPVSSGPIDDPLRARTLPTRPQVRRGYPLSLSISISGGKETNKDSLSNGERTGKSPP

SEQ ID NO: 150904 - protein, 99 aa, Glycine max
  Coding DNA Sequence Number=SeqID_59219
MSRWHDLAGGDRHPVGLTEAHDQSRKPQGPIGLLRGEIRVVVVRMIHTRLPVAVWAKSSPGMYSSCMIASLFGCARTVGPPPGSGGGQGTDKGKLLAPH

SEQ ID NO: 150905 - protein, 238 aa, Glycine max
  Coding DNA Sequence Number=SeqID_59220
  Homolog annotation: Hit_ID=UPI0000ECC274; Match level="QueryCoverage =27%, HitCoverage=96%, E-value=6e-21, Identity=67%"; Hit description =UPI0000ECC274 related cluster
MTVKTSDTCSSRRRSQLVCKRMPGADKPVRARQRMRKEKIPHQAPFAIQAAQLLGRAIGAGLFAITPAGERGMCCKAIKLGNARVFPVDSRGSRMTVEYDYCMHRITDSQSPSRETCRASCINESANARGEAVCVLGALPLPRSLTRCARSFGCGERYQLTQRRSFAPSWAVCTNPPFSPTAAPYPVTIVLSPTRISRARYVGGATEFLKWWPNYGYTRRTVFGICALLKPVNFGKRV

SEQ ID NO: 150906 - protein, 200 aa, Glycine max
  Coding DNA Sequence Number=SeqID_59221
  Homolog annotation: Hit_ID=Q6UUU1; Match level="QueryCoverage=23%, HitCoverage=31%, E-value=3e-13, Identity=80%"; Hit description =Putative uncharacterized protein
  Subcellular localization annotation: CTP_CleavageSite=38; ConfidenceScore=5.01e-01
MNCIFVHVSSTHEFGAMRSDCLVQFSILNLFRSPMNCVFVHGSSTHEFGALRSDCLVQFSILNLFRSPMNCVFIHVFSTHELGAIDTVDLEGGPVGKPVVPAALMNRPTRGERRFAYWALAECILAYYVGTDEGVSEVLHVAGEKRLHRCVSRICDTGYIPLPRSLTRYARVVRLRRAGNGLRTGPEISWKMPGRYLTGK

SEQ ID NO: 150907 - protein, 120 aa, Glycine max
  Coding DNA Sequence Number=SeqID_59222
MVKEECKEVSVSSKRLAKKERHFEIKTNIKEISLLRQPPHFLLCKKTLVSIATSLRLEFNPQVNELLDEGLVRKRLNPCALLVPKIGVPMNPKRIKVIPAWPAPPSVLREKAQSFKNLGI

SEQ ID NO: 150908 - protein, 222 aa, Glycine max
  Coding DNA Sequence Number=SeqID_59223
  Gene Ontology: Mol. function=ATPase activity, coupled to transmembrane movement of substances; Cellular component=integral to membrane; Biological process=transport
  Homolog annotation: Hit_ID=A7Q943; Match level="QueryCoverage=40%, HitCoverage=16%, E-value=1e-15, Identity=48%"; Hit description =Chromosome chr19 scaffold_66, whole genome shotgun sequence
MVKLAPLEKPLLNGDSNVSNNYVPIKARGNENLTWYSNVGFFSILTFSWMIPLITLGNEKTLEHEDLPHLATDDSVDGILPTFTNKLESECGVSNEGRSTQGWGERHSDDDELRVAMRDLVSGGRRPEGAFARVSVGGQGEARVWERLMSARREKAFQFWSHDGSGSGGGGGIGGGGDVNDSDSDDVVLVASDCDGGGGDNDGGYISGGSGGDNCNTPFFVK

SEQ ID NO: 150909 - protein, 179 aa, Glycine max
  Coding DNA Sequence Number=SeqID_59224
MTGIMHYIIVRILLPRSSNLAQASEEDLILMWAFLTGRQIDWAHLVRYRMHKALRANAPLPYPQLITLFLRHFQIPLDDEPFVQVKCSFAIGVGAVTSFGYHAFPPHDERTPSPPPQRDDLALMTEVLSELQGLRSYVGERFDSLDTRFAGMDICLTQLEEDVGYIRQSFDLPPPPPPS

SEQ ID NO: 150910 - protein, 54 aa, Glycine max
  Coding DNA Sequence Number=SeqID_59225
MDKSLKVGEDEWRERERRSMQFYASNEVWFSPLKQDQVQDSPLSALRRHEACKA

SEQ ID NO: 150911 - protein, 161 aa, Glycine max
  Coding DNA Sequence Number=SeqID_59226
MTTLFMGRPLFLIKVDPWVLSTYLHQRATRPAIRGLHVLGLQGLHALTFRGLHVLAFRGLHVLAFRGLHVLAFRGLHVLALRGLHVLAFRGPHALAFRGLHVFNFRGLHVLAVKGSCTFTFVGLHTLTFRGLYVLAFRGLHILAIRGLHVPHFQRATRPHL

SEQ ID NO: 150912 - protein, 64 aa, Glycine max
  Coding DNA Sequence Number=SeqID_59227
MPFCGRAKARLTGALSKGGKVHGVATNVYLWKTSEKPKETGQNENSKFGSCICVCGRLGEKRLK

SEQ ID NO: 150913 - protein, 214 aa, Glycine max
  Coding DNA Sequence Number=SeqID_59228
  Pfam annotation: Domain name=zf-CCHC; Domain location=186-203; Score =10.3; E_value=0.042; Accession=PF00098.14; Description=Zinc knuckle
MNLHSSSSVNDEGSTPKDPLKTREKRKGKKRVKEISQDEKEKIREEERRKILKELRKEKHASYSSHNSCKSLSQELRDYYEGRHRSHLRPHSYMRENERKPEEANINLPYFHGKDNVEAYLDWKIRIEQKLKRKSTLKSYGSHSYPKKDQGQGILVVTPSKSKDDKGKIIEKQPLKASMQEKTSSIKCFKCLGRGHITSQYPITKTHDYEGPRH

SEQ ID NO: 150914 - protein, 113 aa, Glycine max
  Coding DNA Sequence Number=SeqID_59229
PSPTVELSASQALSEQPNVDAKHGIKHEGAETGALSARSERAKRESQVSQRALRGRARARLTGALPKGGKMRGVATNEGISTSYVDKSGAFAPTYPPLERKSDLRSSSLCVNQ

SEQ ID NO: 150915 - protein, 70 aa, Glycine max
  Coding DNA Sequence Number=SeqID_59230
MEKWLQRNSPRRGLEETPQEKGPVPPQSLIVIVSGVPSTSSTLRPLGDGRSTGRGMSSSGRMSIWTFRRR

SEQ ID NO: 150916 - protein, 171 aa, Glycine max
  Coding DNA Sequence Number=SeqID_59231
MAVCLLPATGHPNAAVVSRPAPAWGAVLLDESSISRGPDALAGGDRYSVELTETRLIEARNQSWKPQGPVGLFRVHWVSLVGAIPANNRWGRLALRSLGRMLLSSNVIYICVRVVMLVRMIRTRLFAAARVKSCLSMHSSSAIASLSSCARTVGPPPISGGGPGTVKRKLL

SEQ ID NO: 150917 - protein, 70 aa, Glycine max
  Coding DNA Sequence Number=SeqID_59232
MKFMEFLAKSPFAKRKPCAKRVFGHALSLESQALSDQPLHLRLIWSAKLAKAELSQLQFDLNSAKLQPDR

SEQ ID NO: 150918 - protein, 55 aa, Glycine max
  Coding DNA Sequence Number=SeqID_59233
MGAKYLEVVKRGSHPNNRWSLDEIRLCKSVLKTMLATSNRLLPSSNRLPESKTLW

SEQ ID NO: 150919 - protein, 39 aa, Glycine max
  Coding DNA Sequence Number=SeqID_59234
VEERIPEFQEPMDLRSNPFQGGGNDAIPFLVLKLTTRLK

SEQ ID NO: 150920 - protein, 110 aa, Glycine max
  Coding DNA Sequence Number=SeqID_59235
MDINVSALIGKSVPHIPEKCKDPESEYTNHVARSTYTSELLYEVQAEEPSSSPTLVPPTVHPPPTPELKPLPATLKYAYLEDKKKFSVIISASLDAEQREKLLLVLKKHK

SEQ ID NO: 150921 - protein, 360 aa, Glycine max
  Coding DNA Sequence Number=SeqID_59236
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=69%, HitCoverage=87%, E-value=1e-130, Identity=93%"; Hit description=Beta- lactamase TEM precursor
  Pfam annotation: Domain name=Beta-lactamase; Domain location=31-275; Score=155.6; E_value=1.3e-43; Accession=PF00144.15; Description=Beta- lactamase
  Pfam annotation: Domain name=Peptidase_S11; Domain location=29-251; Score=-124.1; E_value=0.043; Accession=PF00768.11; Description=D -alanyl-D-alanine carboxypeptidase
  Pfam module annotation: Pfam domain module=Beta-lactamase::Peptidase _S11; Domain location=31-275::29-251
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGHHFKNSVAPPTYLALLILLPVAAASGDKSCLTGATLPEGRKADRYPVSGRVGTGERTRELPGGNAWGAEPMENASNAAFLRFLAFCWPFAHMFFPALSPDSVDNRITAF

SEQ ID NO: 150922 - protein, 66 aa, Glycine max
  Coding DNA Sequence Number=SeqID_59237
EEVKKKRVQLLRHFSLLRICLEKLFPRRNLSRGASERFRNVFREEFAKFNRPSTFSSFSSFFDLQR

SEQ ID NO: 150923 - protein, 67 aa, Glycine max
  Coding DNA Sequence Number=SeqID_59238
MAPRKLHAKRSRKDKAAEGTSVAPEYDSHRFRSAEHQQRFEAIKGWSFHGRDSSPAVDIAGYPHGQV

SEQ ID NO: 150924 - protein, 99 aa, Glycine max
  Coding DNA Sequence Number=SeqID_59239
  Homolog annotation: Hit_ID=UPI0000ECBAF8; Match level="QueryCoverage =41%, HitCoverage=48%, E-value=1e-16, Identity=100%"; Hit description= UPI0000ECBAF8 related cluster
MSRNFTDYATIPSLTSGMLRNFTNCATMLPFDFRHVAELHGLPNDGCMQAWHWPSFYNVVTGKTLALPNLIALQHIPLSPAGVIAKRPAPIALPNSCAA

SEQ ID NO: 150925 - protein, 172 aa, Glycine max; identical to SEQ ID NO: 122376
  Coding DNA Sequence Number=SeqID_59240
  Homolog annotation: Hit_ID=A6FJQ2; Match level="QueryCoverage=22%, HitCoverage=84%, E-value=3e-11, Identity=92%"; Hit description=50S ribosomal protein L5

SEQ ID NO: 150926 - protein, 72 aa, Glycine max
  Coding DNA Sequence Number=SeqID_59241
MGVKYLEAVKRRLHATKQWSPDEIRVPLTSIRGRILPKKEGMIKDYLRRKSLAWVGSTWIDQSLEHGVRDFP

SEQ ID NO: 150927 - protein, 205 aa, Glycine max
  Coding DNA Sequence Number=SeqID_59242
MAEEPRRVTLEDYSSSNVPQFFTSISQPEVQAQAITYPPSLIKLIQNNLFHGLPIEDPYAHLATYIDICNTIRLDEVVEKFLKKYFPESKTAEGKAAISSFHQFPDESLSEALERFCDGKIKLKTPEEAIDLIENMAASDIDILRDRAHIPTKKSLLELTSQDALLAQNKLLSKQLEALTETDVPSVGELMNLDVVSLLKNNPLM

SEQ ID NO: 150928 - protein, 44 aa, Glycine max
  Coding DNA Sequence Number=SeqID_59243
MMNSLSEHAALTLSEELAKCAYRAKRVHLLRMNTHPLAELPVAS

SEQ ID NO: 150929 - protein, 31 aa, Glycine max
  Coding DNA Sequence Number=SeqID_59244
MEKTKKLKFEEWVNDKSREFAVQITRGKCTG

SEQ ID NO: 150930 - protein, 154 aa, Glycine max
  Coding DNA Sequence Number=SeqID_59245
SFGFPVAPSKVIRPPITRAFIEKYCTQRQAQGDAPQAADAPPPHQAGPAGSFDTEQYLWHLVRQQAANHRAHVQTHDCLYQMSLSLQSQGFTSFLCPTLDQFRAEVAWPGDWPEARAGEAPAEAPAEAPDEADEAREDEEMADLLDFLGGSGAT

SEQ ID NO: 150931 - protein, 92 aa, Glycine max
  Coding DNA Sequence Number=SeqID_59246
MGLQPMLVKGLMLWNNKWTCDLMQWSQGSQRIVIIKKGEIVEAMTSKVILMMPKNHELSKFHRFKNQVSRIKIQEFKIQEFKNQVSRIKIQE

SEQ ID NO: 150932 - protein, 162 aa, Glycine max
  Coding DNA Sequence Number=SeqID_59247
MRLLLHLPLVKVKKQKGGESSEEIYIQEEGQPLMVKEECKEVSVSSKRLAKKERHFEIKTNIKEISLLRQPPHFLLCKNTLVSIATSLRLEFIPQVKELLDESLVRKRLNPCALLVPKIGIIRHQIPKIGGVMNVSGGATLFCKITRPPNIFMICVHRDSLG

SEQ ID NO: 150933 - protein, 42 aa, Glycine max
  Coding DNA Sequence Number=SeqID_59248
MSYVPESDIRVKSYDHSISRELPVFMSSVYMSDVSESDICVK

SEQ ID NO: 150934 - protein, 153 aa, Glycine max
  Coding DNA Sequence Number=SeqID_59249
MSGKGLQHVRKSLSQYQRLRACLEIKWDTNWKRGARTLERWQCHSRRHDFGYVAVVGAAGPLRLQVLHGGKQNVRVVAGWSSRRDEVVQAIAGALGFWRDGVPTSTVFDDFHQNYNDGVIDKCRCTTNAPHKNLYNYVNATVLTTTTGSSTST

SEQ ID NO: 150935 - protein, 272 aa, Glycine max
  Coding DNA Sequence Number=SeqID_59250
  Gene Ontology: Mol. function=3-dehydroquinate synthase activity; Cellular component=cytoplasm; Biological process=aromatic amino acid family biosynthetic process
  Homolog annotation: Hit_ID=Q6AF95; Match level="QueryCoverage=99%, HitCoverage=75%, E-value=1e-110, Identity=75%"; Hit description=3 -dehydroquinate synthase
  Pfam annotation: Domain name=DHQ_synthase; Domain location=1-237; Score=278.7; E_value=1.1e-80; Accession=PF01761.11; Description=3 -dehydroquinate synthase
MGQADFTRSDAVIGYGGGAVTDLAGFVAATRLRGVQLVQVPTTVLGLVDAAVGGKTGVNTAEGKNLVGAFWAPSAVIGDLDELGSLSPNEATAGFAEVVKAGFIWAPEILDIIEADPTRAVDTSTEEFRRAVELAIDMKAKVVSDDFREAGLREILNYGHTLGHAIEHAERYRWRHGAAISVGMLYAAELSRLAGRLSDAAAERHRTILESLGLPTSYRAGAWPQLLATMQRDKKSRGGMLRFILLDDIAKPTVLQAPDESLLFAAYQEVGE

SEQ ID NO: 150936 - protein, 447 aa, Glycine max
  Coding DNA Sequence Number=SeqID_59251
  Homolog annotation: Hit_ID=Q6WAY6; Match level="QueryCoverage=94%, HitCoverage=79%, E-value=2e-39, Identity=28%"; Hit description =Putative uncharacterized protein
MGTNQNGKRFYQVKIKGLDVTSLKELGRLMEPLQRQAFRKVYEKILDLTTAKVFTEAIVSLAQYYDQPLRCFTLGDFQIVPTVEEFEEILGCPLVGKKLYLFSGFLPSLSKIVAMIRDSARELDCMKQTRNDVVGLPRKYLEGKARDMASQEEWVLFADILALLIFGVVLFPNMDGLVDLTAIDAFLAYHHSKESPVVVILADLFDTFDRRCEKSSARIICCLPTFVYGGRTINWFPQWKEGKEGVLFSCENYPNIPLIGTRGCINYNPTLAIRQLGYPMRGAPAEESLSPFLARDFGAQSFKIIQRVHKAWESPLRKDKELRGSRNGIIGSYHEWLKVHTRGLDWLSKLKIINKENFEALEEDEEVRALKIELGKARLAKEKFKLVATDVWKECAELREENAATARVLEQETKRARKEEHGQDKFHRSLWGSNNELKLRREERDQS

SEQ ID NO: 150937 - protein, 176 aa, Glycine max
  Coding DNA Sequence Number=SeqID_59252
  Homolog annotation: Hit_ID=Q8GEG1; Match level="QueryCoverage=57%, HitCoverage=75%, E-value=1e-50, Identity=91%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGSGPLTSITKIDAQVRGGETRQDYKDTRRFPLEAPSCALLFRPCRLPDTCPAFSLREAWRFLIAHAVGISVRCRSFAPSWAVCTKPPFRPTAAPYP

SEQ ID NO: 150938 - protein, 351 aa, Glycine max
  Coding DNA Sequence Number=SeqID_59253
  Gene Ontology: Mol. function=oxidoreductase activity, acting on the CH-CH group of donors; Biological process=electron transport
  Homolog annotation: Hit_ID=B0KMK8; Match level="QueryCoverage=73%, HitCoverage=83%, E-value=2e-71, Identity=46%"; Hit description=Acyl -CoA dehydrogenase type 2 domain
  Pfam annotation: Domain name=Acyl-CoA_dh_2; Domain location=252-351; Score=-33.5; E_value=0.099; Accession=PF08028.2; Description=Acyl -CoA dehydrogenase, C-terminal doma
  Pfam annotation: Domain name=Acyl-CoA_dh_N; Domain location=96-200; Score=-25.9; E_value=0.073; Accession=PF02771.7; Description=Acyl -CoA dehydrogenase, N-terminal domain
  Pfam annotation: Domain name=ProQ; Domain location=2-167; Score=61.0; E_value=3.9e-15; Accession=PF04352.4; Description=ProQ activator of osmoprotectant transporter ProP
  Pfam module annotation: Pfam domain module=Acyl-CoA_dh_2::Acyl-CoA_dh_ N::ProQ; Domain location=252-351::96-200::2-167
KLQKLYPKAFPKNPAPKVPLKIGIIEDLQLRSDEIGISKEDLQLAIKTWCKSSRYWQACKEGADRLDLDGNAVGVVDATGASHAKGMTPYVPVDTSLQPLEIAEQLAEQFAFTAIDRDQRGGTPKHERDAIRQSGLLSLIIPKEYGGLGSSWEETMQTIRILASVDSSVAHVFEMLIVSAVEHTSGELIIAAIPSQRSGIKVLNDWKNMGQRQTDSGSINFEKVRVEQNEILSDPGPLSSPFACLRPLIAQLILTNIYLGIAEGAFKEAKNYTLSEMRPWNNSNIASISNDPYVLAHYGEFWASLEATRSLTDIAAKRLDLAWGKGISLTESERGEVATSVTTAKIIATRT

SEQ ID NO: 150939 - protein, 457 aa, Glycine max
  Coding DNA Sequence Number=SeqID_59254
  Gene Ontology: Mol. function=hydrolase activity; Cellular component =integral to membrane; Biological process=metabolic process
  Homolog annotation: Hit_ID=A8GE69; Match level="QueryCoverage=35%, HitCoverage=77%, E-value=7e-59, Identity=68%"; Hit description=N -carbamoylsarcosine amidase
  Pfam annotation: Domain name=Isochorismatase; Domain location=43-220; Score=13.3; E_value=3.9e-07; Accession=PF00857.11; Description =Isochorismatase family
AIAAGGGKSGGADRQAGNYGRHCHYVRSAEGAGAGAGGAGRGRTAVRCVGYTTPGAALFAPGVVEAVAAAQGLLAAARQCAIPVIHTQIRYHPQHQQDGGIWVQKAPVMRDMVEGNPLAEFCPAVQPLAAEVVITKQYASAFFGTSLASMLMAQGIDTLLIAGCSTSGCIRASAVDALQYGFRAMVVRECVGDRHDAPHQANLFDIDSKYGDVSVSAAAETHNNISPTTGLLRPENTMTDVSTRPAALAAEDTASIYRKITWKLIPFLCLCYLAAYLDRINIGLAKLQMASDLALSETAAEQPDPAAGRRKDLDRAHYDYLGPALDRHAAGANADPVLHHPLFPRRGRSRLIGGPLSGWIMGHFHEVYGMRGWQWLFLLEGLPSVLLGVLTFWLLPNSVESASWLSSSEKQAVLRELARDEGDAKGLKHSLRDGLLNIRVVMLGGIDFSILLSAYAM

SEQ ID NO: 150940 - protein, 48 aa, Glycine max
  Coding DNA Sequence Number=SeqID_59255
  Homolog annotation: Hit_ID=A6T5W5; Match level="QueryCoverage=100%, HitCoverage=6%, E-value=3e-21, Identity=97%"; Hit description =Putative TonB-dependent receptor
MGVNISGVDFIPALPDNSKNYSQKWGYSDIESEFGMAKAEYDLSDSWT

SEQ ID NO: 150941 - protein, 83 aa, Glycine max
  Coding DNA Sequence Number=SeqID_59256
MRINGSKGPSPGQLFLLLVQVDAYDAVRAFSGVVFIEGLFDGDKQRLTIGGKQQAVGIGRQRPAFLQRVAAVVKADNLAGFTL

SEQ ID NO: 150942 - protein, 164 aa, Glycine max
  Coding DNA Sequence Number=SeqID_59257
MTSMMDAMLGMRQLMENNVATTASVSSAAEADPTLPATAHHPLRNVVGGERSTLGHISNPHLGYNRVAYPYGLPPNYTPLVMRDDAGHVPSPILEREPPRQSDEVHEDRREYAQGGIDFYPPVPVEGLAPNILPQPNLPALPIFLSTEGPPSAAEERRKLDLIE

SEQ ID NO: 150943 - protein, 75 aa, Glycine max
  Coding DNA Sequence Number=SeqID_59258
MAVRLLPATGHRQAAVALPMPRRHELAGGNGRPVGPTEARNQSWKPQGPVGLLQVHWVSLWGEIGIAVAGQNVAK

SEQ ID NO: 150944 - protein, 67 aa, Glycine max
  Coding DNA Sequence Number=SeqID_59259
MENSSLTVNHLIQPYFNLLSENQLRGELPGNHITSETSKRVGFRPQKETPPQKSSLPWIRTENENET

SEQ ID NO: 150945 - protein, 49 aa, Glycine max
  Coding DNA Sequence Number=SeqID_59260
MVIFHQGDAAEDKGEELEEDASMEEKKEGEKERGGSTKLKEEKGREVEL

SEQ ID NO: 150946 - protein, 115 aa, Glycine max
  Coding DNA Sequence Number=SeqID_59261
MTLTILELFLRPYQVTRDATVFGVFNPDFLLYIKHEDLSEIAHGCQCLSISLIQLWILHWQMVVILPKEYLVVWFCSLHNRPDNYLKGIINSALKGLDDAPQPKSKAPARWIVVK

SEQ ID NO: 150947 - protein, 193 aa, Glycine max
  Coding DNA Sequence Number=SeqID_59262
ETKFGHSAPLYHPEAAGPMIRGDTLRLSAPFCQPEAAGPMTSRDQIWSFCTLVSSRGGGPDDTRRYLTVIRTLLSSRGGGPDDKQRHNLVILHPSETKFGHSAHLYHPEAAGPMIRGDTLRLSAPFCHPEAAGPMTSRDQVWSFCTLVSSRGGGPDDTRRYLTVIRTLLSSRGGGPDDKQRPSLVILHPCIIQ

SEQ ID NO: 150948 - protein, 114 aa, Glycine max
  Coding DNA Sequence Number=SeqID_59263
  Subcellular localization annotation: CTP_CleavageSite=54; ConfidenceScore=5.23e-01
PVTRAGNPGALLDFSGSTGYLVGAIPANNRWGRLALRSLGRMLLSSNVIYICVRVVMLVRMIRTRLFAAAWVKSCPGMHSSCVIASLSGCARTVGPPPISGGGPGTVKRKLLVP

SEQ ID NO: 150949 - protein, 160 aa, Glycine max
  Coding DNA Sequence Number=SeqID_59264
MRFCSKQFVLQAKFDISEALDAKKKVMSTVATRWRQFKSSLTSKFVFSISEDQHKEDPSVKYGFNAQIWEEFAATRKTPSWQGIRKKMQEIQKNNDCPYLLSRGGYELLEKKLLDEKMKKRQHDTLMTENPALIEDPPISHSKTCQVEDGPHESIWEDDI

SEQ ID NO: 150950 - protein, 184 aa, Glycine max
  Coding DNA Sequence Number=SeqID_59265
MATAESLEWETKKARKEEWGRNKFRGALWGSNSKLKLRRTERDQSRVEGMILEDKLKACQRSNKSLSEQLSRMEENMWAIIDQYKEKLSLALTHEQRQEDEYAKVSILQAEREARERVIDSLHKEAMMWMDRFAFTLNGSQELPRLLAKAKAMADVYSDSEEVHGLLDYCQHMINLMAHIIRNR

SEQ ID NO: 150951 - protein, 112 aa, Glycine max
  Coding DNA Sequence Number=SeqID_59266
MKENKAKLAVLSTRISMCGNGKLSLGLARFRSRNWHDVGNPFWIPSDGQKSSVKLLLHFFFYLQGMFRASSSSISALLGNTRDLEVIVCCTMSELKPGISWYDQAKDVLVVS

SEQ ID NO: 150952 - protein, 208 aa, Glycine max
  Coding DNA Sequence Number=SeqID_59267
  Homolog annotation: Hit_ID=UPI00006A2939; Match level="QueryCoverage =83%, HitCoverage=95%, E-value=4e-14, Identity=31%"; Hit description =UPI00006A2939 related cluster
MTKGNDWYLKALHWGNEGHPCMSLKGLHVLANRGLHALTLRGLCVLTFRGLHVLTFRGLHALAIRGLRVLTFRGLHALAIRGLHVLTFRGLHALAIRGLHVLTFIGLHALTFRGLHVLANRGLHALTLRGLHVLANVGLHALTFRGLHVLAFRGLHVLTIRGLHALTSRGLHILALRGLHVLTIRGLHALTSRGLHVLALRGLLALAL

SEQ ID NO: 150953 - protein, 152 aa, Glycine max
  Coding DNA Sequence Number=SeqID_59268
MTRRLLAGSLAFESRILHYLIVRILLPRSSNLAQELRLNSPLPYPHLVTLFLQHFNIPLDSEPYVPIKRSFLIGAAVIASFGYQKEHDGSWVKKGAQPNDGEGHLQGGEDSSLLQKILDRFDGLQTFVGERFDALELQVDMRFDEMDSRITK

SEQ ID NO: 150954 - protein, 102 aa, Glycine max
  Coding DNA Sequence Number=SeqID_59269
MSCTGSLSALLHLTKRTASVHPLSEKESLDWDSELCMSRVSRERKVQVRKSFERFCCVKICRDQSLILGSYRFILLVRSSALFGSRKSFWRRCRGTSFYLGS

SEQ ID NO: 150955 - protein, 65 aa, Glycine max
  Coding DNA Sequence Number=SeqID_59270
GRGKVAERRCEKEEEGRTRGEREGEREKEGCKRGESEKKKKRVWEMKRLRGRRRKSGENLSRGRR

SEQ ID NO: 150956 - protein, 148 aa, Glycine max
  Coding DNA Sequence Number=SeqID_59271
MDCAIHLFSISVTLRNFHESPHVPKIYPKAHENPKAFSCISGPIFLESSIQCPCKVGLHHSLPLEKDFDASSIGACRPRIFFINGFLCFLKDEWQRNGERKRERRHHFKEKMSLEEAHHHRRPWIRAWRKKEMNEGRGREEHEFLCSK

SEQ ID NO: 150957 - protein, 166 aa, Glycine max
  Coding DNA Sequence Number=SeqID_59272
  Homolog annotation: Hit_ID=Q6WAY4; Match level="QueryCoverage=89%, HitCoverage=26%, E-value=1e-14, Identity=33%"; Hit description =Putative uncharacterized protein
MVEVSTEAIASLAQYYDQSLRCFTFGDFQLSPMVEEFEEILGCPLGGRRPSLFSGFYPSLARISKIVQISAHELDHRKQVGNGVVGIPRKYLEAKARILAGKGEWALFIDILALLIFGGVLFPNVDGLVDLVAIDAFLAYHNHKESPVVAMLADLYDTFDRTCEKS

SEQ ID NO: 150958 - protein, 270 aa, Glycine max
  Coding DNA Sequence Number=SeqID_59273
  Gene Ontology: Mol. function=hydrolase activity, acting on ester bonds; Biological process=lipid metabolic process
  Homolog annotation: Hit_ID=A8GAX1; Match level="QueryCoverage=70%, HitCoverage=96%, E-value=1e-96, Identity=91%"; Hit description =Lysophospholipase
  Pfam annotation: Domain name=Lipase_GDSL; Domain location=88-257; Score=93.2; E_value=8.2e-25; Accession=PF00657.13; Description=GDSL -like LipaseAcylhydrolase
AHLALAAVIQPGQNAQQGRFSRSGFADQGDRLRGFDKQLDSGKDGELMLTLTNVFTKMMNFKNVFRWHLPFLLLLGLFSLRAVAADTLLILGDSLSAGYRLPIERAWPTLLAEQWQKKPGAPQLVNASISGDTAAQGLARLPALLKQHQPRWVLIELGANDGLRGFPAQDMQRDLGQIITQVQQAGAQPLLMQIRIPPNYGRRYTEAFSAVYPALAKQFNIPLLPFYMEQVVVKPEWMQDDGLYPNGDAQPFIATWMAERLEPLVKPESN

SEQ ID NO: 150959 - protein, 126 aa, Glycine max
  Coding DNA Sequence Number=SeqID_59274
  Gene Ontology: Mol. function=aspartic-type endopeptidase activity; Cellular component=small subunit processome; Biological process=DNA integration
  Homolog annotation: Hit_ID=A7PG51; Match level="QueryCoverage=70%, HitCoverage=16%, E-value=7e-12, Identity=45%"; Hit description =Chromosome chr6 scaffold_15, whole genome shotgun sequence
  Subcellular localization annotation: CTP_CleavageSite=36; ConfidenceScore=5.20e-01
MVLEFATTGIDHVSPTSSLSLNSVLLIPGCPFNIISLSQLTRSHNCSVTFDANSFVIQERGTGRTIGLYYLKPNLSWCRAFSISPLVPILLNRMALPKGRIGILLRLLRHYYFMPMYLSGIGVMQF

SEQ ID NO: 150960 - protein, 81 aa, Glycine max
  Coding DNA Sequence Number=SeqID_59275
  Subcellular localization annotation: CTP_CleavageSite=65; ConfidenceScore=5.70e-01
MAAIQMTSLVSMTCWTCLSLPLVMGPSSASWSLPLVVSSSLCWAYLSLPLVMGPSSASWSLPLVVSSSGSLVNLSKRETYS

SEQ ID NO: 150961 - protein, 56 aa, Glycine max
  Coding DNA Sequence Number=SeqID_59276
MQSGSQSEPFDLDMGDRLEDMIRDLGQESFQQAHAPVVQELLNPVVCLLSLVNVKA

SEQ ID NO: 150962 - protein, 206 aa, Glycine max
  Coding DNA Sequence Number=SeqID_59277
  Homolog annotation: Hit_ID=A5BZH4; Match level="QueryCoverage=40%, HitCoverage=13%, E-value=3e-07, Identity=38%"; Hit description =Putative uncharacterized protein
REKERKPQEANINLPYLYGKDNVEAYLDWDIRVEQQLKRKSTFKSYGSHSYPKKDQGLGILGETPSKPKDDKGKTIEKQPPKASMQEKTSFIKCFKCLGRGLVTSQCPTNKSMIMRGQDIYSSQDEATTSPSSSESEEAKGEESNEEIYHQEEGQPLMVKEECKEISVSSKSKGVVGLGFGVQELKSLCFVGAQNRYYESPNPYDR

SEQ ID NO: 150963 - protein, 275 aa, Glycine max
  Coding DNA Sequence Number=SeqID_59278
  Homolog annotation: Hit_ID=A2Q454; Match level="QueryCoverage=35%, HitCoverage=42%, E-value=4e-24, Identity=58%"; Hit description =Retrotransposon gag protein
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLMEKHLGKSIATEGGTPEKKDKPESSEVKNDVTLEFRQSAKKVELPSFDGDDPAGWISRAEVYFRVQGTTPAVKVSLAQLCMDGPTVHFFNSILRENEDLGYRARIRNHGHSCFLCEIVIRSQFHTTYEPEA

SEQ ID NO: 150964 - protein, 91 aa, Glycine max
  Coding DNA Sequence Number=SeqID_59279
  Homolog annotation: Hit_ID=Q949K7; Match level="QueryCoverage=48%, HitCoverage=50%, E-value=5e-07, Identity=52%"; Hit description =Putative gag polyprotein
MAKKGKLDHIKEMLKDIEGGRDYAFANLAELYLVSDMVIPPKYKVSDFDRYKETSCPKNHLKMYCRKMGGYVRDEKTFPSPFLEGPNDGLH

SEQ ID NO: 150965 - protein, 92 aa, Glycine max
  Coding DNA Sequence Number=SeqID_59280
DIVSDIVDPAASLLDFYLALYNNSSILGQDVLDIVSDIVDPAASILHLTFHLALFHIDKNVKAKCKSLIGQKNAWDYVMDNWGTLVDCPSEH

SEQ ID NO: 150966 - protein, 107 aa, Glycine max
  Coding DNA Sequence Number=SeqID_59281
MQWFDSKQRRLVAVTADQWRWRRRLGILGEPATLAQAKFGSPGRADPAQILLLRLKYRMSCSRCYIANPNDQNVKHWVVSLESKSESDPPVNKSRIAVLVETGLSKT

SEQ ID NO: 150967 - protein, 76 aa, Glycine max
  Coding DNA Sequence Number=SeqID_59282
MEQHNASHNHYILVIDYQRPPKHAAFISKPGNRLHPLVIDYQKPSKLPDLIFKPGNRLHSLGNRLPETILSSCLQF

SEQ ID NO: 150968 - protein, 151 aa, Glycine max
  Coding DNA Sequence Number=SeqID_59283
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLDQTGIEKR

SEQ ID NO: 150969 - protein, 171 aa, Glycine max
  Coding DNA Sequence Number=SeqID_59284
  Homolog annotation: Hit_ID=A5BTM1; Match level="QueryCoverage=66%, HitCoverage=4%, E-value=4e-12, Identity=35%"; Hit description =Putative uncharacterized protein
GNPSDLQPFDPEIDRTFHRLVRHHFIPFDHSEHSITGESVHSVIGDFEHPDLEHYNFDSEHSDFAHSENMAQPPPHERTLREMAAPDFTYESLCIQYPDEDVPYVLKTGLIHLLPKFHGLAGEDPHKHLKEFHIVCSTMKPPDVQEDHIFLKAFPHSLEGVAKDWLYYLAP

SEQ ID NO: 150970 - protein, 55 aa, Glycine max
  Coding DNA Sequence Number=SeqID_59285
MVLRHVNRWIMMKFEHQVMRILKLAKYRLKAQVEKDEGPKAETLSRLLIVAEGPN

SEQ ID NO: 150971 - protein, 267 aa, Glycine max
  Coding DNA Sequence Number=SeqID_59286
  Homolog annotation: Hit_ID=Q6WAY6; Match level="QueryCoverage=29%, HitCoverage=13%, E-value=3e-11, Identity=42%"; Hit description =Putative uncharacterized protein
LDVTSLKELGRLMGPLQRQAFRKVYGKILDLTAAEVFTEVVVSLAQYYDQPLSKRVGSHEANLERRSGPASEILGRQGKGYGKPREPPLMLSSHITIARKAQWWLSWHICLTPLIGGVRKTVHGLSVVTRSLCVVDFTPIPTRHKTPVSCKVIAHAPKKLSLLGPTFGGDRGQHDQLVSSLEGRQGRSLFSCGDYPNVPLIGTRGCINYNPALTIRQLGYPMRGAPTEESLSPFLVRDLGAQGLKVIQRIHKAWRSSLKKDKELRGI

SEQ ID NO: 150972 - protein, 115 aa, Glycine max
  Coding DNA Sequence Number=SeqID_59287
MELIENIYAHDHAILRDRVHQPTKKSLLELSSQDAVLAQNKLLSRQLEILTETLSKLLTNLSNGQPVQPSILQITGCTICGGTHESGLCIPFEEQMQEVSYMGNQQRQGYNQGGF

SEQ ID NO: 150973 - protein, 172 aa, Glycine max
  Coding DNA Sequence Number=SeqID_59288
  Gene Ontology: Mol. function=oxidoreductase activity; Cellular component=integral to membrane; Biological process=electron transport
  Homolog annotation: Hit_ID=A9CF30; Match level="QueryCoverage=95%, HitCoverage=39%, E-value=1e-84, Identity=90%"; Hit description=D -amino acid dehydrogenase
  Pfam annotation: Domain name=DAO; Domain location=8-172; Score=-42.8; E_value=0.0069; Accession=PF01266.15; Description=FAD dependent oxidoreductase
MTKTLKCDVLVVGTGIIGSMAALYLQNAGRDVVLLERGDISRGASSGNAGILAFPEIIPIPAPGIMKKAPRWLFDPLGPLSVPPAYAPKIAPWLWRFWRASAERSFRHGLKSLMEINRLAAIEMAHIAAMPELSSFISKTGTLDIYDSEASLNAARRDWDEKEKARLRIPAR

SEQ ID NO: 150974 - protein, 253 aa, Glycine max
  Coding DNA Sequence Number=SeqID_59289
  Homolog annotation: Hit_ID=A5C169; Match level="QueryCoverage=65%, HitCoverage=14%, E-value=2e-07, Identity=25%"; Hit description =Putative uncharacterized protein
MVIDQSLFYDLTQLSSEGVPFEGALNDDWKFDFSVHDARRLVCTNQADMTGRLLAGSLAFESRMLHYLIVRILLPRSSNLAQVSEEDLIVMWAFHTGQQIDWAHLVRYRIHKALRLNAPFPYPHLVTLFLQHFNIPLDSEPYVPIKRSFLIDVAVIASFGYHKEHDGSWVKKGAQPIDDEGNLLVGEDSSLLQRILDRFDGLQTNVGERSDALELQVDMQFDEMDSRITKVEGDVTYICTCFDLPQPPPPPSS

SEQ ID NO: 150975 - protein, 140 aa, Glycine max
  Coding DNA Sequence Number=SeqID_59290
MAPTRHPLDLDKSNRALGFSALITGLCQSFGVPVTPSKVIRPPITRAFIEKYCMPRHAQGDAHQATDALPPPRQADPVGSLGMECYLLHLVRQQAANHRGDWPEAQTGEEPAGSPGEVDESHMDEEMTDLLGFLGGSGAT

SEQ ID NO: 150976 - protein, 117 aa, Glycine max
  Coding DNA Sequence Number=SeqID_59291
MKGRGQKFFKARLPLEIILDWQYPTPHERRGKDRNTQLPLHIHHHRENPIDRGRSEEEKGSAFLALLILSKLLRKIISVKKIQARRFRNVSVSNYAKILDRSSRFIVRSSFSSVFNG

SEQ ID NO: 150977 - protein, 312 aa, Glycine max
  Coding DNA Sequence Number=SeqID_59292
  Homolog annotation: Hit_ID=Q6WAY4; Match level="QueryCoverage=63%, HitCoverage=35%, E-value=2e-19, Identity=33%"; Hit description =Putative uncharacterized protein
MGSSQKPSLKKRFYQVKIKSLEVTSLRELGQLMGQLQRQAFRKAYGKIWDLARVEVSMEPIASLSQYYDQPLRCFTFEDFQLVLTVKEFEEILGCPLGGRKPYLFSGFYPSTTRVAKVVIISAQELDRVKQNRNGVVGVPRKCLEERAKALQIKANGLSFIDILALLIFGVVLFPNMEGLVDLAAIDAFLAFHHGKESPVVAILAMILSSCEGCPMRGVPSDESITPFIARGFSDHNARDIKLRGSSNGIIGGYHKWLRVQTQGLDWLPNLKTVRDDEVKASEESDEVQALKAELERAWVVEEKFKSIAIKV

SEQ ID NO: 150978 - protein, 142 aa, Glycine max
  Coding DNA Sequence Number=SeqID_59293
MHLFKTFSRLSKQISKEDPYTVKSSINISMQFSKKITKNTDHAPLEGTRGIAHAERHPPIGKSAEGAVENVEAKLHDESRMIQRCFDDNKGDDKKLKGQSKNEFKMFKIESRKNEFKMFKIESRTLQDSRIKLPRIKIKIQD

SEQ ID NO: 150979 - protein, 219 aa, Glycine max
  Coding DNA Sequence Number=SeqID_59294
  Pfam annotation: Domain name=Retrotrans_gag; Domain location=1-110; Score=7.5; E_value=0.01; Accession=PF03732.8; Description =Retrotransposon gag protein
KAKRWLHSFKGNSLKTWEEVVEKFQKKYFPESKTVEGKTAISSFHQFLDESLSEALERFRGCTICGGTHESGVCIPFEEQTQEGGPSNRPPQQGPDIFQRTTKLEETLTQFMQVTMSNDKSTELALKNLEIQVGQLAKQLAEKSSNSFGANTEKNPKEECNVVMTRNKKCLADEDEDSVALEKQIFVKDGTKKKEEEVTDVTNQESEKPIMVEEKEIND

SEQ ID NO: 150980 - protein, 181 aa, Glycine max
  Coding DNA Sequence Number=SeqID_59295
MTRRDKIWSFCTLVSSRGGGPDDTRRYLMVIRTLVSSRGGGPDDTRRYLTVIRTLVSSRGGEPDDTRRYLTAASPMTRGDTLRLSAPLCHPEAAGPMTRGDTLRLSAPFFHPEAAGPMTRRDKIWSFCTLVSSRGGGPDDTRRYLTVIRTLLSSRGGGPDDTQRQDLVILYPCVIQRRRAR

SEQ ID NO: 150981 - protein, 53 aa, Glycine max
  Coding DNA Sequence Number=SeqID_59296
MDKSLKVGEDEWRERERERRSTKFCASKEAKRAMCAKPECLSVEAELSANMLR

SEQ ID NO: 150982 - protein, 172 aa, Glycine max
  Coding DNA Sequence Number=SeqID_59297
MEGIDKHDAKCRGSTRGFFLDRLRQRPGHIFSEVGKVYAVKWNDVLDNVWHLVDKEENYHNVVYNKDLDQPAIVAGRTTLQDFYQLTEDYPVSLTHYVPCPSHSQDDTLYTIKCQILSSSRTFQVACIIFLKTKVELICTWRMLQNAGSCSIIGGRHLKLEPDGNISARSCC

SEQ ID NO: 150983 - protein, 32 aa, Glycine max
  Coding DNA Sequence Number=SeqID_59298
PWDSCKAILLCYSLFRAFVLGFYVFCFDATVH

SEQ ID NO: 150984 - protein, 105 aa, Glycine max
  Coding DNA Sequence Number=SeqID_59299
MATKMKLCPFEALGPMAPIMSMPHIENGQGATKTFRGLALMAFPHMDATIALHSEPVIPRSQNFSGHGMSIGMRFKGSLMYLYQHLLNLSGIYTSKQYHVMIPLV

SEQ ID NO: 150985 - protein, 50 aa, Glycine max
  Coding DNA Sequence Number=SeqID_59300
MGHTLFVSYLQVHDRPSSLPGIRQAEYVAASQPMGSSSQTLTHKGMGSHG

SEQ ID NO: 150986 - protein, 144 aa, Glycine max
  Coding DNA Sequence Number=SeqID_59301
  Gene Ontology: Mol. function=RNA-directed DNA polymerase activity; Biological process=regulation of transcription, DNA-dependent
  Homolog annotation: Hit_ID=A5ANM4; Match level="QueryCoverage=81%, HitCoverage=7%, E-value=4e-25, Identity=42%"; Hit description =Putative uncharacterized protein
MEPEYWDKNPFKATAKPRYYGSNLNQPKKFSAPFDPAEYNYWDYIDAWTNVFWHQNNKFKHSWLIYFKNNTVYNFPNWFLQWWNYFGPIPQIFPEEVQQGFQQFNKLYNSKESRIPADLKYFSSFALSWIFSWQYRYEKTENRK

SEQ ID NO: 150987 - protein, 128 aa, Glycine max
  Coding DNA Sequence Number=SeqID_59302
VDSRGSPGTGDMSRGSGDLGDVSCELCLIYGIWPLVIDYQGLKNEIRKLRGLLVIDYQGIVMVTQLIHDRVEMECLEGAWETLEGNMRCRIRGMIRFTATSLVHPDEPARMLQRNYGVDTTQALHHIV

SEQ ID NO: 150988 - protein, 36 aa, Glycine max
  Coding DNA Sequence Number=SeqID_59303
MGVAHGGGDHVVLSWLVTLEEEKGILILIIWEISKL

SEQ ID NO: 150989 - protein, 237 aa, Glycine max
  Coding DNA Sequence Number=SeqID_59304
  Gene Ontology: Mol. function=nucleic acid binding; Cellular component= intracellular; Biological process=regulation of transcription
  Homolog annotation: Hit_ID=Q39263; Match level="QueryCoverage=85%, HitCoverage=87%, E-value=3e-29, Identity=37%"; Hit description=Zinc finger protein 4
  Pfam annotation: Domain name=zf-C2H2; Domain location=98-120; Score =19.3; E_value=0.014; Accession=PF00096.17; Description=Zinc finger, C2H2 type
MKQHFDLEVVASAEYESEVSSKVASNISIQETYAGPCSDNLTNSSNVTNPIELHLHSDAISLDLTLKFNNNDFSFSSTSESSNGPLSQTNLAANPRVFSCNYCKRKFFSSQALGGHQNAHKRERTIAKRAMRMGIFSERSLGIKAHSSLHHGFSPTMRPPEMKSSARFEQGYVGLPIFLEEDEAELLWQGSYHQVPSEGGHTHQNFTLSGSSNLSFVGSSLPPVDLENSTPELTLKL

SEQ ID NO: 150990 - protein, 187 aa, Glycine max
  Coding DNA Sequence Number=SeqID_59305
  Homolog annotation: Hit_ID=A5X7Z1; Match level="QueryCoverage=96%, HitCoverage=94%, E-value=3e-40, Identity=50%"; Hit description =Microtubule-associated protein
  Pfam annotation: Domain name=TPX2; Domain location=78-134; Score =28.1; E_value=3.3e-05; Accession=PF06886.2; Description=Targeting protein for Xklp2 (TPX2)
  Subcellular localization annotation: CTP_CleavageSite=48; ConfidenceScore=5.68e-01
MEKAGSNSPKSALKFVKNTSQSAAQWSSTNSRGMTKDVLKDKFYDKTKASRRSPPKESNMASPRSPPRENTKPQEFKLHTQERAVKRAMFNYAVTTKFYIMELQKKQEEKLQKLIEEEEVRLLRKEMVPRAQLMPYFDKPFFPQRSSRSIPRESCLHMMSSKCWSCSVGNEIYNLHHYGHQTLKPIK

SEQ ID NO: 150991 - protein, 324 aa, Glycine max
  Coding DNA Sequence Number=SeqID_59306
  Gene Ontology: Mol. function=protein serine/threonine kinase activity; Cellular component=cytosol; Biological process=protein amino acid phosphorylation
  Homolog annotation: Hit_ID=A9PGJ5; Match level="QueryCoverage=95%, HitCoverage=79%, E-value=1e-113, Identity=61%"; Hit description =Putative uncharacterized protein
  Pfam annotation: Domain name=RIO1; Domain location=106-246; Score =61.4; E_value=3e-15; Accession=PF01163.13; Description=RIO1 family
  Pfam annotation: Domain name=Rio2_N; Domain location=8-89; Score =180.8; E_value=3.5e-51; Accession=PF09202.2; Description=Rio2, N -terminal
  Pfam module annotation: Pfam domain module=RIO1::Rio2_N; Domain location=106-246::8-89
MKLDVDVLRYLSKDDFRVLTAVELGMRNHEIVPTELIDRIARLKHGGTYKVLKNLLKHKLLHHDSSKYDGFRLTYLGYDFLAIKTMVNKGVFVAVGRQIGVGKESDIFEVAREDGTVLAMKLHRLGRVSFRAVKSKRDYLRHRSSYNWLYLSRLAALKEFAFMKALETHGFPVPNAIESNRHCVVMSLVQGYPLVQVKQLLNPETVFEAILGQVVRFNLSFQESIDDIDGSDEGRDEAGKPSFSSIERSAGFLDRELAASGFTRKNEEDIQRFIEGGAESDTNSDSEGVDLVEDLNEADTVDDDSSHLSEQPGGNREAGFISIG

SEQ ID NO: 150992 - protein, 40 aa, Glycine max
  Coding DNA Sequence Number=SeqID_59307
MRSILGIERDEGIGNEGGVEVHHFEYDGVNLEAKMEVVEE

SEQ ID NO: 150993 - protein, 387 aa, Glycine max
  Coding DNA Sequence Number=SeqID_59308
  Gene Ontology: Mol. function=RNA-directed DNA polymerase activity; Biological process=RNA-dependent DNA replication
  Homolog annotation: Hit_ID=A7PTP4; Match level="QueryCoverage=85%, HitCoverage=92%, E-value=1e-116, Identity=57%"; Hit description =Chromosome undetermined scaffold_30, whole genome shotgun sequence
MILNVEMRWVVAEQSNKRSLFQLMDSAPSCSWLQAFSFLALVWLFNCGCVHGATPAVKVGNFSKVEDAGNFHIYYGQTFKVIKNSADGQSYLLLQLLGLVESLKGITSDYVASPCVLKLYEGGQIELFNNSDYQKLAEFSSYFLSDTDQQPACNFATFVPFIEDIPLQRAEWIKFMGAFANVEARANQVYTAVKANYLCLAKIATSRTTFKPTVAWMRYKNGLWSFTQEKYQLKYVQDAGGEILGANKNTYNVSDPDDLEEFHAILCTVEVVIDETLTSDPVNYTFSTFIQNLNVEDRSCFSFISNTSLWRYDKRVYNSVALDWYNGAVSQPQLALADLIEVLFPTENYTTTYFRNIAKAEVPINIGLEMCDRDTSTAMEPTIVACG

SEQ ID NO: 150994 - protein, 925 aa, Glycine max
  Coding DNA Sequence Number=SeqID_59309
  Gene Ontology: Mol. function=metal ion binding; Cellular component =intrinsic to membrane; Biological process=innate immune response
  Homolog annotation: Hit_ID=Q84RS2; Match level="QueryCoverage=96%, HitCoverage=89%, E-value=0.0, Identity=66%"; Hit description=ZR1 protein
  Pfam annotation: Domain name=DZC; Domain location=873-908; Score =74.6; E_value=3.3e-19; Accession=PF08381.2; Description=Disease resistancezinc fingerchromo
  Pfam annotation: Domain name=FYVE; Domain location=502-570; Score =45.9; E_value=1.4e-10; Accession=PF01363.12; Description=FYVE zinc finger
  Pfam annotation: Domain name=RCC1; Domain location=234-281; Score =8.9; E_value=0.079; Accession=PF00415.9; Description=Regulator of chromosome condensation (RCC1)
  Pfam annotation: Domain name=RCC1; Domain location=285-333; Score =25.2; E_value=0.00024; Accession=PF00415.9; Description=Regulator of chromosome condensation (RCC1)
  Pfam annotation: Domain name=RCC1; Domain location=347-396; Score =46.0; E_value=1.3e-10; Accession=PF00415.9; Description=Regulator of chromosome condensation (RCC1)
  Pfam annotation: Domain name=RCC1; Domain location=399-446; Score =16.4; E_value=0.012; Accession=PF00415.9; Description=Regulator of chromosome condensation (RCC1)
  Pfam annotation: Domain name=RCC1; Domain location=450-499; Score =38.6; E_value=2.2e-08; Accession=PF00415.9; Description=Regulator of chromosome condensation (RCC1)
  Pfam module annotation: Pfam domain module=DZC::FYVE::RCC1::RCC1::RCC1 ::RCC1::RCC1; Domain location=873-908::502-570::234-281::285-333::347- 396::399-446::450-499
MEIAKIMYGLINSSPFTDKICKDKAQAASWFVGLKAVISRCQHPRAFSSLRSCKGVQSCASSPAGILRRKKNLGLLDDTSQFTQVHSVCASPTLSLSERCFSDGLSCTSDNFYSSSSFLSNTHGVTDNSVPSSPYIDPDNHSNIESTRIDKEHKKNLSYRYLMHSTSPHVGKNNVLKDVMIWGGGIGCLVGIVNERFVQPRIYSLVPKLLESTAMLDVHNIALGGKHAALATKQGEVFCWGHDLLIEGRTRSQWIPQKLGGSLDGISISSVACGEWHTAIVSSCGRLFTYGDGTFGVLGHGDLRSYSSPKEVESLSGLRVRSAACGSWHTAAIVEVMFDRFRYNSASGKLFTWGDGDEGRLGHVDNGSKLVPTRVTQLVDYDFVQVSCGRMLTVALTNMGKVFAMGSAKYGQLGNPHARDKAVMVEGQLKQEFVKVISTGSYHVAVLTSGGSVYTWGRGENGQLGLGDTEDRYTPCFVEALRDRQVNTITCGPSFTAAISLHKPISISDQSTCTGCRLPFGFTRKKHNCYSCGLLFCRACSSKKITNAPLAPSKSKAFRVCDQCFDKRQGGTHPVMASKSRNHNSQQLLKHQHKIADVTEDRGETTVTQGPLLSLGQSCYRKSMPSGRKDWKSNQESQQDVEDSSPMLGGMPQWGQVPCPAIFKINSTENPVAHVSSSKNKLATVSPFNVESTTYNFSNVETDATKSDKVLLEEVHRLRAEAKRLEEQCELKNHKIQECQQKIEESWFVAREEAAKCKAAKEVIKALALRLHTISGKDNVGQEGKAGPNEFVPNVAPIHTEMKSPRDVNVDSLSNSPIVFSDTLKSKFGRSLFPKIDNSNRAESQQDNIDGLKAEWVEQYEPGVYITFTTLQCGKKGLKRVRFSRKRFSEKEAEKWWEENQGTVYHKYGIEGYINNNTSQSQVKG

SEQ ID NO: 150995 - protein, 32 aa, Glycine max
  Coding DNA Sequence Number=SeqID_59310
MADKGHRKESFLGFHNKWNLIINSKMIDERRT

SEQ ID NO: 150996 - protein, 248 aa, Glycine max
  Coding DNA Sequence Number=SeqID_59311
  Gene Ontology: Mol. function=UTP:glucose-1-phosphate uridylyltransfera se activity; Cellular component=cytoplasm; Biological process =metabolic process
  Homolog annotation: Hit_ID=Q9LKG7; Match level="QueryCoverage=97%, HitCoverage=90%, E-value=7e-78, Identity=75%"; Hit description=UTP- -glucose-1-phosphate uridylyltransferase
  Pfam annotation: Domain name=UDPGP; Domain location=1-200; Score =67.0; E_value=1.7e-17; Accession=PF01704.9; Description=UTP--glucose- 1-phosphate uridylyltransferase
LDPFEQHVEWSKIQTPTDQVVVPYDTLAPIPDEVKNLLDKLVVLKLNGGLGTTMGCTGPKWVNLKAVKRLVEADALKMEIIPNPKEVDGVKVLQLETAAGAAIRFFDKAIGINVPRSRFLPVKATSDLLLVQWDLYTLQDGLVIRNQARANPENPSIELGPEFKKVSYFLSRFKSIPSIVELDSLKVAGDVWFGVGAILKSELRDSTLGAQKSLQRGKVSILAKPGVKQEIPDGAVITNKEINGPEDL

SEQ ID NO: 150997 - protein, 615 aa, Glycine max
  Coding DNA Sequence Number=SeqID_59312
  Gene Ontology: Mol. function=catalytic activity; Cellular component =nucleus; Biological process=metabolic process
  Homolog annotation: Hit_ID=A7PTT1; Match level="QueryCoverage=100%, HitCoverage=100%, E-value=0.0, Identity=69%"; Hit description =Chromosome undetermined scaffold_30, whole genome shotgun sequence
  Pfam annotation: Domain name=AMP-binding; Domain location=41-497; Score=346.4; E_value=5e-101; Accession=PF00501.19; Description=AMP -binding enzyme
MDNLQKCQANYTALTPLTFLMRAAACYANRTSVIHEGTRFTWAQTYERCRRLAFSLRALNIARNDVVSVLAPNIPAMYEMHFAVPMAGAVLNTINTRLDAKNIATILRHSEAKVFFVDYEYVSKAKEALRLLMDDNNNNNLKKGVPKPTNQPHSTTFSLPLVIVIDDINTPTRIRLGELEYEQMVHHGNPNYFPEGIQDEWTPIALNYTSGTTSEPKGVVYSHRGAYLSTLSLILGWEMGSEPVYLWTLPMFHCNGWTFTWGVAARGGTNVCLRTTAARDIYRNIVVHNVTHMCCAPIVFNIILEAKQSERIDIKVINGKRKSPVEILTGGAPPPASLLEQIESLGFHVTHAYGLTEATGPALVCEWKKEWNMLPKKEQAQLKARQGVSVLTMADVDVKNLETMESVARDGRTMGEIVLKGSGIMMGYFKDHKASSKAFGKNGDWFKTGDVGVIHPDGYLEIKDRSKDVIISGGENISSVEVESLLYKHPRVLEAAVVAMPHPRWGETPCAFVSLRKNNNNSSSSKIDDVTEAEIIAYCRKNLPHFMVPKVVKFMEELPKTSTGKIQKFELRVMAKVFVQTKNNTTTVNKKSCQVSQNSIVGGYNNEQVLAASRL

SEQ ID NO: 150998 - protein, 38 aa, Glycine max
  Coding DNA Sequence Number=SeqID_59313
MEKMISPTRDKDVFIVELQVSEGCCGCGPEPDTTNLPF

SEQ ID NO: 150999 - protein, 885 aa, Glycine max
  Coding DNA Sequence Number=SeqID_59314
  Gene Ontology: Mol. function=helicase activity; Cellular component =nucleus; Biological process=tRNA processing
  Homolog annotation: Hit_ID=A7QTT0; Match level="QueryCoverage=98%, HitCoverage=92%, E-value=0.0, Identity=48%"; Hit description =Chromosome undetermined scaffold_171, whole genome shotgun sequence
  Pfam annotation: Domain name=ResIII; Domain location=165-310; Score= -30.6; E_value=0.018; Accession=PF04851.6; Description=Type III restriction enzyme, res subunit
MKMLSEAPACEITDINLSEDYSPPHDLLYQIEMKTIVASDKKGDVYEPEVGHLIALTDKRPTCIDDLNKHGNSYLIALIRKVRKKNDDENVFEVQILASQPIKLEILTTNMRIWNALNSDPDGPVIHVSKQLLQPDSAVGENCAQCYSFQRYTDDGSMIGAAIRLFDLNKAQEEGVLSCLAARECSHKNTVKLIWGPPGTGKTKTVASLLFALLKKKCRTLTCAPTNVAVLEVTSRFLRLVTESIDYHTYGLGDILLFGNRKRMSIDDRDDLLDIFLDYRANILAKCFAPLSGWKHHLEQVILLLENPEEQYREYLKCEEKRDYEIDDDDDCLKEENELHAIASQQTKQEKKHMSKDSKIFLAEMLSNNSITDQQLYKARKECLTKLKSLQKIILPDFFDEYTIKNFCIKRSRMIFCTASSSARLHAVEHYRLEMLVIDEAAQLKECESNIPLQLPGLRHVVLIGDEKQLPALVKSEISGKAGFGRSLFERLVLLGHEKHLLNVQYRMHPSISLFPNMEFYDKQILDSPSVKERSHEKHFLHGDMFKFYSFINVAYGQDEFDEGNSRKNMVEVAVVSEIVLNLYKESASRKQTVSVGVISPYKAQVLAIQDALGKRFVGNVDNDFSLKVSTVDGFQGGEEDVIIISTVRYNNMGYVGFLSNFQRTNVALTRARYCLWIVGNSETLMNSGSVWERLILDARARGCYHNADEDERLSDAIATSVIELGQVSDLLKLDSLLFKKAKWKVCLNQSFLISMARIKSAEICKKICSLLMQLSSGWRQPHRNINIRVLDDTSSQQLELYKVNESLYLAWTIDVLEENSNYVQVLKIWDVLPLSEVSNLVRDVDISYKSSNHLSNYNLPQADPMQFLCNQFSSLRLRDINWNQ

SEQ ID NO: 151000 - protein, 113 aa, Glycine max
  Coding DNA Sequence Number=SeqID_59315
MVIMAVATIVIVVIMHGDNNHNDDSNDNGDGDAGDYKSGIGVGVLGWGDISLWPVIKIGLAGVLILAETYKDYFGAFVERFQLLPIPQPDQMQTLSGLGSLGMTQRKQLHHFD

SEQ ID NO: 151001 - protein, 96 aa, Glycine max
  Coding DNA Sequence Number=SeqID_59316
MSELIVLLKSKSLVEHLRPTMPVFVESNMMNREGMSAAWKAEAIPKLTKKQPKVATLLSRKIPPQAADPGMKRDLKSLQDGEFRDGRAHMTTTQIA

SEQ ID NO: 151002 - protein, 88 aa, Glycine max
  Coding DNA Sequence Number=SeqID_59317
  Homolog annotation: Hit_ID=A7PTN9; Match level="QueryCoverage=95%, HitCoverage=55%, E-value=2e-13, Identity=48%"; Hit description =Chromosome undetermined scaffold_30, whole genome shotgun sequence
MTLGESGFQNPLHGWRMMFFSLETICGSKSFVNNVWYIKILSPPEVIQKMGEQVVESLALSSGQRLNGHSVESQDIVSGPPSTGSLEY

SEQ ID NO: 151003 - protein, 145 aa, Glycine max
  Coding DNA Sequence Number=SeqID_59318
  Gene Ontology: Mol. function=transferase activity
  Homolog annotation: Hit_ID=A2Q1Z1; Match level="QueryCoverage=88%, HitCoverage=35%, E-value=3e-20, Identity=40%"; Hit description =Homeodomain-like
MKEKKIQARIKEAYSNDEKCREFMEKGVTQLKSRLNQIHPLVQKFDGCYKQVVNHRRSGSSKKDLMTNAHMIYSQDTDKKIEVEHAWLLLKEECKFDAEFMGKSSKRTNVFASGGYSLSFNLNAPNEVEEYDTTSPMSRLIGERA

SEQ ID NO: 151004 - protein, 135 aa, Glycine max
  Coding DNA Sequence Number=SeqID_59319
  Gene Ontology: Mol. function=binding; Cellular component=kinesin complex; Biological process=DNA integration
  Homolog annotation: Hit_ID=A9PFT7; Match level="QueryCoverage=98%, HitCoverage=28%, E-value=8e-42, Identity=60%"; Hit description =Putative uncharacterized protein
  Pfam annotation: Domain name=TPR_1; Domain location=69-102; Score =21.6; E_value=0.0028; Accession=PF00515.19; Description =Tetratricopeptide repeat
  Pfam annotation: Domain name=TPR_2; Domain location=69-102; Score =19.6; E_value=0.012; Accession=PF07719.8; Description=Tetratricopepti de repeat
  Pfam module annotation: Pfam domain module=TPR_1::TPR_2; Domain location=69-102::69-102
MTLGISASTVFAEDATTEAYPDNDPGGDLIGLRKIEDGSVGKLDEAEKLFLSAIEEAKEGFGEKDPHVASACNNLAELYRVKKAFDKAEPLYLEAINILEESFGPDDVRVGVAVHNLGQFYLGQRKLEEARVSYE

SEQ ID NO: 151005 - protein, 240 aa, Glycine max
  Coding DNA Sequence Number=SeqID_59320
  Gene Ontology: Mol. function=protein binding
  Homolog annotation: Hit_ID=A9PFT7; Match level="QueryCoverage=87%, HitCoverage=38%, E-value=2e-45, Identity=49%"; Hit description =Putative uncharacterized protein
MKLENVARTVMSQICCHRQKHDAFGVIQGWNSLDTVIAAESLALTLQASGNTKDSKEFLERCLNVRKDLLPGDHIQIGANLLHLARVAMLDCSQHKKLDVSRAKAELDMAKNHLHNSIRISCQCLEKVLKQKDKLKKFSKPGDSRKEGQVALAILLQSLNTLSSVELDKQELQEIQEKDINLEAREALLQCISAYKEFVHKRSIADTPEIKKEYLSCLKRAQNLFGHKVDEELSNQNDFR

SEQ ID NO: 151006 - protein, 154 aa, Glycine max
  Coding DNA Sequence Number=SeqID_59321
MGEVEEIQEKMKADMEAIKEKMTTMMEAMMSVKKIMEANAVAIAATSVVAKVNLMSPSGIKQMNHPTSDMVGKDLGSTGGPHDVQIQNEHAFPSYGLPLNYTPPNVAYTPNKNTHEIPHHNLADFEPWLGYATEGQAVGGSGPLKEVKIMPLLT

SEQ ID NO: 151007 - protein, 160 aa, Glycine max
  Coding DNA Sequence Number=SeqID_59322
MKRWWAAHPQSFADLVFASERINVGPKRGKFDHPTRTTEKTGANKEGEDEGETHAVTAIPVRPSFPPTQQYLYSANNKLSPYPPPSYPQRPSLNLPQSLSTALPMTNTTFSTNQKHQPRTITLAEVHQPPFLREYDSNATCACHGEAPGRSIEHGRALKA

SEQ ID NO: 151008 - protein, 33 aa, Glycine max
  Coding DNA Sequence Number=SeqID_59323
MNRGARGRVRVDARPVISRSSSRVQLKTLKKHY

SEQ ID NO: 151009 - protein, 130 aa, Glycine max
  Coding DNA Sequence Number=SeqID_59324
MRGAPAEESLSPFVVIDFGAQSSKIIQRVHKAWEISLRRNKELRGIRSGIIGVWLSKLKVINEENFEAPEEDEEVRALKTELGKAKLAKEKFKLVVTDVQKECTRLREENAATARALERETKRARKEEYG

SEQ ID NO: 151010 - protein, 290 aa, Glycine max
  Coding DNA Sequence Number=SeqID_59325
  Gene Ontology: Mol. function=transporter activity; Cellular component= integral to membrane; Biological process=cell division
  Homolog annotation: Hit_ID=Q4J2V5; Match level="QueryCoverage=100%, HitCoverage=28%, E-value=1e-97, Identity=64%"; Hit description =Acriflavin resistance protein precursor
MLALTSATRTPGELYDLAESKIEQAMGQVRGVGEVSLMGSALPAVRIDLQPQQLTHYGIALDTVRSAVASSTTNLPKGMLQGSSQSWMVDGNGQLDKAAQYRDLIVSYHAGKAVRLHDVATVYDSVEDQYQAGFLNSQPSVMIAIKRQAGANMLDTIDAIKAQLPQLEKDLPADTQLKVVVDRSPTVRASLYDTEETLLVAMLLVIAVVFVFLRNLQAVVIPALALPVSLIGTCAVMYLLGYSLDNLSLMALIIATGFVVDDAIVVLENITRHIEAGLSPLRAALRGAHE

SEQ ID NO: 151011 - protein, 132 aa, Glycine max
  Coding DNA Sequence Number=SeqID_59326
  Homolog annotation: Hit_ID=B0HC01; Match level="QueryCoverage=25%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPSPIPCNWIPTAYYRILKSQNNV

SEQ ID NO: 151012 - protein, 139 aa, Glycine max
  Coding DNA Sequence Number=SeqID_59327
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPSILMGGLLSVREP

SEQ ID NO: 151013 - protein, 110 aa, Glycine max
  Coding DNA Sequence Number=SeqID_59328
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPY

SEQ ID NO: 151014 - protein, 312 aa, Glycine max
  Coding DNA Sequence Number=SeqID_59329
  Gene Ontology: Mol. function=signal transducer activity; Cellular component=membrane; Biological process=signal transduction
  Homolog annotation: Hit_ID=A4WAU0; Match level="QueryCoverage=92%, HitCoverage=75%, E-value=1e-128, Identity=84%"; Hit description =Methyl-accepting chemotaxis sensory transducer
  Pfam annotation: Domain name=MCPsignal; Domain location=68-290; Score= 250.2; E_value=4.4e-72; Accession=PF00015.12; Description=Methyl -accepting chemotaxis protein (MCP) signaling domain
YEEVTAGNLGVSIPEFGNNCAGRLIPGINSLSGNIATLVREIRASSQTAMTLSDQLSSRSAQLSVKTEQQSASLVQTAASMEQMAASTKNNADNTRLASEQANMATRQARKGGELMGQVATNMESITECAQQMTEIISLIDGIAFQTNILALNAAVEAARAGDHGKGFSVVAEEVRNLAHRSAEAAKNIKALIEVTSSNVSQGATVVSEAEKNMQEIVAGSGNVSRLMDEISASTSEQEKGISQITLALSELERVTQSNVAMAEELNGSSDVLRNQVIELQARTRNFRLDQGTPSSLSSGSPSFLQRPEHSL

SEQ ID NO: 151015 - protein, 316 aa, Glycine max
  Coding DNA Sequence Number=SeqID_59330
  Homolog annotation: Hit_ID=Q6WAY4; Match level="QueryCoverage=58%, HitCoverage=33%, E-value=1e-20, Identity=35%"; Hit description =Putative uncharacterized protein
MGKNQNGKRVYQVKVKGLDVTSLKELGRLMGPLQRQAFRKVYGKILDLTIAEVFTEAVVSLAQYYDQPLRYFTFGDFQMVPTIEEFEEILGCPLGGRKPYLFSGFLPSLSKVAAVIGDSAKELDRIKQIRNGVVGLPRKYLEDKARDMASQEKWGPFADVLALLIFGVVLFPNVDGLVDLAAIDAFLAYHHSKESPVVAILADLFDTFDRRGCINYNPALAIRQLGYPMRGAPTAESLSPFLARDLGAQGLKVIQRIQEAWRRPLRKDKELRGIRNGVIGGYHGWLRIHTRGLDWLSKLKVIDEENFEATKEDEEV

SEQ ID NO: 151016 - protein, 207 aa, Glycine max
  Coding DNA Sequence Number=SeqID_59331
MDNEEGVQEQMKVDLSALKDQMASISEVMLKLQKTIEDKATTTASSTVREAESVLQPTLTPGRDRNTAVFGRRYSPQAYPYGLPPDFTPRAAPEDLSQAPTFEGQLPPYDDYPGQDDEEGDTHLGPLLHLKDPSPHELPQPNIVRHIPASPTPVKESVPFTEDKEKIEALEERLRAVEGLGNYPFSDLADLCLVPNIVIPQVQSTGL

SEQ ID NO: 151017 - protein, 80 aa, Glycine max
  Coding DNA Sequence Number=SeqID_59332
  Homolog annotation: Hit_ID=A5BQ25; Match level="QueryCoverage=72%, HitCoverage=10%, E-value=1e-07, Identity=44%"; Hit description =Putative uncharacterized protein
MASSNSLFLEGNSIHRPPIFNDKWTEEDRRRIQYDLKAKNIITSALGIDEYFRVSNCTNAKEMWDTLQLTHEGTTDVKRS

SEQ ID NO: 151018 - protein, 230 aa, Glycine max
  Coding DNA Sequence Number=SeqID_59333
MLRLIFSLVLQEYNKMKPCKVSYQNIKQKMNFGNQELPVLTNEFHYPGREAVNDKFNCLIDNIWNIPKNTNNNEQFVCSVKKGIIYALYNFCIADNQRVPLLTKASPSGKGYTAFVLLSGPHKGVYTNFKDLCLAKEGIQSPIYKGFYSREEAEKALELNTTDINKIKRSLEPENPTIIINAGQTKTSQKTYKDTVSPNTPGSTNDLNLDNFKKIQSLLFKESQARHGPV

SEQ ID NO: 151019 - protein, 130 aa, Glycine max
  Coding DNA Sequence Number=SeqID_59334
  Gene Ontology: Mol. function=phosphoprotein phosphatase activity; Biological process=intracellular signaling cascade
  Homolog annotation: Hit_ID=A7PHV0; Match level="QueryCoverage=65%, HitCoverage=25%, E-value=7e-20, Identity=49%"; Hit description =Chromosome chr13 scaffold_17, whole genome shotgun sequence
MGTLHDFGSIEYSFYNRILTTRTQFLWEPYTATVMSMLPPICLVGSMSWCAVVPLICFHVVEWHQPDRVLRQFGMQQPIPESPSQPWNVHGLTLKGKMDENWFQLLPHLSVSGIIELSLGSTFMLDKRAC

SEQ ID NO: 151020 - protein, 103 aa, Glycine max
  Coding DNA Sequence Number=SeqID_59335
MVKSVGVQFHEEVEIKEVRVQVLLACASSSKFISETEDTLSPLLMIIHITVMSTNDPEFHFRQWLYLLDAHAKRFFQDYHGIPSSPLNCGASNRTPVKAPACS

SEQ ID NO: 151021 - protein, 286 aa, Glycine max
  Coding DNA Sequence Number=SeqID_59336
  Homolog annotation: Hit_ID=Q84VI1; Match level="QueryCoverage=99%, HitCoverage=41%, E-value=1e-112, Identity=76%"; Hit description =Envelope-like protein
MATSPKETSASGSPAVPSSPHQEQPEFKIQPIQIIPGQASVPEKLVPRRQQGVKIAENPSLATSPREVDTEMDKKIRGIVSSILKDASVPDAEKDVPTSSTPDVSVPDVNKDVPTSSAPNAEVLPSPSEEESTEEEDQASEETPAPRAPEPAPGNLIDLEEVESDEEPIANRLAPGIAERLQSRKGKTPIKRSGRIKTMAQKKSTPVTPATSRRSKVAIPSKKRKEISSSDSDDDVELDVSTSKRAKKSGRKVPENVPDAPLDNISFHSIGNVEKWKYVYQRRLAG

SEQ ID NO: 151022 - protein, 110 aa, Glycine max
  Coding DNA Sequence Number=SeqID_59337
MRDDKRFLYVIGIRVNSGVGLGGKFLVALEPAPKWALPPGRVVVGAGAWRASLWMGAGALGYTGAELEESPARAEKLGCSDPPSIGTYEGDLIELPSLQTYFDSLPGKYQ

SEQ ID NO: 151023 - protein, 218 aa, Glycine max
  Coding DNA Sequence Number=SeqID_59338
  Homolog annotation: Hit_ID=Q6WAY4; Match level="QueryCoverage=100%, HitCoverage=36%, E-value=6e-14, Identity=27%"; Hit description =Putative uncharacterized protein
MEEFKEILGCPLGGRKPYLFSGFLPSLSKIAVVVGDSARELDRMKQTRNGIVGLPQKYLEGKARDMASQEEWVPFVDILALLIFGVVLFPNVDGLVDLTAIDAFLAYHHSKESLVVAILADLFDTFDRRCEKNSTWIVCCLPALCVWLVSCLFQQDIRRPCPLQSYRSCVEKRRVDWDQYLAGIRGSAINWFPRWKEGNEGVLFSYGDYPNVPLIGTR

SEQ ID NO: 151024 - protein, 129 aa, Glycine max
  Coding DNA Sequence Number=SeqID_59339
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=52%, HitCoverage=38%, E-value=8e-23, Identity=73%"; Hit description =Chromosome chr4 scaffold_32, whole genome shotgun sequence
  Pfam annotation: Domain name=APC10; Domain location=1-109; Score= -58.5; E_value=0.00035; Accession=PF03256.7; Description=Anaphase -promoting complex, subunit 10 (APC10)
LIVLYVVFKLDESYTPSKVSIRAGDGFHNLKEIKTVELVKPTGWVYLSLSGADPRTWALVIATFPNNILNFNLLKRGHKHGILLLVYGFEIDTINLRSLKICFLESVGEEGFDFFLHLIRFICPFTFNE

SEQ ID NO: 151025 - protein, 131 aa, Glycine max
  Coding DNA Sequence Number=SeqID_59340
MATQLIHDHVVMECLEGVWETLEGNGRCRFRGTIRLTATSLPVGWILPTPTPYRLVEPVQVIEVSSSEEDLEEDPEELPPEPAMDAPDLPEDDEDPLPDVDSLEDIMSASEADSTEESSPGGTTICDDSSS

SEQ ID NO: 151026 - protein, 76 aa, Glycine max
  Coding DNA Sequence Number=SeqID_59341
  Homolog annotation: Hit_ID=A6FJQ2; Match level="QueryCoverage=50%, HitCoverage=84%, E-value=3e-11, Identity=92%"; Hit description=50S ribosomal protein L5
MTGGKPLTHAAPGDGHSLSMRKEKIPHQAPFAIQAAQLLGRAIGAGLFAITPAGERGMCCKAIKLGNARVFPVTTL

SEQ ID NO: 151027 - protein, 86 aa, Glycine max
  Coding DNA Sequence Number=SeqID_59342
  Subcellular localization annotation: CTP_CleavageSite=46; ConfidenceScore=5.68e-01
MLSLAHQWAKRASTAKRNFSTLSAIEESGRASISRSRAKRKINALSAAVVFSQLSARLVLSSNPLTRTKRKGGASATSQIQSLFKA

SEQ ID NO: 151028 - protein, 124 aa, Glycine max
  Coding DNA Sequence Number=SeqID_59343
MNSQEIDVAKSYSIEKSQRTPVLELYTQEILVGKLAEEVTQCVARIEEDLVEIEAQEEIPSKEHGLRGKDEMKGEEKAQQWEEYLQQDIQQEIKIFAIVYPLSANLALSAQSSHAKPSLLALST

SEQ ID NO: 151029 - protein, 57 aa, Glycine max
  Coding DNA Sequence Number=SeqID_59344
MRGVATNVYSRKTSEKPERCGLRTLSVKGLGVISMHGEGCFPCSYIFLNCDEEIRPM

SEQ ID NO: 151030 - protein, 218 aa, Glycine max
  Coding DNA Sequence Number=SeqID_59345
  Homolog annotation: Hit_ID=Q5QJQ3; Match level="QueryCoverage=14%, HitCoverage=24%, E-value=5e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPISRYMLLSVIDNIDQEQAMKYKSTIDAQGYRARIRNHGHSCFLRETCRASCINESANARGEAVCVLGALPLPRSLTRCARSFGCGERYQLTQRRSFAPSWAVCTNPPFSPTAAPYPVTIVLSPT

SEQ ID NO: 151031 - protein, 131 aa, Glycine max
  Coding DNA Sequence Number=SeqID_59346
MKREKHVSYSSHNSCKSLSAELRDYYEGRRMSHLRPHSHRREKERMPQGANINLPYFYRKDNVEANLDWKIRVEQQHKKKSTSKSYGSHSYPKKDQGQGILGVTPSKPKDDKGKTIEKQAPKASMQEKTSL

SEQ ID NO: 151032 - protein, 252 aa, Glycine max
  Coding DNA Sequence Number=SeqID_59347
  Gene Ontology: Mol. function=oxidoreductase activity; Cellular component=glycerol-3-phosphate dehydrogenase complex; Biological process=electron transport
  Homolog annotation: Hit_ID=A9CKL1; Match level="QueryCoverage=71%, HitCoverage=40%, E-value=3e-93, Identity=93%"; Hit description =Oxidoreductase
  Pfam annotation: Domain name=DAO; Domain location=37-252; Score=28.2; E_value=1.6e-07; Accession=PF01266.15; Description=FAD dependent oxidoreductase
MAEVTNIPNPGHTSSWYAASANVKTVRPTLEGALEADVCVIGGGFTGISAALELSERGYAVIVLEGVRVGFGASGRNGGQIVNGYSRDLETIAGRYGHDKAVKLGEMSLEGGTIIRNRVTKYAIDCDLVDGGFFAAFTSKQIREMEAHKAHWEKHGHGGLEMVSGADVGRYVKTDRYAGRGGGCRKPGRSDIRKFAGHCGRAGGKPRRADGNGQREGEICSRLRQCLSRQVAAGNWRTDDAGLEPGHGNGAA

SEQ ID NO: 151033 - protein, 105 aa, Glycine max
  Coding DNA Sequence Number=SeqID_59348
  Gene Ontology: Cellular component=mitochondrion
  Homolog annotation: Hit_ID=Q5MA28; Match level="QueryCoverage=37%, HitCoverage=39%, E-value=5e-12, Identity=86%"; Hit description =Putative uncharacterized protein orf108
MSPEQFQYIWRKTIPHIEVGMGSGVFTSHRSARPHSSKLAPLGEEGFSIAKDSIQPQVPLRLPCYDFTPVEDPTVGPGTYSPRHADPRLLAIPTSCSRVAENNPN

SEQ ID NO: 151034 - protein, 73 aa, Glycine max
  Coding DNA Sequence Number=SeqID_59349
MAYSLVVGASSHLFSFVFHCISLGDLVLKKMSHAVKDNRCEKGFYWRSLVLTNMDGEEQPLPVNSDAVKRYYA

SEQ ID NO: 151035 - protein, 190 aa, Glycine max
  Coding DNA Sequence Number=SeqID_59350
  Homolog annotation: Hit_ID=A5B939; Match level="QueryCoverage=37%, HitCoverage=52%, E-value=9e-23, Identity=69%"; Hit description =Putative uncharacterized protein
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNCYRPLQWINEIPTVPVYYPSETHSLRDRGLAESAGKEDPVELDSSPTL

SEQ ID NO: 151036 - protein, 136 aa, Glycine max
  Coding DNA Sequence Number=SeqID_59351
GIAPKRHPVDPEKSNRALGFPALVTGLYQSYRVLVPPRQGHIIIGIAPARHLVDPKKSNRFYGVPVTSSKGIRPPTNRAFIKKYCVSRQAQDETPQQPGDDAPPPPLEFTSAHPQKGLSIAYDTWPTNRQPSPKPK

SEQ ID NO: 151037 - protein, 272 aa, Glycine max
  Coding DNA Sequence Number=SeqID_59352
  Homolog annotation: Hit_ID=Q6WAY6; Match level="QueryCoverage=24%, HitCoverage=11%, E-value=1e-07, Identity=44%"; Hit description =Putative uncharacterized protein
MGTRGCISYNPVLAIRQLGYPMRGAPLEDELAPVISRGFNKTNVETLQKVRKAWEVLQKKDKELRGSNNGLIGGYRKCLRTAKREEVEAPEEDEEVQALRMELKQAQTVKERFKSAALKIQKENAELRDINIATTKALEQETKRACREEHGRNKFRGALWGSNSDLKLRREERDQSRVDKTNMLAIITKYQEELNLAAAHEHRVADEYAQVYAEKEARGRVIDSLHQEATIWMDRFALTLNGSQELPRLLAKAKAMADTYFALEEIHELLGY

SEQ ID NO: 151038 - protein, 127 aa, Glycine max
  Coding DNA Sequence Number=SeqID_59353
WGTNQTGKRFYQVKVKSLDTTSIKELGRLMEPLQMQAFRKTYGKILELTIAEVSIEAIASLTQYYDQPLRCFTFGDFQLGKKTIPFLRVTPLFEQNCNCGQGFSKRFGSHKTDSKRHSGPTTKVPRR

SEQ ID NO: 151039 - protein, 99 aa, Glycine max
  Coding DNA Sequence Number=SeqID_59354
LSVEKLASTVLWKLSTPCSYTETESWGWYMFPMLPHSMFGYFVLNGVHSIISLILAFILDRAAHHHRFPFEIGCNDSCGQFALIIVFNLELSVWTVWGD

SEQ ID NO: 151040 - protein, 148 aa, Glycine max
  Coding DNA Sequence Number=SeqID_59355
MGKAEEVQEKVKANMEAMKEKMATMMEAMMSMKKIMEVNAVTIVATSTVAKVNLMPPSGLNQMNHPTLDMVGKDLGSRDDLHDVQNQNKHAFPPYGLPPNYTPPNVAYTLNGDVNNSTPISIESQQPRTIMHMSLKPWGRHMKFLTTI

SEQ ID NO: 151041 - protein, 212 aa, Glycine max
  Coding DNA Sequence Number=SeqID_59356
  Homolog annotation: Hit_ID=Q4VPE9; Match level="QueryCoverage=25%, HitCoverage=29%, E-value=1e-12, Identity=74%"; Hit description =Lateral organ boundaries-like 1
  Pfam annotation: Domain name=DUF260; Domain location=94-175; Score= -9.1; E_value=8.1e-05; Accession=PF03195.5; Description=Protein of unknown function DUF260
MTVKTSDTCSSRRRSQLVCKRMPGADKPVRARQRMRKEKIPHQAPFAIQAAQLLGRAIGAGLFAITPAGERGMCCKAIKLGNARVFPVTTLIPPYFRSDECKKFAKVHKVFGASNVSKILVEVPEEQRAVCVLGALPLPRSLTRCARSFGCGERYQLTQRRSFAPSWAVCTNPPFSPTAAPYPVTIVLSPTRISRARYVGGATEFLKWWANY

SEQ ID NO: 151042 - protein, 128 aa, Glycine max
  Coding DNA Sequence Number=SeqID_59357
  Homolog annotation: Hit_ID=Q0ZCD0; Match level="QueryCoverage=75%, HitCoverage=7%, E-value=4e-07, Identity=28%"; Hit description =Integrase
VDSRGSPAPVARLCGLCSSADHHTDLCPSVQQSEAIEQSEAYAANIYNRPPQPQQQNQPQQNNYDLSSNRYNPGWRNHPNLRWSNPSQQQQQQQQPYFQNVAGPSRPYVPPPIQQQQQQQQPQKQQTV

SEQ ID NO: 151043 - protein, 150 aa, Glycine max
  Coding DNA Sequence Number=SeqID_59358
MTTLTQTWMTLLLSNVLPSDHNSDLPLPKYQLVYAILTRMSVHVAQVIVDAIYLFAGMPPTRHPLDPDKSNRALGFLALITGLCQSFGVPVTPSKVIRPPITRAFIEKYYTPRQAQGDAPQAADAPPPPHQADPAGSLGMECYLQHLVRQ

SEQ ID NO: 151044 - protein, 566 aa, Glycine max
  Coding DNA Sequence Number=SeqID_59359
  Gene Ontology: Cellular component=cell outer membrane; Biological process=membrane organization and biogenesis
  Homolog annotation: Hit_ID=A8G9P3; Match level="QueryCoverage=100%, HitCoverage=73%, E-value=0.0, Identity=64%"; Hit description=Organic solvent tolerance protein precursor
  Pfam annotation: Domain name=OstA_C; Domain location=100-481; Score =392.8; E_value=5.3e-115; Accession=PF04453.5; Description=Organic solvent tolerance protein
PYLQLPIGDRRRSGFLIPNAKYGSNNGFEFMLPYYWNIAPQVDATITPHYMSKRGLQLQNEFRYLTQFVAGLLELDYLPSDNQYNKDKAARPSVQNDSNDDRWLFYWRHSGVYDQHWRFNADYTKVSDPYYFNDLDSKYYSSTDGYATQKFSVGYADTNWDATLSSKDFQVFGNTSSQNVYRAMPQLDVNLYQNDIGPFDGRIYAQAVKFTNVSNRMPEATRLHIEPTLNLPLSNGWASLDTEAKLLATHYQQDNVNYYNENIDTTRTNQLKESVNRTLPAVQGYTQTLEPRVQYLYIPYRNQSNIYPYDSTLLQTDYTGLFRDRTYSGLDRIASSNEVATGVTTRIYDNDLVERFNVSVGQIYSFTPSRTGVNQTNKEDDTGSLVWAGDTYWKVSDRWGVRGGLQYDTRLDNVSQGNAIVEYRRDADRMVQLSYRYSSPEYVAQALSGSGLIDNPSYQKIYKNGISQVGATASWPIADAWSLVGGYYYDTRNSRPAEQLVGLQYSSCCYAIRLGYERKINGWENNDSKYDNQISFNIELRGLSSNYGLGTNEMLRQGIIPYQRAF

SEQ ID NO: 151045 - protein, 1048 aa, Glycine max
  Coding DNA Sequence Number=SeqID_59360
  Gene Ontology: Mol. function=carbamoyl-phosphate synthase (glutamine -hydrolyzing) activity; Cellular component=cellular_component; Biological process=pyrimidine nucleotide biosynthetic process
  Homolog annotation: Hit_ID=Q8ZIL4; Match level="QueryCoverage=99%, HitCoverage=99%, E-value=0.0, Identity=90%"; Hit description =Carbamoyl-phosphate synthase large chain
  Pfam annotation: Domain name=ATP-grasp; Domain location=674-821; Score=-81.8; E_value=0.048; Accession=PF02222.13; Description=ATP -grasp domain
  Pfam annotation: Domain name=ATP-grasp_3; Domain location=648-823; Score=-36.4; E_value=0.0036; Accession=PF02655.5; Description=ATP -grasp domain
  Pfam annotation: Domain name=CPSase_L_D2; Domain location=128-364; Score=493.3; E_value=2.9e-145; Accession=PF02786.8; Description =Carbamoyl-phosphate synthase L chain, ATP binding domain
  Pfam annotation: Domain name=CPSase_L_D2; Domain location=674-858; Score=32.1; E_value=8.2e-14; Accession=PF02786.8; Description =Carbamoyl-phosphate synthase L chain, ATP binding domain
  Pfam annotation: Domain name=CPSase_L_D3; Domain location=424-547; Score=230.3; E_value=4.4e-66; Accession=PF02787.10; Description =Carbamoyl-phosphate synthetase large chain, oligomerisation domain
  Pfam annotation: Domain name=CPSase_L_chain; Domain location=558-672; Score=100.3; E_value=6.2e-27; Accession=PF00289.13; Description =Carbamoyl-phosphate synthase L chain, N-terminal domain
  Pfam annotation: Domain name=CPSase_L_chain; Domain location=6-126; Score=222.1; E_value=1.3e-63; Accession=PF00289.13; Description =Carbamoyl-phosphate synthase L chain, N-terminal domain
  Pfam annotation: Domain name=Dala_Dala_lig_C; Domain location=674 -844; Score=-100.3; E_value=0.0042; Accession=PF07478.4; Description =D-ala D-ala ligase C-terminus
  Pfam annotation: Domain name=GARS_A; Domain location=136-303; Score= -119.4; E_value=0.072; Accession=PF01071.10; Description =Phosphoribosylglycinamide synthetase,
  Pfam annotation: Domain name=MGS; Domain location=930-1016; Score =117.2; E_value=4.9e-32; Accession=PF02142.13; Description=MGS-like domain
  Pfam annotation: Domain name=RimK; Domain location=126-327; Score= -72.0; E_value=0.077; Accession=PF08443.2; Description=RimK-like ATP -grasp domain
  Pfam module annotation: Pfam domain module=ATP-grasp::ATP-grasp _3::CPSase_L_D2::CPSase_L_D2::CPSase_L_D3::CPSase_L_chain::CPSase_L _chain::Dala_Dala_lig_C::GARS_A::MGS::RimK; Domain location=674 -821::648-823::128-364::...
  Pfam module annotation: Domain location=674-858::424-547::558-672::6 -126::674-844::136-303::930-1016::126-327
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLAEFGVTMIGATADAIDKAEDRRRFDVAMKSIGLDTARSGIAHTMEEALAVAEEVGFPCIIRPSFTMGGTGGGIAYNREEFEEICERGLDLSPTNELLIDESLIGWKEYEMEVVRDKNDNCIIVCSIENFDAMGIHTGDSITVAPAQTLTDKEYQIMRNASLAVLREIGVETGGSNVQFSVNPKDGRLIVIEMNPRVSRSSALASKATGFPIAKVAAKLAVGFTLDELMNDITGGRTPASFEPSIDYVVTKIPRFNFEKFAGANDRLTTQMKSVGEVMAIGRTFQESMQKALRGLEVGASGFDPKVDLDDGEALTRIRRELKDAGSDRIWYIADAFRAGMSVDGVFNLTNVDRWFLVQIEELVRLEEQVAREGVNSLSADFLRALKRKGFADVRLATLAGVAESEIRKLRHQFNLHPVYKRVDTCAAEFATDTAYMYSTYEEECEANPNQDRDKIMILGGGPNRIGQGIEFDYCCVHAALALREDGYETIMVNCNPETVSTDYDTSDRLYFEPVTLEDVLEIVRIEQPKGVIVQYGGQTPLKLARALEAAGVPVIGTSPDAIDRAEDRERFQQAVDRLKLKQPANATVATLEQAVEKAAGIGYPLVTAVSVSNDAPVLLDRFLDDAVEVDVDAICDGERVLIGGIMEHIEQAGVHSGDSACSLPAYTLSTEIQNVMRQQVEKLAFELNVRGLMNVQFAVKDNEVYLIEVNPRAARTVPFVSKATGVPLAKVAARVMAGKTLAEQGVTEEVIPPYYSVKEVVLPFNKFPGVDPILGPEMRSTGEVMGVGRTFAEAFSKAMLGAQSNMKKQGRALLSVREGDKKRIVDLAAKLQKFGFELDATHGTAVVLGEAGINPRLVNKVHEGRPHIQDRLKNGEYTYIVNTTAGRQAIEDSKLIRRSALQYKVHYDTTLNGGFATAMALNADPTEKVISVQEMHAQIKG

SEQ ID NO: 151046 - protein, 381 aa, Glycine max
  Coding DNA Sequence Number=SeqID_59361
  Gene Ontology: Mol. function=isoleucine-tRNA ligase activity; Cellular component=cytoplasm; Biological process=tRNA aminoacylation for protein translation
  Homolog annotation: Hit_ID=A8ALT6; Match level="QueryCoverage=100%, HitCoverage=40%, E-value=0.0, Identity=84%"; Hit description =Isoleucyl-tRNA synthetase
  Pfam annotation: Domain name=Anticodon_1; Domain location=128-286; Score=205.7; E_value=1.1e-58; Accession=PF08264.4; Description =Anticodon-binding domain
  Pfam annotation: Domain name=zf-FPG_IleRS; Domain location=341-370; Score=59.0; E_value=1.7e-14; Accession=PF06827.5; Description=Zinc finger found in FPG and IleRS
  Pfam module annotation: Pfam domain module=Anticodon_1::zf-FPG_IleRS; Domain location=128-286::341-370
MYLKGSDQHRGWFMSSLMISTAMKGKAPYRQVLTHGFTVDGQGRKMSKSIGNTVAPQDVMDKLGADILRLWVASTDYSGEMAVSDEILKRAADSYRRIRNTARFLLANLAGFNPATDCVSPEEMVVVDRWAVGRALAAQQDIVQSYENYDFHEVVQRLMHFCSIEMGSFYLDVIKDRQYTAKGDSLARRSCQTALWHIAEALVRWMAPIMSFTADEIWGYLPGERPQYVFTEEWYQGLFGLAQDEALNDAYWAELLKVRGEVNKVIEQARSDKRIGGALEATVTLYADPELAAKLQALGDELRFVLLTSGATVADYVTASDEAQQSELLKGLKIALHKAEGEKCPRCWHYTTDVGQNPEHAAVCGRCYTNVAGNGEVRKFA

SEQ ID NO: 151047 - protein, 101 aa, Glycine max
  Coding DNA Sequence Number=SeqID_59362
MANKTSCPMKQKPPTLIPKTIPKLQNSLRICELQNKERETRLKRAIKGINSRTHQQESSQGYCASNQWGKTHQMIIMMDGSNSHKGKIITFKLSFQNYHDM

SEQ ID NO: 151048 - protein, 66 aa, Glycine max
  Coding DNA Sequence Number=SeqID_59363
MVGYTPSSFADLVFAGERIEVGLKRGKFDYPALMNEKAGANEENEKEGGTHVVTVIPTWPNLPPTP

SEQ ID NO: 151049 - protein, 104 aa, Glycine max
  Coding DNA Sequence Number=SeqID_59364
  Homolog annotation: Hit_ID=A6FJQ2; Match level="QueryCoverage=36%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGFPSHDVVKTDGQCQACMPA

SEQ ID NO: 151050 - protein, 190 aa, Glycine max
  Coding DNA Sequence Number=SeqID_59365
LQIVPFVVRLMKQANVFPLKKTLKNFIIWEINSDKGILKEDFQASSRVPIINKDNGGHTLVTMSNHKSTESALKNLEVQVGQLAKQMADKSSNSFVENIEQNPKEECKAVMTRSKRFVEAKDVDSVVHKKKTADKKGTDGKKNERKNNKNAKKSRSEKAVDEGVEVPYPVVPSKKEKDRHLARFLDIFRK

SEQ ID NO: 151051 - protein, 53 aa, Glycine max
  Coding DNA Sequence Number=SeqID_59366
MTRPRPHCKVSPRVTNSWVMTAKGGVVDKSKALAPTYPPMRNSDCGAKKSLAH

SEQ ID NO: 151052 - protein, 392 aa, Glycine max
  Coding DNA Sequence Number=SeqID_59367
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=57%, E-value=0.0, Identity=84%"; Hit description =Photosystem I P700 chlorophyll a apoprotein A2
  Pfam annotation: Domain name=PsaA_PsaB; Domain location=1-392; Score =474.7; E_value=1.2e-139; Accession=PF00223.10; Description =Photosystem I psaApsaB protein
DPLHVRPIAHAIWDPHFGQPAVEAFTRGGALGPVNIAYSAGWLHLQPKWKPSVSWFKNAESRLNHHLSGLFGVSSLAWTGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHKGLYDTINNSIHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNEN

SEQ ID NO: 151053 - protein, 117 aa, Glycine max
  Coding DNA Sequence Number=SeqID_59368
MHEQRLAINSWGYGLDGGGCMNVHGAATLGNLFVGIQTQWWRMHERQSIHGTPNKIRLWRMHEQRLTINSWHSGLDGGGYMNDNQFMGFRIRFDDGGCTNSARHSIRGAPDSMEEDA

SEQ ID NO: 151054 - protein, 189 aa, Glycine max
  Coding DNA Sequence Number=SeqID_59369
MRAHPEREAITHLLCIPGQDFTRAAAKRRARIMRTNMTTLTWIWMTLLFSNILPNDHNANLPLQMYQLGSRPQDASVDPKKSNRALGFPTLITGLVSPTGCLFPPARDCACKTPSGPEEVQQGLGVFYGVLVTSGKGIRPPTNRAFIKKYCVPRQAQGETPQQPGDGRQRATDAPPSPLEFTSAHPQKF

SEQ ID NO: 151055 - protein, 64 aa, Glycine max
  Coding DNA Sequence Number=SeqID_59370
MSQASSSSVFILPGNTQDLEGYEFFTDGCGHTCAYLYFLFSHCRFLSPQVPSLLDEVPSLGPHG

SEQ ID NO: 151056 - protein, 140 aa, Glycine max
  Coding DNA Sequence Number=SeqID_59371
  Pfam annotation: Domain name=G-patch; Domain location=1-42; Score =11.6; E_value=0.0076; Accession=PF01585.14; Description=G-patch domain
MVARVMLRNGFEPGMGLGKDCLVNADVVDIKGNPYKYGLGYEPGMSRRKNVPSRFRADRVWPDRISQCFTSAGMVSEEEVAAIEEEFPQDPPNMRGRFFEDPDNEGLTIDFDRDISQTINKEGRGRPVARVGEVGRSGRT

SEQ ID NO: 151057 - protein, 298 aa, Glycine max
  Coding DNA Sequence Number=SeqID_59372
  Homolog annotation: Hit_ID=Q2HW90; Match level="QueryCoverage=74%, HitCoverage=44%, E-value=2e-23, Identity=30%"; Hit description =Putative uncharacterized protein
MGSSQKPSLKMRFYQVKIKSLEVTSLRKLGQLMGQLQQQAFRKAYGKIWDLARVEVSMEPIASLSQYYGQPLRCFTFEDFQLVPTVKEFKEILGCPLGGRKPYLFSGFYPSTTRVAKVVKISAQELNQVKQNRNGVVGVPRKYLEVKARILADKGEWTPVIDIFTLLIFEGVLFPNVDGLVDLAAIDVFLAYHNHKESPVVAMPADLYDTFDRRCEESNARIVCCTPALYVGLVSHLFLQEGRPVYPLQGYRSCVEKGKANWDQLLASMEGRLLIGSLARRKEESGFYLHAKDVQMFP

SEQ ID NO: 151058 - protein, 76 aa, Glycine max
  Coding DNA Sequence Number=SeqID_59373
MDIHALWEKREMAPKKLSTTRSRRDATGEGSSAAPEFDSHRFQSAEHQQRFEAIKGWSFYRERRVQLREDEYMDFQ

SEQ ID NO: 151059 - protein, 147 aa, Glycine max
  Coding DNA Sequence Number=SeqID_59374
MEGGIGLILDLTPKEKKGIEGLKREKVPLATFSIQGKRHIPSYNERELMDKLQRLRQGKLREEERTSIARFLSGLNMEMKDKEDKGKTIEKSTHILVPKQGLATLNASNVLGEETTSSLSSNGSEDETRGEEYSEEVYPHEEGDLLM

SEQ ID NO: 151060 - protein, 117 aa, Glycine max
  Coding DNA Sequence Number=SeqID_59375
  Homolog annotation: Hit_ID=A5ATL8; Match level="QueryCoverage=36%, HitCoverage=34%, E-value=1e-15, Identity=93%"; Hit description =Putative uncharacterized protein
  Subcellular localization annotation: CTP_CleavageSite=63; ConfidenceScore=5.44e-01
MQALSGMIGRKASVGGFLSSPSNPRAQPWTGGGNYQAGVRYPSSPSRKRWILGAVRIDPCNAVANALSIPPGEYRRTLPGLDMPRILLKERGAFGNADTGGAWLSSARATAGDKPEE

SEQ ID NO: 151061 - protein, 70 aa, Glycine max
  Coding DNA Sequence Number=SeqID_59376
  Gene Ontology: Biological process=transposition, DNA-mediated
  Homolog annotation: Hit_ID=Q1J7G7; Match level="QueryCoverage=41%, HitCoverage=41%, E-value=8e-10, Identity=100%"; Hit description =Transposase
MVKVGTSYVPIKRLIFAKSWPRAFPWLLFLSAVPPVQLLTGWCVTAKAPPDISAGKCSGHAARNHHTRRA

SEQ ID NO: 151062 - protein, 126 aa, Glycine max
  Coding DNA Sequence Number=SeqID_59377
MAPRKLSTKRSRKDAAAEGTSAAPEFDNHRFRSAEHQQRFEAIKGWSFHRERRVQLRDDEYTDFQEEIARRRWTSLVTPMAKFDPDIVLEFYANAGLQRRACGTCGHGRPQPVPGIPASVGGGPRS

SEQ ID NO: 151063 - protein, 92 aa, Glycine max
  Coding DNA Sequence Number=SeqID_59378
MASSTCFQQISSQITIMKQKPSKITHHISQNPIPTKIKDALHDSENAFLSRFGAEKVCKGWSFDGASMVEEEERKLRERGREKASEFFFGAE

SEQ ID NO: 151064 - protein, 81 aa, Glycine max
  Coding DNA Sequence Number=SeqID_59379
MNLIIVIKRKEHALRCPYRTRARVMGEVEEVQEQVKADTEALKEQMATIMEAMMSIKEIMEVNAVAIAATNTIVEVDLTPP

SEQ ID NO: 151065 - protein, 181 aa, Glycine max
  Coding DNA Sequence Number=SeqID_59380
MTTLTQIWMTLLLSNIQPSDHNSNLPLPKYQLVYATLTWMSIHVAQLITDAICLFAGMPPTRHPLDPDKSNRALGFLALITGLCQSFGVPVAPSKQTANHRVHVQTHDSLYQLSLSLQSQGFASFPCPTPDQFRAEVAWPGDWLEAQAGEASAEAPDEADEAHEDEEMTDLLDFLGGSGAT

SEQ ID NO: 151066 - protein, 60 aa, Glycine max
  Coding DNA Sequence Number=SeqID_59381
MEVGIGKEFRGIKSHVKQEQIGRTLVIDRDTRVGINLGGKGMCLGYSFCSFKEIGSIVFR

SEQ ID NO: 151067 - protein, 54 aa, Glycine max
  Coding DNA Sequence Number=SeqID_59382
MEFMSETQILVYGETKDTSLLGSKEDSEMIGKTLLGMFSNLEHHQSLGAQRSRV

SEQ ID NO: 151068 - protein, 229 aa, Glycine max
  Coding DNA Sequence Number=SeqID_59383
  Homolog annotation: Hit_ID=Q6WAY6; Match level="QueryCoverage=36%, HitCoverage=15%, E-value=2e-10, Identity=42%"; Hit description =Putative uncharacterized protein
MGTRGCINYNPVLAIRQLGYPMKGAPLEEELAPVISRGFNKTNMETLQKVCKAWEVVQKKDNELRGSGPIGGYREWLKAHVQGLDWLPSLRTAKREEVEAAEEDEEENAELRDVNVATTKALEQETKRARREEHELKLRREERDQSRVHSLILKDELKACSRSKRSLSQHLCETETNMLAIISKYQEELSLATAHEHRVADEYAQVYAEKEARGRVIDSLHQEATMWMD

SEQ ID NO: 151069 - protein, 42 aa, Glycine max
  Coding DNA Sequence Number=SeqID_59384
MEIEDSKTSTWTMNHMVFILMNTVLDHLAVKDVNQKQQMDMR

SEQ ID NO: 151070 - protein, 310 aa, Glycine max
  Coding DNA Sequence Number=SeqID_59385
MASRKLASKRSRKDAAAVGTSTALEFDSHYFRSAEHQQRCEAIKGWSFHRERRVQLRDDEYTDFQEEIARRHWTSLVTPMAKFDLDIVLEFYANAWPTEEGVRDLRRPQSVPGISASIGGGPEEAIAQLLSIPGQDFARTAAGRRVRIMRTNMTTLTQTWMTLLLNNILPRDHNSNLPLPKCQLVYVILTRMSVHVAQLIADAIYLFAGMPPTRHPLDLDKSNRALGFPALITGLCQSFGVPVTPSKMIRPSITLAFIEKYCTTRQVQGGNPQAPDASPPPAQAGPAGSFDIEWYLRHLVRQQAANHRAH

SEQ ID NO: 151071 - protein, 78 aa, Glycine max
  Coding DNA Sequence Number=SeqID_59386
MCTVKKVIWTFQPPVTKDETNLQRMRDDMMQMRKSATRGIGIIPFERHIAAIGTTNNNMLSKRKTLDEGSLLSSKSET

SEQ ID NO: 151072 - protein, 187 aa, Glycine max
  Coding DNA Sequence Number=SeqID_59387
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
VGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQRIGLASGSKSALPQTCLLNLKLKRKGMQAWHWPSFYNVVTGKTLALPNLIALQHIPLSPAGVIAKRPAPIALPNSCAA

SEQ ID NO: 151073 - protein, 79 aa, Glycine max
  Coding DNA Sequence Number=SeqID_59388
VAGCTICGGAHKSGCCILNEEQIAHEVNYMGNQPRGNFNASGFPGFQNNQQYQQQRQWQNHSGNQFNRDQGGSSTRPQQ

SEQ ID NO: 151074 - protein, 78 aa, Glycine max
  Coding DNA Sequence Number=SeqID_59389
KAVASGGSNLARLGELGGNHLPYFAINRGGSEEEKGSAPLALLSLSNLLGGDAFPNLAKVSTVLRRSSFVLHRSSIFN

SEQ ID NO: 151075 - protein, 120 aa, Glycine max
  Coding DNA Sequence Number=SeqID_59390
MTIIEEMETISKQFKQLDVCGKDSIENIIDVKADGNCGYRAIAALLGMDEELWSLVRYHLHKELTSWSEEYINLLGGIERFEELKCSLLVDGLSMVRYHRQVDEYYGYGIWDMSLIHDTT

SEQ ID NO: 151076 - protein, 98 aa, Glycine max
  Coding DNA Sequence Number=SeqID_59391
  Subcellular localization annotation: CTP_CleavageSite=35; ConfidenceScore=5.79e-01
MVSPPASPPSSSSPSPPLPPPDASASLSAVKRTRKASRLQSLSTRPPSVERPMVHVDPATGKANSPHRKKLRTYLGFVARDKVDVTRNLKSQRLLTVG

SEQ ID NO: 151077 - protein, 118 aa, Glycine max
  Coding DNA Sequence Number=SeqID_59392
METFPAVEELLQRLMDWGQLEVSKPPAVPKPTPFSYQSNKVVPCKYTPHTFGERIATEVDSLSDVSSIGACRPRIFFINGFLCFLEDEWQRNGERKRERRRHFKEKMSLEEAHHHWRP

SEQ ID NO: 151078 - protein, 121 aa, Glycine max
  Coding DNA Sequence Number=SeqID_59393
AQKSRLPQRSFEMKDWGNFLHRILEEDSEDSAPVKMFLLVWGFSSKQRRLVAATSGSGWWRRRSPLFLLNAQILTQCNFFSTMARSAGQFSLLTQFPLGKLQTKFEDDLTVNKSTIVILLE

SEQ ID NO: 151079 - protein, 165 aa, Glycine max
  Coding DNA Sequence Number=SeqID_59394
MTLLLSNILPSDRNADLPLRKYQLGSRPLDTKWTRRSPTRPWGFQLWLRASISPTGCPYPPARSCHRDIGVTPVGHPVDLKKSNRVLGFPTLIMGLCQFYGVPVSPNKVIRSPTNRVFIKKYCTPRQAQGETPQQPGDAQQQATNAPSPPPKPLSSSTKRLEYCL

SEQ ID NO: 151080 - protein, 164 aa, Glycine max
  Coding DNA Sequence Number=SeqID_59395
MTLLLSNILPNDRSADLPLRKYQLGSRPQDTQWTWKSPTGPWGFQLWLRASISPTGCPYPPPPARSCHPDIGKDRAHKTPSGPGKVQQGPGVSSSDYGPLSVLRSACRPNKVIRPRINRAFIKKYCAPRRAQGETPQQPRDGWQRATNAPPPPLEFISTHPQKG

SEQ ID NO: 151081 - protein, 232 aa, Glycine max
  Coding DNA Sequence Number=SeqID_59396
IINEENFEAPEEDEKVQALKTELGKARLAKEKFKLVATDVRKECAGLREENAVTARTLEQETKRARKEEHGRDKFRGALWGSNNELKLRREERDQSRAHSMVLKEELAACSRSKRNLSQRLCETETNMLAIVSKYQEELNLATTHEHKVADEYAQVYAEKVARGRVIDSLHQEATMWMDRFALTLNGSQELPRLLAKAKAMVDTCSDPEEIHKLLYYCQHMIDLMAHIIRNR

SEQ ID NO: 151082 - protein, 165 aa, Glycine max
  Coding DNA Sequence Number=SeqID_59397
MGRRDKIWSFCTLFSSRGGGPDDMRRQNLVIPHPFSIQAQFVSDGTQRQNLVILHPLSSRGGGPDDMRRQNLVIRTLCHPEATGPMTCGDKNLVIPHPFAIQTQSCPMARRDKISSFCTLCHPEAAGPMTCGDKIWSFRTPLPFRHSSVRWHAETKFVILHPLSS

SEQ ID NO: 151083 - protein, 130 aa, Glycine max
  Coding DNA Sequence Number=SeqID_59398
  Homolog annotation: Hit_ID=Q6WAY4; Match level="QueryCoverage=84%, HitCoverage=24%, E-value=6e-07, Identity=31%"; Hit description =Putative uncharacterized protein
MGTNQNGKRFYQVKVKGLDVTSLKELGRLMGPLQRQAFRKVYVKILDLAAAEVFTEAVVSLAQYYDQSLRCFTLGDFQMVPTIEDKIAAVVGDSAKELDRMKQTRNGVVGLPRKYLEGKARGMASQEKWG

SEQ ID NO: 151084 - protein, 105 aa, Glycine max
  Coding DNA Sequence Number=SeqID_59399
  Subcellular localization annotation: CTP_CleavageSite=32; ConfidenceScore=5.66e-01
MGVFPFLLCNLSAMPGANFLAMGSSSDSTSSRSMRSPGAGTSFSGTGPGPGIICMGWILNSGCSWFDGVLVDDGDDGTEGETGDEVSFGEVAMEKQSFWSGFVNI

SEQ ID NO: 151085 - protein, 76 aa, Glycine max
  Coding DNA Sequence Number=SeqID_59400
  Pfam annotation: Domain name=G-patch; Domain location=3-42; Score =23.7; E_value=0.00026; Accession=PF01585.14; Description=G-patch domain
MMVRVMLGNGYEPGMGLGKHNGGITSLISAKGNHGKFGLGYKPTQADIKKGITGKKSGGQGSQLGQEVKGGPPCHI

SEQ ID NO: 151086 - protein, 68 aa, Glycine max
  Coding DNA Sequence Number=SeqID_59401
MVSGAYNTRPSEARLGELIQLQFFYFDRKTHISHSRCYVVNPNGQNVDNCHSHLRQNLKMIQWLTNQG

SEQ ID NO: 151087 - protein, 96 aa, Glycine max
  Coding DNA Sequence Number=SeqID_59402
MASRERDPVRERMATSRRFIYQSLKRRVWISRGGGKRDECLFHLRESHDMETCPAVEELLQRLMDWGQLEVSKEGREEPQICMQSEEKKVLYPPRP

SEQ ID NO: 151088 - protein, 147 aa, Glycine max
  Coding DNA Sequence Number=SeqID_59403
  Pfam annotation: Domain name=Transposase_23; Domain location=47-117; Score=10.0; E_value=9.5e-05; Accession=PF03017.5; Description =TNP1ENSPM transposase
  Subcellular localization annotation: CTP_CleavageSite=30; ConfidenceScore=5.38e-01
MASFSQLQSQMQSQGLAVPPKPQVSPSGPRVSTKGSYVDPSGNDPETGDSDRCGLYIEADLARLVAMGRVYKGSTVVHNTPLSPGQVKVSVEEITDADASVPVPTDEVSLVGQALHTFLSWPTHLVKSLSQQVAVSSAKPPPKPYPK

SEQ ID NO: 151089 - protein, 47 aa, Glycine max
  Coding DNA Sequence Number=SeqID_59404
MGSFLVVIVNTREEPASGPAPDHVEFAGCGLVAANYEHGGVSSERGC

SEQ ID NO: 151090 - protein, 161 aa, Glycine max
  Coding DNA Sequence Number=SeqID_59405
  Homolog annotation: Hit_ID=A7PT07; Match level="QueryCoverage=72%, HitCoverage=7%, E-value=5e-10, Identity=35%"; Hit description =Chromosome chr8 scaffold_29, whole genome shotgun sequence
QQGFEQFNKLYNSKESRIPADLKYFSSFALSWIFSWQYRYGKTENNKQYPPLQRHAFVKWWSQFDTSKAAPDQVKNWFQSNPEFLKPADPETSLFLNQKSQLAAFLASSKSKESLAQNLKEVLQLLQQEVEEEPSKKEAESSETNDDQEDDSFYQNEDDCF

SEQ ID NO: 151091 - protein, 251 aa, Glycine max
  Coding DNA Sequence Number=SeqID_59406
  Homolog annotation: Hit_ID=Q2HW90; Match level="QueryCoverage=57%, HitCoverage=26%, E-value=4e-13, Identity=34%"; Hit description =Putative uncharacterized protein
MDGLVDLAVIDAFLTYHDHKESPVVAMLADLYDTFNQRCQKSSTRIACCTPALYVWLVSHLFRQEVRHACPLESHRSCTEKGGANWDQLLANKEGVSVNWFPRWKEGRIGVLISCRGFPNIPLIGTRGCISYNLVLAIRQLGYPTEGHARGRARACHFTRWLKAHVQGLDWLPSLRTAKREEVEALEEDKEVQALRAELEQAQTVKERFKSTALKIRKENAELRDTNIAITKALEQETKRVHREEHGRNKF

SEQ ID NO: 151092 - protein, 89 aa, Glycine max
  Coding DNA Sequence Number=SeqID_59407
MVSWPCHLCVKLLHAHNGGQAQALKALHDDGFPFMDALEHGVKHLRRGIIGISVEEEGGSVEEAGIGASDAEVERASNLLPLAFLGPLK

SEQ ID NO: 151093 - protein, 17 aa, Glycine max
  Coding DNA Sequence Number=SeqID_59408
MADQQATKSKAKGKKMP

SEQ ID NO: 151094 - protein, 203 aa, Glycine max
  Coding DNA Sequence Number=SeqID_59409
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
AGSEQESARGSFQGETPGIFIVLSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTLLVSLAYLSFAPNMGTESRPAGMQAWHWPSFYNVVTGKTLALPNLIALQHIPLSPAGVIAKRPAPIALPNSCAA

SEQ ID NO: 151095 - protein, 72 aa, Glycine max
  Coding DNA Sequence Number=SeqID_59410
MGSSTRKLVERMRRVNLELNVRMVVLEVEKCEILRVRKAKFGVSGNWSLKKAWAEQMRKMSDKCERKEPFLG

SEQ ID NO: 151096 - protein, 157 aa, Glycine max
  Coding DNA Sequence Number=SeqID_59411
MSGFTRNSPQISASPHQLDLAPYASEPYNAQWNAPGLLRDKHTLRSSRILGEMEVDEPWLGLWLPLNYQVDMGSSLAYDNGIWGEPYRLFAAKFLFVGMAFVDNWVVGKEKVCYWLSKDIVGFGGKFGRTGMAVTAGVSPSSHPSSFAPVFSVVLVG

SEQ ID NO: 151097 - protein, 326 aa, Glycine max
  Coding DNA Sequence Number=SeqID_59412
RIATVVKDSARGLDRIKQTRNGIAGLPQKYLEDKARGMANQGDWVPFMDVLALLIFGVVLFPNVDGLIDLAAIDAFLAYHHSKESPVVAVLADLFDTFDRRGAPTEESMSPFLVRDLGAQNSKTIQRIHKAWETPLRKDQELRGIRNGIIGGYHEWLKVRIRGLDWLAKLKVVSEENFEAPEEDEEVQALKSELGKAKLAKEKFKLAATHVRKECAGLREENAITARALEQETKRARKEEYGRNKFRGALWGSNNELKLRREERDQSQAHSMVLKEELIACSRSKRSLSQRLCETETNMLAIIAKYQEELGLATAHEHRIADEYAQ

SEQ ID NO: 151098 - protein, 105 aa, Glycine max
  Coding DNA Sequence Number=SeqID_59413
MVRTRGLRRVVGTGRGRDLSQDVAEDVPRRRRPTASARRQRLPEDVPHASDGSPERTGATDVAESDRVASDGTATDDEGFPDGPHDPFVLIGFVDHVAHSIWSGQ

SEQ ID NO: 151099 - protein, 139 aa, Glycine max
  Coding DNA Sequence Number=SeqID_59414
  Homolog annotation: Hit_ID=Q1SWJ5; Match level="QueryCoverage=68%, HitCoverage=44%, E-value=2e-08, Identity=32%"; Hit description =Putative uncharacterized protein
WEWKLEWRRHLFDNEVQAAANFLDDISRGHIDCWTSDCWVWKPEPNGQFSTRSTYCMLLEGAADQTVDEALEDLWQLKIPLKPTIFAWRLIKDRIPTKGNFRRRQLEKGFAQPYNYWSNWHLIRRTYGSASLLVSTLYI

SEQ ID NO: 151100 - protein, 173 aa, Glycine max
  Coding DNA Sequence Number=SeqID_59415
  Gene Ontology: Mol. function=helicase activity; Biological process =viral genome replication
  Homolog annotation: Hit_ID=Q2A9E0; Match level="QueryCoverage=94%, HitCoverage=11%, E-value=1e-46, Identity=50%"; Hit description =Putative uncharacterized protein
MRTSSCPFIKYPSLDDIDHIISAEIPSQEDDPELYKLVQNHMVHGPCGILRHASPCMKEGKCSRFYPKKFQPTTLIDGDGYLVYHRRNIGWTITKNEIIIDNRCIVPYNPKLLKKYQAHINIEWCNQSTSIKYLFKYINKGYDRVTTVRVHDDNGTVPHANNPNDEIKEYLDC

SEQ ID NO: 151101 - protein, 29 aa, Glycine max
  Coding DNA Sequence Number=SeqID_59416
MPAGQLDRRYRRAKQHFSQAVTGAISIAG

SEQ ID NO: 151102 - protein, 118 aa, Glycine max
  Coding DNA Sequence Number=SeqID_59417
  Homolog annotation: Hit_ID=A6FJQ2; Match level="QueryCoverage=32%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPLGETMIVTSLHALLLIARGCK

SEQ ID NO: 151103 - protein, 95 aa, Glycine max
  Coding DNA Sequence Number=SeqID_59418
MIPPVRIVHPTEGVQGIQNPFWNDVLHYNNINWSHPGEEDICGLEMPSSFNVGQELYVDMEFDSKDAVKNAVKQYVMKVHQTFKMVESKGDKYVA

SEQ ID NO: 151104 - protein, 320 aa, Glycine max
  Coding DNA Sequence Number=SeqID_59419
MASRKHKSIGSRPTTQYDTRRFSSLDAWNRYTDNVLGRNILPKRKVELYHTELDDFKTELERRNFHKRLTNFIDASIDLALEKEFYANLYSSKGPSPKQSRVRRHSVKIDADSLNIFLETPVVLAEGETIPTYSRYYRLPTDYKEIEAALRITGRGFILNTEGHPGKILRKDLTTLGQVWSVLSYSNLAPTSHTSDLIVDKARLIFGLVSRMDMNIGALISGQITSTAQSNTSRLGFPTLITKLCRARGVVSDSLTFEHLSPIINFAYIRKNCWNPKELTVSIRGARRARVRPTELPSTSAAPTPASTSATPFVPAQTDS

SEQ ID NO: 151105 - protein, 21 aa, Glycine max
  Coding DNA Sequence Number=SeqID_59420
MWGPLHMKFWAKISRAFTISG

SEQ ID NO: 151106 - protein, 243 aa, Glycine max
  Coding DNA Sequence Number=SeqID_59421
  Homolog annotation: Hit_ID=A8GHX5; Match level="QueryCoverage=100%, HitCoverage=88%, E-value=1e-124, Identity=91%"; Hit description=SseB family protein
  Pfam annotation: Domain name=SseB; Domain location=8-243; Score =198.2; E_value=2e-56; Accession=PF07179.3; Description=SseB protein
MSAHHHDAAPSENELERLLKLAVTEPAHRPAFFRELLDATVLILGDSEQVQQDGDIALNADTPVNIQHWEKQDGGSIIPFFTSLEALQKAVEDEQPFIAMPARVLFEITQGADLFLNPKAEYGKEFYPEEVAMLLATGGIVKPVEHYVDKETQILLGQPEEYPSAMVDALTTLFSQRKPVRRAFLALMHDQAADEKPNLLIGLEVDAESAEIEALINEAGSVASETAPNDEPVDFCLVSEKER

SEQ ID NO: 151107 - protein, 78 aa, Glycine max
  Coding DNA Sequence Number=SeqID_59422
PTNRAFIKKYCAPRQAQGETPHQHWDGRQRATEAPPSPLEFTSAHPQKGLSIAYTTWPTNRRPSPKPKVARYLGYACI

SEQ ID NO: 151108 - protein, 58 aa, Glycine max
  Coding DNA Sequence Number=SeqID_59423
MQHRNIVSEAGELYSKKLAKFVGKRLKSEWAASVSIIYCIDSNSAFSLEIQCSNKVNA

SEQ ID NO: 151109 - protein, 134 aa, Glycine max
  Coding DNA Sequence Number=SeqID_59424
MKNAFNKKVRSRKFHEGDLVLKKMSHTVKDNRGKGPGAYQHGWRGATFTRELRCCQAILCLGSGAIEEVAAFLTLCFKPCVVCDNLSLFAQSMGCPKIILGSGQMSGWGRMQVEARVTIDRSSSHAQHWTNRKH

SEQ ID NO: 151110 - protein, 51 aa, Glycine max
  Coding DNA Sequence Number=SeqID_59425
MAKGNPAYHLTSRVRTTEGGGDDISLCVSTGSFAPWLTKGAGNHKVTPHVT

SEQ ID NO: 151111 - protein, 162 aa, Glycine max
  Coding DNA Sequence Number=SeqID_59426
  Homolog annotation: Hit_ID=Q6WAY4; Match level="QueryCoverage=72%, HitCoverage=25%, E-value=1e-08, Identity=28%"; Hit description =Putative uncharacterized protein
MGSSQKPSLKKRFYQVKIKSLEVTSLGELGQLMGQLQRVEVSMEPIASLSQYYDQPLRCFTFEDFQLVPTVKELEEILGCQLGGRKPYLFFGFYPSTTRVAKVVKISAQELERLKQNRNGVVGVPRKFVLFPNMEGLVDLAAIDAFLAFHHGKESPVVAILA

SEQ ID NO: 151112 - protein, 101 aa, Glycine max
  Coding DNA Sequence Number=SeqID_59427
MRGYRMVIRTFRQPRANKPVDAQGLTSSSAPVVNQGGRVLYGYPHLWSSRDNKSDDMRGYRMVIRTFCHPEAASRMTCGGTVWLSAPFVNQGRTSPLMRRD

SEQ ID NO: 151113 - protein, 287 aa, Glycine max
  Coding DNA Sequence Number=SeqID_59428
RRHAAGVPAGDPGRGTVGHPRSAALSDLRANFAGLRQRQPAGAVADRCVDGGIPAGADLCRRHRRGADGADLAGDRAGAGAAHRAEKRRGAEFAGHQHRPLHRPGGRRPAAGQLRRRRGLRCGRDELCTGDRGAAVVEAAEGRGQRPVGTLLRRLPRRPALCPFQPRAARGTAAGSGVLRLLQLGLGAAAAGGAPHAGRQRRFLRRSAGGGRRRGDPRGDRAAAPAPAAECRRAGAAGGGAHRRGDGGPVAGAAAVAGGGAAVGAGRRLDHCADHAQRRGAGRAAQL

SEQ ID NO: 151114 - protein, 115 aa, Glycine max
  Coding DNA Sequence Number=SeqID_59429
  Homolog annotation: Hit_ID=A6FJQ2; Match level="QueryCoverage=33%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNAREHDLDRSTARKVLIQHFQEIADKVLNLLAYP

SEQ ID NO: 151115 - protein, 75 aa, Glycine max
  Coding DNA Sequence Number=SeqID_59430
MKHNSKLIGWRMHERKRNSWGSDKKARMEDCTRGSSLVNDEAWLQTLWVEECMKENAIHWAPKWREWRIALEGPH

SEQ ID NO: 151116 - protein, 307 aa, Glycine max
  Coding DNA Sequence Number=SeqID_59431
  Homolog annotation: Hit_ID=Q84VH5; Match level="QueryCoverage=100%, HitCoverage=46%, E-value=1e-106, Identity=67%"; Hit description =Envelope-like protein
MATSPKETSAPGSPAVPSSPSSIKAPSIQEQPEFHIQPIQMIPGQAPVPEKLVPKRQQGVKISENPSLATSPREVDTEMDKKIRSIVSNILKNASVPDADEDVPTSSTPNASVPDVEKDVPTSSAPNAEVLSSSSKERSTEEDDQAAEETPAPRAPEPAPGDLIDLEEVESDEEPIANKLAPGIAERLQSRKGKTPIKSTPITPTTSRRSKVAIPSKKRKEISSSDSDDDVELDVPDIKRTKTSGKKVPGNVPDAPLDNISFHSIGNAERWKFVYQRRLALERELGRAALDCQEIMDLITAAGLLKT

SEQ ID NO: 151117 - protein, 61 aa, Glycine max
  Coding DNA Sequence Number=SeqID_59432
MTMVVVVGCDGNNVVMVVVAVVTMVTTMVVVVVVAMAIMAVKGGNDGGGGGGRNNNNENER

SEQ ID NO: 151118 - protein, 56 aa, Glycine max
  Coding DNA Sequence Number=SeqID_59433
MGFCGKGKWYNARGISLSSDIISKFPTVRWPAGKREGFGRREKKQHCETEEAEESV

SEQ ID NO: 151119 - protein, 38 aa, Glycine max
  Coding DNA Sequence Number=SeqID_59434
MVIFIHGVAVEGRGEEINALFNNIFFETKRANNVNKFQ

SEQ ID NO: 151120 - protein, 68 aa, Glycine max
  Coding DNA Sequence Number=SeqID_59435
MILHEIRRPNSQKTVPSGLANCRNLPFSERATQGSQVRLPWEENARSRHQHLFEENVGKTGKGVVYEL

SEQ ID NO: 151121 - protein, 277 aa, Glycine max
  Coding DNA Sequence Number=SeqID_59436
KPCAPPRSSRSCCCCTSRWRCSSPPACACLNGGSASDETDIRLVLRAGNPAHAGLGAAHHHPGHGAGHAGGRDARPGAGAAAALAPGGAVLAHGLRDRVRAQHAAAGADVFPVLRAAPDRGADVAPCDRHRGARAALRHLLRRSLPRRHRGGAARPAGSGAGAEHVAVAHRRRRGAAAGDPAGGAGAGQLPGGHVQGHAAAVGDHGGRAAATEQDDRLHHLPLHRAPDAGRRAVPGAEPDRGLGRARPGGPPATIWRKAMSSSITIKNLHKRYGELE

SEQ ID NO: 151122 - protein, 60 aa, Glycine max
  Coding DNA Sequence Number=SeqID_59437
MARRVLAPCPYFRDLYERELKGLLMIIPKVVISLLMVSRAVGTTSNNMLSKRKTLDEGSL

SEQ ID NO: 151123 - protein, 224 aa, Glycine max
  Coding DNA Sequence Number=SeqID_59438
  Gene Ontology: Cellular component=mitochondrion
  Homolog annotation: Hit_ID=Q5M9X8; Match level="QueryCoverage=50%, HitCoverage=87%, E-value=1e-31, Identity=55%"; Hit description =Putative uncharacterized protein orf166a
YRLLRWFWNSRKEAFKGCALNPIPGFIGAVGVSVGTTLSCRMKYRTKALYSRVFFNSHSFIPNKVLSFGRWALSVSYPSCTTSLIAQAWAGPTSIPRGAGLVRETAIHKSMGLTLYLGMKRGKIACHKSEARFVTLLREGRLAIRASRDEAFWRSQVNFGPPNPATDEKAYGVTGSVGTGDGHLEAHHDLQARPAKTWEGYPIGSQRIHSTCSPVDFIFIIFDT

SEQ ID NO: 151124 - protein, 87 aa, Glycine max
  Coding DNA Sequence Number=SeqID_59439
MRLGAYEQFEQGDPSWSFIQLLNYFKLTLLDETKELMSLFQGHRLSLETFLLFSFLYYPGDPLLLRGWSRLRTLGSWALSSWRQSTE

SEQ ID NO: 151125 - protein, 116 aa, Glycine max
  Coding DNA Sequence Number=SeqID_59440
MKGGEHKYRFNNNKREKPEKVRVLDDETGDKHELFEVLRMPSRCVFFKVFMSFLHHSTSSCHSFPESLKIMASPPASPPPPPPPSLPPPPPPPSPAPSNASASPSAVKRIRKASRL

SEQ ID NO: 151126 - protein, 146 aa, Glycine max
  Coding DNA Sequence Number=SeqID_59441
GLASSYNHVLAIGQLGYPMRGAPLEDELTPVISRGFNKTNVEALHKVRKAWEVFQKKDKELRGSNNGPIGGYRKWLKAHVQGLDWLPSLRTAKREEVEAPEEDEEVQALRAELEACREEHGRNKFRGALWGSNSELKFQREERDQS

SEQ ID NO: 151127 - protein, 146 aa, Glycine max
  Coding DNA Sequence Number=SeqID_59442
MWLPPEPWNEKPRGLVGKNTAGTNSEGLCGVAIRLCETETNMLAIITKYQEELNLAAAHEHRVADEYAQVYTEKEARGRVIDSLHQEETIWMDRFALTLNGSQELPRLLAKSKAMANTYSAPEEIHGLLSYCQHMINLMAHIIRNR

SEQ ID NO: 151128 - protein, 258 aa, Glycine max
  Coding DNA Sequence Number=SeqID_59443
  Homolog annotation: Hit_ID=Q2HW90; Match level="QueryCoverage=65%, HitCoverage=31%, E-value=9e-19, Identity=34%"; Hit description =Putative uncharacterized protein
MASQEKWVPFADILALLIFGVVLFPNVDGLVDLAAIDALLAYHHSKESPVVAILVDLFDTFDRRCEKNSARIICCLPALCVWLVSHLFQQDIRHPCPLQSYRSCVEKRRLDWDQHLTVIGGSTINWFPRWKEGKEGVLFSCGDYPNVPLIGTRGCINYNPALAIRQLGYPMRGAPMEENLSPFLLRVHTRGLDWLSKLKFIDEENFEAPKEDEEVQALKLELGKARLAKEKFKTAATNIRKECTELREENAATARALE

SEQ ID NO: 151129 - protein, 182 aa, Glycine max
  Coding DNA Sequence Number=SeqID_59444
  Homolog annotation: Hit_ID=Q6WAY6; Match level="QueryCoverage=55%, HitCoverage=18%, E-value=3e-12, Identity=37%"; Hit description =Putative uncharacterized protein
MPIVEVFHVWGLPNGGSAINWFPRWKEGKEGVLFSCGDYPNVPLIGTRGCINYNPALAIRQLGYPMRGAPTEGSLSPFLVKDLGAQGLKVIQRIHKAWRSPLRKDKELRGIRNGVIGGYHGWLRIHTRGLDWLSKLTVIDEENFEAPEEDEEVRALKLELGKERLAKEKFKSAATHIRKECT

SEQ ID NO: 151130 - protein, 79 aa, Glycine max
  Coding DNA Sequence Number=SeqID_59445
MLAIIAKYQEELGLATTHEHRIADEYAQVYAEKEARGRLWEFYGSITGVPEAPESHFPTKWGVWWPPSSPRRAQLAQAS

SEQ ID NO: 151131 - protein, 257 aa, Glycine max
  Coding DNA Sequence Number=SeqID_59446
MNGQIREELRTQIKEELRAQLEEENKRSLERMTMALKEAIKIELSYKGSPESLLIQSDIQQLGACVSTKGSNAQINVQPSWEDDADVIPMMGLYVQREDGTLGLVSMGKIMDGDSIIHTVAYADDVVRVSVETIIDPDVEIPYGTSEIQYVKQALDTFVAWPTHLVKVVLDEDAEIIPHKVDAHVAKPANVDADDLMRGLIKYSFDIYDKPVEFEFDGSNFGIVDAPTSIFLTYYDVSEIIAGDKSLNISVQQLWLM

SEQ ID NO: 151132 - protein, 52 aa, Glycine max
  Coding DNA Sequence Number=SeqID_59447
MGSEIYPKVHENPRAFFSSSSPILLESSIQYLWGVGLHQYVPSNVLGQRILR

SEQ ID NO: 151133 - protein, 78 aa, Glycine max
  Coding DNA Sequence Number=SeqID_59448
MWAWERCTSLAPKRTPPVIENKPLGHRWLRRGNQHIGNDDLIVFRRKLDIMKQHEFLWEPYTTNIICQCCLQFVWLQA

SEQ ID NO: 151134 - protein, 45 aa, Glycine max
  Coding DNA Sequence Number=SeqID_59449
MMLHSLNQRLLLGGLSSSVIDKKEYFNDPRPLEPERLKALRIQWA

SEQ ID NO: 151135 - protein, 223 aa, Glycine max
  Coding DNA Sequence Number=SeqID_59450
GPNVKTNPLASHGGASVNAIEKDRPSGSKRLEDVATSRRFIYQSLQAACMVSRGGDKSDELFEKGREDPQICTQSAERRAPPTPKALVICFTRNMTSLRSEYPPVVPKPMLFSYKSDKVVPWKYTPPSFGKGAATEVDSLSAKVTNITGLSGVTHSGWVFAPLHPTELPSKGKAPMTQESVSVATPSKEVDPPVVRGVEKKEDLQGRAVTLEEAHEFLRLIQQ

SEQ ID NO: 151136 - protein, 128 aa, Glycine max
  Coding DNA Sequence Number=SeqID_59451
  Gene Ontology: Mol. function=nucleic acid binding
  Homolog annotation: Hit_ID=A5C8K0; Match level="QueryCoverage=85%, HitCoverage=6%, E-value=7e-12, Identity=33%"; Hit description =Putative uncharacterized protein
  Pfam annotation: Domain name=zf-CCHC; Domain location=103-120; Score =19.0; E_value=0.0021; Accession=PF00098.14; Description=Zinc knuckle
MNTLGFQNCKSAKDMWDTLQEHEMELLRLNQHEETDKKKKGIALKASSAIQEDSDKEDSIDLDNDEDISLFVKRFNKFLRVRGNQKRPNFKPKRRTKTSSSTLKCFDCNQPRHLRVDCPIFKKKDGEV

SEQ ID NO: 151137 - protein, 94 aa, Glycine max
  Coding DNA Sequence Number=SeqID_59452
  Gene Ontology: Mol. function=nucleoside-triphosphatase activity; Cellular component=chloroplast
  Homolog annotation: Hit_ID=Q2PMM5; Match level="QueryCoverage=82%, HitCoverage=4%, E-value=2e-32, Identity=70%"; Hit description =Protein ycf2
MANSSDSIVSSTMESDKSLNVQEFFYSILFLLLVAGYLVRTHLLFVSRVYSELQTEFEKNLFLVALEQLGDSLEEIRSFAFGGNMLWGGGPTYG

SEQ ID NO: 151138 - protein, 50 aa, Glycine max
  Coding DNA Sequence Number=SeqID_59453
GPMMRSKTKQLVDAFQQMVADILNKAQVEKDEGPEAEALLSILIVAEAQD

SEQ ID NO: 151139 - protein, 168 aa, Glycine max
  Coding DNA Sequence Number=SeqID_59454
  Homolog annotation: Hit_ID=Q6UUU1; Match level="QueryCoverage=35%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKDMQKHHWQQPLPVTSVQRVGSSENLRKTALQG

SEQ ID NO: 151140 - protein, 135 aa, Glycine max
  Coding DNA Sequence Number=SeqID_59455
  Homolog annotation: Hit_ID=A5BK68; Match level="QueryCoverage=94%, HitCoverage=70%, E-value=5e-36, Identity=64%"; Hit description =Putative uncharacterized protein
VSGVGSLISTPPVLIRSGPWSSVSGLPADKISEIDQPAGLVWLFLSIEKKESAVCASHLLLGSAGRHGILGLTFLTHIQSYRHGPTDLFSIGASSSATRFYLTKPRARPRREFALPNSLFDNKAETPDPTFISFE

SEQ ID NO: 151141 - protein, 22 aa, Glycine max
  Coding DNA Sequence Number=SeqID_59456
MNNRNQSRYLGTAASGDGVTTD

SEQ ID NO: 151142 - protein, 118 aa, Glycine max
  Coding DNA Sequence Number=SeqID_59457
MKVDMEAMKEKMATMMEAMMIMKKIMEASAVVVATTSTVAKAKIWEVRAAPMMCKFKTSTPSRHMACLSTIRHPMWRTLPIRMSITPLLYPLRANNPKLIMHMSLKPWGRHMKFPTTI

SEQ ID NO: 151143 - protein, 93 aa, Glycine max
  Coding DNA Sequence Number=SeqID_59458
MKTLHGSGIATNIIDNNEISTNARIQTNCMHETNDNRNNKNKQYEPGDPTVMWLRMPPDSWVTVTKGGVVDKSRAFAPMYPQFVMRNSDLRSS

SEQ ID NO: 151144 - protein, 157 aa, Glycine max
  Coding DNA Sequence Number=SeqID_59459
MPISPCRCISWDRAHKTPSGPEEVQQGPGVSSSGYGPLNRTHKDTQWTRRSPTGPWGFQLWLQASVVLQGARFPRQGHGLRLQDTQWTRRSPTGSWSCQALIAGLCEFYGVPVAPSKVIRPPTNRAFIKKYCVPRQAQGETPQQPGDGRQRATDAPP

SEQ ID NO: 151145 - protein, 231 aa, Glycine max
  Coding DNA Sequence Number=SeqID_59460
  Homolog annotation: Hit_ID=Q2HW90; Match level="QueryCoverage=65%, HitCoverage=35%, E-value=1e-16, Identity=29%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEGVLFPNVDGLVDLAAIDVFLAYHNHKESPVVAMLADLYGTFDRRCEESNARIVCCTPALYVGLVSHLFLQEGRPIYPLQGYRSCVEKGKANWDQLLASMEGRLLIGSLTKRKEESGLYLHAKDVQMFPGWEHGVVLIIIPSSP

SEQ ID NO: 151146 - protein, 114 aa, Glycine max
  Coding DNA Sequence Number=SeqID_59461
SRSEDADIFGKGADDDSRPEDADISGEGVDDDSRPEDADISREGADDDSRPEDADIFEEGADDDVSHCMLSGFESYELQNDTFSQSRPKDADISREGADEDVSHCMLSGFESYG

SEQ ID NO: 151147 - protein, 130 aa, Glycine max
  Coding DNA Sequence Number=SeqID_59462
ATLPEGRKPDRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTGWVLS

SEQ ID NO: 151148 - protein, 100 aa, Glycine max
  Coding DNA Sequence Number=SeqID_59463
YVPIKRSFLIGAAVIASFGYRKEHDGSWVKKGAQPIDKEGHLPVGEDSSLLQRILDRFDALELQMDMQFNEMDSRITKVKGDVSHIRTCFDLPPPPRPSS

SEQ ID NO: 151149 - protein, 98 aa, Glycine max
  Coding DNA Sequence Number=SeqID_59464
  Subcellular localization annotation: CTP_CleavageSite=47; ConfidenceScore=5.46e-01
MGQMVTQLNQAQSQNSDKLPSQTVQNPKNVSAITLRSGNQIQVPPPVAAPAPKPVKLHSIPEKEDEIVAQKLKCGDSFGKYKCCLPRRFRRGCASSGW

SEQ ID NO: 151150 - protein, 56 aa, Glycine max
  Coding DNA Sequence Number=SeqID_59465
SSRLIFSLKWHLQSSFFHLHSTAINLQEAKDSIDEEDPRPRSSNGGTSCGIKSIFI

SEQ ID NO: 151151 - protein, 155 aa, Glycine max
  Coding DNA Sequence Number=SeqID_59466
MAPRKLASKRSRKDKAAEGTSSAPEYDSHCFRSAEHQQRFEAIKGWSFLWERRVQLRDDEYTDFQEEIVHQRWASQVTPMAKFDPDIVLEFYANAWPTEEGVRDMRSWVRGQWIPFDADAIGQLLGYPLVLEEGQECKYGQRRNRSDGFDEEAIA

SEQ ID NO: 151152 - protein, 90 aa, Glycine max
  Coding DNA Sequence Number=SeqID_59467
MKNVEERSKTFAKSLTETFRKRYGSASAWIFFTETIFLSKFERERENWGRSLPPSSPRRAGLLPPEATTFWRNLLEGPSGLGCYLHPHFY

SEQ ID NO: 151153 - protein, 47 aa, Glycine max
  Coding DNA Sequence Number=SeqID_59468
MGAKYLEVVKRGSHPNNGWSPNKIRAPTKHKDLSSCKPHPPSNNSFT

SEQ ID NO: 151154 - protein, 159 aa, Glycine max
  Coding DNA Sequence Number=SeqID_59469
  Gene Ontology: Mol. function=RNA-directed DNA polymerase activity; Biological process=RNA-dependent DNA replication
  Homolog annotation: Hit_ID=Q0ZCD0; Match level="QueryCoverage=76%, HitCoverage=10%, E-value=4e-09, Identity=31%"; Hit description =Integrase
MMLLFLRGVHEVATDSSSSTENKKLEGILDALVNLVTQLAINQKSTPVARVCHLCSSADHHTDLCPSLQKFGVNEQPEAYAANIYNRPPQQQNQQQQSNYDLSSNRYNPGWRNHPNLRWTSPPQQQQPIPHFQNVVGPSKPYVRPSIQQKQQQPSQKRQ

SEQ ID NO: 151155 - protein, 265 aa, Glycine max
  Coding DNA Sequence Number=SeqID_59470
  Homolog annotation: Hit_ID=Q2HW90; Match level="QueryCoverage=77%, HitCoverage=44%, E-value=2e-21, Identity=33%"; Hit description =Putative uncharacterized protein
MGTNQTGKRFYQVKVKSLDTTSIKELGRLMEPLQMQAFRKTYGKILELTIAEPLRCFTFRDFQLVPTIEEFEEILGCPLGGRKPYLFSGCLPSLSRIATVVKDSASALDRIKQTRNGIAGLPRKYLEDKARGMANQGDWVPFMDVLALLIFGVVLFPNVDGLVDLAAIDAFLAYYHGKESPVVAVLADLFDTFDRRCEKSSARIICCLTALCVWLGSHLFQQDTRHPCPLLSHRSCTEKRRIDCDHLLAGIGGRTISWFPRWKER

SEQ ID NO: 151156 - protein, 170 aa, Glycine max
  Coding DNA Sequence Number=SeqID_59471
  Gene Ontology: Cellular component=mitochondrion
  Homolog annotation: Hit_ID=A7QD24; Match level="QueryCoverage=64%, HitCoverage=80%, E-value=1e-28, Identity=59%"; Hit description =Chromosome undetermined scaffold_79, whole genome shotgun sequence
MGLTLYLGMKRGKIACHKSEARFVTLLREGRLASRASRDEAFWRSQVNFGPPNPATDEKAYGVKGSVYVVTLPAFKRGTGDGHLEAHHDLQARPARPGKATRLGVRGSIVPAAPRTSSSSFLKAGGRDLLSATEKNGAYLTRHNLTMHPIPMRLPHGPCESAPTLPRELF

SEQ ID NO: 151157 - protein, 109 aa, Glycine max
  Coding DNA Sequence Number=SeqID_59472
MEAMKEQMATMMEAMKSMKKIMEANAVTVAATSAIAKTHEIPHHNLADFEPCLGYATKGQAVGGIPMPNTLKGPQFRPQPKPLHFAVGRAPCYGRNGKVGSSRGKAQGH

SEQ ID NO: 151158 - protein, 104 aa, Glycine max
  Coding DNA Sequence Number=SeqID_59473
MDKVDIFVPHPLTNACLLIQLSPECGCKPLVCLLKRPALLSVDFQDCSIRDYSSCTLVGRSELSRIGYWTNGLSYLKKGGVELRCKDYSPIELSLFLFGLTMHP

SEQ ID NO: 151159 - protein, 55 aa, Glycine max
  Coding DNA Sequence Number=SeqID_59474
MSLPSAVHVSSIIKREASDDWETQEKRRSRDESRHHGKGRTDEISVLSLLCSYLR

SEQ ID NO: 151160 - protein, 79 aa, Glycine max
  Coding DNA Sequence Number=SeqID_59475
MLYGALIELDGARVMGKDLGSMGGPHDVQIQNEHAFPPYGLPLNYTPPNVVYTPNKNVNNSTPIPIKSQQPQTDYAHVS

SEQ ID NO: 151161 - protein, 145 aa, Glycine max
  Coding DNA Sequence Number=SeqID_59476
  Homolog annotation: Hit_ID=Q6WAY6; Match level="QueryCoverage=54%, HitCoverage=13%, E-value=2e-10, Identity=41%"; Hit description =Putative uncharacterized protein
RTINWFPRWKEGNEGVLFSCGDYPNIPLIGTRGCINYNPTLAIRQLGYPMRGALAEESLSPFLVRDFSVQSSKIIQRVHKAWESPLRRDKELRGIRNGIIGESAATVRALERETKRARKEEHGRDKFCGALWGSNNELKLRREER

SEQ ID NO: 151162 - protein, 195 aa, Glycine max
  Coding DNA Sequence Number=SeqID_59477
  Gene Ontology: Mol. function=DNA-directed DNA polymerase activity; Cellular component=cytoplasm; Biological process=DNA replication
  Homolog annotation: Hit_ID=P26464; Match level="QueryCoverage=100%, HitCoverage=56%, E-value=7e-92, Identity=82%"; Hit description=DNA polymerase III subunit beta
  Pfam annotation: Domain name=DNA_pol3_beta; Domain location=1-70; Score=42.2; E_value=1.8e-09; Accession=PF00712.10; Description=DNA polymerase III beta subunit, N-terminal domain
  Pfam annotation: Domain name=DNA_pol3_beta_2; Domain location=79-180; Score=132.2; E_value=1.5e-36; Accession=PF02767.7; Description=DNA polymerase III beta subunit, central domain
  Pfam module annotation: Pfam domain module=DNA_pol3_beta::DNA_pol3 _beta_2; Domain location=1-70::79-180
MEMIARVTLNQPHDAGATTVPARKFFDICRGLPEGAEIAVQLEGDRMLVRSGRSRFSLSTLPAADFPNLDDWQSEVEFTLPQATMKRLIESHAVLYGASGREELRTVATDGHRLAVCSMPIGDALPNHSVIVPRKGVIELMRMLDGGDTPLRVQIGSNNIRAHVGDFVFTSKLVDGRFPDYRRVLPKNPDKTLEA

SEQ ID NO: 151163 - protein, 102 aa, Glycine max
  Coding DNA Sequence Number=SeqID_59478
MATARWALKHPIYGTVILQFGIYTDRPNVSKTTFPNEKLYTVPEFQQTLLTTTKTRIWGSHGHVAPHATGLLGHGNKKWGGQQKQGFCSYVSSICDEELRPT

SEQ ID NO: 151164 - protein, 124 aa, Glycine max
  Coding DNA Sequence Number=SeqID_59479
NKRGYISCGSVLVEGTSTRLFKENKGGYIPYGSLLLKDFTRLKRNLKDRRNRLFQDHDEDQVNLCLMTKSHDNNKEESIRKKWYIDSGCSKHIAGDVSKFTTVSPRKVDMLHTMTTISVKSQKK

SEQ ID NO: 151165 - protein, 60 aa, Glycine max
  Coding DNA Sequence Number=SeqID_59480
MELIENMAASDHAILCDRVHVVLFVAELTNRAVVFPLKNTIMKLTIWEINKGRVTIKVDT

SEQ ID NO: 151166 - protein, 170 aa, Glycine max
  Coding DNA Sequence Number=SeqID_59481
MVKEECKEVSVSSKRLAKKESHFEIKTNIKETSPLRQPLHLLLCKKTLVSTAMPLGLEVIPQVKELLDEGLIHKSLNTCALLVPKIGVLTITMMTIKDDDKGDEQKAQRSKNNSSESRTSQEFKNQEEFKTQVESLESRIKIQDSRSQESRSRFKTQDSRMKKRLNQDKY

SEQ ID NO: 151167 - protein, 136 aa, Glycine max
  Coding DNA Sequence Number=SeqID_59482
MVRTCSPLKVTACDPLMARTCCPLKVWACSPLMERTLPPLGTGVGVLILPTCSKYNSRPFTKKFVDRVFSGFSDSFPRINVGGDSARIPFVEHASRESRVALPPKGEGVQPLMVRTCCPLKGEGVQPSDGEDVVVL

SEQ ID NO: 151168 - protein, 100 aa, Glycine max
  Coding DNA Sequence Number=SeqID_59483
  Homolog annotation: Hit_ID=Q9LJA5; Match level="QueryCoverage=96%, HitCoverage=31%, E-value=8e-08, Identity=35%"; Hit description =Arabidopsis thaliana genomic DNA, chromosome 3, P1 clone: MTO24
ELCRRNKEIRSKQVIPHTGGSKANPRRRNELLLETGKLPSRGQLYIETHKRKDGSFVNEAAKTIAEQIEVGLTQSIVDESEVSPLDVVGRVLGLEHSGRV

SEQ ID NO: 151169 - protein, 129 aa, Glycine max
  Coding DNA Sequence Number=SeqID_59484
MEYGAKKDKELRGSINGIVGGYHKWLKARTQEITWLPKLKISSEEETETPEESEEVQAMKVELERVQAVKEKFKKMAIKVRKECDELRDQQRAQALKSRERPVKSRRYDIRGQVEGLSKVKEELVRIVE

SEQ ID NO: 151170 - protein, 97 aa, Glycine max
  Coding DNA Sequence Number=SeqID_59485
MERYLQHLVRQQAANHRGQVQVHECLYRFSLSQQGQGFAPFACPTPEQFGAQVAWPGDWPEAQAGEEPAGSPGEAEEARMDEEMTDLLGFLGGSGAT

SEQ ID NO: 151171 - protein, 53 aa, Glycine max
  Coding DNA Sequence Number=SeqID_59486
MTPLPVKEDKNRYGPSHENHETGQIQAKGLSGEGRRPKWRRMKAQRQRHYQDY

SEQ ID NO: 151172 - protein, 103 aa, Glycine max
  Coding DNA Sequence Number=SeqID_59487
MYPPLFSLNQVDVPSTRTDPQEMYPLLFSVNNPSRCTLYLYHKGYTLQCVKTKISGGRRETQEFRRLVLCSFGKGRRETQKEFRRLVLGEFFLAKVEEMKKNE

SEQ ID NO: 151173 - protein, 56 aa, Glycine max
  Coding DNA Sequence Number=SeqID_59488
MSPVESPTVATCPSRASEGEAHGSTKAGLLLLRTSIKEKSDLRSPSLCVNQAILYT

SEQ ID NO: 151174 - protein, 186 aa, Glycine max
  Coding DNA Sequence Number=SeqID_59489
  Homolog annotation: Hit_ID=A5AZG1; Match level="QueryCoverage=51%, HitCoverage=30%, E-value=3e-07, Identity=34%"; Hit description =Putative uncharacterized protein
  Pfam annotation: Domain name=zf-CCHC; Domain location=116-133; Score =22.5; E_value=0.00059; Accession=PF00098.14; Description=Zinc knuckle
MSHHSSSVNGEGRHRSHLRPHSHRREKERNPQEANINLSYFHGKDNVEANLDWEIRVEQKLKRKSTLKSYCSHSYPKKDQGLGILEAAPSKPKGDKGNTIEKQLPKASMQEKTSSITCFKCLGRGHITSQCPTKKTMIMRGQDIYSCQDEATTSPSSSECEEAKGEESSEEIYPQEEGQPLMVKEE

SEQ ID NO: 151175 - protein, 127 aa, Glycine max
  Coding DNA Sequence Number=SeqID_59490
MTSIVTKFVKLCNVIEKESPEKAKGFFLQKAVASGGSNLARLGELGGKLDASSIGACRPRIFFINGFLCFLEDKWQRNGEGLYGNDADVAPEFSPLKIVEFGNPSHDTLDPRDRGFGGRLWRWKWEK

SEQ ID NO: 151176 - protein, 106 aa, Glycine max
  Coding DNA Sequence Number=SeqID_59491
MSHAVKDNRGKWAPNYEGPFVVKRAFSGGALGQDHLELPSGVGKKHKQQKPIKVHRNGCKWGWGHDRLIVAPFSMLNKQRTSLQGSPVSSPGRAELAWASNPCTKI

SEQ ID NO: 151177 - protein, 52 aa, Glycine max
  Coding DNA Sequence Number=SeqID_59492
MESGRIQVSVPSNSYPRVWLWVILRAFQSVLEGYTTNCLPFSGISEARLKVR

SEQ ID NO: 151178 - protein, 225 aa, Glycine max
  Coding DNA Sequence Number=SeqID_59493
  Homolog annotation: Hit_ID=UPI00016621D1; Match level="QueryCoverage =71%, HitCoverage=40%, E-value=2e-12, Identity=30%"; Hit description =UPI00016621D1 related cluster
  Subcellular localization annotation: CTP_CleavageSite=38; ConfidenceScore=5.33e-01
MAIHPRLQRTSRPPLQRAARPRLQRTTRPHLQRAACPHLQKVVGPLLQRASRPHLKRTTCPRLQMVARLHAFAFRGLHVLTIRGLRILPFRGLYALTFRGLNVLHFKGLHALPFRGLHVLLFRGLCALSFRGVHVLAFRWLHALAFKGLHVVAFRGLHALAFRRLPVLTFRGLHALLYRRLHDLTFRGLHVVAFRRLHAVTFRGIHAIFRGLYILSFRGLHVLAF

SEQ ID NO: 151179 - protein, 146 aa, Glycine max
  Coding DNA Sequence Number=SeqID_59494
  Pfam annotation: Domain name=zf-CCHC; Domain location=74-91; Score =24.8; E_value=0.00027; Accession=PF00098.14; Description=Zinc knuckle
MELQRLNPNEETDKRKRSMALKASSSMQEEEEFDDEEDFSLFVKKFHKFVKNRRMERRHNFNNGKRSQEGSPTLKCYKCNRLGHIKAHCPTNQSWPKKNEKKSHEERRSKKAYIAWDDNDSSDGSEKEINLQSKDYESDENISQED

SEQ ID NO: 151180 - protein, 31 aa, Glycine max
  Coding DNA Sequence Number=SeqID_59495
MAMDNNKDEGNGGCITVYVGNCSGHMRIQYC

SEQ ID NO: 151181 - protein, 24 aa, Glycine max
  Coding DNA Sequence Number=SeqID_59496
MERIKCDSIVRIEELKKQQGEVTK

SEQ ID NO: 151182 - protein, 556 aa, Glycine max
  Coding DNA Sequence Number=SeqID_59497
  Gene Ontology: Mol. function=transporter activity; Cellular component= membrane; Biological process=oligopeptide transport
  Homolog annotation: Hit_ID=A7PIM4; Match level="QueryCoverage=97%, HitCoverage=98%, E-value=1e-166, Identity=54%"; Hit description =Chromosome chr13 scaffold_17, whole genome shotgun sequence
  Pfam annotation: Domain name=MFS_1; Domain location=37-480; Score= -22.3; E_value=0.1; Accession=PF07690.7; Description=Major Facilitator Superfamily
  Pfam annotation: Domain name=PTR2; Domain location=99-472; Score =211.1; E_value=2.6e-60; Accession=PF00854.12; Description=POT family
  Pfam module annotation: Pfam domain module=MFS_1::PTR2; Domain location=37-480::99-472
MEQEMEKRNVVRIEENEEKWVHDASVDYKGRVPLRASTAIELSERVSYFGIATNLISYLTKVMHEDLQTAAKSVNYWSGTTTLMPLVGGFVADAYTGRFYMILFSSFVYLMPGIKPADYVSIHPKFKTMQQWGMPSAKEADQFDDDHLEERKKKMSFFNWWNFAMCFALLLGATVVVYVQDFVSWGVATLIVTILMTLTVIAFCMGKRFYRYRRTEGNPLTPILQVLIAAMRKRNLSCRSNPALLHEVPESERSQGRLLSHTNRLRFLDKAAIIEEKRIEQKYNPWRLATVTRVEETKLVLNIIPIWLTSLTVGVTVGQGQTLFVKQAAATNLKISHSFKIPPASMASVTAVGTLIAVPIYDRITVPIMRKFTGNERGISILRRISIGMALSVIVMVVAALVEGKRLRMATHEVLTVGETRHETMSVVWLIPQYLILGVGDSFSLVGLQEYFYSQVPDSMRSLGMALYLSVLGVGFFLSSFLIIIVDRVTGKTGNSWIGKDINSSRLDRFYWMLAVINALVLCVFLLVIKRYTYKAVQRRAIETDCCKSDGVEMVA

SEQ ID NO: 151183 - protein, 498 aa, Glycine max
  Coding DNA Sequence Number=SeqID_59498
  Gene Ontology: Mol. function=tetrahydrofolylpolyglutamate synthase activity; Cellular component=extracellular space; Biological process= folic acid and derivative biosynthetic process
  Homolog annotation: Hit_ID=Q8W040; Match level="QueryCoverage=94%, HitCoverage=85%, E-value=1e-130, Identity=51%"; Hit description =Folylpolyglutamate synthetase, chloroplastic isoform
  Pfam annotation: Domain name=Mur_ligase_M; Domain location=65-239; Score=-32.8; E_value=0.0011; Accession=PF08245.3; Description=Mur ligase middle domain
MAQGDNGSSKSSSVTPYEEALDALSSLITKRTRVGDVNMEERFNVLYKYLKMLDLEEAISNMKIIHVAGTKGKPGSVNAVTAEYGGMLGSNCKENTDDNVPMPTFFHFLALLAFKIFAAEQVDVSIMEVGLGGKYDATNVVPTPIVCGITSLGYDHMEILGNTLGEIAGEKAGIFKHRIPAFTVPQPDEAMHVLREKASQLNVPLQVVTPLDAKLLNGSRLALGGEHQYINAGLAIALCSTWLKMNGHLEDSDSSACMKQHTLPEKFIKGLTTASLQGRAQIVPDQFINDEIPNELVFFLDGAHSPESMEACARWFSLAIKDQDQILFHQKLDNSNFSNQVVKMHNGETVQKKSTQILLFNCMSERNPQLLLPHLMKTCADHGVYFKKALFVPGLSVYHKVGSHALPATDSDVDLSWQLTLQRVWENLMQGNKVTWLEGKSNNSAPEELNMEMSASNCEHSAVFSSLPLVLKWLRDTVQQNQSTRFQVTLIHGYTGEL

SEQ ID NO: 151184 - protein, 683 aa, Glycine max
  Coding DNA Sequence Number=SeqID_59499
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A7QEA5; Match level="QueryCoverage=100%, HitCoverage=77%, E-value=0.0, Identity=75%"; Hit description =Chromosome chr1 scaffold_84, whole genome shotgun sequence
  Pfam annotation: Domain name=APC2; Domain location=622-681; Score =122.0; E_value=1.8e-33; Accession=PF08672.2; Description=Anaphase promoting complex (APC) subuni
  Pfam annotation: Domain name=Cullin; Domain location=236-579; Score =199.0; E_value=1.2e-56; Accession=PF00888.13; Description=Cullin family
  Pfam module annotation: Pfam domain module=APC2::Cullin; Domain location=622-681::236-579
MDGEFGDDASQNKDCMDLDEKGKLCNKVGEMDVDECYNDHRFSENCKLVKNIGKVVLDLRNLGFTSTAEDAYASAIFLLLKAKVHDVAGDDFRSSVLQSIKSWIQAVPLQFLHALLVYLGDVVSYESTSSGLKSPLAPQPSSCCPGIDTPSEGLVRWKLRLEYFAYETLQDLRIAKLFEIIVDYPESSPAIEDLKLCLEYTGQHSKLVESFISALRYRLLTAGASTNDILHQYVSTIKALRTIDPAGVFLEAVGEPIRDYLRGRRDTIKCIVTMMTDGTGAHSSSSGNPGDSLLEELNRDEEIQENAGVDDDFNTDDRQAWINAMRWQPDPVEADPLKGSRNQRKVDILGMIVGIIGSKDQLVHEYRTMLAEKLLNKSNYDIDSEIRTLELLKIHFGESSLQKCEIMLNDLIGSKRINSNIKATINQPSQTSVELGDSAISMDVISATIISSNFWPPIQDEPLNLPEPVDQLLSDYAKRFNEIKTPRKLLWKKSLGTIKLELQFQDREMQFTVAPVHASIIMKFQDQPSWTSKKLAAAIGVPADVLNRRINFWISKGIIAESQGADSSDHVYTIVENMAEPSKNGASTGCAQELLGGEEEEERSVASVENQLRKEMTVYEKFILGMLTNFGSMALDRIHNTLKMFCIADPPYDKSLQQLQSFLSGLVSEEKLELRDGMYFLKK

SEQ ID NO: 151185 - protein, 139 aa, Glycine max
  Coding DNA Sequence Number=SeqID_59500
  Gene Ontology: Mol. function=nucleic acid binding; Biological process= DNA integration
  Homolog annotation: Hit_ID=A5BQE2; Match level="QueryCoverage=89%, HitCoverage=20%, E-value=8e-13, Identity=39%"; Hit description =Putative uncharacterized protein
MVCSETSTSNLIMDIVRSMLSNSSLPVSWMYALKIVMYLLNKVPSKTVQKTPFELCAVQELLKLKILWFIENGETSGSEASQIVEIKEVRVQVPLTSASTSRIFVPYTVEPHFNNQEEQQINDPEVNNEPIVEQSQEIV

SEQ ID NO: 151186 - protein, 51 aa, Glycine max
  Coding DNA Sequence Number=SeqID_59501
MAIYRKSHLGQRQLALASWLLHLEGISTPRRAGAHPGDSDTSLGKLGSRNF

SEQ ID NO: 151187 - protein, 178 aa, Glycine max
  Coding DNA Sequence Number=SeqID_59502
MSSRKRKSVSSRPTTQYDTRRFHSFEAWTRYTDNVLGRHILAERKVEIYHTELDEFKGELERCNFHKRLTNFADSSIDLALVKEFYAKLYSPEGPSPKQVRIRGHLITIDADSLNAFLETPVVLAEGESLPAYSRYYRMPTDIREIKVALCIPGRGFILNVEGHPGKILRKDLNTLAQ

SEQ ID NO: 151188 - protein, 145 aa, Glycine max
  Coding DNA Sequence Number=SeqID_59503
MVRTRGLGRALGAGRGRGISEDAHEANVPRRHRPIASARRQRVHLHEDVTERHEDVPQLHEDVPHVFDATPEMTGAADAVQTKGVATDGSLGSLATDEGFPGGPRDPSILTDFAEHVTHNIWSGQPGGSTSSRAAATAVELQFAL

SEQ ID NO: 151189 - protein, 254 aa, Glycine max
  Coding DNA Sequence Number=SeqID_59504
  Gene Ontology: Mol. function=transferase activity, transferring glycosyl groups; Cellular component=cytoplasm; Biological process =amino acid biosynthetic process
  Homolog annotation: Hit_ID=Q57MS4; Match level="QueryCoverage=100%, HitCoverage=84%, E-value=1e-134, Identity=95%"; Hit description=ATP phosphoribosyltransferase
  Pfam annotation: Domain name=HisG; Domain location=8-176; Score =290.6; E_value=3.1e-84; Accession=PF01634.9; Description=ATP phosphoribosyltransferase
  Pfam annotation: Domain name=HisG_C; Domain location=177-252; Score =141.4; E_value=2.5e-39; Accession=PF08029.2; Description=HisG, C -terminal domain
  Pfam module annotation: Pfam domain module=HisG::HisG_C; Domain location=8-176::177-252
MPIDILRVRDDDIPGLVMDGVVDLGIIGENVLEEELLTRRAQGEDPRYFTLRRLDFGGCRLSLATPVDEPWDGPAALNGKRIATSYPHLLKRYLDQKGVQFKSCLLNGSVEVAPRAGLADAICDLVSTGATLEANGLREVEVIYRSKACLIQRDGDMADAKQQLIDKLLTRIQGVIQARESKYIMMHAPTERLDEVIALLPGAERPTILPLAGDQQRVAMHMVSSETLFWETMEKLKALGASSILVLPIEKMME

SEQ ID NO: 151190 - protein, 51 aa, Glycine max
  Coding DNA Sequence Number=SeqID_59505
MSPVESPTVATCPLRASEGEAHGCAFQRRKGRQKRGFCSYVPSFGEEIRPT

SEQ ID NO: 151191 - protein, 110 aa, Glycine max
  Coding DNA Sequence Number=SeqID_59506
MGIAPTKTPSEPEEVQQGPGVSSSGYGPLSVLQGARTPPARSRHHRDRDCKTPSGPEEVQQGLGIFYGVPITSSKGIRPPTNRAFIKKYCAPDRRRAKHHSSIGMVGSGK

SEQ ID NO: 151192 - protein, 57 aa, Glycine max
  Coding DNA Sequence Number=SeqID_59507
MDGQWVWKQDLPPVVPDKRTPSPPPQRDNSSSLLTEVLTELCDLRAFVEQRFDAMDS

SEQ ID NO: 151193 - protein, 82 aa, Glycine max
  Coding DNA Sequence Number=SeqID_59508
MRGIVHEPQVNIGADQKFSPVDVFKQEKEKGGQTLVTLTVERATRPRLERTTCPHHQRAACPHLQRTTRPRLERATRPHLGY

SEQ ID NO: 151194 - protein, 100 aa, Glycine max
  Coding DNA Sequence Number=SeqID_59509
MGDQEETQEQMKADMSALKEQMASMMEAMLGMRQLIEKNVATAAAVSSAAEADPTLLATAHHPPSNIVGRGRDTLGHDGNPYMFLVEIGIVGARYAGWTN

SEQ ID NO: 151195 - protein, 210 aa, Glycine max
  Coding DNA Sequence Number=SeqID_59510
  Homolog annotation: Hit_ID=Q6WAY4; Match level="QueryCoverage=88%, HitCoverage=33%, E-value=4e-23, Identity=36%"; Hit description =Putative uncharacterized protein
MGTNQNGKRFYQVKVKSLDVTSLKELGRLMGPLQRQAFRKVYGKILDLTATEVFTEAVISLAQYYDQPLRCFTFGDFQMVPTIEEFEEILGCPLGGRKPYLFSGFLPSLSKIAAVVGDSAKEMDRMKQIRNDVVGLPRKYLEGKARDMASQEKWSPFADILALLIFGVVFFPNVDGLVDLAAIDAFLAYHHSKESPVVAILADLFDTFDW

SEQ ID NO: 151196 - protein, 108 aa, Glycine max
  Coding DNA Sequence Number=SeqID_59511
  Subcellular localization annotation: CTP_CleavageSite=34; ConfidenceScore=5.12e-01
MHTQSFTIPQFLKIGLTHKKQSPVESPTVTTCPSAGERGEAHGCAFQRRKDARSRHQRLFVENVEKTEGNRSKTKILSSGVVFTFEEGRQKRGSCSYVPSIEEEIRPT

SEQ ID NO: 151197 - protein, 75 aa, Glycine max
  Coding DNA Sequence Number=SeqID_59512
MSERIVIIKKGGDCGSNDFQDYFDDAKESRVKQVSKNQESKSFRNQVSKIQDSKNNQVSKNQDSRIKRRLNQDKY

SEQ ID NO: 151198 - protein, 101 aa, Glycine max
  Coding DNA Sequence Number=SeqID_59513
MYVCNAPAFVDELRGYGGGSGASIARCRPSLGCCGVSPCTYLGGAILLYESPINRGPDDLVGGDGHSLELTKARNQSWKSKDPVGLLRVHWVSCGRDPCKQ

SEQ ID NO: 151199 - protein, 201 aa, Glycine max
  Coding DNA Sequence Number=SeqID_59514
  Homolog annotation: Hit_ID=A7UQU7; Match level="QueryCoverage=68%, HitCoverage=23%, E-value=2e-19, Identity=37%"; Hit description=IMP dehydrogenase/GMP reductase, putative
MDCSSSCLSPAPEAFRDLGQSGGYAWGAVALVHMYDQLDEASWTTTRQIGGYLTLLQCWIYEHFLSVHQCVTDDAYEETSPHASRWLTTKAHMKGITGAPYRAHCDAFTVTDVCWFPYSDHRGVRGFELISSFQGQLRWGPTVVAVRPKRVLCQFGYIQSIPPSPVSVSLSYDDIDDRWMHFMHFSDHVVAVGDLCVVLGQ

SEQ ID NO: 151200 - protein, 177 aa, Glycine max
  Coding DNA Sequence Number=SeqID_59515
MAEKTKKKLEEAAQSVSTEGVIDPPSPIRRHVKWKMAPIKKTRQMTSEAAKEIAEKIASQGSFVPHGRRDLLTAAVGRPEHPGRVRAVGAGVTIKQYFGLAPRTSRSSSSMASKELEQLTQQIRDQLEESITKKPEVGTSAARVSTKGSCVDLSPTDPDTGDSEQMRLYIEENPFCL

SEQ ID NO: 151201 - protein, 67 aa, Glycine max
  Coding DNA Sequence Number=SeqID_59516
  Gene Ontology: Mol. function=phosphoprotein phosphatase activity
  Homolog annotation: Hit_ID=A5C0F5; Match level="QueryCoverage=85%, HitCoverage=8%, E-value=4e-14, Identity=50%"; Hit description =Putative uncharacterized protein
MKRHEFVWEPYPSTVISFLPPICLVGSLAWYAVVPLICFQVIEWHQPDRVLRQFGMQQPAQSLLHNP

SEQ ID NO: 151202 - protein, 175 aa, Glycine max
  Coding DNA Sequence Number=SeqID_59517
  Subcellular localization annotation: CTP_CleavageSite=61; ConfidenceScore=5.23e-01
MPLWGKIASVGLLAKQPGLGMPLVSTPATGGRDGGGSSSVWPVGGRETSGGGTAGGGAGKMSGMAQEYRIQVSPKEVSFLLNFLHLKTSLAVIGMLTSLKQVKGDFLVFHTHLQVALPHVHNTLGSHHEWSTQNQGDLNIFFNVHDYKVHRKSELKDFDQDVFYHFDWSCDGAVC

SEQ ID NO: 151203 - protein, 98 aa, Glycine max
  Coding DNA Sequence Number=SeqID_59518
VDSRGSHHLVRQQAANHRAHVQTHDYLYQLSLSLQSQGFTFFPCPTPDQFRAEVAWPGDWPEARAGETPAEAPDEAEEAREDEEMTDLLDFLGGSGAT

SEQ ID NO: 151204 - protein, 54 aa, Glycine max
  Coding DNA Sequence Number=SeqID_59519
ISEPNLGTWAQKSTPRFMRTLGPSLAALTQSSWSLLLMALVISPFLGRIASMID

SEQ ID NO: 151205 - protein, 110 aa, Glycine max
  Coding DNA Sequence Number=SeqID_59520
VGSKISEWTVARGIHTNQNSPLTNLSQSDGCVVKTKYAETLTTVCNFREIFVLYIQLEVLIKHPEYGSIPHNLERLQKQLWDDQCPSTGDLDLNIRAFGVLLETSAPCQT

SEQ ID NO: 151206 - protein, 254 aa, Glycine max
  Coding DNA Sequence Number=SeqID_59521
  Homolog annotation: Hit_ID=Q2HW90; Match level="QueryCoverage=94%, HitCoverage=61%, E-value=2e-24, Identity=28%"; Hit description =Putative uncharacterized protein
MGTNQTGKRFYQVKVKSLDTTSIKELGRLMEPLQMQAFRKTYGKILELTIVEVSIEAVASLTQYYDQPLRCFTFADFQLVPTIEEFEEILGCPLGGRKPYLSSGCLPSLSRIATVVKDSARGLDRIKQTRNSIAGLPQKYLEDKARDLVAIDAFLAYHHSKESPVVAVLADLFDTFDRRIDWDQLLAGMGGRTISWFPRWKEGKEGVLFSCGRYPNIPLVGTSGCINYNPALAIRQLGYPMRGAPTEESMSPFL

SEQ ID NO: 151207 - protein, 217 aa, Glycine max
  Coding DNA Sequence Number=SeqID_59522
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=80%, HitCoverage=27%, E-value=1e-95, Identity=84%"; Hit description =Photosystem I P700 chlorophyll a apoprotein A1
AIRQGDSEVAESWFNQAAEYWKQAIALTPGLFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGGGFRGIQITSALMLFAGWFHYHKAAPKLAWFQDVESMLNHHLTGLL

SEQ ID NO: 151208 - protein, 292 aa, Glycine max
  Coding DNA Sequence Number=SeqID_59523
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPHIQFPTSYIGMSLLQLVNLYCYITDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151209 - protein, 172 aa, Glycine max
  Coding DNA Sequence Number=SeqID_59524
MVGYAPSSFADLVFARERIEVGLKRGKFNHPAWANEKTGANEEGEDEGETHAVTTIPIRPSFPPTQQCHYSTNNKPSPYPPPSYPQRPSLNQPQSLSTSLLMTNTTFSTDQNTNQEMNFAAKKPVALTPARFPQPPFFRGYDSNRMCVYHGGAPGHSIEHCMTLKRKVQSLN

SEQ ID NO: 151210 - protein, 284 aa, Glycine max
  Coding DNA Sequence Number=SeqID_59525
  Gene Ontology: Mol. function=calcium-dependent phospholipid binding; Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
  Pfam annotation: Domain name=Annexin; Domain location=119-183; Score =2.1; E_value=0.029; Accession=PF00191.11; Description=Annexin
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDEAINSKQLDNDHIIWILSTRNLFQLRETFACYNNLYGNTLEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151211 - protein, 87 aa, Glycine max
  Coding DNA Sequence Number=SeqID_59526
MQNSRVTLRVESQHFATTPVLRTDDIGFTLVDLKKLGYHNDSFIMAEQARQGKTIGVNVEDDDSYMDTYASPLTAQITETEVTKPSK

SEQ ID NO: 151212 - protein, 140 aa, Glycine max
  Coding DNA Sequence Number=SeqID_59527
MLLPSAIHASSTNESGAPRSDCIALFANSPFSTFFSEPHECYCLALFMHPPPTSLGAPRSYYVALFANSPFSTFFRSPMNVLPSAVHASSTYESGAPRSYCVALFANSPFSTFFRSPMNLFLALFMCPPPTSLEPREVIT

SEQ ID NO: 151213 - protein, 130 aa, Glycine max
  Coding DNA Sequence Number=SeqID_59528
MLVRMIRTRLLAATRVKSCPGMDGSYAIASLSGCARTVSPPPGSGGKRTLNSLKVWIWSPLKARTRSPLKARACSSLKLRTCRPLKARACNPLKVRMCIPLKVRMCSPLKVRTRTCSPLKARACSPLMDE

SEQ ID NO: 151214 - protein, 156 aa, Glycine max
  Coding DNA Sequence Number=SeqID_59529
  Pfam annotation: Domain name=Retrotrans_gag; Domain location=1-101; Score=4.7; E_value=0.019; Accession=PF03732.8; Description =Retrotransposon gag protein
MIHRDPLVEYWNDLKSSLRKRYILSYYERELMDKLQSLRQGSMSVEEYRLQMKDQAQGILGDAPSQSKEIKGKTIEKSTPNTISQERTSNLLNMIMRGQNIYISQEETTSSPSSSGSEDEVRGEESSEEVYPHEKGVTFLMVRRLLGGQYCDLSQS

SEQ ID NO: 151215 - protein, 74 aa, Glycine max
  Coding DNA Sequence Number=SeqID_59530
MGAVKDQMTSMMEAMLSMRRMMEDNAAIIATTSAAVEANLTHPSCINQTSRPAPNMVDQGREVLDSTGGPYMVQ

SEQ ID NO: 151216 - protein, 148 aa, Glycine max
  Coding DNA Sequence Number=SeqID_59531
MAPRKLASKRSRKDKAAEGTSSAPEYDSHRFRSAVHQQRFEAIKGWSFLQERRVQLRDDEYTDFQEEIGRRRWTSLVTPMAKFDPEIVLEFYANAWPTEEGVRDMRSWVRGFCPDCCREASANHVHQHDHPDPDMDDVAPQQHPAQRS

SEQ ID NO: 151217 - protein, 129 aa, Glycine max
  Coding DNA Sequence Number=SeqID_59532
MSGFTRNSPQISASPHQLDLAPYASEPYNAQWNAPGLLRDKHTLRSSRILGEMEVDEPWLGLWLPLNYQVDMGSSLAYDNGIWGEPYRLFAAKFLFVGMAFVDNWVVGKEEVCYWLSNDIVGLVGNLAV

SEQ ID NO: 151218 - protein, 56 aa, Glycine max
  Coding DNA Sequence Number=SeqID_59533
HSSEWLSGGENFWCKDPEGQQRLKRKLSCEVLDKSLSNCEKLPSYGELNPQLVLPT

SEQ ID NO: 151219 - protein, 30 aa, Glycine max
  Coding DNA Sequence Number=SeqID_59534
WRHPNLRSLYQTFCPIRFASSGIRASTLDT

SEQ ID NO: 151220 - protein, 71 aa, Glycine max
  Coding DNA Sequence Number=SeqID_59535
MTHGEQAQEVALVCIKNKLKRLLKRLALTDPLKLLQEHNKGLHQTYLREVAKEKKHRLLTMLECDEHDARP

SEQ ID NO: 151221 - protein, 162 aa, Glycine max
  Coding DNA Sequence Number=SeqID_59536
MTTLTWIWMTLLFSNILPSDHNANLPLQMYQLGSRPQDTQWTQRSPTGPWDFQLRLRASVVLQGVRSPRQGHESHPQRHSVDPEKSNRALGFPALVTGFCSPTGCPFPPARSHHHDIGIAPARHPVDPKKSNRVLELSSSNYGSLSVLRSSCDLQQGHQAPY

SEQ ID NO: 151222 - protein, 167 aa, Glycine max
  Coding DNA Sequence Number=SeqID_59537
  Subcellular localization annotation: CTP_CleavageSite=55; ConfidenceScore=5.78e-01
MAAKSTKPSTFGKRTTSKINKASISANGPHFSWLAISLALPSKYFRGRPTTPLRVCFMRSNSLAESPTTAATLLKEGRNPEKRYGFLPPRGHPSISSNSSIVGTIWKSPNVKHLKRLVIVFGRGDTTASVKYLPPRSKSRIFSVHFAKGLPLERSHQSSQFLEAGDI

SEQ ID NO: 151223 - protein, 196 aa, Glycine max
  Coding DNA Sequence Number=SeqID_59538
  Homolog annotation: Hit_ID=Q6WAY4; Match level="QueryCoverage=85%, HitCoverage=30%, E-value=2e-18, Identity=34%"; Hit description =Putative uncharacterized protein
MGTNQNGKRFYQVKIKSLDVTSLKELGRLIGPLQRQAFHKVYGKILDLTTAEVFTEAVVSLAQYYDQPLRCFTIGDFQIVPTVEEFEEILGCPLGGRKPYLFSGFLPSLSKIAVVVGDSTRELDRVKQTRNGVVGLPWKYLEGKARDMESQEEWVPFADILALLIFGVVLFPNVDGLVDLARIDAFLAYHHGKGIL

SEQ ID NO: 151224 - protein, 196 aa, Glycine max
  Coding DNA Sequence Number=SeqID_59539
MNRICWLRIAREFIVTLRGLLFFFVNRAAFPHSTRPASSRTCTIDATKIVNSIIEEIRKRATIWHQISGGVERAAVRSGKTIKKRRLFVKVSTERPLGSGKQITITESTKHWELPGEELGTGTRRSENHLNRGIDGISYFVTHSNCGSKSNKFDDLLRERRSKNMLLKPSQHMSGRPPLIVYKQKRVQRQGKKGFS

SEQ ID NO: 151225 - protein, 102 aa, Glycine max
  Coding DNA Sequence Number=SeqID_59540
MRRASVKRNVYSSIIWYSIFDMLFAIQVHTPPLLGFAKNCLWREKYASHEALQNGGFNPFSFSLTFGNSIRAIRGKIEESQKIARDAAIAVGRHVIPLRGKG

SEQ ID NO: 151226 - protein, 64 aa, Glycine max
  Coding DNA Sequence Number=SeqID_59541
MAVVIRFWALIAMTAQLIHDRVMMECLEGVWEALEGNERCRFRGTVRLTATSLVHPEQPARTLQ

SEQ ID NO: 151227 - protein, 147 aa, Glycine max
  Coding DNA Sequence Number=SeqID_59542
  Gene Ontology: Mol. function=4 iron, 4 sulfur cluster binding; Cellular component=nitrate reductase complex; Biological process =nitrate metabolic process
  Homolog annotation: Hit_ID=Q6UUU1; Match level="QueryCoverage=40%, HitCoverage=40%, E-value=1e-18, Identity=78%"; Hit description =Putative uncharacterized protein
MHPFIHPLSAAVDPAWEAKSDWEIYKAIAKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151228 - protein, 51 aa, Glycine max
  Coding DNA Sequence Number=SeqID_59543
MAAQRMSKVGSSFRNCNLTEELWARAIEEAIEKQKVFASYIRDKNRKEIDD

SEQ ID NO: 151229 - protein, 61 aa, Glycine max
  Coding DNA Sequence Number=SeqID_59544
MIEHVLAIRIAIPWIIGLNQTHVFTKKVHEVKLKYGSNHLAKIGAKDGSSYITASSTAKHI

SEQ ID NO: 151230 - protein, 286 aa, Glycine max
  Coding DNA Sequence Number=SeqID_59545
  Gene Ontology: Mol. function=nucleotide binding; Cellular component =intrinsic to membrane; Biological process=defense response
  Homolog annotation: Hit_ID=Q2YE88; Match level="QueryCoverage=94%, HitCoverage=22%, E-value=1e-134, Identity=89%"; Hit description=NBS -LRR type disease resistance protein Rps1-k-1
  Pfam annotation: Domain name=LRR_1; Domain location=107-128; Score =17.3; E_value=0.059; Accession=PF00560.24; Description=Leucine Rich Repeat
  Pfam annotation: Domain name=LRR_1; Domain location=130-152; Score =12.1; E_value=1.7; Accession=PF00560.24; Description=Leucine Rich Repeat
  Pfam annotation: Domain name=LRR_1; Domain location=154-175; Score =11.8; E_value=2; Accession=PF00560.24; Description=Leucine Rich Repeat
  Pfam annotation: Domain name=LRR_1; Domain location=83-105; Score =2.4; E_value=1.1e+02; Accession=PF00560.24; Description=Leucine Rich Repeat
  Pfam module annotation: Pfam domain module=LRR_1::LRR_1::LRR_1::LRR _1; Domain location=107-128::130-152::154-175::83-105
MHDLATSLGGDFYFRSEELGKETKINTKTRHLSFTKFNSSVLDNSDDVGRTKFLRTFLSIINFEAAPFKNEEAQCIIVSKLMYLRVLSFRDFRSLDSLPDSIGKLIHLRYLDLSHSSVETLPKSLCNLYNLQTLKLFDCIKLTKLPSDMCNLVNLRHLDISWTPIKEMPRRMSKLNHLQHLDFFVVGKHQENGIKELGGLPNLRGQLEIRNLENVSQSDEALEARIMDKKHISSLRLKWSGCNNNSNNFQLEIDVLCKLQPQYNIESLDIKVCFLHLDNYLLSRTF

SEQ ID NO: 151231 - protein, 97 aa, Glycine max
  Coding DNA Sequence Number=SeqID_59546
MALLTELLEVTPNEAIAETRQAGGPHVRLSWLRDMLSGTWSTCTIILTRRRRPLHGRWPITFHYFSAGFTSTFRRSIDVSSMMVMLRLAHVPVGGLR

SEQ ID NO: 151232 - protein, 74 aa, Glycine max
  Coding DNA Sequence Number=SeqID_59547
MTSSSSHSRRGLPTAKCKVVVDGRKLRALQQQCLHGYTYQLLCPSVAKYIRGKMLKVLLISIGGDISSCVSPTV

SEQ ID NO: 151233 - protein, 72 aa, Glycine max
  Coding DNA Sequence Number=SeqID_59548
MEENCIMSVLASDFSEVVNCSSMAFNRTLTFVEAMTSKIILMMPKNQELSKFQRIRSKKVSRIMFQRIRIQE

SEQ ID NO: 151234 - protein, 112 aa, Glycine max
  Coding DNA Sequence Number=SeqID_59549
MAAPRKRERRDAVDGHPGPVDVSGRRADVSRPARSRYLHPADRHRPWWRARRLHRTGRPAGRRPDPDVAGAGRRGRAAQGQPAGVPRRAVPGCGLPGVGRHRPAAHTEARGR

SEQ ID NO: 151235 - protein, 132 aa, Glycine max
  Coding DNA Sequence Number=SeqID_59550
MKIKGHIGSEIVFGTICYHIGMHLSIIPKELGRSVYVDEIFQQTHLQKDTGQFVDDRSRRTHEEFEARLSQARSDAASSVAARPKHKGCLYGTGDLAHTYKCENDSFMQHTQGSSSRAEDVAEINRLREELR

SEQ ID NO: 151236 - protein, 41 aa, Glycine max
  Coding DNA Sequence Number=SeqID_59551
GRMQVGMGSRPTNRCPFPALNEQRTSLQGSPSSFEFAVFYY

SEQ ID NO: 151237 - protein, 163 aa, Glycine max
  Coding DNA Sequence Number=SeqID_59552
MGDQEETLEQMKADMSALKEQMASMMEAILGMRHLMEKNVATTAAVSSAAEADPTLLATAHHPPSNIVGRGRDTLGHNGNPHLGYNRAAYPYGLPPNYSPPVLQDDAGHIASPVLEREPPQQPDEVHKDPEDYARRDVEFYPPIPEGPAPSTLPQPNIATQPI

SEQ ID NO: 151238 - protein, 128 aa, Glycine max
  Coding DNA Sequence Number=SeqID_59553
MVIEKRNANIQNLIYGYGGGFISRLSFSENTETFSSLTSYQELRRSEFLIGGYVGAKALLLSTTPLSVTMTQELVARGDTLRLSAPCHSVTPSVIDEQRPMWSSAPFPEMSASSGGDFFKSHKLSKTT

SEQ ID NO: 151239 - protein, 229 aa, Glycine max
  Coding DNA Sequence Number=SeqID_59554
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGIRSNPWLVSLFQVPGVTFYGRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151240 - protein, 157 aa, Glycine max
  Coding DNA Sequence Number=SeqID_59555
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=1e-25, Identity=56%"; Hit description =Putative uncharacterized protein
  Subcellular localization annotation: CTP_CleavageSite=33; ConfidenceScore=5.32e-01
MTMITPSSKLTLTKGNKSWYRAPPRERDQPRVRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 151241 - protein, 259 aa, Glycine max
  Coding DNA Sequence Number=SeqID_59556
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMNYDSLPSGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151242 - protein, 101 aa, Glycine max
  Coding DNA Sequence Number=SeqID_59557
  Gene Ontology: Mol. function=aspartic-type endopeptidase activity; Biological process=DNA integration
  Homolog annotation: Hit_ID=A5AJ19; Match level="QueryCoverage=78%, HitCoverage=16%, E-value=3e-19, Identity=52%"; Hit description =Putative uncharacterized protein
MIWVPKGSIVKTNIQGSKKIRDSFKQSRYIDSGCSKHMTRDASKFTHISPKNRGPVTYGDHNKEHNFSAPRTPQQKGVVERKNRSLEELTRTMLNDTNIPK

SEQ ID NO: 151243 - protein, 202 aa, Glycine max
  Coding DNA Sequence Number=SeqID_59558
AVRRCSTQRNPPADRHSRYADGADAQRHGAHQYRRQQLARAGGGRSARRHRSGSGGGGRGHAGDPRHRPLIRTTASRQVVDDGALCPLVARALVGQRHQALAHFAQFADVPVDLRHLLQRARLHVGAVAGRIVEQRHQLAALVQVEAHLPRLAQQRQLFNVPGGIMAVTVIAADRGGAVLHELRAAGEKSPGKPQRCRTGGR

SEQ ID NO: 151244 - protein, 167 aa, Glycine max
  Coding DNA Sequence Number=SeqID_59559
MVINQSLFYDLTQLSSEGVPFEGTLNDDWKFDFSVHDARRLVCTNQADMTGRLLADSLAFESRILHYLIVRILLPRSSNLAQALRLNAPLPYPHLVTLFLQHFNIPLDFEAYVPIKRSFLIGAAVIASFGYRKEHDGSWVKKGAQPIDKEGHLPVGEDSSLLQRILD

SEQ ID NO: 151245 - protein, 99 aa, Glycine max
  Coding DNA Sequence Number=SeqID_59560
  Homolog annotation: Hit_ID=Q0B5I8; Match level="QueryCoverage=94%, HitCoverage=23%, E-value=3e-32, Identity=64%"; Hit description=Major royal jelly protein precursor
IRDLGSVGGNTDGIVTDKKGNLYITDVTRNGIVRYDPETHSMSLVAANEEVRWPDTPAIRPNGELIFTSSRLNDHFAGAVKPGEERYDLWRLRLSASKD

SEQ ID NO: 151246 - protein, 45 aa, Glycine max
  Coding DNA Sequence Number=SeqID_59561
MVKVGTSYVPINVSFSPKVGPGLPGINREQPGIYLFCGKVNLPST

SEQ ID NO: 151247 - protein, 301 aa, Glycine max
  Coding DNA Sequence Number=SeqID_59562
  Gene Ontology: Mol. function=protein kinase activity; Biological process=protein amino acid phosphorylation
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQILEGLNYLHLHDPCIIHRDLNCSNVFVNGNTGQDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151248 - protein, 64 aa, Glycine max
  Coding DNA Sequence Number=SeqID_59563
  Subcellular localization annotation: CTP_CleavageSite=52; ConfidenceScore=5.07e-01
WLSARKNPEEDKLSSSLSAPLQVIKRTASAHLLSETSALSQNPLRRAKQSIRALSARARTRPPT

SEQ ID NO: 151249 - protein, 143 aa, Glycine max
  Coding DNA Sequence Number=SeqID_59564
MGDQEEIHEQMKADMSALKEQMASMMDAMLGMRQLMENNRATAAVVSSAIEADPTLPATAHHSLPNVVGRERSTLGHISNPHLGYNRVAYPYGLPPNYTPPVMRDDTGHVPSPILEGEPPRQLDEVHEDRSEYTQGDIDFYPL

SEQ ID NO: 151250 - protein, 162 aa, Glycine max
  Coding DNA Sequence Number=SeqID_59565
EVEAPVEDKEVQALREELEQAQTIKERFKSAALKIQKENAELRDVNIATTKALEQETERALEGLPKVQEKLVSVFMRDRDQHARGRVIDSLHQEATMWMDRFALTLNGSQELPRLLAKAKAMADTYSAPEEIHGLLSYCQHMIDLMAHIIETARKFVSSLRS

SEQ ID NO: 151251 - protein, 172 aa, Glycine max
  Coding DNA Sequence Number=SeqID_59566
  Pfam annotation: Domain name=G-patch; Domain location=2-41; Score =25.7; E_value=0.00015; Accession=PF01585.14; Description=G-patch domain
MARVMLGNGYEPEMGLGKDNDDITSLINAKGNRGKYGLGYKPTQADIKRSIAGRKSGGQSSQLRQESEGSPPCHISRSFISAGLGDEGQVVAVATYPSAGGRRVTRGMRVPRKEYARSRHQRLFEENVGKTGKDAIYELLSERFGSCIYARGRVFPFAPTYSSICDEEIRPT

SEQ ID NO: 151252 - protein, 63 aa, Glycine max
  Coding DNA Sequence Number=SeqID_59567
  Gene Ontology: Mol. function=zinc ion binding
  Homolog annotation: Hit_ID=Q6I5K6; Match level="QueryCoverage=98%, HitCoverage=3%, E-value=7e-09, Identity=43%"; Hit description =Putative uncharacterized protein OSJNBb0088F07.13
MAYDEEGHRYGHMTTNLSECVNKVLKDCRNIPIIALVKSTYSRCRKYFVDRGRQAQRQLNEGQ

SEQ ID NO: 151253 - protein, 308 aa, Glycine max
  Coding DNA Sequence Number=SeqID_59568
MASRKLASKRSRKDKAAEGTSSAPEYDSHRFRSAVHQQRFEAIKGWSFLRERRVQLRDDEYTDFQEEIGRRRWASLVTPHGQWIPFDADAIGQLLGYPLVLEEGQECEYGQRRNQSDGFDEEAIAQLLCIPGQDFARTSAGRRVRIMRTNMTTLTQIWMTLLLSNILPTDHNSDLPMPKCQLVYAILTRMSIHVAQLIADAIYIFAGMAPTRHPFDPDKSNRALGFPSLITGLCQSFGVPVAPTKVIRPPITRAFIEKYCTQRQAQGDAPQAAGAPPPPHQAGQAGSFDMEQYLRHLVRQQAANHRAH

SEQ ID NO: 151254 - protein, 160 aa, Glycine max
  Coding DNA Sequence Number=SeqID_59569
  Gene Ontology: Mol. function=transferase activity, transferring glycosyl groups; Cellular component=cytoplasm; Biological process =nicotinate nucleotide biosynthetic process
  Homolog annotation: Hit_ID=Q8UIS9; Match level="QueryCoverage=100%, HitCoverage=36%, E-value=1e-88, Identity=99%"; Hit description =Nicotinate phosphoribosyltransferase
MTKTDIATRVHNHTWKLDPIVRSLIDTDFYKLLMLQMIWKLYPEVDATFSLINRTKTVRLAEEIDEMELREQLDHARTLRLSKKENIWLAGNTFYGRSQIFEPEFLSWLSSYQLPEYELFKRDGQYELNFHGRWMDTTLWEIPALAIINELRSRSAMRSL

SEQ ID NO: 151255 - protein, 173 aa, Glycine max
  Coding DNA Sequence Number=SeqID_59570
MTTFTWIWMTLLFSNILPDDHNANLPLLMYRDCAHKTPSGPEEVQQGPGVSSSGYGPLSVLQGARPPNEESHPQRHPVDPEKSNRALGFPALVTGLCSPTGCPFPPARSRHHRVPITSNKGIRPPTNRAFIKKYCGSRQAQGETPQQPGDGQQRATDAPPSPLEFTSAHPQKG

SEQ ID NO: 151256 - protein, 122 aa, Glycine max
  Coding DNA Sequence Number=SeqID_59571
  Homolog annotation: Hit_ID=Q2R1R7; Match level="QueryCoverage=47%, HitCoverage=3%, E-value=2e-07, Identity=50%"; Hit description=AT hook motif-containing protein, putative
MLDEFNVHAKTFRMVRDRLRDVQVDNIKLKLIANCEKDGRTYNVPTVPEVAALILYNTFSYFLTGKMDIDLILYKAVDQMGYTMVESERLSYIRNNPKKLRVDKFCSLQQSLDDGSRKGLNK

SEQ ID NO: 151257 - protein, 108 aa, Glycine max
  Coding DNA Sequence Number=SeqID_59572
MLSKTIEGNGPELRRAFVVKRAFSGGALVLTNMDGEELPSPGQDHLGLPSGVETKHERQKPIEDERKRGWGHDRPIVAFLCAKRAENVATRQPRILCILQLSFTICLF

SEQ ID NO: 151258 - protein, 73 aa, Glycine max
  Coding DNA Sequence Number=SeqID_59573
MVVVVGETEGPSVFKGYTIAMLQFSGISEPGSSQLDDTGGEFHVSRGMAVTAWVSPSSSPSLFAPVFSFVQAG

SEQ ID NO: 151259 - protein, 45 aa, Glycine max
  Coding DNA Sequence Number=SeqID_59574
MGLPGLKEHSNSVTPKAYTPKSPSGPLPPDSGPTPKIILAHKHCL

SEQ ID NO: 151260 - protein, 15 aa, Glycine max
  Coding DNA Sequence Number=SeqID_59575
MVNYFSTKYKKIFRW

SEQ ID NO: 151261 - protein, 90 aa, Glycine max
  Coding DNA Sequence Number=SeqID_59576
  Subcellular localization annotation: CTP_CleavageSite=25; ConfidenceScore=5.04e-01
MGLNQFRFFNMVHDILVKVKLEVTRTSTVLNVFGSKQSSDRKMQGSRMKTKGMQFVEQKERYVHYDAMKRCLCMLEIKCGSDLIRIDFLE

SEQ ID NO: 151262 - protein, 149 aa, Glycine max
  Coding DNA Sequence Number=SeqID_59577
DGTDQLILPQGKIDIVVAGQNVANSCVIASSSDCARTFGPPPISGGGPGTDKSKLLAPHPGVQDLEFSEGADVEPFEGEEVQPSEGKDVVTTYPSAGGRREGSQERLPRKENARSRHQRLFEENVGKTGKLWSTNFKCERSGSCIYAWG

SEQ ID NO: 151263 - protein, 152 aa, Glycine max
  Coding DNA Sequence Number=SeqID_59578
MGIAPTKTPSEPEEVQQGPGVSSSGYGPLSVLQGARTPPARSRHHSSTEYLSPPARASGPLLIELSSRSTAPQTGAGRNTTTALGWSAAGNRRTAITSRVHLCSSTKRLERCLRHMADQQVHDRQVIRRPAKDVKEALLGGNLVPFESMLVI

SEQ ID NO: 151264 - protein, 223 aa, Glycine max
  Coding DNA Sequence Number=SeqID_59579
  Gene Ontology: Mol. function=oxidoreductase activity; Biological process=metabolic process
  Homolog annotation: Hit_ID=A9CES2; Match level="QueryCoverage=100%, HitCoverage=45%, E-value=1e-111, Identity=89%"; Hit description =Putative uncharacterized protein
  Pfam annotation: Domain name=SAF; Domain location=132-197; Score =35.4; E_value=2e-07; Accession=PF08666.3; Description=SAF domain
MAAVANGTGLDCPDDGLAFLPAGLHDLARVFRPAADGGRMARSGLVDIAASQEPDGREVFNNIRYGVFVTFKAHNEYARACFKQYGLLTDPSGWYASMWRPFHIIGLETSISVLSAVLRNEATGCSKEFRGDAVATAKKDMQPGEMLDGEGGYAVWANAIPATRSLDMKALPIGLAHNVKLKRAIRKDQIVSFDDVELVNDLDVVKLRQDMENRFRPQKDAAA

SEQ ID NO: 151265 - protein, 63 aa, Glycine max
  Coding DNA Sequence Number=SeqID_59580
  Subcellular localization annotation: CTP_CleavageSite=41; ConfidenceScore=5.09e-01
VSPHATGLLGHDSKGCVRVTVGCLRMPSDSWVTITKGGVVNKSRVFAPTYPQFVMRNSDLRSS

SEQ ID NO: 151266 - protein, 148 aa, Glycine max
  Coding DNA Sequence Number=SeqID_59581
MGKVEEAQEQMKADMEAMKEQMATMMEAMMSMKKIMEANAVIVAAISAIAKVNPMPPSGLNQMNHPTSDMAHEIPHHNLADFESCLGYATKGQAVGGIPMPNTLEGPQCRPQPQPLHFVVGRAPLAMAEEGKLDHIEERLKDIEGVED

SEQ ID NO: 151267 - protein, 147 aa, Glycine max
  Coding DNA Sequence Number=SeqID_59582
NGTTGESSAVHTWAKTTEFGSGTRTDFRYSGKKSKNIAYSAATFLYASVVAGLRPAETIDSQAEKAIDGRIGTGTRAILGPTKPCHEQSTQQEQGIFKLRLIPSIALPSSNRLNCIVYSPAKLAADSTSPRVYALFVLASAMKEGIL

SEQ ID NO: 151268 - protein, 302 aa, Glycine max
  Coding DNA Sequence Number=SeqID_59583
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q6UUU1; Match level="QueryCoverage=19%, HitCoverage=40%, E-value=4e-18, Identity=78%"; Hit description =Putative uncharacterized protein
  Pfam annotation: Domain name=ATP-synt_B; Domain location=126-252; Score=-7.9; E_value=0.0055; Accession=PF00430.9; Description=ATP synthase BB' CF(0)
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLIGQAIAFAMFVAFCMKFVWPPLINAISERQRKIADGLNAAEKAKADLADAQAQVKAELIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151269 - protein, 53 aa, Glycine max
  Coding DNA Sequence Number=SeqID_59584
ALLFLSLHSSPSSSKLLSMASYGEAKESFDEEDPRPTSSNGAYTMWYQEHLHL

SEQ ID NO: 151270 - protein, 198 aa, Glycine max
  Coding DNA Sequence Number=SeqID_59585
NDRRFEAPQLVIAHDLPPSDREPHGHPSGGCRGVDQAGHLVARLLCGPGREPGAAHDRDGQRVHGRDGRSHGLRRPATGRHEGRVDLEPGEELGHQCRCISQPCLADVAGGVEGQHRPGAGRQRAQCDGLGGQLPRRLIVVGDADGEFATVGQRGDSGVEAAVPVGRQGAGARDLSAPGSAAVTAAARVKGERPIPPG

SEQ ID NO: 151271 - protein, 212 aa, Glycine max
  Coding DNA Sequence Number=SeqID_59586
  Pfam annotation: Domain name=Transposase_23; Domain location=47-117; Score=10.0; E_value=9.5e-05; Accession=PF03017.5; Description =TNP1ENSPM transposase
  Subcellular localization annotation: CTP_CleavageSite=30; ConfidenceScore=5.38e-01
MASFSQLQSQMQSQGLAVPPKPQVSPSGPRVSTKGSYVDPSGNDPETGDSDRCGLYIEADLARLVAMGRVYKGSTVVHNTPLSPGQVKVSVEEITDADASVPVPTDEVSLVGQALHTFLSWPTHLVKSLSQQVAVSSAKPPPKPYPKVDDPLYLMTLTIPELFLRPYQVRWDVTVFGVFNLDFPLYIKHEDLSEITHGGQCLSISVLQLWIM

SEQ ID NO: 151272 - protein, 92 aa, Glycine max
  Coding DNA Sequence Number=SeqID_59587
MAEVTTEAIASLAQYYDQPEEVEAPEEDEEVQALRVELEKAQTVKERFKSVALKIRKENAVGKNMAGTNSEGLCGAVTTSLSSGERKGTNHE

SEQ ID NO: 151273 - protein, 158 aa, Glycine max
  Coding DNA Sequence Number=SeqID_59588
MRKCGRVRLPSFIVDHIVVPGDMSRGSGDLGDVRRTPGSQQIKGTKTTKQGGLLENGGQEARRASGNRLPRGCNRLPGLKRNWKTVEASGNRLPACVIDYTEEWVPGNRLPDPDGGAEGDEDPLPEVDSPEEVMSTSEADSTEDSGPGEMAISGGSSS

SEQ ID NO: 151274 - protein, 95 aa, Glycine max
  Coding DNA Sequence Number=SeqID_59589
DSTSDSPQISASPYQLDLAPYASEPYNAQWNAPGLLRDKHTLRSSRILEEMEVVFVIGSVVGGKLGRIGMAVTAWVSPSFSPSSFAPVFSVVLVG

SEQ ID NO: 151275 - protein, 60 aa, Glycine max
  Coding DNA Sequence Number=SeqID_59590
MGSSQTPSLKKRFYQVKVKSLGITSLKELGQLMGQLQRQAFRKAYADEVLHLWGLPAITY

SEQ ID NO: 151276 - protein, 133 aa, Glycine max
  Coding DNA Sequence Number=SeqID_59591
  Gene Ontology: Mol. function=receptor activity; Cellular component =integral to membrane
  Homolog annotation: Hit_ID=A5AS39; Match level="QueryCoverage=52%, HitCoverage=53%, E-value=6e-27, Identity=87%"; Hit description =Putative uncharacterized protein
  Pfam annotation: Domain name=DUF803; Domain location=1-131; Score= -104.0; E_value=0.00021; Accession=PF05653.5; Description=Protein of unknown function (DUF803)
GASAGVGGCRGWLNYAASEQIVLRVHHMRAIGAGLFAITPAGERGMCCKAIKLGNARVFQSDVALDTFNTAVVSPIYYALFTSFTILASAIMFKDYYGQSISSIASELCGFVTVLSGTTVLHSTREPDPPVNT

SEQ ID NO: 151277 - protein, 86 aa, Glycine max
  Coding DNA Sequence Number=SeqID_59592
MRQQQQTQWEKNRTCEYKCAERPNLKLVSHGRKVTLIGRPVLEIEGLVGATGLSPLIYCSVVTGDPGLISAFVERWHNETSTFHLP

SEQ ID NO: 151278 - protein, 285 aa, Glycine max
  Coding DNA Sequence Number=SeqID_59593
  Homolog annotation: Hit_ID=Q6WAY6; Match level="QueryCoverage=80%, HitCoverage=37%, E-value=7e-25, Identity=36%"; Hit description =Putative uncharacterized protein
MKQVENGVVGIPRKYLEAKARILAGKGKWAPFIDILALLIFGGVLFPNVDGLLDLAAIDAFLAYHNHNESPVVAMLADLYDTFNRRSEKRNTRIVCCTPALYVWLVSHLFCQEVRHAWPLESHRSCTEKGGANWDQLLASKERASVNWFPRWKEGRTGVHISCGGFPNVPLMGARGCISYNPVLAIRQLSYPMRGAPLEDELAPVISRGFNKTDVETLQKVRKAWEVVRKKDKELRGSNNGPIGGHRKWLRAHVQGLDWLPSLRTTKRGGKLRHQRKMKRCRPIG

SEQ ID NO: 151279 - protein, 69 aa, Glycine max
  Coding DNA Sequence Number=SeqID_59594
MGDQEETQEQMKADMSALKEQMASMIEAMLGMRQLMENNVATAAAVSSAAEVDPTLPATAHHPLPNAVG

SEQ ID NO: 151280 - protein, 60 aa, Glycine max
  Coding DNA Sequence Number=SeqID_59595
MAEKIPIEKQLPRRFAPEIMSKIKEEIERLLRSKFIISARDLNNATPKDEYAMPVAENVW

SEQ ID NO: 151281 - protein, 65 aa, Glycine max
  Coding DNA Sequence Number=SeqID_59596
MKQISASGIQPTFIIRVIKHQLEILQVAKIYKSDAPGLTAHLLSCSASFFFLGCSDHLNALLRAF

SEQ ID NO: 151282 - protein, 66 aa, Glycine max
  Coding DNA Sequence Number=SeqID_59597
MGEEEKKPEENKVEEKKAEEEEKKEEKNQRNQKMTRNPRRNLCHQKSCKAQSLQCMNTLSTISGIF

SEQ ID NO: 151283 - protein, 36 aa, Glycine max
  Coding DNA Sequence Number=SeqID_59598
MGTSKLYTRAMKGTMHKPQANLGADYKFSPNSSLLQ

SEQ ID NO: 151284 - protein, 54 aa, Glycine max
  Coding DNA Sequence Number=SeqID_59599
STLEDPTLGSGLDCGGCMNDNQFMGLRIRFDGGGCTNSTRQSIRGTPDSMVEDA

SEQ ID NO: 151285 - protein, 247 aa, Glycine max
  Coding DNA Sequence Number=SeqID_59600
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIKFHKKVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151286 - protein, 145 aa, Glycine max
  Coding DNA Sequence Number=SeqID_59601
  Gene Ontology: Mol. function=helicase activity
  Homolog annotation: Hit_ID=A2Q378; Match level="QueryCoverage=52%, HitCoverage=4%, E-value=5e-18, Identity=51%"; Hit description =Putative uncharacterized protein
MVCNSNDTTQNVNIQNEELKEYLDCRYISPCEAAWRIFAFPIHGRKPAIERLYFHLPDQHSVLYEDHDDIDDVLSKPTISYSKFLAWMNTNKSAKDLLHLRISELLQISNMQHIEKHVLPWVFYKMTENMLKQSKRLRTGAQLII

SEQ ID NO: 151287 - protein, 164 aa, Glycine max
  Coding DNA Sequence Number=SeqID_59602
  Homolog annotation: Hit_ID=Q949K7; Match level="QueryCoverage=21%, HitCoverage=40%, E-value=3e-07, Identity=66%"; Hit description =Putative gag polyprotein
GGIPLQNTLEGPQYHPQPQPSRSTAVKTLMTMAGMGKLDHLEERLRAIEGGEDYAFANLKELFLEPNIITPPKFKVLDFDKYKGTTCPKNHLKMYCQKMGECCKRSRNEDTSFKRNTPTKLGARARVTGVKQQELPNDERRDDDGIGHESRKGTIDGGSWSMKR

SEQ ID NO: 151288 - protein, 142 aa, Glycine max
  Coding DNA Sequence Number=SeqID_59603
  Pfam annotation: Domain name=G-patch; Domain location=16-53; Score =7.7; E_value=0.022; Accession=PF01585.14; Description=G-patch domain
IASVDSFSGQPFLSDTAVMVAQVMLGNGYEPGMGLGKNNGGRTRGNRGKFGNFISAGLGHEGQVVAICEDDSPSGSDLVRSCPPGFRLGNWRVEERPDIYATSIISDDESLEGTNTWDPTIDFKQETHQAEGEEDEDVGLPP

SEQ ID NO: 151289 - protein, 226 aa, Glycine max
  Coding DNA Sequence Number=SeqID_59604
  Homolog annotation: Hit_ID=Q6WAY6; Match level="QueryCoverage=53%, HitCoverage=21%, E-value=2e-11, Identity=30%"; Hit description =Putative uncharacterized protein
MEDAPVSPRVEGLVCPLQGHRMCAKKGKENWEELLVGMVGASVNWFPRWKEGGAGVLCSYEGFPNVPLMGTMSCINYNPILAIRQLGYPMRGAPSEEGIAPFIARGFSEGNAKMLQRVRKTWNTVERKDKELRGISNDVSGGYHKWLKARTQGITWLPKLKISSGEEVEVPEENEEVQALKVELERMRVVKEKFKMKATRVRKECDELRDVNMAMAETLERESKRT

SEQ ID NO: 151290 - protein, 163 aa, Glycine max
  Coding DNA Sequence Number=SeqID_59605
LFEVALERSPPICASSSSISVVYKSKGETKDIELVEEEQTRIGADPSSGTSNKYENYKEEARKKTLKHKPKRVESVNADAEAFAEAVEHTKKRDTGHQSVSLENKTGDSTMLKMGDSAKVMIKQDMKGRRHKYGFNNNEREKTQKKRVADDETADNHQLDEVL

SEQ ID NO: 151291 - protein, 79 aa, Glycine max
  Coding DNA Sequence Number=SeqID_59606
MSLPSAVHVSSTFEIGAMLHDCLSVDPQVQSSIHHFFGAPRMSLRSAIHMSSTFECGAPRSHCLALFANSPFSTFFGAP

SEQ ID NO: 151292 - protein, 77 aa, Glycine max
  Coding DNA Sequence Number=SeqID_59607
MGIRKRAQSIQKHNDCPHDSLEEQVTQGSFVPHGRQDILNTAIGRPDHGGRVRAAGSGVTITQYYGRASKDMQQLVH

SEQ ID NO: 151293 - protein, 57 aa, Glycine max
  Coding DNA Sequence Number=SeqID_59608
MVYSRRPLLMDLLCKLGDATFMVEPMSEACAWLKRMHPKKSTTWPIPTVKGSIKEDL

SEQ ID NO: 151294 - protein, 39 aa, Glycine max
  Coding DNA Sequence Number=SeqID_59609
MTGEQVYQRVQHLNTVFGKTLKKDKRQDEGWLEYPSRSS

SEQ ID NO: 151295 - protein, 269 aa, Glycine max
  Coding DNA Sequence Number=SeqID_59610
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMSWCRRPGQKTAPTGPARWGAPGRAAGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151296 - protein, 60 aa, Glycine max
  Coding DNA Sequence Number=SeqID_59611
AQSVKFRNIPEAKKGDDYVIHKVSGRANSNRPIWAFQDALQKAVPSGGSTLARLGELGGK

SEQ ID NO: 151297 - protein, 306 aa, Glycine max
  Coding DNA Sequence Number=SeqID_59612
TGARVHGMILKEELAACARSKRSLAQHLEATEQSMLAIIGQYKEELNQSVTHEQKLAEDFAQVYAEKEARGRVIDALHQEATMWMDRFALTLNGSQDLPRLLAKAKAMAEEQMKADLSALKDQMASISKVMLKLQKTIEDKATATASSTVREAEPVLQPALNLGRDRNTAVFGRRYSPQASPYGLPPDFAPRAAPEDLSQAPSFEGQLPPYAVYTVQDDEEGDPRLGPLLHLKDPSPHELPQRNIVRHVPASPAPVKESVPFAEDKGKIEAMVERLRAVEGLGNYPFLDLVDLCLVPNIVIPPKFK

SEQ ID NO: 151298 - protein, 305 aa, Glycine max
  Coding DNA Sequence Number=SeqID_59613
  Gene Ontology: Mol. function=motor activity; Cellular component=cell projection
  Homolog annotation: Hit_ID=UPI00016621D1; Match level="QueryCoverage =98%, HitCoverage=41%, E-value=2e-28, Identity=39%"; Hit description =UPI00016621D1 related cluster
HVLTFRGLHILAFRGLHVLAFRGLHVLTFRGLHYVTFRGLHVLAFRGLHALTFRGLHALTFEGQHALTFRGLHVLAFRGLHALAFRGLQVLAFRGLQVLAFRGQQVLTFRGLHALTFRGLHILTFRGLHALTFRGLQVLAFRGLHILAFRGLHVLTFRGLQVLAFRGLQVLTFRGLHALTFRGLQVLTFKGLHVLTFRGLHALTFRGLQVLAFRGLHVLTFRGLQVLAFRGLQVLTFKGLHALTFKGLHALTFRGLQVFAFRGLHILAFIGLQVLAFRGLHALAFRGLHVLTFRGLHALAFRGLH

SEQ ID NO: 151299 - protein, 307 aa, Glycine max
  Coding DNA Sequence Number=SeqID_59614
  Gene Ontology: Mol. function=oxidoreductase activity; Cellular component=integral to membrane; Biological process=potassium ion transport
  Homolog annotation: Hit_ID=Q5PNE8; Match level="QueryCoverage=49%, HitCoverage=45%, E-value=1e-73, Identity=85%"; Hit description =Putative ion-channel protein
  Pfam annotation: Domain name=Aldo_ket_red; Domain location=170-307; Score=-103.1; E_value=0.0068; Accession=PF00248.12; Description =Aldoketo reductase family
MMHAVALLLGVAGGSADDVNHRHIFGVAAGDAVNRTKFTDAKGGQQRGRAVAATVTIGRIGGIEFISAADPGNTGMVNDAVEKLQVVVAGSISDVAELARFSPSSRCHAWQAFVTTTENSVSCDLCRVTAQCKRIHCYADATFSHLRQERCMSTFPHAERYHQMQYRRSGRSGLKLPAISLGLWHNFGDSTRVDNSRALLRHAFDRGITHFDLANNYGPPPGSAESNFGRILREDFHGLRDELVISTKAGYTMWDGPYGDWGSRKYLISSLDQSLKRMGLEYVDIFYHHRPDPETPLEETMRALDQV

SEQ ID NO: 151300 - protein, 96 aa, Glycine max
  Coding DNA Sequence Number=SeqID_59615
  Subcellular localization annotation: CTP_CleavageSite=52; ConfidenceScore=5.14e-01
MGTRIYLFFELILRHSCPSCSATDGVVRNGKKHRRTSALASVAVTLRVTATPAALNAPYRARPIRHSGCATVGKGDRCGPFRYYASWRKGDVLQGD

SEQ ID NO: 151301 - protein, 190 aa, Glycine max
  Coding DNA Sequence Number=SeqID_59616
  Gene Ontology: Mol. function=helicase activity; Biological process =viral genome replication
  Homolog annotation: Hit_ID=Q9LW42; Match level="QueryCoverage=72%, HitCoverage=8%, E-value=4e-17, Identity=39%"; Hit description =Helicase-like protein
YSLNDPTIDDLDDYDEQTFLSASSAYQNTGGTYIDIGDPIWECPHCKAMIWYDERINKDKQTKIIIAIKDMLDHHNHYAQRFRMARDKLHYAAVPDLKMKLISQRQTDGRLYNLPTTTEVVSLIVGDEHSADKRDIIIEKKSGLLKRIHELHPAYLPLQYPLLYPKGEDGYKLNIPHKDHANIDAAKRKQ

SEQ ID NO: 151302 - protein, 23 aa, Glycine max
  Coding DNA Sequence Number=SeqID_59617
NDSGKVQGVRFLVKSRRADVMTL

SEQ ID NO: 151303 - protein, 132 aa, Glycine max
  Coding DNA Sequence Number=SeqID_59618
MGHLRVPMNPKRIKVIPEWPAPPSVRKIWGFHDLTNFYKRCWGKKPRVSRTSGFEVKSFSRGREHDVTSIGASEWSMKRERRRYFKEKMSLEEAHHHRRQWIRAWRKKEMNEGRGREEHGILCSKRALKCEI

SEQ ID NO: 151304 - protein, 276 aa, Glycine max
  Coding DNA Sequence Number=SeqID_59619
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLALDRRLQVDWDSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151305 - protein, 51 aa, Glycine max
  Coding DNA Sequence Number=SeqID_59620
TIEEIFIWHGASIGFWRGRNLTDYLTTGVKYLEVVKRRLHATKQWSPDEIR

SEQ ID NO: 151306 - protein, 248 aa, Glycine max
  Coding DNA Sequence Number=SeqID_59621
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGGFVHARALSAILNRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151307 - protein, 126 aa, Glycine max
  Coding DNA Sequence Number=SeqID_59622
RRCVAGVCGGHGRAAAGVDTGRATTGKGNSPRRQGQRLHLTAKENHLHLWHEAQHAWATAASARAIVAVDLQGLGGVVMQLEAAMLQAALHPRDRFGMMGDAMILPARWGEHAQRQQPQPLAVQYQ

SEQ ID NO: 151308 - protein, 270 aa, Glycine max
  Coding DNA Sequence Number=SeqID_59623
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFRTECVVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151309 - protein, 25 aa, Glycine max
  Coding DNA Sequence Number=SeqID_59624
LSAALAPSLNPLTRAKRDDAISEPI

SEQ ID NO: 151310 - protein, 156 aa, Glycine max
  Coding DNA Sequence Number=SeqID_59625
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-27, Identity=58%"; Hit description =Putative uncharacterized protein
MTMITPSSKLTLTKGNKSWDIAHTCFNEEVQTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 151311 - protein, 73 aa, Glycine max
  Coding DNA Sequence Number=SeqID_59626
  Subcellular localization annotation: CTP_CleavageSite=52; ConfidenceScore=5.44e-01
MTLQTLFLIISPMNSYRKILMPPKASGASLRGGQSTGKGFKLALPEPTVKKSSSTTSGSPTQAGSSTQKPKTE

SEQ ID NO: 151312 - protein, 392 aa, Glycine max
  Coding DNA Sequence Number=SeqID_59627
  Gene Ontology: Cellular component=integral to membrane
  Homolog annotation: Hit_ID=A6TH76; Match level="QueryCoverage=77%, HitCoverage=27%, E-value=1e-139, Identity=86%"; Hit description =Putative periplasmic binding protein
IRASEALVDELDLAQLSANNRQELSRIRSELAQKQSEQLDAYLQALRNQQNSQRQREAEKALESTELLAENSENLPPGIIDQFKINRELSQALNQQVQRLDLVASQQRQATNQTLQVRQALNTLREQSQWLGSSNLLGEALRAQVARLPERPRPQQLDTETAQLRVQRLHYEDLLSKQAQLRLIRQADGEPLTAEQNRILQAQLRTQSELLNSLLRGGDTLLLELTKLKVANGQLEDALKEINEATHRYLFWTSDVSPIGFSWPLEVVQDLRRLISLDTINQLGKASVMMLTSKETLFPLFGALVLRADWQGDSGSFLADAAYRVLVNSGGFAAAGIVDDARLRIAGGLALPAGGRHWRRRDRHRAAAVGSDDLRYLRPAKWIVHRPLRLAA

SEQ ID NO: 151313 - protein, 33 aa, Glycine max
  Coding DNA Sequence Number=SeqID_59628
MKECSWLDMLGETSSKNKRLIPQSNFKARYQLL

SEQ ID NO: 151314 - protein, 275 aa, Glycine max
  Coding DNA Sequence Number=SeqID_59629
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLEPVLSLNLGNTVGCTNTSTLVLLVGDLESWTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151315 - protein, 89 aa, Glycine max
  Coding DNA Sequence Number=SeqID_59630
MKHFTDTLISANIGTKAGTGPPLEVDGIDKLDRPGLKIANKKHKRGRVGAPHRVTKVETENWFKIEFLQPGGSTSSRAAATAVELQFAL

SEQ ID NO: 151316 - protein, 139 aa, Glycine max
  Coding DNA Sequence Number=SeqID_59631
MAPRKLASKRSRKDKAAEETSSAPEYDSHRFRSAVHQQRFEAIKGWSFLRERRVQLRDDEYTDFQEEIGRRRWASLVTPMAKFDPEIVLEFYANAWPTEEGVRDMRSWHAEPGLRFFFMPYSRPSSGQRLHGPGDWPEA

SEQ ID NO: 151317 - protein, 295 aa, Glycine max
  Coding DNA Sequence Number=SeqID_59632
MAPKKLSTKRSRRDAAAEGSNATPEFDSHHFRSAEHQQRFEAIKGWSFHRNRRVQLREDEYTDFQEEIARRHWMSLVTPMAKFDLEVVLEFYANAWPTEEGVRDMRTWVRVQWIPFGADALSQFLGDPLVLEEGQECEFSKRRNRADEFDEEAIAQLLCTLGQDAARTAAGRQVRIMRTSMTTLTQTWMTLLLSNVLPSDHNSNLPLLKCQLVYAILARMSVHVAQVIADAIYLFAGMPPTKHPLDLDKSNRSLGFPALITGLYQSFGVPVTPSKVIRPPITRAFIEKYCTPRQA

SEQ ID NO: 151318 - protein, 61 aa, Glycine max
  Coding DNA Sequence Number=SeqID_59633
MAHQRNKRGYISCGSVLVEGTSTRLFKENKGGYIPCGSFLVKDFTRLKRNLKDRKSLGDWM

SEQ ID NO: 151319 - protein, 63 aa, Glycine max
  Coding DNA Sequence Number=SeqID_59634
MDKSLKVGEEEWRERERRGTKFCASNEIMAAEWRMKKDDWRCHFKEKMSQKEACHYRKPWIRA

SEQ ID NO: 151320 - protein, 97 aa, Glycine max
  Coding DNA Sequence Number=SeqID_59635
MGMSLEWVWAGMVVARSDNESCESSDIEDLDVDFEQPVNQTGEEKDEDWGFLLDLRRIVEREEREIKSHQEETEVVNLGTCEEKNEVKIGTCVSANI

SEQ ID NO: 151321 - protein, 135 aa, Glycine max
  Coding DNA Sequence Number=SeqID_59636
  Subcellular localization annotation: CTP_CleavageSite=33; ConfidenceScore=5.11e-01
MGQNGHFGNIFQPLGPPGSIRKLRDEVTSSPGRASYFWRKQVARLGELLRNLLPSFFINRREGLKGRGSASFGSILVLHVFIFILLPSVIFFFVLRYNLRLTASRYLTHIVRQSVKFRDMPDVERKHCCTIRKVP

SEQ ID NO: 151322 - protein, 67 aa, Glycine max
  Coding DNA Sequence Number=SeqID_59637
MDSGSLFFFQVEDVLGEHATLKRVFTRCGMQGVWLWEILKALQSVLQGYIANCLPFSGISEARLEVA

SEQ ID NO: 151323 - protein, 56 aa, Glycine max
  Coding DNA Sequence Number=SeqID_59638
MERSTSCKVILVGIISNSPNLLHMESGIKLILAPRSMRAFSIETSPIEQGVVTFPG

SEQ ID NO: 151324 - protein, 64 aa, Glycine max
  Coding DNA Sequence Number=SeqID_59639
MKKQQWKRSERQRRRGERRCHPLRNKPWKKELHHQDEPWIRSLERMLQWRKRKRERKREGGARN

SEQ ID NO: 151325 - protein, 129 aa, Glycine max
  Coding DNA Sequence Number=SeqID_59640
  Homolog annotation: Hit_ID=A5BEV8; Match level="QueryCoverage=63%, HitCoverage=10%, E-value=8e-08, Identity=41%"; Hit description =Putative uncharacterized protein
MNNMITLQHTKIKASFETSTHVVGHVFKVTLCKRLLGLVSRYALNKIFVEFERVHYAGKTLSRCGCVMRTTHDLPCAFTLKSKLREIAYPDLNFMCPPPEKVNTKGAQKKLMTKYPRSTKRDPVLLGIC

SEQ ID NO: 151326 - protein, 49 aa, Glycine max
  Coding DNA Sequence Number=SeqID_59641
MAPDRTQLQNMVKKESESFKEYALEGLGSTSSPSHGRKGNDYHDGRHLA

SEQ ID NO: 151327 - protein, 88 aa, Glycine max
  Coding DNA Sequence Number=SeqID_59642
MSGLTRDSLKISASPYQSDLAPYASEPCNAQWNAPGLLRDKHTLRSSRILGEMEVDEPWLGLSRCKIHFLVGVLVYAKGGVCHWKCGR

SEQ ID NO: 151328 - protein, 81 aa, Glycine max
  Coding DNA Sequence Number=SeqID_59643
MEKGDTKEFRRLVLRSFGKGRRETQKEFRRLVLGEFFLAKGEEMKRMNSTSFQGLENQKTLEAITGNRLPNQCNRLHKAFM

SEQ ID NO: 151329 - protein, 32 aa, Glycine max
  Coding DNA Sequence Number=SeqID_59644
MAQGTLYIVSAPSGAGVCFSYHPRRASRRSAW

SEQ ID NO: 151330 - protein, 131 aa, Glycine max
  Coding DNA Sequence Number=SeqID_59645
MLISPAEVSIGLCCHDIGIALTRHLVDPEEPNRALGFPALVSGLCQSYRVPIPPASDPARKTPSGPGEVQQGLGVSSSDYGPLSVLRIACRPRQGNKRTIATSEAPQLIHKSWSVAYDPWLTSRRPSPKPK

SEQ ID NO: 151331 - protein, 56 aa, Glycine max
  Coding DNA Sequence Number=SeqID_59646
MGAKYLEVVKRGSHPNNGWSPDEIRVHDLIRPGCNKFFLVGDNLCIINIVNGHWPR

SEQ ID NO: 151332 - protein, 301 aa, Glycine max
  Coding DNA Sequence Number=SeqID_59647
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDQVHRQARAQRHVPLRGGFGFFKVAELSRLYLRAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 151333 - protein, 205 aa, Glycine max
  Coding DNA Sequence Number=SeqID_59648
WLKAHVQGLDWLPSLRATKRDEDEAPEEDEGVQAFRTELKQAQTVKERFKSAALKIRKENAELRDVNIATTKALEQETKRACREEHSRNKFRGALWGSNSELKLRREERDQSRTNMLAIINKYQEELSLAMTHEHRVADEYAQVYAEKETRGRVIDSLHQEATMWMDRFALTLSGSQELPRLLAKAKAMADTYSAPEEIHRLLSY

SEQ ID NO: 151334 - protein, 50 aa, Glycine max
  Coding DNA Sequence Number=SeqID_59649
MLDTKFVLHPQTPSQVAKDQLTMKDKRDEEKESSLSTVTIPTLETIPPKA

SEQ ID NO: 151335 - protein, 109 aa, Glycine max
  Coding DNA Sequence Number=SeqID_59650
MWMDRFALTLNRSRELPRLLAKAKAMADTYSAPEEIHGLLGYWKNTITKRAARDPYRTRSKSRTMGDQEETQEQMKADMSALKEQMASMMEAMLGMKQLMEKNAATAAA

SEQ ID NO: 151336 - protein, 130 aa, Glycine max
  Coding DNA Sequence Number=SeqID_59651
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=69%, E-value=3e-24, Identity=69%"; Hit description=LacZ protein
MEDGETSKLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAECPAVLLPVTPHPRQ

SEQ ID NO: 151337 - protein, 235 aa, Glycine max
  Coding DNA Sequence Number=SeqID_59652
MGNGPCSALAGDLPVPRVGDLGAAGVDDVPVEQAQVLDRAVGAPGQLAGHVLGYLHVLDRGAQVQLGRQAGGRVRRQRGVDELLRGGLVGRALDQMQAGVGGPHAFLRHAEADGQALVDQVPGADVEVRADHGFAALEGVGGRARAVEEQRGVQRGQLGIERPQVRRVDCPHPRQEEDERHARRVGGRGHRHRAGILGLPQVLPAARRLRHLLGAVGDAERVITGADREGGIAVA

SEQ ID NO: 151338 - protein, 198 aa, Glycine max
  Coding DNA Sequence Number=SeqID_59653
  Homolog annotation: Hit_ID=UPI00006A2939; Match level="QueryCoverage =59%, HitCoverage=75%, E-value=2e-08, Identity=31%"; Hit description =UPI00006A2939 related cluster
GLHALAIRGLRVLTFRGLHALAIRGLHVLTFRGLHALAIRGLHVLTFVGLHALTFRGLHVLANRGLHALTLRGLHVLANVGLHAFTFRGLHVLANRGLHALTFRGLHILAFRGLHVLTLRGLHVLALRGLHALALRGLHVLALRGLHVLTIRGLHALTSRGLHVLALRGLPALALGTSYPHLQRTTCPHLRRATCPHL

SEQ ID NO: 151339 - protein, 61 aa, Glycine max
  Coding DNA Sequence Number=SeqID_59654
MIMRSQDIYSSLDEATTSPSSSESEEAKREESSLQELKSLCFVGAKNRWYDECFEWCNPLL

SEQ ID NO: 151340 - protein, 111 aa, Glycine max
  Coding DNA Sequence Number=SeqID_59655
  Gene Ontology: Mol. function=helicase activity; Biological process =viral genome replication
  Homolog annotation: Hit_ID=Q2A9I1; Match level="QueryCoverage=94%, HitCoverage=7%, E-value=3e-20, Identity=47%"; Hit description =Putative uncharacterized protein
MLDEYNVHAKSFKMTRNRLKDGQMHNEMLKLIVNHEKDGHTYNVPTVQEVVALIVSDLDANSKRDIIVETQQGQLQRIHELHSSYLVLQYPFMFPSGEDGYRPDILHSSSP

SEQ ID NO: 151341 - protein, 57 aa, Glycine max
  Coding DNA Sequence Number=SeqID_59656
  Homolog annotation: Hit_ID=A5BXI2; Match level="QueryCoverage=100%, HitCoverage=5%, E-value=1e-10, Identity=46%"; Hit description =Putative uncharacterized protein
MATSQDGNGGVLPLAFAVVEDKNDICLISDRHASIKSVVANEALGWQPPCGYHVYCV

SEQ ID NO: 151342 - protein, 71 aa, Glycine max
  Coding DNA Sequence Number=SeqID_59657
MANLWLSECCLAKPSVARAKHRLCGLSAICYSMHKAKPALLAKPLFEIKMASRKRKSTTSRPIAQYDTRGF

SEQ ID NO: 151343 - protein, 44 aa, Glycine max
  Coding DNA Sequence Number=SeqID_59658
MGPAMHVSSGEFYMVVSFRREKETMLTISMIHCISKGILVFVLL

SEQ ID NO: 151344 - protein, 186 aa, Glycine max
  Coding DNA Sequence Number=SeqID_59659
MRGAPTEESLSPFLVRDFGTQSFKIIQRVHKAWESPLRKEKELRGIRNGIIGGYHEWLKVHTRGLDWLSKLKIINEENFEAPEEDEEVRALKTELGKARLAKEKFKLVTTDVRKECAKLREENAATARALEQETKRARKEEHGRDKFRGALWGSNSELKLRSEERDQSRAHSTVLKEELAACLMRT

SEQ ID NO: 151345 - protein, 61 aa, Glycine max
  Coding DNA Sequence Number=SeqID_59660
ITTHDSKLAGGGHMNENAIHGAPKKGLRMENCTKQSLRMAPNSGGGHMNENAIQWGLRKRD

SEQ ID NO: 151346 - protein, 164 aa, Glycine max
  Coding DNA Sequence Number=SeqID_59661
MTDLVSAEDDVNLRVSTGLSAVIDERSQKTTQQKVYTNNHSGISARQRDSKVSMTDLVSAEDDVNLRVSTGLSAAIDEGAEDDVSLYVLSGFLSYRQQKVYTDNHSGIFARQRDSKVSMTDLVSAEDDRDSKVSMTDLVSAEDDKQKVYTDNHSGISGRQRDSK

SEQ ID NO: 151347 - protein, 91 aa, Glycine max
  Coding DNA Sequence Number=SeqID_59662
MQSQGLALPPEPEVGPSPAHVSTKESCVDPSGNDPNTGDSDKYGLELWDQQNLQIGRIMRSMIPISDDIDHPTTFSKAIAGYVGCYRVRGV

SEQ ID NO: 151348 - protein, 33 aa, Glycine max
  Coding DNA Sequence Number=SeqID_59663
MWVSDMNGSRMEKEEREETPLQGEDESRRSSPP

SEQ ID NO: 151349 - protein, 51 aa, Glycine max
  Coding DNA Sequence Number=SeqID_59664
MEDMPSFQESSLPFIYYMRKNTSQPGSQDFGHYFIGTPYKRDGSIIIKSLQ

SEQ ID NO: 151350 - protein, 111 aa, Glycine max
  Coding DNA Sequence Number=SeqID_59665
  Gene Ontology: Mol. function=RNA-directed DNA polymerase activity; Biological process=RNA-dependent DNA replication
  Homolog annotation: Hit_ID=A5C3T8; Match level="QueryCoverage=51%, HitCoverage=4%, E-value=2e-12, Identity=57%"; Hit description =Putative uncharacterized protein
MHRILLEDGAKSVRQPQRRLNPVILDVVKKEVTKLLRLNQVTRKDHFPLPFIDQIWRRSLIKCLSAWQGFIGVLSRILAKWPFHYPICCKRRWSLILMTGVKRLLIASSVQ

SEQ ID NO: 151351 - protein, 127 aa, Glycine max
  Coding DNA Sequence Number=SeqID_59666
MTRGNPSYLQPFDPEIDRTFHRLVRHHFIPFDHSEHSITGESVHSVIGDFEHPDLEHYNFEHFDSEHSDFAHSQNMAQPPPRERTLREMAAPDFTYESLCIQYPDEDVPYVLKTGLIHLLPKFHGLA

SEQ ID NO: 151352 - protein, 65 aa, Glycine max
  Coding DNA Sequence Number=SeqID_59667
  Gene Ontology: Mol. function=sequence-specific DNA binding; Biological process=regulation of transcription, DNA-dependent
  Homolog annotation: Hit_ID=P03034; Match level="QueryCoverage=92%, HitCoverage=25%, E-value=1e-17, Identity=80%"; Hit description =Repressor protein CI
MGMGQSGVGALFNGINALNAYNAALLTKILKVSVEEFSPSIAREIYEMYEAVSMQPSLRSRDVLT

SEQ ID NO: 151353 - protein, 291 aa, Glycine max
  Coding DNA Sequence Number=SeqID_59668
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINNCNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151354 - protein, 293 aa, Glycine max
  Coding DNA Sequence Number=SeqID_59669
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIKYWTIGVRQLFVSMLMAQYTDYTEIKSQVVDRRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151355 - protein, 116 aa, Glycine max
  Coding DNA Sequence Number=SeqID_59670
  Homolog annotation: Hit_ID=Q1H2M1; Match level="QueryCoverage=94%, HitCoverage=75%, E-value=6e-34, Identity=62%"; Hit description =Putative uncharacterized protein
  Pfam annotation: Domain name=DUF1841; Domain location=1-109; Score =161.3; E_value=2.6e-45; Accession=PF08897.2; Description=Domain of unknown function (DUF1841)
MAVGIMHMHPEYHTILDHPEQYLEQAYYPEMGETNPFLHMSLHLSIQEQISINQPIGITPAYGKLCTRFQEEHEAQHALLECLAETIWLAQRNQTGLDAAHYLNLIEQRAGIAPST

SEQ ID NO: 151356 - protein, 147 aa, Glycine max
  Coding DNA Sequence Number=SeqID_59671
VAEDDVSLCVLSGFRLTDSKKVYTDNHSGISARQRDSKVSMTDLVSVEDDRDSKVSMTDLVSAEDDQKVYTDNHSGISARQRDSKVSMTDLVSAEDDGAEDDVSLCVLSGVSSYRMQKVYTDNHSGISSRQRDSKVSMTDLVSAEDD

SEQ ID NO: 151357 - protein, 83 aa, Glycine max
  Coding DNA Sequence Number=SeqID_59672
NCFTAVGAWRQGEQKADVTKAGVAAHDVQRYVKESDRAAQCTRQDEMSNEELKLQDSRCRIQCPGHPARKYWSCCTMHNAGST

SEQ ID NO: 151358 - protein, 236 aa, Glycine max
  Coding DNA Sequence Number=SeqID_59673
  Homolog annotation: Hit_ID=Q6WAY6; Match level="QueryCoverage=96%, HitCoverage=37%, E-value=4e-23, Identity=31%"; Hit description =Putative uncharacterized protein
MANQEEWALFMDVLALLIFGVVLFPNMDGLVDLVAIDAFLAYHHSKESPVVAILADLFDTFVRRCEKSSARIICFLPTLCVWLVSHLFQHDIRHPCPLRSHHAYVENRRVDWDQHLAGIGGRTISWFPRWKEGKEGVLFSCGDYPNIPLIGTRGCINYNSALAIRQLGYPMRGAPSEESLSPFVMRDFSAQSFKIIQRVHKAWESPLRKDKELRGIHNGIIGGYHEWLKVHKRGLD

SEQ ID NO: 151359 - protein, 281 aa, Glycine max
  Coding DNA Sequence Number=SeqID_59674
  Gene Ontology: Mol. function=nucleoside-triphosphatase activity; Cellular component=chloroplast
  Homolog annotation: Hit_ID=Q2PMM5; Match level="QueryCoverage=97%, HitCoverage=13%, E-value=1e-121, Identity=73%"; Hit description =Protein ycf2
  Pfam annotation: Domain name=AAA; Domain location=99-281; Score= -37.0; E_value=0.036; Accession=PF00004.20; Description=ATPase family associated with various cellular activities (AAA)
MIKFYGDLTHSHHLSKNNSGYQMIEQPGAIYLRYLVDIHKKYLVIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKKMSHTNGFGSTTMGSNVRDLVALTNEALSD

SEQ ID NO: 151360 - protein, 120 aa, Glycine max
  Coding DNA Sequence Number=SeqID_59675
MASNKKETKKELIDRDICHALWGDPDVQWADQPATHTAGGILCLWSEKVFRMERKIIGPGYGILIVPEITQRDLEHATGVWRILGLENLMDGLKTWRLTNHLGWEVSSPGYDPMDQLGAS

SEQ ID NO: 151361 - protein, 69 aa, Glycine max
  Coding DNA Sequence Number=SeqID_59676
LEVGSGSYWKLEVGNESYWKLKVEMEVVVIIKKGENVNHEDFDDIKKNLLEKEGDVNHASFDGVEKKSH

SEQ ID NO: 151362 - protein, 228 aa, Glycine max
  Coding DNA Sequence Number=SeqID_59677
  Homolog annotation: Hit_ID=Q6WAY4; Match level="QueryCoverage=90%, HitCoverage=36%, E-value=1e-25, Identity=34%"; Hit description =Putative uncharacterized protein
MGTYQTSKRFYQVKIKGLDITSIKELGRLMGPLQMQAFRKAYGKILDLTIAEISTEAIASLAQYYDQPLRCFTFGDFQLVPTVEDFEEILGCPLGGRKPYLFSGFLPSLSKIAIVVRDSVRGLDRVKQTRNDIVGLPWKYLEGKARDMANQEEWVPFMDILALLIFGVFLFPNVDGLVDLAAINVFLAYHHSKESPMVAILADLFDTFDRRCKKSSARIICCLPALCV

SEQ ID NO: 151363 - protein, 87 aa, Glycine max
  Coding DNA Sequence Number=SeqID_59678
MYNTSFQLLLIWNSAIKGLDDAPQPKSKASAMWIVVKCNRQKGSTKCGYYVMHWMSTIILGTFRNNWEAYFNDSRPLEPERLKALQI

SEQ ID NO: 151364 - protein, 160 aa, Glycine max
  Coding DNA Sequence Number=SeqID_59679
MWSFLTGRQIDWAHLVQYRMHKALWANAPLPYPQLVTLFLRHFQIPLDDEPFGQVKSSFATGAGAVTSFGYCKDRNGQWLKKDALPPQDERTPSPPPQRDDSALMTEVLSELRGLRTYVGEHFDSLDTRFAGMDIRLTQLEEDVGYIRQSFDLPPPPPPS

SEQ ID NO: 151365 - protein, 286 aa, Glycine max
  Coding DNA Sequence Number=SeqID_59680
  Homolog annotation: Hit_ID=Q6WAY6; Match level="QueryCoverage=84%, HitCoverage=45%, E-value=2e-16, Identity=28%"; Hit description =Putative uncharacterized protein
ASVNWFPRWKEGRTGILISCGGFPNVPLMGTRGCINYNPVLAIRQLGYPMRGAPLKEELTPIIARGFNSTNAEALQKVRKAWEMVQKKDKELKGSSNKPIGGYHRWLKAYMQGLDWLPNLRTTKGVEVEAPEKDEEENTKLRDINIAIAKALEQETKRAHREEHGRNKFRGALWGSNSELKLWREEKDQSRVDSLILKDELRICLRSKRSLSQQLCETETNMLAIISKYQEELNLATAHEHKVADEYAQVYAEKEARGRVIDSLHQEATMWMDRFALTLNGSQELP

SEQ ID NO: 151366 - protein, 94 aa, Glycine max
  Coding DNA Sequence Number=SeqID_59681
MVAVGDGETTRKRRLKCLNKRCSRERKLLAHSRHLLNDPNGQIMENCLVKLKTKFREDPTVNEGWEAFLPRQLHVAFSRSFIKRLPPEASSWLL

SEQ ID NO: 151367 - protein, 199 aa, Glycine max
  Coding DNA Sequence Number=SeqID_59682
TIKEAKGFFKSESTTFRDSGNANSFLYSLCLIVFIRRTADIAFENSNLIPFMSLKLLVYSELVKAFYSNLEIQEGTLISEVYGIKMVIDQSLFYELTQLSSECVPFEGTLIDDWKYEFSVHDARRLVCTNQADMTGRLLAGSLAFESHILHYLIVCILLPRSLNLAQVSEEDLIVMWAFHKGRQIDWAHLLRYRMHKAL

SEQ ID NO: 151368 - protein, 93 aa, Glycine max
  Coding DNA Sequence Number=SeqID_59683
MNVLSGATFFYKITRAPNIFMVCVHRDPLGVEEKSLEFQEPWDLRSNPFQGEGMMQSYPARALDRRLQEDWAKDAREGPRVLMSLRVDFRPMG

SEQ ID NO: 151369 - protein, 84 aa, Glycine max
  Coding DNA Sequence Number=SeqID_59684
MELPTVATYPSTGGRCGAHGCVFQERKMRGIATNVYSKKTSEKPEKVWSTNFNRERFGSCFYTRGRVFPSLLRILNCDEEIRPT

SEQ ID NO: 151370 - protein, 148 aa, Glycine max
  Coding DNA Sequence Number=SeqID_59685
  Gene Ontology: Mol. function=monooxygenase activity
  Homolog annotation: Hit_ID=A6T9R3; Match level="QueryCoverage=98%, HitCoverage=43%, E-value=4e-68, Identity=83%"; Hit description =Putative luciferase-like monooxygenase
MSYRLSLLDKSPIAAGESATQALHRTLQLAQRAEAWGYHRFWLAEHHNSDQLASPSPELLIAWIIGQTRHIRVGSGGVMLQHYSPYKVAENFNLLAALAPGRIDLGVGKAPGGLPLSTRALQLGVHQQEKGSFAEQLALLDSWLSVPP

SEQ ID NO: 151371 - protein, 101 aa, Glycine max
  Coding DNA Sequence Number=SeqID_59686
EAAQSGNVDGVIDPPSPVRRHVKWKMARTKKTGEMTTEVVKEIAEKIDSFEEQATQGSFVPHGRQDVWPLQLDVQSTLDVSVLLEPIRDQLEESIIEKVTR

SEQ ID NO: 151372 - protein, 46 aa, Glycine max
  Coding DNA Sequence Number=SeqID_59687
MAGSKQQMHHSHLQSPSAHLQKLERCLRPVVDQQATKSKAKGSKIP

SEQ ID NO: 151373 - protein, 23 aa, Glycine max
  Coding DNA Sequence Number=SeqID_59688
VRDKQAIRRPGQDVKEALLGGNL

SEQ ID NO: 151374 - protein, 139 aa, Glycine max
  Coding DNA Sequence Number=SeqID_59689
MQCMNMLREPGKSSLLTCYSRAQCPMCAVKKVIWTFRLPVSKDEINIQCMRDDKIRCAKAQQGEVSSHSKKHIVAVGTTSNNMLSKRKTLDEGSLSSSKSETQHDHRFTSTPYVPMDPGIGPLFNSPCVQIVLVFVFIK

SEQ ID NO: 151375 - protein, 107 aa, Glycine max
  Coding DNA Sequence Number=SeqID_59690
MHPPPSSLGAPRIYCLTAVRLSSTLKSYPEPHELIIIHASSTIESRALRIVLPSAVRLSSTLKSYSEPHEVIVIHASSTIESGTPRIDCLALFIYPPPSNIIRCPTN

SEQ ID NO: 151376 - protein, 564 aa, Glycine max
  Coding DNA Sequence Number=SeqID_59691
  Gene Ontology: Mol. function=ATP-dependent helicase activity; Cellular component=nucleus; Biological process=RNA-mediated posttranscriptional gene silencing
  Homolog annotation: Hit_ID=A7PDE9; Match level="QueryCoverage=66%, HitCoverage=71%, E-value=1e-159, Identity=68%"; Hit description =Chromosome chr17 scaffold_12, whole genome shotgun sequence
  Pfam annotation: Domain name=DUF1605; Domain location=456-554; Score =14.6; E_value=0.0026; Accession=PF07717.7; Description=Domain of unknown function (DUF1605)
  Pfam annotation: Domain name=HA2; Domain location=376-443; Score =16.3; E_value=0.0079; Accession=PF04408.14; Description=Helicase associated domain (HA2)
  Pfam annotation: Domain name=Helicase_C; Domain location=229-323; Score=56.6; E_value=8.8e-14; Accession=PF00271.22; Description =Helicase conserved C-terminal domain
  Pfam annotation: Domain name=PWI; Domain location=4-77; Score=5.9; E _value=0.0023; Accession=PF01480.8; Description=PWI domain
  Pfam module annotation: Pfam domain module=DUF1605::HA2::Helicase _C::PWI; Domain location=456-554::376-443::229-323::4-77
MGSDDSLKTWVSDKLMSILGYSQPTVVQFMIGLSKQATSPAHLVGKLVEFGISSMDTHAFAEEIYSRVPHRSSGSRRLTYSILKADDDSDDDYVDKSSVTTASSRRKEKERQVKRRTSPDEVSDSESEEERLKDQREKEELEQHMRERDAAGTRKVLVNVQIDLDIARFRPDLKLLISSATLDAEKFTIVTSLQIHVTQPPGDILVFLTGQEEIETAEEILKHRTRGLGTKISELIICPIYANLPTELQAKIFEPTPEGARKVVLATNIAETSLTIDGIKYVIDPGFCKMKSYNPRTGMESLLVTPISKASANQRAGRSGRMGPGKCFRLYTAYNDLDDNTRTNLANVVLTLKSLGIHDLLNFDFMDHPPAEALLKALELLFALSALNKLGELTKCSDDIISIAAMLSVGNSIFYRPKDKQVHADNARLNFHTGNVGDHMALLKVRSMKRARDIRDQLAGLLERVEIELTSDANDLDAIKKSITSRFFPHSARLQKNGSYRTVKHSQTVHIHPSLGLAQLVGLGSSSSMDSFASWKMNGSGMEKEEREETPLQGEDESRRSSPP

SEQ ID NO: 151377 - protein, 162 aa, Glycine max
  Coding DNA Sequence Number=SeqID_59692
MSNLRFLEQRGKNDDVFLTGIGGCHVSVIRNHANEIFEREFSVLVFVLVEILNDVSEQRDLAGKDQTAVTSESELFFGLFEEAIEEREVKEARRDGEASAFGAHIDEDEAGGRAARGGGFVVGAAAEADVLPARHKLEGEASALVSELLERVLKTKKEKEIK

SEQ ID NO: 151378 - protein, 28 aa, Glycine max
  Coding DNA Sequence Number=SeqID_59693
MEEVNDMGIKFLFGFRLDCNDWRIEDYT

SEQ ID NO: 151379 - protein, 410 aa, Glycine max
  Coding DNA Sequence Number=SeqID_59694
  Gene Ontology: Mol. function=protein kinase activity; Biological process=protein amino acid phosphorylation
  Homolog annotation: Hit_ID=A7PEA2; Match level="QueryCoverage=87%, HitCoverage=47%, E-value=2e-82, Identity=47%"; Hit description =Chromosome chr11 scaffold_13, whole genome shotgun sequence
MGKVAIFWPIQRFRWLLGLQAEKFEMSSQKGRHEHEEEMGTGKVVVVAVKASRDISRNALVWALTHVVQPGDCIKLLVLIPPLSSSKRVWGLSRFTTDCASSHWRSSLGTISDQKEVITDSCSQLVLQLHDFYDPEKIKIRVKILSGSLSGAVAAEAKRVQSSWVILDNNYLFFHNFRKLKLEKKDCMEQLHCNIVIMKRSRPKILRLNLNSSSKMELNMACPLALSNFKDNSEHADIIRGPAVTPASSPEQGSPLLTATDIGTSSISSSDPATSPFFHSDNHERQRRGFTFVHEGLTNLEDIESDSESEKLSMSSKSSYFQPWIANVICMDGDYSKHENMQRSSDKTLATAYETLLQKFSKLDQDPILGMLNCKLDVNLSKSVREAISLSKTSAPGPPPLCSICQHKAP

SEQ ID NO: 151380 - protein, 344 aa, Glycine max
  Coding DNA Sequence Number=SeqID_59695
  Gene Ontology: Mol. function=molecular_function; Cellular component =cellular_component; Biological process=multicellular organismal development
  Homolog annotation: Hit_ID=A7PEA8; Match level="QueryCoverage=99%, HitCoverage=93%, E-value=1e-165, Identity=82%"; Hit description =Chromosome chr11 scaffold_13, whole genome shotgun sequence
  Pfam annotation: Domain name=Abhydrolase_1; Domain location=59-293; Score=-1.2; E_value=0.0065; Accession=PF00561.11; Description =alphabeta hydrolase fold
  Pfam annotation: Domain name=Ndr; Domain location=5-302; Score=517.0; E_value=2.2e-152; Accession=PF03096.5; Description=Ndr family
  Pfam module annotation: Pfam domain module=Abhydrolase_1::Ndr; Domain location=59-293::5-302
MGNHEHHIRTGCGIVSVIVYGDPDKPALITYPDLALNYMSCFQGLFFCPEAASLLLHNFCIYHISPPGHEVFFPLKLPQEFLQLGAAAICAEDPVPSAEDLADQIIEVLNYFGLGAVMCMGVTAGAYILTLFAIKYRERVLGLILVSPLCKAPSWTEWFYNKVMANLIYFYGMCGLLKECLLQRYFSKEVRGNVEVAESEIVQACRKLLDERKRTNVLRFLEAINQRPDISDGLKRLKCRTLIFVGDSSPFHSEALYMTSKLDRRYSALVEVQACGSMVTEEQPHAMLIPMEYFFMGYGLYRPTQFSDSPRSPLSPSCISPELLSPESMGLKLKPIKTRVSLQV

SEQ ID NO: 151381 - protein, 37 aa, Glycine max
  Coding DNA Sequence Number=SeqID_59696
MAGAPWPAKKTSTHVGNGLQILRCKFSEPIESAIMRY

SEQ ID NO: 151382 - protein, 513 aa, Glycine max
  Coding DNA Sequence Number=SeqID_59697
  Gene Ontology: Mol. function=receptor activity; Cellular component =mitochondrion; Biological process=protein amino acid phosphorylation
  Homolog annotation: Hit_ID=Q9C5B1; Match level="QueryCoverage=100%, HitCoverage=78%, E-value=1e-148, Identity=54%"; Hit description =Putative uncharacterized protein At5g08660
  Pfam annotation: Domain name=DUF668; Domain location=242-333; Score =165.1; E_value=1.9e-46; Accession=PF05003.3; Description=Protein of unknown function (DUF668)
MTNLSAGGFVSGAVTKGNEIGILAFEVANTIVKGFSLMESLSTKNIKHLKEEVLQLEAVQDLVSKDTDELLKIVGADKRDELKVFSDEVIRFGNRSKDPQWHNLDRYFEKVSRELNSQRQSKEEAELLMQQLMTMVQFTAELYHELHALDRFAQDYQHKREEDDNSGAAQSGDGLSILRAELKSQKKQVKHLKKKSLWSRSLEEIMEKLVEIVHFLHLEINNAFGTADDHKPLIRTISNRQKLGPAGLALHYANIVLQIDTLVARSSSMPANTRDALYQSLPPNIKLALRSKLPSFHVVKEVQSYLLLTISDIKQEMEKTLHWLVPIATNTAKAHHGFGWVGEWASTGSELNKKTMKADVLRIETLHHADKDKVENYILELLLWLHRLAVKSKAGIDTGETRSTLKSQVGTALQTTNQQSTKALSPLLTTDEQKMLQDVSNKIRIRRISKSLDFDSVMADNDRLTKSSSYSYSSTSRSKELSFNRILSKLPVIDFGIDKKRALDVIDRLDVVR

SEQ ID NO: 151383 - protein, 95 aa, Glycine max
  Coding DNA Sequence Number=SeqID_59698
  Gene Ontology: Mol. function=X-Pro aminopeptidase activity; Biological process=proteolysis
  Homolog annotation: Hit_ID=A7PEB4; Match level="QueryCoverage=100%, HitCoverage=20%, E-value=1e-21, Identity=57%"; Hit description =Chromosome chr11 scaffold_13, whole genome shotgun sequence
MELHVKNREKLLTSLRQHLSESSRPPSRWRRANALRHRSLEALHESFFAYFFGVIEPGFYAAIDVATGNSILFAPRLPSEYAVWLGVIKPLSYFK

SEQ ID NO: 151384 - protein, 240 aa, Glycine max
  Coding DNA Sequence Number=SeqID_59699
  Gene Ontology: Mol. function=caffeoyl-CoA O-methyltransferase activity; Cellular component=integral to membrane; Biological process=lignin biosynthetic process
  Homolog annotation: Hit_ID=A5BVQ3; Match level="QueryCoverage=95%, HitCoverage=14%, E-value=3e-74, Identity=63%"; Hit description =Putative uncharacterized protein
  Pfam annotation: Domain name=Methyltransf_3; Domain location=28-239; Score=399.1; E_value=6.7e-117; Accession=PF01596.8; Description=O -methyltransferase
MDNISKPEVILQSEGLLKDARIICQYILETGVYPREAEILKELRNATAEHPLGFMGAAPDAGQLMAMLLKLLNAKKTIEVGVFTGYSLLLTALTIPNDGKIIAMDPDRKAYEIGLPFIKKAGVEHKIDFIECPALPVLDKLLEEPANEGSFDFAFIDADKNNYWNYHERLIKLVKIGGLVAYDNTLWGGTVALPEKAVSEPKREWRRLSLAFNKAISKDCRVQIAFLSIGDGVIICMRVR

SEQ ID NO: 151385 - protein, 80 aa, Glycine max
  Coding DNA Sequence Number=SeqID_59700
MKVDITDFRDLINGYLWRVLTGYHRVKYCSVRTVEKLTIKGVANGIKANLSSSTVGFEDEPDRSWWACNTPDKSHWKEWD

SEQ ID NO: 151386 - protein, 161 aa, Glycine max
  Coding DNA Sequence Number=SeqID_59701
  Subcellular localization annotation: CTP_CleavageSite=55; ConfidenceScore=5.28e-01
MAELSQASYQAWRLHSSGRPTYLHPLCHHRNHARSFFPSISLNLTLSKSANTNAIASTVFSTSTSQPQLEDYSVFDDHENSAEYLVLGLEQTPLPLGSDVFGLGSSCSVRLSNEAVSASLVKKENENETQWFAEDESFLLDFVYEDNGFVSQENSSEVPPL

SEQ ID NO: 151387 - protein, 473 aa, Glycine max
  Coding DNA Sequence Number=SeqID_59702
  Gene Ontology: Mol. function=6-phosphofructokinase activity; Cellular component=6-phosphofructokinase complex; Biological process=glycolysis
  Homolog annotation: Hit_ID=A7PEE3; Match level="QueryCoverage=98%, HitCoverage=94%, E-value=0.0, Identity=81%"; Hit description =Chromosome chr11 scaffold_13, whole genome shotgun sequence
  Pfam annotation: Domain name=PFK; Domain location=95-345; Score=28.5; E_value=7.8e-15; Accession=PF00365.11; Description=Phosphofructokinase
MGSSPNSKPKIIRGSAGYVLEDVPHMADYIPDIPTYSNPLQNNPAYSVVKQYFVHVDDSVPQKIIANKDSPRGVHFRRAGPRQRVYFESDDVQAAIVTCGGLCPGLNTVIRELVCALYHMYGVKKILGINGGYKGFYAHNTITLTPKSVNDIHKRGGTILGSSRGGHDTTKIVDSIQDRGINQVFIIGGDGTQRGADRIFEEIRRRRLKVAVVGIPKTIDNDIPVIDKSFGFDTAVEEAQRAINAAHVEAESGENGIGVVKLMGRYSGFIAMYATLASRDVDCCLIPESPFHLEGPGGLFEFTEKRLKENGHMVIVIAEGAGQELVSESIQSLNKQDASGNKLLQDVGLWISQKIKDYFNKQKRMTINLKYIDPTYMIRAVPSNASDNVYCTLLAQSAVHGAMAGYTGFTSGLVNGRQTYIPFYRITEGQNKVIITDRMWARLLSSTNQPSFTIAKTVSEEKREEEANGHISE

SEQ ID NO: 151388 - protein, 739 aa, Glycine max
  Coding DNA Sequence Number=SeqID_59703
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=86%, HitCoverage=88%, E-value=0.0, Identity=66%"; Hit description =Chromosome chr18 scaffold_1, whole genome shotgun sequence
  Pfam annotation: Domain name=MORN; Domain location=119-141; Score =30.7; E_value=5.3e-06; Accession=PF02493.11; Description=MORN repeat
  Pfam annotation: Domain name=MORN; Domain location=142-164; Score =27.6; E_value=4.7e-05; Accession=PF02493.11; Description=MORN repeat
  Pfam annotation: Domain name=MORN; Domain location=165-187; Score =24.6; E_value=0.00037; Accession=PF02493.11; Description=MORN repeat
  Pfam annotation: Domain name=MORN; Domain location=188-210; Score =37.8; E_value=3.9e-08; Accession=PF02493.11; Description=MORN repeat
  Pfam annotation: Domain name=MORN; Domain location=211-233; Score =37.8; E_value=3.8e-08; Accession=PF02493.11; Description=MORN repeat
  Pfam annotation: Domain name=MORN; Domain location=73-95; Score=25.8; E_value=0.00016; Accession=PF02493.11; Description=MORN repeat
  Pfam annotation: Domain name=MORN; Domain location=96-118; Score =37.6; E_value=4.5e-08; Accession=PF02493.11; Description=MORN repeat
  Pfam annotation: Domain name=PIP5K; Domain location=425-705; Score =453.9; E_value=2.1e-133; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=119-141::142-164::165-187::188 -210::211-233::73-95::96-118::425-705
  Subcellular localization annotation: CTP_CleavageSite=47; ConfidenceScore=5.17e-01
MQETLLSLPLSHHEDIHILPKKKKTQQLHHNKAGSDNTTNTNSHPTRVSRRVSPAVSPSSGGGEKSLPNGDIYSGALSGNAPHGTGKYLWSDGCMYEGEWRKGKACGKGRFSWPSGATYEGEFKSGRIDGFGSFIGVDGDMYRGSWVADRKHGFGEKRYGNGDVYEGWWRCNLQEGEGRYTWRNGNEYVGEWRGGVISGKGVLVWANGNRYEGYWENGVPVGKGVFTWCDGSTCAGNWRKEFMEEAREEKMMKRSSVDDGFKSVSFPRICIWELDGEAGDITCDIVHNAEASLFYRDGTTTTTACESENSGDDNNKSPCWSLDGTAGGDVKKPGQTVSRGHKNYDLILNLQLGIRYTVAKHASIVRELRPGDFDPKEKFWTRFPPEGSKFTPQHHSVDFRWKDYCPMVFRHLRELFAIDPADYMLAICGSDTLREMSSPGKSGSIFYLTQDDRFIIKTVKKSEVKVLIRMLPSYYQHVCQYKNSLVTAFLGVHCVKPVGGQKTRFIVMGNVFCSEYRIHKRFDLKGSSHGRSTDKPREQIDETTTLKDLDLNFVFRLEQSWFQELIWQLGRDCEFLEAEGIMDYSLLIGLHFRDDSSVDEMKSSPRSSHSGKRDMFDNEMLTCRGPLIRLGMNMPATAERVCKAGLDHQTTSGSSNSQISDVILYFGIIDILQDYDISKKIEHAYKSLQVDSTSISAVDPKLYSKSAWRPKEYRMRTGTNSGLLRWHSMHQEMLQTWVI

SEQ ID NO: 151389 - protein, 448 aa, Glycine max
  Coding DNA Sequence Number=SeqID_59704
  Gene Ontology: Mol. function=phosphoric diester hydrolase activity; Cellular component=nucleus; Biological process=DNA repair
  Homolog annotation: Hit_ID=A7P2B3; Match level="QueryCoverage=37%, HitCoverage=15%, E-value=5e-35, Identity=47%"; Hit description =Chromosome chr19 scaffold_4, whole genome shotgun sequence
  Pfam annotation: Domain name=zf-XS; Domain location=364-397; Score =5.5; E_value=0.046; Accession=PF03470.5; Description=XS zinc finger domain
MRRCFWSGRDAPSVGWVYSGSHNFSAAAWGRQISNPFRTKADRPKKEDPSVNYGLHICNYELGIIFTFPPTENNGCLEVKSTKLDDIILPFVVPAPKYRSSDRPATKQAMREVMVELAEREKEKHTEEEMMDELDDEEEYVELPEELEATNYVEQENEDEKAYADILWSQDLKVVATHHAIAAAVNCAITPRRYKRVTSFSVKILILWKCAIRQEAVGPAVKWIPGKNVLESLPKTEQLTQGVADANLDSGQDDGEWVMELLGTTGELEGLLEESQNVNFKTPAGRGNNWQSISGSKQSKSVDDSLVKGEITDESPVKNDSVDDEGEEEEEEEEEGFDAMEDTDDDLMSDDYDSDTSQKSHETRGPGAIDWYRGLQPLITHGKTKGSKKVKIHREFAALLEVELRRRGTSVIPPGEVFGKWKGLKDEKDHEIVWPPMVVIQNTRLEQD

SEQ ID NO: 151390 - protein, 936 aa, Glycine max
  Coding DNA Sequence Number=SeqID_59705
  Gene Ontology: Mol. function=oxidoreductase activity; Cellular component=integral to membrane; Biological process=electron transport
  Homolog annotation: Hit_ID=Q5ENY4; Match level="QueryCoverage=94%, HitCoverage=99%, E-value=0.0, Identity=74%"; Hit description =Respiratory burst oxidase 1
  Pfam annotation: Domain name=FAD_binding_6; Domain location=584-674; Score=-22.1; E_value=0.092; Accession=PF00970.15; Description =Oxidoreductase FAD-binding domain
  Pfam annotation: Domain name=FAD_binding_8; Domain location=582-702; Score=186.2; E_value=8.1e-53; Accession=PF08022.3; Description=FAD -binding domain
  Pfam annotation: Domain name=Ferric_reduct; Domain location=384-541; Score=163.7; E_value=5e-46; Accession=PF01794.10; Description=Ferric reductase like transmembrane component
  Pfam annotation: Domain name=NADPH_Ox; Domain location=125-226; Score= 210.7; E_value=3.4e-60; Accession=PF08414.1; Description=Respiratory burst NADPH oxidase
  Pfam annotation: Domain name=NAD_binding_6; Domain location=708-871; Score=250.6; E_value=3.4e-72; Accession=PF08030.3; Description =Ferric reductase NAD binding domain
  Pfam annotation: Domain name=efhand; Domain location=227-255; Score =26.1; E_value=0.00013; Accession=PF00036.23; Description=EF hand
  Pfam annotation: Domain name=efhand; Domain location=271-299; Score =5.1; E_value=5.2; Accession=PF00036.23; Description=EF hand
  Pfam module annotation: Pfam domain module=FAD_binding_6::FAD_binding_ 8::Ferric_reduct::NADPH_Ox::NAD_binding_6::efhand::efhand; Domain location=584-674::582-702::384-541::125-226::708-871::227-255::271 -299
MGGTCADLHHHESDIELTDAERIGTDVGPDSGTKSQGEEAEGQHYVEVTMDIHRDSVALHSVKTVAADDVDMVEEEEEEGDKLGLMGKKRLEKKTSFGASVVQSAANRMKQLKRLASFSKPAPKHFERTKSAVGHALTGLKFISKTDGGAGWVEVEKRFHKLTATTDGYLPRALFAQCLGLNKESEAYAEKLFDTLARQRGIQGGSINKIQMKEFWDHISDQSFDTRLKTFFDMVDKDADGRITEEEIKEIICLSATANKLSNIQKQAEEYAALIMEELDPDDTGYIMIDNLETLLLHGPEETTRGESKYLSQMLSQKLKPTFADSAVMRWCRDAKYFLLDNWQRSWVLALWIGVMFGLFAYKFVQYRRKAAYEVMGHCVCMAKGAAETLKLNMALILLPVCRNTITWLRNKTKLGVVVPLDDNINFHKVIAVAIAVAVAVHSIYHLTCDFPRLLHASDEKYKLMQPFFGDRPSDYWYFVKSWEGVTGIIIVVLMAIAFTLANPRFRRGRAKLPKPFNKFTGFNAFWYSHHLFVIVYALLVVHGIKLYLTKEWYKKTTWMYLAIPITIYALERLVRAFRSSIKSVKILKVTLYPGNVLSLKMSKPQGFSYKSGQYMFVNCAAVSPFEWHPFSITSAPDDDYLSVHIKILGDWTRSLKAKFTQACQQPLNGQSGLLRAECLKGDNSPSSFPKVLVDGPYGAPAQDYREYEVVLLVGLGIGATPMISILKDMVNNFKANDEEEGGQERVSDFKTRRAYFYWVTREQGSFDWFKGVMNEVAEEDRRKVIELHSYCTSVYEEGDARSALIAMLQSLNHAKNGVDIVSGTRVMSHFAKPNWRSVYKRIALNHPDARVGVFYCGPSALTHELRQLALDFSHNTSTKRNNHSLETPWEKLENLLTYVTVLSRIPESRQRKKHMMVYAVQDKIKPLSVRQVGNS

SEQ ID NO: 151391 - protein, 504 aa, Glycine max
  Coding DNA Sequence Number=SeqID_59706
  Gene Ontology: Mol. function=ferrochelatase activity; Cellular component=chloroplast; Biological process=porphyrin biosynthetic process
  Homolog annotation: Hit_ID=A7PKK7; Match level="QueryCoverage=98%, HitCoverage=100%, E-value=0.0, Identity=78%"; Hit description =Ferrochelatase
  Pfam annotation: Domain name=Ferrochelatase; Domain location=70-408; Score=606.1; E_value=3.3e-179; Accession=PF00762.10; Description =Ferrochelatase
MYRCSGGHVESSTNINPLKNCVVGRSTLGWFETQPLVSEQLLNRRLLSVEALVTPTVQDFSDTPLIGDDKIGVLLLNLGGPETLEDVQPFLFNLFADPDIIRLPRLFSFLQKPLAQFVSVLRAPKSKEGYASIGGGSPLRRITDAQARHFPITYFPYITTAEELRKSLWSKNVPAKVYVGMRYWHPFTEEAIEQIKRDGITKLVVLPLYPQFSISTSGSSLRLLESIFRDDEYLVNMQHTVIPSWYQREGYIKAMTNLIEKELKGFDCPEEVMIFFSAHGVPLAYVEEAGDPYKAEMEECVDLIMEELEKRKITNAYTLAYQSRVGPVEWLKPYTDETIIELGKKGVKSLLAVPISFVSEHIETLEEIDVEYKELALNSGIEKWGRVPALGTETTFISDLADAVIESLPYVGAMAVSNLEARQKVFALWKSLVPLGSVEELLTAYDSQRRELPPPVIVWEWGWTKSAETWNGRAAMLAVLLLLFLEVTTGEGFLHQWGILPLFR

SEQ ID NO: 151392 - protein, 81 aa, Glycine max
  Coding DNA Sequence Number=SeqID_59707
MELGGGFEDKGEGVEVRGEGEAAEGGEEVEGGERGEEEGVDSDEGVEGECARVWDGMEEGESIEGFLVMPDNHSGTSTFYP

SEQ ID NO: 151393 - protein, 313 aa, Glycine max
  Coding DNA Sequence Number=SeqID_59708
  Gene Ontology: Mol. function=transaldolase activity; Cellular component=mitochondrion; Biological process=carbohydrate metabolic process
  Homolog annotation: Hit_ID=A7QT89; Match level="QueryCoverage=74%, HitCoverage=54%, E-value=6e-87, Identity=69%"; Hit description =Chromosome chr1 scaffold_166, whole genome shotgun sequence
  Pfam annotation: Domain name=Transaldolase; Domain location=94-310; Score=-54.0; E_value=1.8e-05; Accession=PF00923.10; Description =Transaldolase
  Subcellular localization annotation: CTP_CleavageSite=23; ConfidenceScore=5.61e-01
MAMASTATSISSLNTATGFPLPRSSFFTPLSRVHGEPLRLLTSHPYLLSFYFFSNTKVAPYPHAANTNTHENYNIAPHLYENQRQKPYYDNLCRPVSDLLPFIIVNGFRDFERAISSSNAYDDRLRELVEAGKDIESAYWELVVKDIQDACKLLEPIYNEKDGEDGNVSVMVSPKLANDTKGTIEAAKKLHKMVGSPSVYIKIPATDEFISSMKEVICLGISVYATLIFCLPKYEAVIDAYLDGLEACSMTDLYKVSSAAAFYISRVDATLDKKLDQIGTTEALDLKGKGAVAQAVLAYQLYQKKFSGPRWER

SEQ ID NO: 151394 - protein, 48 aa, Glycine max
  Coding DNA Sequence Number=SeqID_59709
MGKLPDGNNKCTMTLAATQASTGVRAVECGGSLESNCKVLVMSTLQAE

SEQ ID NO: 151395 - protein, 159 aa, Glycine max
  Coding DNA Sequence Number=SeqID_59710
MVRKTELLYKIDIFQLRITYSEKIFIPRTKKNHPVFSRAQLVQESICGNDKKAVYQHIVKSDFDINAIGWQASSGMSSYSRSLNSSKNFGVGKPVGHHYIHYCITKGKTAAAKVLIMRMPNIYRGDNTYVTDKEGKIPVKLASESGCVDNEIIALLTSR

SEQ ID NO: 151396 - protein, 88 aa, Glycine max
  Coding DNA Sequence Number=SeqID_59711
  Homolog annotation: Hit_ID=A3FM76; Match level="QueryCoverage=79%, HitCoverage=13%, E-value=3e-08, Identity=50%"; Hit description =Inducer of CBF expression 1
MWRRVHSQHFFKRDNYCKGKSTEVLVDSKKRKTCNNIIGEGGSGLNYDSDEISDDNNKMEEISARNGGNSPNANSTITGGVHQKGKKT

SEQ ID NO: 151397 - protein, 74 aa, Glycine max
  Coding DNA Sequence Number=SeqID_59712
MAKARDRNRRICSKKSNCGRDQAAHIVAGMKMAESSAGTTKVCMLINQLQLALILFVLTFHLSPKFSSLEPTPC

SEQ ID NO: 151398 - protein, 336 aa, Glycine max
  Coding DNA Sequence Number=SeqID_59713
  Gene Ontology: Mol. function=ubiquitin-protein ligase activity; Cellular component=ubiquitin ligase complex; Biological process =protein ubiquitination
  Homolog annotation: Hit_ID=A7R3F8; Match level="QueryCoverage=100%, HitCoverage=28%, E-value=5e-76, Identity=47%"; Hit description =Chromosome chr4 scaffold_519, whole genome shotgun sequence
MQKLHDPSIVPNHTLRHLIDQWLQLDPQFDPANPEASTIESLASLKLNLESYESSLENKLQALRKISVLSDEYCSFNKSCFLQLDFLPLLLELVFGTQVSPENDMNFIELALCCIKKLLPLGSLEPLNMIKDGSKLATFVLLFEKGTNSVKTSLCRVIESASSSSSETEDLCSTLGKTNELVHEIVQVVNQNYEVSGDAIKAMSALCSLQSNRESLVRGGAIEEIMRYITSSERRNMAPVAMRIVEKLMGLRSAKEALVNHPNGVQTLVNMVFRVSDQKCSESAVEVLLTVCGEFERAREEAIESGVLTRLLLLLQSQCSNTTKSKARMLLKLLRS

SEQ ID NO: 151399 - protein, 506 aa, Glycine max
  Coding DNA Sequence Number=SeqID_59714
  Homolog annotation: Hit_ID=Q2HTA0; Match level="QueryCoverage=51%, HitCoverage=40%, E-value=8e-22, Identity=33%"; Hit description=IMP dehydrogenase/GMP reductase, related
MVRTRGGPRALGSGTDRGMGRDEDDIDVSRHRRPIASARRQRVQVDVAEKVPQVIEDVPPQVTEDILDVTKDVPYVDEDISTADLDAANVDVADVAADGAEGSPTEHGEGFPSGPHDTSLLTSFADHVAYNIWCGEERPELKLVSYGRKVDKFRSPTPEIEDLVAGTRLSPLIGCSMVTGDPGLISAFAERFEPLGVDEVVLLLTELLEVSGKEARAETAQRWIVVAHACLLHLVGCALFANKSATHFHVVHLKAFRDPSQSAGYAWGVAALVHIAGYMSTFAVFISASLMMRTLRLPHVPRAPYRARLDALTITDVSWLPYSEHQAVRGFKLISCYHGQLRWGHVVVYVRPERVLRQFGYIQTIPPPPVTASLSYDEIDERWMHFGDHLAPAGEICVVPGQVSMDYMEWYFQISHPFVTPTHEGDEPRQPAALDVEAYVEPHVPEVPIAADLPDIQWYFSCEAIVERLERVLNLRMVTAGTKLHEIMEDCLWLAKGKASDGSLRA

SEQ ID NO: 151400 - protein, 45 aa, Glycine max; identical to SEQ ID NO: 107595
  Coding DNA Sequence Number=SeqID_59715

SEQ ID NO: 151401 - protein, 86 aa, Glycine max
  Coding DNA Sequence Number=SeqID_59716
MTCAEHKETCVVRTVIVLLLNLQSKHVVENVDMNKGWIEKATEESKEEENLDDGGDEQSLIPSSSSDELNKKVDDFIARVNRQKEA

SEQ ID NO: 151402 - protein, 670 aa, Glycine max
  Coding DNA Sequence Number=SeqID_59717
  Gene Ontology: Mol. function=nucleic acid binding; Cellular component= nucleus
  Homolog annotation: Hit_ID=Q5XUX6; Match level="QueryCoverage=95%, HitCoverage=88%, E-value=1e-112, Identity=39%"; Hit description =Putative uncharacterized protein
  Pfam annotation: Domain name=DUF1767; Domain location=60-153; Score =98.0; E_value=3e-26; Accession=PF08585.3; Description=Domain of unknown function (DUF1767)
MPPIRIRRLRLDSDSDGEEQDPLQPQSEPQTHFPVEISDDEDFLDVLDSLPPPSPACPVTDFLRRLGLSPKSDWLTSCLREFQSSVPAFEHLDVAAKAKRCFEQFLYADMNFCGSGILPPNVDAMHLNVLPGPYVLQVDEIINMTCPLRGRYEKANPGIKRCLKLSMTDGIQRVFGMEYRPIEALEVCASSGLKVTISNVHVRRGLLMLVPETIEILGGLVEELDAARNRLVGELKKPPRPRGRRTRNGVFIPLATRATLAAWPPGGVDDLARSGSTLHSTDPVQENNQGSGPSMSGTGNSNSIPHMASNADAMNMDMSRDTNSVSRGSSMANQLSSVMSKAEEMHIDASNVTREYSVDHQSSNMVSNVSAAYNDTVHITRESSVATECPPVVESVETYRDRTPVATDSSHPRRTSSTVREYSVDNRFSNMVSNVSVVHNDTVHITRESSATTECPPVVENVETYRDRTPAATDSSHPRRASSSVLNTSDVEMGDASDHPLILSGDQEVPFTYMASLSAKWAKMKEEAPAIRGKIKCFLTGVKGFRYKKRTSYELQAYVDDGSLISEILIDHDVVQKGIGFSPEEVTAAISSPDTKTVQQMRDTMHKFQAFLANFEGIILVELNKKSSLPLALEMSQGCPQSDARLLLRRLKSLNPPQVQKPTDPIELSP

SEQ ID NO: 151403 - protein, 29 aa, Glycine max
  Coding DNA Sequence Number=SeqID_59718
MTNPWANMMAYYAHTSLRISLGYVTGSKE

SEQ ID NO: 151404 - protein, 949 aa, Glycine max
  Coding DNA Sequence Number=SeqID_59719
  Gene Ontology: Mol. function=ATP-dependent helicase activity; Cellular component=mitochondrial matrix; Biological process =regulation of translation
  Homolog annotation: Hit_ID=A7QKJ8; Match level="QueryCoverage=73%, HitCoverage=95%, E-value=0.0, Identity=68%"; Hit description =Chromosome chr2 scaffold_112, whole genome shotgun sequence
  Pfam annotation: Domain name=DEAD; Domain location=447-637; Score =210.4; E_value=4.2e-60; Accession=PF00270.20; Description=DEADDEAH box helicase
  Pfam annotation: Domain name=Helicase_C; Domain location=727-803; Score=82.1; E_value=1.8e-21; Accession=PF00271.22; Description =Helicase conserved C-terminal domain
  Pfam annotation: Domain name=Tetraspannin; Domain location=11-182; Score=6.2; E_value=5.5e-05; Accession=PF00335.11; Description =Tetraspanin family
  Pfam module annotation: Pfam domain module=DEAD::Helicase _C::Tetraspannin; Domain location=447-637::727-803::11-182
MAKSDKERKKIWILGIILDTVLAVSDHVVLCLGGNPGLHSIGPFCLLRYKEYQLQDFSSLFLKELNNSRNWERLKVCLVKSEDCNNLSKKYKTLKQYKSAKLSPIEAGCCRPPSQCGYPAVNASYYDLTFHPVSPNNDCKRYKNSRAIKCYDCDSCKAGVAQYMKTEWRVVAIFNVVLFVVLSPAMWGWMVGEAGRAACNWNWVSLRNMGGGPRTFPGGVNKWKWKRMHEKLARDKQNRLIEQEKQLYQARIRSHIRSTLSPDHQSAAAATHRPLSPNDHVKALADRFVKEGAEDLWNNHDGPLTPNPTPNLNFGPKHTRGYRSVPEVGNSRVGAHKYRFWRKGSDDSSSSESESEVELSVKKRGSSASLGEYDVKRERRVVPKTSPEVEFIRYQLNKRKLSQIEEQQSQEQQQSNESILSNTRFDECGISPLTVKALSSAGYVQMTRIQEASLPICLEGMDALVKAKTGTGKSVAFLLPAIETVLKAMSSNTSQRVPPIYVLILCPTRELASQIAAVAKVLLKYHETIGVQTLVGGIRFKVDQKRLESDPCQAKCKAFFGGQGILVATPGRLLDHIENKSGISLRLMGLRMLVLDEADHLLDLGFRKDVEKIVDCLPRQRQSLLFSATMPKEVRRVSQLVLKREHKYVDTVGMGCVETPVKASYSNYCHCRTLKIAKVKQSYLIAPHESHFQLVHQILKEHILQTPDYKVIVFCVTGMVTSLMYNLLREMKMNVREIHSRKPQLYRTRISDEFRESKQLILVSSDVSSRGMNYPDVTLVIQVGIPSDREQYIHRLGRTGREDKEGEGVLLIAPWEEYFLDEIKDLPLQNFPLPDINPHTKLKIENSMAKIDNDIKEAAYHAWLGYYNSIREIGREKTTMAELANRFSESIGLQRPPALFRKTAIKMVTPNSQDCSDDSSIFKALTSDLNHYADDWPALKLLQGRQMDE

SEQ ID NO: 151405 - protein, 296 aa, Glycine max
  Coding DNA Sequence Number=SeqID_59720
  Homolog annotation: Hit_ID=Q67XD6; Match level="QueryCoverage=66%, HitCoverage=71%, E-value=2e-66, Identity=62%"; Hit description =Putative uncharacterized protein At2g32500
  Pfam annotation: Domain name=Dabb; Domain location=206-296; Score =21.2; E_value=0.00041; Accession=PF07876.3; Description=Stress responsive AB Barrel Domain
  Pfam annotation: Domain name=Dabb; Domain location=91-186; Score =89.7; E_value=9e-24; Accession=PF07876.3; Description=Stress responsive AB Barrel Domain
  Pfam module annotation: Pfam domain module=Dabb::Dabb; Domain location=206-296::91-186
MAVKGSNRKRSVVHLKCKAPKFAWYLNERRWFFPVHPFLSCDKPLSLIEEAERKAAENGFCDAMLKLWHLYFYLYLSSFPPNLSIFSRKIVEHVCLLKAKHDLSEEEENDMLGYLYTTQYQMGGVVAISLGRISSPNPERYTHALFMRFQKKENLEKFYENPFYMKVLKDYVMTYCHGLTNVDYESEVADEMLSIFRKGEEFNHGVEFVLLISFNEDALGNQAEHALASLASMMLESPSLIVQFTHGLNLSPSSKEYTHGVVIRFRSVEAFEIFINSKEYKNISALGLLYAIQILV

SEQ ID NO: 151406 - protein, 510 aa, Glycine max
  Coding DNA Sequence Number=SeqID_59721
  Gene Ontology: Mol. function=structural constituent of ribosome; Cellular component=ribonucleoprotein complex; Biological process =metabolic process
  Homolog annotation: Hit_ID=A9PD70; Match level="QueryCoverage=91%, HitCoverage=85%, E-value=1e-178, Identity=69%"; Hit description =Putative uncharacterized protein
  Pfam annotation: Domain name=CBS; Domain location=189-307; Score =82.3; E_value=1.6e-21; Accession=PF00571.19; Description=CBS domain
  Pfam annotation: Domain name=CBS; Domain location=19-137; Score=95.4; E_value=1.7e-25; Accession=PF00571.19; Description=CBS domain
  Pfam annotation: Domain name=PB1; Domain location=376-461; Score =58.6; E_value=2.1e-14; Accession=PF00564.15; Description=PB1 domain
  Pfam module annotation: Pfam domain module=CBS::CBS::PB1; Domain location=189-307::19-137::376-461
MAPLFSTWKWIREERTVKSLRLSKALTVPETTTVYEACRRMAARKVDALLLTDSNALLCGILTDKDIATRVIAREVNLEETHVSKVMTRNPVFVLSDALAVEALQKMVQGRFRHLPVVENGEVVAILDIAKCLYDAIARMERKAEKGKAIAAAVEGIEKHWGTSTPGSNSTFMETLREQIFKPSLSTIIPQNSKVVTVSPTDSVLTTTKKMLELRASSAVVTVGDKLCGILTSKDILMRVIAQSLPPSSTLVEKVMTPNPECGTIDTPIIDALHTMHDGNFLHLLVVNRDGIVVATVDAIHITHAAVATASQVGNTPNFNSEAANSMIQKIWDSAMALAPNEEEEDSQSETSLKMISEGGETGRSISYLASSMQNAFSFKLQDRKGRLHRFTCDTRSLAEVITSVIQRVGDDIDPMDLPQILYEDEENDKVVLASDSDLAAAVDHAKTAGLKGLRLHLDYSGTHGYGTDSSSLSWKYANSEAWASAYSAIAAGAAVVAALGLLAFVRRSQ

SEQ ID NO: 151407 - protein, 95 aa, Glycine max
  Coding DNA Sequence Number=SeqID_59722
MDGLIVAEAKQKHSPSGVVLSNDVLTLDLAAGTDHSLIIALVTVYGLICGIITSMIKHPDKTSMVGMRFVLAAPVEDRAEFEEVMAKKTLNPFPI

SEQ ID NO: 151408 - protein, 196 aa, Glycine max
  Coding DNA Sequence Number=SeqID_59723
  Homolog annotation: Hit_ID=A7PKS1; Match level="QueryCoverage=66%, HitCoverage=88%, E-value=2e-12, Identity=37%"; Hit description =Chromosome chr7 scaffold_20, whole genome shotgun sequence
MAFEDFDPIFSKPKVEVEWASQSSRPFFFHAYSPDSSHLRDIVRIGGSWSEFAGYFVTSLKSQDLKLLLELDSSSYGVVSHAKLVAQKSKGMPLITIPLIKLVDSAAAMEVKSNFCSSLSEAFEIKSMECSLEKEMKPYNWNSDKSFKISNSENGVSTDGLQNSPVVPKLSRLKVLPTSLWYYGIHGELVNKMSQG

SEQ ID NO: 151409 - protein, 71 aa, Glycine max
  Coding DNA Sequence Number=SeqID_59724
MGCWRSLKNFPDQDLAVDANLVSHFDDDVGSRTKLCWCGCGSLLRKMKGGGDREGEEKKKWVNRKEKREKI

SEQ ID NO: 151410 - protein, 392 aa, Glycine max
  Coding DNA Sequence Number=SeqID_59725
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SH30; Match level="QueryCoverage=100%, HitCoverage=31%, E-value=3e-67, Identity=40%"; Hit description =Putative copper-transporting ATPase 3
  Pfam annotation: Domain name=HMA; Domain location=212-276; Score =54.8; E_value=3e-13; Accession=PF00403.17; Description=Heavy-metal -associated domain
  Pfam annotation: Domain name=HMA; Domain location=287-351; Score=3.9; E_value=0.75; Accession=PF00403.17; Description=Heavy-metal -associated domain
  Pfam annotation: Domain name=HMA; Domain location=50-126; Score=34.5; E_value=3.9e-07; Accession=PF00403.17; Description=Heavy-metal -associated domain
  Pfam module annotation: Pfam domain module=HMA::HMA::HMA; Domain location=212-276::287-351::50-126
MATKFLALACLRNNEGSGYLSPRPHYPSMPKYPKGVTEEEGSSNISSKALFSVVGMTCSACAASVEKAVKRLPGIRQAVVDVLNNRAQVLFYPSFVNDVLKLNFIRLDALFLHEMMNDSISFHVGLSNGSIRVPQITLKINIHAPQITLKIKVKQASKTKKKITQKDAVQSNATNLDKPPEKEETIREVIEDAGFQATFIRDDNETSVQICRIRIQGMTCTSCSSTVESALQSIQGVVKAQVALATEEAEVHYTPNVVTYNQILEAVEDTGFQATLISTGEDMSRIDLQVEGIRTGRSMRLIENSLQALPGVQGVETHPEFNKVSLSYKPDLTGPRNFINVIEETGSRRFKAKIFPEEGGRRNSHRREEIRQYYRSFLWSLVFTIPVFLTSM

SEQ ID NO: 151411 - protein, 1068 aa, Glycine max
  Coding DNA Sequence Number=SeqID_59726
  Gene Ontology: Mol. function=microtubule motor activity; Cellular component=microtubule associated complex; Biological process =microtubule-based movement
  Homolog annotation: Hit_ID=A7QIX1; Match level="QueryCoverage=90%, HitCoverage=98%, E-value=0.0, Identity=56%"; Hit description =Chromosome chr2 scaffold_105, whole genome shotgun sequence
  Pfam annotation: Domain name=CH; Domain location=27-128; Score=23.1; E_value=0.001; Accession=PF00307.22; Description=Calponin homology (CH) domain
  Pfam annotation: Domain name=Kinesin; Domain location=532-808; Score =371.0; E_value=1.9e-108; Accession=PF00225.14; Description=Kinesin motor domain
  Pfam module annotation: Pfam domain module=CH::Kinesin; Domain location=27-128::532-808
MNMQWEQEGRGRGGTDNGNGFPRAGSQQLVSLVKWINAVLPNFNLPLDTSEEELRAWLRDGSVLCSILDNLVPGSVKGSGSLNELIGVKRFLVALDELGLSGFELSDLEQGSMVPVLQCLETLKTHFAYNAARENIQSCSRKRWDQSNLTSFEESDSCLKDASKLQHAVDGSVVSDEITSVDHTGIKSNELFQLKQGLLADFSDAKLNEVLKSNNLDSVSTQLLFNIGNRILSDIFERKNGDVPQAHRAACLLRKILQVIQLRFSNQAESMKNQNHLFKAREGKYQTRINALETLAVGTTEENEVVTSWVQQLKVEQTKFEEKKKLEEQDFSRLKKEKVHSEIKISELKQDLEIAKRTYEEHVSELELQATESKAEYEKRIEGLKLHLADARMQVKELEAFSESRFLKWKNKEDTYQTIVNFQVGAFQELRAAMKSVKDDVIKTKRNYLEEFKYFGRRASPGAAVKLCLGDLLVMGSNPETASLHMQGCVYVGIKLKGLAEAAENYHVVIAENRKLYNEVQDLKGNIRVYCRIRPFLPGQSQSHTTIEFVGDDGELIVGNPLKQGKENRKLFKFNKVFGQATSQEEIFKDTQPLIRSVLDGYNVCIFAYGQTGSGKTYTMEKHTKYCFLDLHTLGIWNTAQPNGLAVPDASMHSVNSMADVLELMNIGLTNRATSATALNERSSRSHSVLSVHVRGTDLKTNTLLRGCLHLVDLAGSERVDRSEATGDRLKEAQHINKSLSALGDVIFALSQKSSHVPYRNSKLTQLLQSSLGGQAKTLMFVQLNPDVASYSETVSTLKFAERVSGVELGAARSNKEGRDVRELMEQLASLKDVIARKDEEIERLQSLKANHNGAKLGMISARHGSSSPRRHSIGTPRNSMRLAGARSFGVNGKAASEMDNCSEYSDKHSEAGSHQSMDDFRNKSSSLRLKLTRDDSSQNVNEDIDLLRFGDADSEERLSDISDGGLSMGTETEGSISSIVEYTLFPELEKAAEITPVKDTTTDNLPAESTEKLIMPSKIPKAAQVPQKVQSRPSRLSLNKTSSKVLSSVRKPAASSSSSVKPPKRWQ

SEQ ID NO: 151412 - protein, 191 aa, Glycine max
  Coding DNA Sequence Number=SeqID_59727
  Gene Ontology: Mol. function=oxidoreductase activity; Cellular component=integral to membrane; Biological process=metabolic process
  Homolog annotation: Hit_ID=O81738; Match level="QueryCoverage=98%, HitCoverage=98%, E-value=6e-50, Identity=57%"; Hit description =Putative uncharacterized protein F16G20.120
  Subcellular localization annotation: CTP_CleavageSite=55; ConfidenceScore=5.17e-01
MWFLGWKGQSGFSASSTAEQVTQGIDGTALTAIVTATSGLGLETTRVLALRSVHVVMAVRSVDSGKNVKETILKEIPSAKIDVMELDLSSMASEEGVEITVNSLHPGSIVTNILRYHDYINAVANMVGKYFLKNVQQGAATQCYVALHPQVKGISGEYFMDSNKGTPASLAKDSELAKKLWEFSLSLTNPK

SEQ ID NO: 151413 - protein, 137 aa, Glycine max
  Coding DNA Sequence Number=SeqID_59728
MLSKSEPKQEDGAEPVLYGSVHPTRHGLAQSARGEFQCGGFTLEQPRVAVGVEDAFAEQIVERGLPRGAFGVVVEAELEDVLEVFGVARDGDEALFTGEEGKGADAGLVRAAARAEVVGDPVVHAVGVLDEAREAAE

SEQ ID NO: 151414 - protein, 996 aa, Glycine max
  Coding DNA Sequence Number=SeqID_59729
  Gene Ontology: Mol. function=nucleoside-triphosphatase activity; Cellular component=intrinsic to membrane; Biological process=innate immune response
  Homolog annotation: Hit_ID=A7R2A6; Match level="QueryCoverage=99%, HitCoverage=99%, E-value=0.0, Identity=65%"; Hit description =Chromosome undetermined scaffold_411, whole genome shotgun sequence
  Pfam annotation: Domain name=TIR; Domain location=164-296; Score= -32.1; E_value=0.068; Accession=PF01582.11; Description=TIR domain
  Subcellular localization annotation: CTP_CleavageSite=61; ConfidenceScore=5.73e-01
MDIQEESSTTLGPLTAKSSRNMSSSSSAFFSANQSPFFSPRSSSCQLSESLRPDAPSDRIHSDAAAPSTISGIPEPKSIVNVGCSFSEVAASPAGCNAGDLQNLDRISSSVGISSSTVSGYCHPYDDGYSGLKEKRSKRGRNKRTSSTPGSRSLSSYRLKSCDVFIGLHGRKPPLIRFANWLRVELEIQGISCFISDRAGCRNSCKLGIAEKAMDVASFGIVIITRKSFKNPYTIEELQFFSGKKNLVPIYFDLSPADCLVRDIFEKRGELWEKHGGELWLLYGGLEQEWKDAVHGLSRVEEWKLEAHDGNWRDCILRAVTLLAMKLGRRGAAEHLTKWREKVKEEELPFTRNENFIGRKKELSQLEFMLFGDVTGDSRQDYIDLKARPKRRHLTIGRGKSSVLDERHMGNGTREEKTSVLWKESEKEIEMQSIEFSHGHHRSRIKCGGKYTRRKRGMKIVYGKGIACISGDSGIGKTELILEFAYRFHQRYKMVLWIGGESRHIRQNYLKLRSILEVDLSVENSLEKTRIKGFEEQEEAAVSGIRNELMRNIPYLVIIDNLESEKDWWDHKLVMDLLPRFGGETHIIISTCLPRVMNLEPLKVSYLSGVEAMSLMLGSGKDYPVAEVDALRTIEEKLGRLTLGLAIVSGILSEIPITPSRLLDTINRIPLKDMSWSGKEAHSFRQNTFLLQLFDVCFSIFDHSDSPRSLATRMVLVSGWFAPCAIPVSLLALAAQKIPEKQKGTCFWRKLLQSLTCGFTSSHTKKSELEASSLLLRFNIARSSTKQGHIYFNDIIKQYARKREVTGSAQAMVQAVISQGSISENIEHLWAACFLLFAFGHNPPAVELEVSEFLYLVKKVVLPLAIHTFITYSRCTAAIELLHLCTNALEAADQAFVTPVDKWFDKSLCWRSIQTNAQLNPCLWQELALCRATVLETRGKLMLRGAQFDIGDDLIRKAVYIRTSICGEDHPDTISARETLSKLTRLIANVQIRAST

SEQ ID NO: 151415 - protein, 530 aa, Glycine max
  Coding DNA Sequence Number=SeqID_59730
  Gene Ontology: Mol. function=ATP-dependent DNA helicase activity; Cellular component=nucleus; Biological process=regulation of transcription, DNA-dependent
  Homolog annotation: Hit_ID=Q38861; Match level="QueryCoverage=65%, HitCoverage=39%, E-value=1e-149, Identity=78%"; Hit description=DNA repair helicase XPB1
  Pfam annotation: Domain name=Helicase_C; Domain location=126-199; Score=52.1; E_value=1.9e-12; Accession=PF00271.22; Description =Helicase conserved C-terminal domain
MTLTFSTKSEVLTVEIAATLVREDERITDLNFLIGPKLYEANWLDLVKGGFIANVQCAEVWCPMTKEFFAEYLKKENSKKRQALYVMNPNKFRACEFLINFHEGTRGDKIIVFADNLFALTEYAMKLRKPMIYGATSHVERTKILQAFKTSKDINTIFLSKVGDNSIDIPEANVIIQISSHAGSRRQEAQRLGRILRAKGKLEDRMAGGKEEYNAFFYSLVSIDTQEMYYSTKRQQFLIDQGYSFKVGKWDGMICCLTWNKWEHELNFLVIIREKNGREMRRNILVKVEKEVITSLPPPDEGPNLSYHRLEDQLALLGKVLSAGDDQVGLEQLDEDADEIALQSARRSQGSMSAMSGAKGMIFGHDCFLPRAVLCVKANKDRSRASRKIQRRDISCLKEDMGQPKCAVFVMKSFDASKSRHNGFSTVHFMEMWTNRCLTFSSSKNQLLKSENVHQTDKHRMLKEENYSVARQIDNRHMLKLVLRNRTCIEIKIRGWRRKGRCHRQNREKLKVRKRMVMKVVVGKGGKGSG

SEQ ID NO: 151416 - protein, 171 aa, Glycine max
  Coding DNA Sequence Number=SeqID_59731
  Homolog annotation: Hit_ID=A7QNK6; Match level="QueryCoverage=53%, HitCoverage=76%, E-value=7e-09, Identity=38%"; Hit description =Chromosome chr2 scaffold_132, whole genome shotgun sequence
MRIFSDTRGSPESLNKSTLHFVGYKGHSAERACSLIVPHPTVQTSSVEYVATIRQLSDLIVFLELAQTHRARLRGVHQLPELHHRQDFPDERGRHGLEFFGHSGFGPGGNVGLEEVVEAHEAEEAANQLPEEAQEGEDVKEKLREQELRVPHWETHQRDFFLSASRENWGK

SEQ ID NO: 151417 - protein, 396 aa, Glycine max
  Coding DNA Sequence Number=SeqID_59732
  Homolog annotation: Hit_ID=A7QNI8; Match level="QueryCoverage=100%, HitCoverage=100%, E-value=1e-108, Identity=54%"; Hit description =Chromosome chr2 scaffold_132, whole genome shotgun sequence
  Pfam annotation: Domain name=DUF793; Domain location=1-385; Score =698.5; E_value=5.1e-207; Accession=PF05633.2; Description=Protein of unknown function (DUF793)
MPATTENNNQGSFLGRISIRRNQVMSMDGSHDQEMEDLELFQKHIGDRFSELLSSTSEDSSSSSSSSSGDALLSIAWLRRLLDEFLCCEAEFKAVVLMGRDPSQITKPPLDKLLPDLLDRGVKSLDVCNAVTLGLDAVKNLQRLAEIAVAALEQTPLGDGQVRRAKKALSALVAAMLNDDSNAAAKGTERTRSFGRRAGNTNTTKYKSLSWSMAKNWSAAKQIHAMMSNLTAPRGAESSGLAQPMYMMSTVLVFVMWTLVAAVPCQERNGLGTHFPLPRQLGWAQPMIGLQEKIAEEWKKKEKKGNVGLLEEMQRMDKLGQSLIEFADSFQFPTETERMDEVKKHVEELGDICKKMEEGLEPLQQQIREVFHRVVRSRTEFLLALDQAAKSTTPAL

SEQ ID NO: 151418 - protein, 448 aa, Glycine max
  Coding DNA Sequence Number=SeqID_59733
  Gene Ontology: Mol. function=nucleic acid binding; Cellular component= intracellular
  Homolog annotation: Hit_ID=A7QNI2; Match level="QueryCoverage=99%, HitCoverage=99%, E-value=2e-63, Identity=52%"; Hit description =Chromosome chr2 scaffold_132, whole genome shotgun sequence
  Pfam annotation: Domain name=G-patch; Domain location=15-59; Score =59.3; E_value=1.3e-14; Accession=PF01585.14; Description=G-patch domain
MAAPESPLCYVGVARQSAAFRLMKQMGWEEGEGLGKEKQGIKGHVRVKNKQDTIGIGLEKPNNWAFDTTQFDNILKRLKVQAPQSHDIEEKVETKASVPVDNEEDSVPKTTRPQGRYARRERGKLVSQYSLKDLEGILVKKGDVSGSTDNSDGELDMLKTSEIQKFEDEGSKYPAIPPDWWGYKYGFVSGGFLGAESKKKKSMISGKAERTAFFEEDQENLYNLVQDMVMLNLRSMAAAAQGRVPRRNRTRYLFRHDSHSTWCRVHLSFAGHGWAVGHAQLDPSGCEHVQSSSLPHAKHAVTALRPLSLCVDREKSTTGKQGLGIKDRPKKVAGCYFQGKKKSFDDSDEDSADNDSLEQAANDDLIKVEKIVEGKVKLKKLCKQILQQVPGESLKLKQLKVLIDEHSSSIWSDFSSRRESVAYLKQKLTGSRKFYIEGKRVRLASKRS

SEQ ID NO: 151419 - protein, 227 aa, Glycine max
  Coding DNA Sequence Number=SeqID_59734
  Homolog annotation: Hit_ID=A7QNG9; Match level="QueryCoverage=49%, HitCoverage=29%, E-value=9e-13, Identity=48%"; Hit description =Chromosome chr2 scaffold_132, whole genome shotgun sequence
MTDLRNEAKETLQLNAFSFHFKQPLALQRKPQLPASLHASHKFKVDEVPIVSLFAKASQQGNVAETAKVKLGQKQGNVALPAGLRKHLGKARSAAVPPPPPPALVSSKRRDDSLLQQHDWIQGAILLCKNSFNASPECEISQLPRSVSDGSPELSENSKNDRVPLRYNIINFHVPGTHRRNITIVSRDDGKCGQRSGKDGDMSSESEIFWVKGREGKVLLTVAQFTK

SEQ ID NO: 151420 - protein, 735 aa, Glycine max
  Coding DNA Sequence Number=SeqID_59735
  Gene Ontology: Mol. function=nucleoside-triphosphatase activity; Cellular component=protein complex; Biological process=cell division
  Homolog annotation: Hit_ID=A7QNG1; Match level="QueryCoverage=100%, HitCoverage=85%, E-value=0.0, Identity=69%"; Hit description =Chromosome chr2 scaffold_132, whole genome shotgun sequence
  Pfam annotation: Domain name=AAA; Domain location=443-628; Score =265.1; E_value=1.5e-76; Accession=PF00004.20; Description=ATPase family associated with various cellular activities (AAA)
  Pfam annotation: Domain name=AAA_3; Domain location=443-569; Score= -6.9; E_value=0.0019; Accession=PF07726.2; Description=ATPase family associated with various
  Pfam annotation: Domain name=AAA_5; Domain location=443-575; Score =11.8; E_value=0.00037; Accession=PF07728.5; Description=ATPase family associated with various
  Pfam annotation: Domain name=Sigma54_activat; Domain location=433 -631; Score=-179.8; E_value=0.024; Accession=PF00158.17; Description =Sigma-54 interaction domain
  Pfam module annotation: Pfam domain module=AAA::AAA_3::AAA_5::Sigma54_ activat; Domain location=443-628::443-569::443-575::433-631
MLAKALAHYFEAKLLLLDLTDFSLKIQSKYGFSNMESSFRRSTSETTLERLSDLFGSFSIFSQREEPKGKMNRPSSGVDLQSMGAEASCNPPILRRNASSSSNISGLASQTYPTNSVPLKRTTSWSFDEKLLIQSLYKVLAFVSKTYPIVLYLRDVDRLLYKSQRIYNLFQKMLKKLSGPVLILGSRVIDSGNDYEEVDEKINSLFPYNIEIRPPEDESHLVSWKSQLEEDLKMIQVQDNKNHIMEVLAANDLDCDDLDSICVSDTMVLSNYIEEIIVSAISYHLMKNKDTEYRNGKLVISSNSLSHALNIFHKGKSSRRDTSKLEDQAVKSEKQIEEGTAMKPEAKSENAAPVKKAEAETLSSVGKTDGEKSVPAPKAAEVPPDNEFEKRIRPEVILANEIDVTFSDIGALDETKESLQELVMLPLRRPDLFTGGLLKPCRGILLFGPPGTGKTMLAKAIAKEAGASFINVSMSTITSKWFGEDEKNVRALFTLAAKVSPTIIFVDEVDSMLGQRTRVGEHEAMRKIKNEFMTHWDGLLTKQGERILVLAATNRPFDLDEAIIRRFERRIMVGLPSVENREKILRTLLAKEKVDNELEFKEIATMTEGYTGSDLKNLCTTAAYRPVRELIQQERIKSLDKKQKASRGQNKDVQESRGQSVVGNTQDALDEEEEVKQERVIITLRPLNMQDFKEAKNQVAASFAAEGAGMGELKQWNDLYGEGGSRKQQQLSYFL

SEQ ID NO: 151421 - protein, 159 aa, Glycine max
  Coding DNA Sequence Number=SeqID_59736
  Gene Ontology: Mol. function=metal ion binding; Cellular component =plasma membrane; Biological process=cytokinin metabolic process
  Homolog annotation: Hit_ID=A7QST8; Match level="QueryCoverage=60%, HitCoverage=36%, E-value=1e-26, Identity=46%"; Hit description =Chromosome chr4 scaffold_162, whole genome shotgun sequence
MGNGESTHDSHDDFFQQPLSYDDFFRQPLSYDGCSADISHQYHQPASYDGSSVNTSHQYHQPSTYAESSVNTRHQHKQRPTYIADNFSSLDQVVSALREAGLESSNLIIGIDFTKNNEWTASTHDQNVFSFYRDERYCHGFEEVLARYREIVPHLNWQV

SEQ ID NO: 151422 - protein, 202 aa, Glycine max
  Coding DNA Sequence Number=SeqID_59737
MCNATDYNVQSIGGYVLLIQLWACNYCSQLNEWNSLYERRFQETLPQVGPLSVNSEYMKWFRHKTKLYISRQHARRGLMGEIIEIMQFMLFLYGRRVSTLDDLALCLDKMTLLAEEDDRIIEAREEAPPSVPQFEGQEFDTLGRSVETQGLGRHRESVDAEAHVIPAMPERQHGMYYTLDQFTQVPSQMSPLYPYPYQSETS

SEQ ID NO: 151423 - protein, 139 aa, Glycine max
  Coding DNA Sequence Number=SeqID_59738
MRLGREPTWWQGREGHSTSMSSGWRGTKSEREWVRNPTAQLSMPVGHCIILYAAKLMVEETFSAAKEKREYESVRVRGSAEWRPAGRKVQELGFAKGRWEDCYYLLAKEKERNTIPCTLKSIGKEAILSNFLKTIARKY

SEQ ID NO: 151424 - protein, 514 aa, Glycine max
  Coding DNA Sequence Number=SeqID_59739
  Gene Ontology: Mol. function=protein kinase activity; Cellular component=cytoplasm; Biological process=protein amino acid phosphorylation
  Homolog annotation: Hit_ID=A7QNB2; Match level="QueryCoverage=98%, HitCoverage=48%, E-value=0.0, Identity=73%"; Hit description =Chromosome chr2 scaffold_132, whole genome shotgun sequence
  Pfam annotation: Domain name=WD40; Domain location=191-229; Score =10.2; E_value=1.7; Accession=PF00400.23; Description=WD domain, G -beta repeat
  Pfam annotation: Domain name=WD40; Domain location=241-279; Score =20.1; E_value=0.0084; Accession=PF00400.23; Description=WD domain, G- beta repeat
  Pfam annotation: Domain name=WD40; Domain location=283-322; Score =31.9; E_value=2.3e-06; Accession=PF00400.23; Description=WD domain, G-beta repeat
  Pfam annotation: Domain name=WD40; Domain location=326-364; Score =11.6; E_value=1.2; Accession=PF00400.23; Description=WD domain, G -beta repeat
  Pfam annotation: Domain name=WD40; Domain location=369-406; Score =32.4; E_value=1.6e-06; Accession=PF00400.23; Description=WD domain, G-beta repeat
  Pfam annotation: Domain name=WD40; Domain location=418-456; Score =12.5; E_value=0.91; Accession=PF00400.23; Description=WD domain, G -beta repeat
  Pfam module annotation: Pfam domain module=WD40::WD40::WD40::WD40::WD4 0::WD40; Domain location=191-229::241-279::283-322::326-364::369 -406::418-456
MEIEHYRREILQSEVINGIHEVYCEELSSSLNQDDAESELLLHFLISLKEQKHMDANKLAEEIRCLESDVKEVERRHDLRKSLLPSSLQNDSSLQIENVSLKESIISNANELRLMKIIPRLESAYFSMRSKIKLPETDTATHPDKDILINHDNWCGAQKDMEQHKATDALGAFFDSLCKYARYSKFEVRGILRNTDFNNPANVICSLSFDRDEDYFAAAGISKKIKIFEFNALFNDSIDIHYPVVEMSNRSRLSCVCWNNYIQNYLASTDYDGAVKLWDANTGQGFSRFTEHEKRAWSVDFSLLCPTKFASGSDDCSVKLWNINEKNSLATIRNVANVCCVQFSTHSSHLLAFGSADYSAYCYDLRNLRNPWCVLAGHRKAVSYVKFLDSETLVSASTDNMLKIWDLNKTSPVGPSTSACSLTLSGHTNEKNFVGLSVADGYIACGSETNEVYVYHKSLPMPVTSHRFGSIDPISGEETDDDNGLFVSSVCWRGKSDMVVAANSSGCIKVLQMV

SEQ ID NO: 151425 - protein, 317 aa, Glycine max
  Coding DNA Sequence Number=SeqID_59740
  Gene Ontology: Mol. function=metal ion binding
  Homolog annotation: Hit_ID=Q2PEP6; Match level="QueryCoverage=100%, HitCoverage=50%, E-value=1e-102, Identity=63%"; Hit description =Putative myosin heavy chain-like protein
MDLKRSLEEREESYQKLNIEYKQIDSLFKEWMVKLEVAEKKIEEMAGEFHEGIESKDQKIADLEHTVEELKRDLEEKGDEISTSLENVRMLEVKLRLSNQKLRVTEQLLSEKEESFWKTEEKFQQDQRALEDRIATLSAIITANNEAFDEIVSNLKECANSVTTGIETISWKVSDDCKNFKDSVSNVSHELGVAKDHVREMKREKEQLKRDKRHLLEQLQVKNEQEVTLRKSVEKLEAKASKEESEKMNLTTTVVQLKKTVGELEKMMKEKEDGMLDLGEEKREVIRQLCLWIDYHRSRYDYLKDILSKSRRGQRAA

SEQ ID NO: 151426 - protein, 438 aa, Glycine max
  Coding DNA Sequence Number=SeqID_59741
  Homolog annotation: Hit_ID=A7QU94; Match level="QueryCoverage=100%, HitCoverage=79%, E-value=1e-171, Identity=65%"; Hit description =Chromosome chr2 scaffold_176, whole genome shotgun sequence
  Pfam annotation: Domain name=PPR; Domain location=26-60; Score=16.4; E_value=0.088; Accession=PF01535.11; Description=PPR repeat
MRATFHQVGESGPLAERWKWSRPNANVYTLLIQGLAAVLRVSDALRVIRYICEIGVSPGEEVPFGKIVKCPSCRIAVGVAQPQQGIQIVSCAKCRYQYELVSGDIVSIESEEISMDITAWERGLRYVKLMKQSIPAAVHSIVVQTPSGLARTHRFATETVDLPAQEGERVTVAVAAPSNVYRKVGPFKFSPRAPDFYPGEAMCITNHKDGRESLLLRAPRKEVNSSLLKPSLIFPLLALLATGDVASGIIDPGLPQLLSVVAVSTLVVGSTVNTVVLPQFNQLPQKSVEVTAIKQQLLSQYDVLLSRINDLKEAAEKEIWMLARMCQLENKISAVGEPAYRTRISKVKRVRESLQNSLRGRIELIESYARISSMIEIEVEMETDVLAAETASNMDSIKEQIEQIMELENLEERWKIQAEANDEAERLLSSQPMPLDEV

SEQ ID NO: 151427 - protein, 158 aa, Glycine max
  Coding DNA Sequence Number=SeqID_59742
MGAMNDYQLTIKKIVDNDTLIAIGFPIDEFDYAEAILDGLANDLVSSLAKLIVTQLGKNACPYWTEVTFLNGSQAVGGQEPTILGEDSEKEFEKTRWGSGNEVGEKEGMRVRIKLTKEEAARLLSKCNNGGILQFKDVAHELVLIPVNRVSVAPDAQC

SEQ ID NO: 151428 - protein, 132 aa, Glycine max
  Coding DNA Sequence Number=SeqID_59743
  Homolog annotation: Hit_ID=A0MFB2; Match level="QueryCoverage=100%, HitCoverage=99%, E-value=4e-20, Identity=38%"; Hit description =Putative uncharacterized protein
MPVSDPSSGRTFIWIIAGLLFISVAAGGACLVAYLLLPESETSTSWIPEIGVGLVSLPWLFWLLTFIYRILSRIFGCRVSFGGGSVGNWVPAAKADVEVAVASHAKGGDQLNRASSFASHESEMALAKSMAT

SEQ ID NO: 151429 - protein, 555 aa, Glycine max
  Coding DNA Sequence Number=SeqID_59744
  Gene Ontology: Mol. function=triacylglycerol lipase activity; Biological process=lipid metabolic process
  Homolog annotation: Hit_ID=A7PKT4; Match level="QueryCoverage=90%, HitCoverage=78%, E-value=1e-141, Identity=52%"; Hit description =Chromosome chr7 scaffold_20, whole genome shotgun sequence
  Pfam annotation: Domain name=Lipase_3; Domain location=1-91; Score =3.1; E_value=0.0003; Accession=PF01764.16; Description=Lipase (class 3)
MLEIVGNKDTKSVVITGHSIGGATASLCTLWLLSYLQSISSSVSILCITYGAPLIGNESFSQTIFKERWGGNFCHVVSKHDIMPRLLFAPITSLSTQLNSLLQFWHLSMTSPDFGKLANQISEKEKDKLFTAVMDYLEAATQDGEKSAPILFHPFGSYFFVSEEGAVCVDSPSAIIKMMHLMLATSSPASSIEDHLKYGDYVNKMSAQTLYQSNSMQKNIPDSSYEAGLELAIQSSGIANQEPAITSAKECLKTTRRMGPSPTLNAASLAVSLSKVVPYRAQIEWYKTWCDEQDDQMGYYDSFKSRDSSSSKRDMKININRCKLARFWNNVIDMLERGELPHDFDKRAKWVNTSHFYKLLVEPLDIAEYYGKGMHRTKGHYMQHGRERRYEIFDRWWKDKTVTTGREENKERSKFASLTQDSCFWARVEEARDWLNCVRSERDTNKLALLWDKIENFEKYAIDLIENKEVSGDVLFKNSSYSIWVEDLRELKQLKAKVQRFPRQFTGFLDGEEENADHVFLSCKTIEAIWKFFLAGVSMVNGTCKRQGLKPWMRC

SEQ ID NO: 151430 - protein, 116 aa, Glycine max
  Coding DNA Sequence Number=SeqID_59745
MTGSSHSLLRRDENRGRPPMLYKGVKFLQFGSDSPAIWTPEKATYTEAPTRSVTKVRKGVALAWVQRRHESDSRGVDETKDASISRDSNLPPGTAQLNCFWKKDERERGKSTEYLR

SEQ ID NO: 151431 - protein, 122 aa, Glycine max
  Coding DNA Sequence Number=SeqID_59746
MDMAVRFLEDLEGISIHSDREDKWIWKEDASGVYTVGNGYKMLMSDQTDENQDDAFTELWKVKQNYVALVGINIVDKHFSTISVEPENALPPACGWERKWKQFSKMEIEEDLLDLEYLAASK

SEQ ID NO: 151432 - protein, 874 aa, Glycine max
  Coding DNA Sequence Number=SeqID_59747
  Gene Ontology: Mol. function=metal ion binding
  Homolog annotation: Hit_ID=Q8L7I1; Match level="QueryCoverage=91%, HitCoverage=78%, E-value=1e-173, Identity=46%"; Hit description =Putative uncharacterized protein At4g10930
NEQVYIKDDDGNVKPELLDGDDKSELPDEVAQKKIRATGSQMTSSNDSAGAHLLENAQKCPALKQSPTNSIVKSDIMNIVKGTNRRHSKERTDTNACDKLSENKGNMAGLRVKKIMKRVSDDGESSLVVQNLRKEIREAVRNKSSINFEDNHFDPKLLEAFRAAITGPKTELVNKLSPAAIKAKKSMLQKGKVRENLTKKIFGTSNGRRKRAWDRDCEIEFWKYRCMRATKPEKIETLKSVLDLLRKGSNNPESKQASECQAKNPILSRLYLADTSVFPRKKDVKPLSVLKTIANSEQTKHSPSEKVPNLSVDNNTIKATDINNLLSKNSVCSSEKKVDKKLVRGPVGDNSTSGKVRSDNHSERTSVSSAGAKTSTKELDLKSGCMKSDKRKWALEVLARKTAATSGNTANGNQEDNAVFKGNYPVLAQLPIDMRPVLAPCHHNKIPISVRQTQLYRLTERILRNTNLAVIRRTADTELAVADAINIEKEVADRSNSKLVYLNLCSQELLHHTNNTKTNVATDTSPPASSSMLTDQQSELNTDDLSTDPEVETALKNAGLLSDSPPSSPHENRETCNGDMSGPDNILEPDSHPDLDIYGDFEYDLEDEDYIGASVTKVSFPKQEQNESKVKLVFSTMNLKKSDIALDCADCEGSERNEVPGDASFSPNFQDDAVLRDRASTIDAETGQPSVSSVLLSCEGAVEPPDSEFEELYGPDKEPLIKKNPVGESRSLHGDGKTETLSVANDCHNDEKHVLDNAVNASELGNENLTEKVSEAGENFQRKKEKSDVTAKQTDSVNHIIKKVEAYIKEHIRPLCKSGVITADQYRWAVAKTTEKVMKYHSRSKSANFLIKEGEKVKKLAEQYVEAAQQNRKN

SEQ ID NO: 151433 - protein, 209 aa, Glycine max
  Coding DNA Sequence Number=SeqID_59748
  Homolog annotation: Hit_ID=A7PXS9; Match level="QueryCoverage=75%, HitCoverage=83%, E-value=2e-15, Identity=37%"; Hit description =Chromosome chr15 scaffold_37, whole genome shotgun sequence
MGNCSMKGTTGECHHSIRVMCDSGAILQFKAPKTVAQVLQHYPGYGIFRQGHASSPLPEQETLSYGLFYYLLPLKEVQVEHQESCCDKVRVSEEMCKSAASACDYVEKLSNGSALEVLPTAKNGVWRVKLVIDPRQLEKILSEQVNTEALIEKMRMAATACSTTTPSPSRTPTPTMSSRKLLGWKTTLFNAKIAKDTSPAASNFFLGSC

SEQ ID NO: 151434 - protein, 209 aa, Glycine max
  Coding DNA Sequence Number=SeqID_59749
  Subcellular localization annotation: CTP_CleavageSite=46; ConfidenceScore=5.23e-01
MLSAYMIINRSSPSSSFLQPLHAPPPPSNNKPHHQTTYRNANTPPRGEHDAQTLPLSHITIVPSFTCTNTVSQLATTISILLQIWFTIITPSPPSSLEITMASNTTIPIQIRPATKSSRSRDPSPRTTPLSPTSAPPPTSLDTALTLLEIEVGGGICGDDGFGSEKWNVERIRYIQNGFWWSSEEVKDVLGLYCDRRRKVEDHLKRWPL

SEQ ID NO: 151435 - protein, 372 aa, Glycine max
  Coding DNA Sequence Number=SeqID_59750
  Gene Ontology: Cellular component=integral to membrane; Biological process=peroxisome organization and biogenesis
  Homolog annotation: Hit_ID=A5B880; Match level="QueryCoverage=98%, HitCoverage=76%, E-value=1e-147, Identity=68%"; Hit description =Putative uncharacterized protein
  Pfam annotation: Domain name=Aa_trans; Domain location=1-360; Score =291.1; E_value=2.2e-84; Accession=PF01490.9; Description =Transmembrane amino acid transporter protein
MSRSVPNTCGANVTFCGIFQYLNLLGIVIGYTIAASISMRAIKRSNCFHKSGGKNPCHMPSNLYMIIFGATEMFLSQIPDFDQIWWLSTVAAIMSFTYSIIGLSLGIAKVAETGPFKGGLTGVSIGPVSETQKIWRTSQALGDIAFAYSYAVVLIEIQDTIKSPPSEAETMKKATLISIAVTTTFYMLCGCMGYAAFGDAAPGNLLTGFGFYNPYWLIDIANAAIVIHLVGAYQVFSQPIFAFVEKEVTQRWPNFNREFKIPIPGFSPYKLKVFRLVLRTVFVVLTTVISMLLPFFNDIVGVIGALGFWPLTVYFPVEMYISQKKIPKWSNRWISLKIFSMACLIVSVVAAVGSVAGVLLDLKKYKPFHSNY

SEQ ID NO: 151436 - protein, 1099 aa, Glycine max
  Coding DNA Sequence Number=SeqID_59751
  Gene Ontology: Mol. function=metal ion transmembrane transporter activity; Cellular component=mitochondrion; Biological process=metal ion transport
  Homolog annotation: Hit_ID=A7PKP7; Match level="QueryCoverage=51%, HitCoverage=79%, E-value=0.0, Identity=69%"; Hit description =Chromosome chr7 scaffold_20, whole genome shotgun sequence
  Pfam annotation: Domain name=CorA; Domain location=12-384; Score =201.4; E_value=2.1e-57; Accession=PF01544.9; Description=CorA-like Mg2+ transporter protein
  Pfam annotation: Domain name=Polyketide_cyc; Domain location=448-583; Score=71.1; E_value=3.7e-18; Accession=PF03364.11; Description =Streptomyces cyclasedehydrase
  Pfam annotation: Domain name=Polyketide_cyc; Domain location=691-822; Score=86.2; E_value=1e-22; Accession=PF03364.11; Description =Streptomyces cyclasedehydrase
  Pfam module annotation: Pfam domain module=CorA::Polyketide _cyc::Polyketide_cyc; Domain location=12-384::448-583::691-822
MVRRKTSVGITTGVKTWMVVSSETGEQRLEDVGKHSLMRRTGLPARDLRVLDPMLSHPSSILVRERAILVNLEHLKGIITSTEVLMINSSNPFFLLFLQDLLTRLTHQPPSPMSNDMNPGYEAKPPAMCGSEDSSQNVSHVKISEEVKADSPKMAPIAPKQLPFEFRALETFIESACRLEEEAYPALDELTSQLCTLNLERVRHIKSRLVALSGRVQKVADELEHLLDDDKDLAEMYLTEKLNASLLDQASLKEEYNSESEDTDQSDESNSEKYDKFPGLKLNVEELEMLLEAYFAQTNGILQRLFSLSEYVDDTEDYINMMLDDKRNELLQATIIFNTLNMILNAGIVVVGLTSSTTNLGGAQPLSLRFLSKPAPFLSLSFFFPYHSANNGIAVSSTQCKPRIRCDKEVGNGNNNGIEEDEEAEREVQCEVQVVSWRERRVKAEIPVNADIESVWNALTDYDHLADFIPNLVWSGKIPCPYPGRIWLEQRGFQRSMYWHIEARVVLDLQELINSAWDRELHFSMVDGDFKKFEGKWSVKSGTRSSSTNLSYEVNVIPRFNFPAIFLERIIKSDLPVNLQALAYRVERNISGNQKLSLPENHLDKTSSDINESSAQKINSALCENKEDLVNSIPGTLPMPSSEVNINNWGAFGKSCRLDRPCMVDEIHLRRFDGLLENGGVHRCVFASITVKAPVRDVWTVMSSYESLPEIVPNLAISKILSRDNNKVRILQEGCKGLLYMVLHARVVLDLCEYLEQEISFEQVEGDFDSFQGKWTFEQLGNHHTLLKYSLESKMRKDTFLSEAIMEEVIYEDLPSNLCAIRDYIENKTASNILEACKQNTNSGQQTVPSGFEDDDSYCSAEDLSDCNAQSSSQQRPRVPGLQRDIEVLKSELLKFIAEHGQEGFMPMRKQLRLHGRVDIEKAINRKGGFRKIATIMNLSLAYKHRKPKGYWDNLENLHYEQQTIGLLTFKSSKERWIKLMAVASSHFQFEVSRLLSLKVRRQRSRQGKLAKDKKVDDDVASPDVDHSGIIRDAIPGLRLRGQSVSIAKVVPTAAAKKLGSLALGVEKGHPRRPVKLLDLSEPALIHGEEGDDASLYGL

SEQ ID NO: 151437 - protein, 224 aa, Glycine max
  Coding DNA Sequence Number=SeqID_59752
  Gene Ontology: Mol. function=protein serine/threonine kinase activity; Cellular component=mediator complex; Biological process =protein amino acid phosphorylation
  Homolog annotation: Hit_ID=P93322; Match level="QueryCoverage=98%, HitCoverage=52%, E-value=5e-96, Identity=76%"; Hit description =Cdc2MsE protein
  Pfam annotation: Domain name=Pkinase; Domain location=1-223; Score =1.5; E_value=1e-08; Accession=PF00069.16; Description=Protein kinase domain
  Pfam annotation: Domain name=Pkinase_Tyr; Domain location=1-224; Score=-160.0; E_value=0.013; Accession=PF07714.8; Description =Protein tyrosine kinase
  Pfam module annotation: Pfam domain module=Pkinase::Pkinase_Tyr; Domain location=1-223::1-224
MWQEIIRHHRDKLNHSINQYTVKSLLWQLLNGLSYLHSNWMIHRDLKPSNILVMGEGEEHGVVKIADFGLARIYQAPLKPLSDNGHFPTILKVVQYSSHFSLNIHLDMWAVGCIFAELLTLKPLFQGAEVKATSNPFQLDQLDKIFKDIVTVPGHPTLEKWPSLASLPHWQQDVQHIQGHKYDNAGLYNVVHLSPKSPAYDLLSKMLEYDPRKRLTAAQALEHE

SEQ ID NO: 151438 - protein, 553 aa, Glycine max
  Coding DNA Sequence Number=SeqID_59753
  Gene Ontology: Mol. function=carbon-nitrogen ligase activity, with glutamine as amido-N-donor; Cellular component=cytoplasm; Biological process=translation
  Homolog annotation: Hit_ID=A7PKQ4; Match level="QueryCoverage=93%, HitCoverage=91%, E-value=1e-154, Identity=50%"; Hit description =Chromosome chr7 scaffold_20, whole genome shotgun sequence
  Pfam annotation: Domain name=Amidase; Domain location=164-553; Score =108.6; E_value=1.9e-29; Accession=PF01425.12; Description=Amidase
MGLFKSKGVVYRPVKDVNLGSDSTEFYLQANVKAPRMTGILVKIFTWFLESPILGSLLFYILKGNNLIHKLITNAELEESPLFVPSHHFEGSLFSSRFFPSDHKEQEVKCLDSALTPQEQVQLAIECLPTSSEKAHNETNPSFSRWTIMDYSRAYSSGDITPLMVAERFIAAINESSKPPLRMGFFINYNAEDILRQANESTLRYQKGTPISVLDGVPVAIKDEMDCLPYPTTGGTKWLHKERLCTDDACCVKRLRLCGAILVGKTNMHELGVGTSGINPHYGAARNPYDINKISGGSSSGSAAVVSAGLCPVALGVDGGGSVRMPASLCGVVGLKPTFGRVPHSGWLLVEKFHPISPLICFDDVRLCCSHAMRKLQDHYGWKEEGLTGGRGKNAELAGTFLTNSVIVKIPRGSGNHNSVSRRHYVYSYVNNSKGMRIIILPYLWLFFFSFPSLPHGDPEFGWDARVALNIYGAFSGKEYIKAQKLRNRQLQFHMKIFAEADVIVSPTTGVTAYSIQDDALKTGELDYVNGAALVRYSISGNFLGLPAVTVPV

SEQ ID NO: 151439 - protein, 502 aa, Glycine max
  Coding DNA Sequence Number=SeqID_59754
  Gene Ontology: Mol. function=hydrolase activity, acting on carbon -nitrogen (but not peptide) bonds; Cellular component=cytoplasm; Biological process=nitrogen compound metabolic process
  Homolog annotation: Hit_ID=A7QU39; Match level="QueryCoverage=93%, HitCoverage=58%, E-value=0.0, Identity=78%"; Hit description =Chromosome chr2 scaffold_176, whole genome shotgun sequence
  Pfam annotation: Domain name=NAD_synthase; Domain location=163-423; Score=-83.0; E_value=1.4e-06; Accession=PF02540.8; Description=NAD synthase
VASLRGSLSSFQEQASCKTKVPSVEVPFSLCLPFNLKTHLSLPLKIKYHTPEEEIAFGPGCWLWDYLRRSGASGFLLPLSGGADSSSVAAIVGCMCQLVVKAELAGEVDLNIHSSFLENPAKLLEYRAWWPLITSECSTCKEAKLSTDEIANGDEQVKADAIRIGNYKDGLYPTDSREFAKRIFYTVFMGSENSSEMTRSRAKVLADEIGSWHLDVSIDVVVSAFLSLFQTLTGKRPRYKVDGGSNVENLSLQNIQARIRMVLAFMLASLLPWVHSKPGFYLVLGSSNVDEGLRGYLTKYDCSSADINPIGSISKQDLRAFLQWAAIHLGYSSLADIEAAPPTAELEPIRSNYSQLDEVDMGMTYEELSVYGRLRKIFRCGPVSMFQNLCYRWGARLTPSQVAEKVKHFFKYYSINRHKMTVLTPSYHAESYSPEDNRFDLRQFLYNARWPYQFRKIDELVSELDVKDVKDSGDHEAMAATSDGVGGMGVAAAGSGNPNVGL

SEQ ID NO: 151440 - protein, 757 aa, Glycine max
  Coding DNA Sequence Number=SeqID_59755
  Gene Ontology: Mol. function=protein phosphatase type 2A regulator activity; Cellular component=protein phosphatase type 2A complex; Biological process=signal transduction
  Homolog annotation: Hit_ID=A7QU32; Match level="QueryCoverage=89%, HitCoverage=99%, E-value=0.0, Identity=48%"; Hit description =Chromosome chr2 scaffold_176, whole genome shotgun sequence
  Pfam annotation: Domain name=WD40; Domain location=338-375; Score =15.2; E_value=0.25; Accession=PF00400.23; Description=WD domain, G -beta repeat
  Pfam annotation: Domain name=WD40; Domain location=399-436; Score =39.3; E_value=1.4e-08; Accession=PF00400.23; Description=WD domain, G-beta repeat
  Pfam annotation: Domain name=WD40; Domain location=440-478; Score =38.0; E_value=3.4e-08; Accession=PF00400.23; Description=WD domain, G-beta repeat
  Pfam annotation: Domain name=WD40; Domain location=481-519; Score =2.7; E_value=15; Accession=PF00400.23; Description=WD domain, G-beta repeat
  Pfam annotation: Domain name=WD40; Domain location=531-570; Score =7.4; E_value=3.9; Accession=PF00400.23; Description=WD domain, G -beta repeat
  Pfam annotation: Domain name=WD40; Domain location=572-611; Score =10.1; E_value=1.8; Accession=PF00400.23; Description=WD domain, G -beta repeat
  Pfam annotation: Domain name=WD40; Domain location=710-749; Score =11.9; E_value=1.1; Accession=PF00400.23; Description=WD domain, G -beta repeat
  Pfam module annotation: Pfam domain module=WD40::WD40::WD40::WD40::WD4 0::WD40::WD40; Domain location=338-375::399-436::440-478::481 -519::531-570::572-611::710-749
MAKKGGKHWEPMKVERKESDSSEMNVMFALTRKDSKYSCGCTVQTEQTNKAKIPMNIVSISGSSSNFEQDPEVGIGERWDMEEEEDQFYETREELCSVSDGGSDCSESDESSSGNNGHVTRYQVWAQNLESVHQRRLNFLRWMGLESDLNYSMKGEELGDQPCGIDRITATSGAVLRTSFAIEEGLPSTSNQIVLDSLSDEASGSQENRENLACMIRNLDDGTEYIVDKLGQDGAPSTLRVLGSNQLISLEEFQKNIGPSSFIRRHLQRDTENTRLLGVGKRKMKRGWLRKLDSIACFVHNHGFDETKCKDCDSVDRSGIQRVRVHSYRKRFKELSSLYTEQEFKAHKGVILTMKFSLDGKYLASGGEDGMKLVKTEKLRRSSEATCVIVPPKTFRISAKPLHEFQGHSSDIIDLAWSKRGFLLSSSVDKTVRLWHVGIDRCLRVFYHNNYVTCVNFNPVNDNFFISGSIDGKVRIWEVVHCRVSDYIDIREIVTAVCFRPDGKGTIVGTMAGNCRFYDIVDNHLQLDAQLCLRGKKKTSGKKITGFQFSPSDPSKLLVASADSHVCILSGVDVIYKFKGLRSAGQMHASFTTDGKHIISVSEDSNVCIWNYTGQDRNTSKAKKIWSSESFLSHNAAIAVPWCGIESMPGTLLSPSLGEDVNQRCSLPSPDCFFLSRGFLSELIPKVSATWPEETLVDSSCQTQTVVSPTMCKSEYKFLRSACKGMSNSHLWGQVIVTAGWDGYIRVYQNYGLPVRG

SEQ ID NO: 151441 - protein, 138 aa, Glycine max
  Coding DNA Sequence Number=SeqID_59756
  Gene Ontology: Mol. function=binding
  Homolog annotation: Hit_ID=A7PKW2; Match level="QueryCoverage=75%, HitCoverage=8%, E-value=5e-45, Identity=83%"; Hit description =Chromosome chr7 scaffold_20, whole genome shotgun sequence
  Pfam annotation: Domain name=SH3_1; Domain location=79-138; Score =27.0; E_value=7e-05; Accession=PF00018.19; Description=SH3 domain
MLEMSGMIMIMIISLMGISWIRHQQAEALCMRVMIREEPPSYSSSVMQRHESFENPLAGNGLHSFGSQDDERASSGNPQHGSALYDFTAGGDDELSLTAGEEVDIEYEVDGWFYVKKKRPGRDGKMAGLVPVLYVSQS

SEQ ID NO: 151442 - protein, 127 aa, Glycine max
  Coding DNA Sequence Number=SeqID_59757
  Gene Ontology: Mol. function=nucleoside-triphosphatase activity; Cellular component=mitochondrial matrix; Biological process=ATP -dependent proteolysis
  Homolog annotation: Hit_ID=A7NZT2; Match level="QueryCoverage=33%, HitCoverage=8%, E-value=5e-09, Identity=71%"; Hit description =Chromosome chr6 scaffold_3, whole genome shotgun sequence
MAISMMIHCLLNLRLFVLNMEKGVPLLPKWLSFSRVNARAWTGVEIGPARLHLSLSQKLGVQIVLCWTTSCWKDITGILYSCCTGCKICVHIPSGVKDEADIRGHRRTYIGSMPGRLIDGLKVQNLT

SEQ ID NO: 151443 - protein, 252 aa, Glycine max
  Coding DNA Sequence Number=SeqID_59758
  Homolog annotation: Hit_ID=A5AE14; Match level="QueryCoverage=42%, HitCoverage=8%, E-value=2e-10, Identity=34%"; Hit description =Putative uncharacterized protein
MTGTLQHLCDVRKVPGCLIGLPNGHTATSTKEGTIRLVGGLRLENDRTLKMLIRAGERRDVLYFFREIPKVKACKVEGITQLEVWHKRLRHPSWQTTQLISDGSRNREHLSKMARLKESIDISSMWRELCDFKEVYPLNFGANFLFHHTEIASTSSISIIDEANLENQIDDRPANQNESLVEQILDDKGGTDTTEVVVTDTTVFPEPPDIQIPNTHNENEPLGRGCRVKYPSTQLQDYVIHTIQKLSPYIRS

SEQ ID NO: 151444 - protein, 1061 aa, Glycine max
  Coding DNA Sequence Number=SeqID_59759
  Gene Ontology: Mol. function=hydrolase activity, acting on acid anhydrides, in phosphorus-containing anhydrides; Cellular component =spliceosome; Biological process=mRNA processing
  Homolog annotation: Hit_ID=A7PFD4; Match level="QueryCoverage=99%, HitCoverage=99%, E-value=0.0, Identity=79%"; Hit description =Chromosome chr11 scaffold_14, whole genome shotgun sequence
  Pfam annotation: Domain name=DEAD; Domain location=75-226; Score =113.9; E_value=4.7e-31; Accession=PF00270.20; Description=DEADDEAH box helicase
  Pfam annotation: Domain name=DSHCT; Domain location=774-967; Score =229.6; E_value=7.2e-66; Accession=PF08148.3; Description=DSHCT (NUC185) domain
  Pfam annotation: Domain name=Helicase_C; Domain location=384-468; Score=41.5; E_value=3.1e-09; Accession=PF00271.22; Description =Helicase conserved C-terminal domain
  Pfam module annotation: Pfam domain module=DEAD::DSHCT::Helicase_C; Domain location=75-226::774-967::384-468
MEIESPTLGKRREPELPVTETTSMPKKARSSERTCVHEVAVPSSYVSSKDEELHGTLSNPLHNGPMAKSYPFTLDPFQQVSIACLERNESVLVSAHTSAGKTAVAEYAIAMSFRDKQRVIYTSPLKALSNQKYRELSQEFTDVGLMTGDVTLSPNATCLVMTTEILRGMLYRGSEVLKEVAWVIFDEIHYMKDRERGVVWEESIIFLPPAIKMVFLSATMSNATEFAEWICNIHKQPCHVVYTDFRPTPLQHYVFPMGGSGLYLVVDENEQFREDNFLKLQDTFTKQNLGDGKRGGKGAGRGGKGGNASGGSDIYKIVKMIMERKFQPVIIFSFSRRECEQHAMSMSKLDFNSQEEKDTVEHVFQNAVLCLNEEDRNLPAIELMLPLLQRGIAVHHSGLLPVIKELVELLFQEGLVKALFATETFAMGLNMPAKTVIFTAVKKWDGDSHRYIGSGEYIQMSGRAGRRGKDERGICIIMIDEQMEMNNLKDMVLGKPAPLVSTFRLSYYSILNLMSRAEGQFTAEHALPDMEKRVSKLEQEVALLDASGEAQVSEYHKLKLEIAQLEKKIMSKIIRPEIILYFLVPGRLIKVREGGTDWGWGVVVNVVKKPSGGGYIVDTLLHCSPVSNENSSRPKPCPPRPGEKGEMHVVPVQLPLISALGQLRVSIPPDLRPLEARQSILLAVQELGNRFPQGLPKLNPVKDMDVRDSEIVELVNQVEELEKKLFTHPMHKHQDMDQIKCFERKAEVNHEVQQLKTKMRDSQLQKFREELKNRSRVLKKLGHIDADGVVQLKGRAACLIDTGDELLVTELMFNGTFNDLDHHQVAALASCFIPGDKSTEQIQLRTELARPLQQLQDSARRIAEIQHECKLDINVNEYVDSTVRPFLMDVIYSWSKGANFADVIQMTDIFEGSIIRSARRLDEFLNQCYQMAAMAERRGGFLKKRHRIAVAWWVANGSAMVRSPTTMDSTERSPSHATQPRPCTQNVAQQRRPRVPPARPSSDNSTSTTHTATTTTLQSATDGNVLRAAANAVGEADLEKKFAAASESLRRGIMFANSLYL

SEQ ID NO: 151445 - protein, 140 aa, Glycine max
  Coding DNA Sequence Number=SeqID_59760
MSHHSSSVMARSLSEELRDYYEGRHRSHLRPHSHRREKERKPQEANINLSYFHGKDNIEAYLDWEIRVEQQLKKKSTSKSYGSHSYSKKDQGQGILGVTPSKPKDDKEAIIEKQPLTTSVQEKTSSIKCFKCLGRGHINS

SEQ ID NO: 151446 - protein, 210 aa, Glycine max
  Coding DNA Sequence Number=SeqID_59761
  Homolog annotation: Hit_ID=A5B5G7; Match level="QueryCoverage=80%, HitCoverage=11%, E-value=3e-08, Identity=29%"; Hit description =Putative uncharacterized protein
MWLKGAKTLVFLFGNRDERAKCACCDKPVHRSYGFKEKKSFVSSASQIRFDRSRFHSQEAWDRYTDIIVPKKLLPERNVVIYHTEFDEFKEELERRKWDEELTSFDEGNIDVAIVKEFYANLYDPEDKSPKQVRVRGYLVKFDEDKLNTFLKTPVIIEEGETLASYSRFALLRSDPQELAATLCVPWRGFELNIDGQPLKILRKNMTTLA

SEQ ID NO: 151447 - protein, 102 aa, Glycine max
  Coding DNA Sequence Number=SeqID_59762
MQRRSTAGDLIPINLEINTTCRRCNAERIKKILQDLEAAATPEEVPRSSKASSSFPIPGQSHIDLIEEVIMDEGPRRVTLEDYSSSSVPQFFTSIAQPEVQA

SEQ ID NO: 151448 - protein, 184 aa, Glycine max
  Coding DNA Sequence Number=SeqID_59763
MQSSDRSPSKPKPLVIHFTRDITTHIPRGFQPSIAKTPTPFPYTSDKAVPWKYGVQGLGGRKDTSVIRVGNGMPATKITNISGTISMTHSGRIFTPSELPARSKDKGKTKADIGERERTGLTANDEALVGKFAEEAQDISVEGFGGIVKNITVNNYLTFADEEIPVKGRGHNKVLHVSVKCMDT

SEQ ID NO: 151449 - protein, 97 aa, Glycine max
  Coding DNA Sequence Number=SeqID_59764
MHKLHSKVGPEPPKHEDLSEIAHGGQCLSISVLQLWILHLTDTSMRAGNSDIYGFLEPQSIQSGHWQMVVILPKEHLVVWFCSLHNMLDNYLKGIIN

SEQ ID NO: 151450 - protein, 141 aa, Glycine max
  Coding DNA Sequence Number=SeqID_59765
MVSGNRLPMVCNRLHRVTRHWCLGDPRFRGTIRLTATSLVHPEEPAHTLQQPVEWILPTPTPYRLVEPVQVIEVSSSEEDLEEDPEELLPEPAVDAPDFPEDDEDPLLDVDSPEDVMSASEADSTDESGPGGTAKSDDSSS

SEQ ID NO: 151451 - protein, 208 aa, Glycine max
  Coding DNA Sequence Number=SeqID_59766
  Homolog annotation: Hit_ID=A5BU47; Match level="QueryCoverage=95%, HitCoverage=10%, E-value=7e-11, Identity=29%"; Hit description =Putative uncharacterized protein
MDEPFIMAEQARHVFYIQDPCDLRFLVVLQGRPSGFNHRHDDSTLDICETPTFFQMSHTTLMMYTYFHLPKVMRTPPPSLPQLDVQSEAMFRNTRQSTQLRRLTLRTLDQPRPIVNIDAATGQGPGSHKEKFHNYLGVVAREKIPIEHKNWKDVPDSLKDLVWDDILIHKLGRNLLQAAKPLIGRESGKTCRKFKNTMTVPIYSLVVI

SEQ ID NO: 151452 - protein, 217 aa, Glycine max
  Coding DNA Sequence Number=SeqID_59767
  Gene Ontology: Mol. function=identical protein binding; Biological process=negative regulation of catalytic activity
  Homolog annotation: Hit_ID=O65757; Match level="QueryCoverage=48%, HitCoverage=79%, E-value=2e-25, Identity=62%"; Hit description =Putative Pi starvation-induced protein
  Pfam annotation: Domain name=Subtilisin_N; Domain location=53-122; Score=30.6; E_value=5.8e-06; Accession=PF05922.7; Description =Subtilisin N-terminal Region
MVTSNTNNTILKISKLAILLVLFASVCNVAMSDSTAKPLDQHATTGSDPTAPAVHIVYTERPQNEEPEAYHIRTLTSVLGSEEAAKEALLYSYKSAASGFSAKLTPEQVEQISTCAQAAYYQEACSELGDWYSLLSPFRHFEETILHVMRDCPLASQGAYLGLSLAWDKGDKNLEVNIDSLKIECYLCHIYREANGCADALANYACAMEEEYVILEQ

SEQ ID NO: 151453 - protein, 253 aa, Glycine max
  Coding DNA Sequence Number=SeqID_59768
MVTKSGMRTLLRLGGVDGDPVLRGTRRATYVYLTTEWYLRICRGGSGDLGDVRWGAIAQNQACPIPTQPRHSQPVKTCDVPKQASSWQSTNKGTKVHEAGRLVWRLASYLSCVLSEKFPLIVMAVQLIHDRVVMECLEGVWETLECNERCRFRGTVQLTATSLPVEWILPTPTPYRLVEPVQLIEVSSSEEDLEEDLEELPPEPAMDALDLPEDGKDLLPDVDSPEDIMSASEADSTKESGPGGTANSDDSSS

SEQ ID NO: 151454 - protein, 152 aa, Glycine max
  Coding DNA Sequence Number=SeqID_59769
MAYASNNPPPPLPLLMTNEVSVHNATPVKAISMNAYVATLIATYKSIHYSTFGTILLEYEAHIERSRKRALGSINLTEVCRLKKKRCKKLLMNSLSEAIWLSEPCSLSEASSSLSGCKTLEEDKLEICMFSVQPARPVRMLSLVALSAPTPA

SEQ ID NO: 151455 - protein, 136 aa, Glycine max
  Coding DNA Sequence Number=SeqID_59770
MAAEWRRKRERRRHFKEKMSLEEAHHHRRPWIRAWRKKKMNEGRGREEHKILCSKRALKSEDCISGEDNTNLVHQKFVACRRNSFGEEVSMLMTGWNIFYGRFGNAGMLLVVPGNDFWTKSIKSYGEKSSHKKIKK

SEQ ID NO: 151456 - protein, 162 aa, Glycine max
  Coding DNA Sequence Number=SeqID_59771
MIYGKVSKLFVVRWKDVLDSIWHLIDKDGNYHNIVYNKDLDQPVIVAGWTTLRDFYQLTEYHLVSLTHYVPNFVTFKVYLTQQKVSYNNLDVPSSMYYFLKYKGWTHLHLEDIAEYRLVFNHWRKTLKIGAGWKHFCEILSLTADMEIVFEFIDPTINRALF

SEQ ID NO: 151457 - protein, 113 aa, Glycine max
  Coding DNA Sequence Number=SeqID_59772
MGGSLFAWKPPLPLAIKHDPPVAMAIQALTWLIPPLALARRAYVDRCRWSHWRDTPREELAASSNGDTDVEEALASLIGDTDMEESTMHCLQCYIGYGCSYAGYGCSSDKCSD

SEQ ID NO: 151458 - protein, 75 aa, Glycine max
  Coding DNA Sequence Number=SeqID_59773
  Homolog annotation: Hit_ID=A6FJQ2; Match level="QueryCoverage=50%, HitCoverage=84%, E-value=3e-11, Identity=92%"; Hit description=50S ribosomal protein L5
MTWKPRTHAAPGDVHSLSMRKEKIPHQAPFAIQAAQLLGRAIGAGLFAITPAGERGMCCKAIKLGNARVFPVTTL

SEQ ID NO: 151459 - protein, 116 aa, Glycine max
  Coding DNA Sequence Number=SeqID_59774
MCNRLPETYNRLPVKNFRKSFLKRHISSNHFEKARRAYICVFDFKKQERDILRELLMQAPLELRNGERERERRRHFKEKMSLEEAHHHRRPWIRAWRKKEMNEGRGREEHEILCSK

SEQ ID NO: 151460 - protein, 45 aa, Glycine max
  Coding DNA Sequence Number=SeqID_59775
MEMQRKTKEKRIASNPTPQEHWIEDSKKIGPEIQEMTLGFSRALR

SEQ ID NO: 151461 - protein, 70 aa, Glycine max
  Coding DNA Sequence Number=SeqID_59776
MGLHHFGIRARFKGFSKLLGLKFLGGGEHQLDRAQRFLLDALNAQMQRLLRENNEELYERIERLENREGH

SEQ ID NO: 151462 - protein, 159 aa, Glycine max
  Coding DNA Sequence Number=SeqID_59777
  Gene Ontology: Mol. function=RNA-directed DNA polymerase activity; Biological process=regulation of transcription, DNA-dependent
  Homolog annotation: Hit_ID=A5C5U6; Match level="QueryCoverage=65%, HitCoverage=5%, E-value=9e-15, Identity=38%"; Hit description =Putative uncharacterized protein
MEPEFWDKNPFKATAKAFPTGFHFKPTAINKSRTFYELILVDSNSVSIKHFKDPKDQTLNTYSTILILKVLQPRHFGSDLNKGKKISVPFDPVGYTYWDYVDAWTKGDVGLTGASSKGGKCVESPPTFIQGTLQKNRNVWSTNFKFERFGSCFYARGRY

SEQ ID NO: 151463 - protein, 69 aa, Glycine max
  Coding DNA Sequence Number=SeqID_59778
MARRLQEDWAKDAGEGPRILMSLRTSFSLFYLSKSHSHLSLSLHSSSPTFKLYSMASYGGELVLDSSSP

SEQ ID NO: 151464 - protein, 130 aa, Glycine max
  Coding DNA Sequence Number=SeqID_59779
MPEESEEVQALKAELIKTRVVKEKLKVPVTRVRKECDELKDINMTMVEALEREMKKARKEDNNKLKLRMAERDKSRMESLMLEDKLKSYQRSKRSLTEQLSKMEENMLIIIDQYKEKMELAASLGQMLED

SEQ ID NO: 151465 - protein, 50 aa, Glycine max
  Coding DNA Sequence Number=SeqID_59780
MQEKYSKGMVNIDIEGMLKQQPDDGGVPKMKIQGLKNPTLLGYPPYTMEP

SEQ ID NO: 151466 - protein, 111 aa, Glycine max
  Coding DNA Sequence Number=SeqID_59781
MNKEGVGKENEKNDEVVTSEKVVSEEGKKKSNEQTTNKGKAIVNHPPIEHLPYPHAPSKKDKESPIAIKVVGPFFLTQILQEMAPILLPIPYMATHKQGNKETSNNQRPKK

SEQ ID NO: 151467 - protein, 73 aa, Glycine max
  Coding DNA Sequence Number=SeqID_59782
MSGACAYKMDEKMGTNSQQDTPDTPSRSADSLPILKKHFILDKVMPKYFQSPMTSAFIPKDGSLMLQHRKICA

SEQ ID NO: 151468 - protein, 89 aa, Glycine max
  Coding DNA Sequence Number=SeqID_59783
MWDMLTTTYKGMSQESEDMKLSRKQRKFHHLRNHYRDLVQRCIPSAEYGKRFDEKCDEDDELAFISRKIQKMRKNKSEYRWKNSSKKVF

SEQ ID NO: 151469 - protein, 124 aa, Glycine max
  Coding DNA Sequence Number=SeqID_59784
  Homolog annotation: Hit_ID=Q84VH5; Match level="QueryCoverage=62%, HitCoverage=11%, E-value=5e-34, Identity=97%"; Hit description =Envelope-like protein
MKRESPLSLHYKLFEGTHVPDIVSTSGKAADSGAVSKDALIAELKDTCKVLEATIKATTEKKMELERLIKRLSESGIDDGEAAEQEDEAAEEEVEAAEKEEEAAEEEEDAAEDTESDDDSEATP

SEQ ID NO: 151470 - protein, 41 aa, Glycine max
  Coding DNA Sequence Number=SeqID_59785
MEQPKIVEVQSEKEGRVGRIKFQYERAKANKLGHYMVLPES

SEQ ID NO: 151471 - protein, 164 aa, Glycine max
  Coding DNA Sequence Number=SeqID_59786
MGFPGGPRDPWVSYDDVDDTWMHYSNHLDAAGDSCVVPGQCAPDYIDWFFRISHPFMTATQPSDPPADAPAAQPRHVPQVPESDIPQVPDDPARSDVDEPTHAVEACDAIAERLECHLRLGVLTPGTSTHEVIEECLNIARSVTQDRIVYVRSRRRHLLVDEYG

SEQ ID NO: 151472 - protein, 60 aa, Glycine max
  Coding DNA Sequence Number=SeqID_59787
MKAILGYQDVMDIMEEGYLSLPERATEAQKAIHKENKKNKDFVIEAVPESNKHENAVTRK

SEQ ID NO: 151473 - protein, 163 aa, Glycine max
  Coding DNA Sequence Number=SeqID_59788
  Subcellular localization annotation: CTP_CleavageSite=26; ConfidenceScore=5.23e-01
MARPAELPSTSSAPTPASTSVAPSVPAQSDSQRFEAMLRRIHHEQIILLQSLQVVAPPGSIPSVEQFMERVAWPGAQPSLHREDEGPIAQATIPEPFIVEEEAGETQVRQEATATPERSLEDTSEPPAPVLTLNTSPPTTPVLHLTDEEDVQTQDTQDQSQEF

SEQ ID NO: 151474 - protein, 101 aa, Glycine max
  Coding DNA Sequence Number=SeqID_59789
MAYRKHKSIGSRPTTQYDTRRFHSLDSWNWYTDNVLGRNILPERKVELYHTELDDFKTELERCNFHKRLTNLVNGSIDLALVKEFYANLYSSECPSPKQAR

SEQ ID NO: 151475 - protein, 322 aa, Glycine max
  Coding DNA Sequence Number=SeqID_59790
  Gene Ontology: Mol. function=oxidoreductase activity; Cellular component=chloroplast; Biological process=metabolic process
  Homolog annotation: Hit_ID=A9PC91; Match level="QueryCoverage=100%, HitCoverage=100%, E-value=7e-96, Identity=57%"; Hit description =Putative uncharacterized protein
  Pfam annotation: Domain name=adh_short; Domain location=18-237; Score= 62.9; E_value=1.1e-15; Accession=PF00106.16; Description=short chain dehydrogenase
MATQLSDRLEPWHTLAGKVVMVTGASSGLGRDFCLDLGRAGCRVVVAARRVDRLESLCDEINSMAAGDGGRSRRAVAVELDVAADDPAVDKYVQKAWEAFGHIDALINNAGVRDIGGAGDLVFEKNLSLPLDRNSWIRAVGIFCCEGIQHQLVGNVKSPLELSEEEWNHAFRTNLTGTWLVSKYVCKRMRDAQRKGSIINIASIAGLNRGQLPGGAAYSSSKAGVNMLTRVMALELGAHKIRVNSISPGLFKSEITEKLMEKNWLNNVAMKTVPLRKFGTSDPALTSLARYLIHDSSEYVSGNNFVVDAGATLPGVPIYSSL

SEQ ID NO: 151476 - protein, 130 aa, Glycine max
  Coding DNA Sequence Number=SeqID_59791
  Homolog annotation: Hit_ID=Q2HW90; Match level="QueryCoverage=86%, HitCoverage=20%, E-value=8e-07, Identity=30%"; Hit description =Putative uncharacterized protein
MSTILAATFLSMEVCHEKKRGTLRCCNHLLYVWIVTHLYESNYMGYALDPLRRFHRIPMKKQQPTEWKKELSNYEVDHFSWVCPWYLPKHIIFNCGEFSNVSLVGLRGCVTYIPTKVIKLENLCKFMRVP

SEQ ID NO: 151477 - protein, 57 aa, Glycine max
  Coding DNA Sequence Number=SeqID_59792
MTISTNNSLFKWGGSGGSDDGDNNGGGGGGIDNGGGTRIVVATMVIVTLSTLTNINK

SEQ ID NO: 151478 - protein, 278 aa, Glycine max
  Coding DNA Sequence Number=SeqID_59793
MDRSMIDAASGGALGDMTPAEARNLIEKMASNSQQFSARNDAIVIRGVHEVATTNPSASFETKKLEGKLDALVNLVTQLALNQKSVPVARQNQPSQSNYDLSSNRYNPGWRNHPNLRWSSPQQQQQQPAPSFRNAAGPSRPYIPPPIQQQQQPQKQPTVEAPPQPSLKELVRQMTMQNMQFQQETRASIQSLTNQMGQLATQLNQQQSQNSDKLPSQAVQNPKNVSAISLRSGKQCQGPQPVAPSSSANEPAKLHSIPEKGDDKNLPNDFCAGDLHST

SEQ ID NO: 151479 - protein, 117 aa, Glycine max
  Coding DNA Sequence Number=SeqID_59794
  Subcellular localization annotation: CTP_CleavageSite=58; ConfidenceScore=5.43e-01
MVKVGTSYVPGSTSHFRQKLAQGFPVSTGRHQDLFILRSVFRTGAPVCFYQLSLLFSYCGVVRKRQKHRRTQRWSSVAVYAARNQLLTPAALNAPLQGASPKLRPFSSLRATDSEGR

SEQ ID NO: 151480 - protein, 270 aa, Glycine max
  Coding DNA Sequence Number=SeqID_59795
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGDKNSARKAILARERIRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151481 - protein, 43 aa, Glycine max
  Coding DNA Sequence Number=SeqID_59796
MAEPSKKQKGSSSRSQRHSETQEMSIPSSIPSASLFSSEEQRI

SEQ ID NO: 151482 - protein, 143 aa, Glycine max
  Coding DNA Sequence Number=SeqID_59797
KSVGNNAYLPMFGRHRPTDTSVGGDRHYGRWVRTSACLFARQECKSSDGIEYVIAPLGVLQAPHQGAVIKETTGPLRPGVHSPREDTVVPLKARACSTLKVRACSPTKARTCQSSKGEDVVSLKGEGVKPCNGEDGSPLEGED

SEQ ID NO: 151483 - protein, 133 aa, Glycine max
  Coding DNA Sequence Number=SeqID_59798
MPVAHGGQTLVFYEIKLIETCLGPPDSFNPDSAKILNDGTSTLNGCTTSIPYTNENGVAPVDVRTEVHFVHLWSVGCGIVMLDLKLLAHFPHHLVIQVGAIVRDNLPRQTIPVDDLPLYEPDHQTLGDASVRR

SEQ ID NO: 151484 - protein, 79 aa, Glycine max
  Coding DNA Sequence Number=SeqID_59799
TLIPQKPGGLPESRHDKRVRGKGSRGLHVITPSVEDFQVAHLYVLNNSNEVLPYILHHEGLVKESNPKMLKNRVLKEHN

SEQ ID NO: 151485 - protein, 213 aa, Glycine max
  Coding DNA Sequence Number=SeqID_59800
MTTLTQIWMTLLLSNIQPSNHNSDLPLPKCQLVYAILTRMSIHMAQLIADAIYLFAGMAPTRHLLDPDKSNRSLGFPALITGLCQSFGVPVAPSKVIRPPITRAFIEKYCTQRQAQGDAPQAADAPPPHQAGPTGSFDTEQYLRHLSQGFTSFLCPTPDQFRAEVAWPGDWPEARAGEAPAEAPAGAPDEADEAREDEEMTNLLDFLGGNGAT

SEQ ID NO: 151486 - protein, 196 aa, Glycine max
  Coding DNA Sequence Number=SeqID_59801
MTQELVACGNTLRLSAPRHSVKPSMIDEQRPVWSFAPFPEMSASSGGNFFKSHKIRRNKSPLSAEGAHACGGQNLVISAPLCHSDTVVSDGTQRQNLVILHPLSSRGGGPDDMRRQNLVIPHPFAIQTQSCPMAPRDKIWSFCTFCHPEATGPMTCGDKIWSFRTPFPFRHSRVRWHAETKFGHSAPFVNRGRQAR

SEQ ID NO: 151487 - protein, 96 aa, Glycine max
  Coding DNA Sequence Number=SeqID_59802
MYTYVLETFSKIFESIQRLTNWNEGNVTGSMMIGCGITWMLGKLGRMDGDPGLRKTRIWATWEYVSSVGGGQQGMVGLCAICGCGKLVVHHRPTAT

SEQ ID NO: 151488 - protein, 389 aa, Glycine max
  Coding DNA Sequence Number=SeqID_59803
  Gene Ontology: Mol. function=hydrolase activity, acting on ester bonds; Cellular component=intracellular; Biological process =nucleobase, nucleoside, nucleotide and nucleic acid metabolic process
  Homolog annotation: Hit_ID=P46837; Match level="QueryCoverage=100%, HitCoverage=50%, E-value=0.0, Identity=90%"; Hit description=Protein yhgF
MFRGRNEGILQLSLNADPQFDEAPRESYGETLIADHLGLRLNNAPADSWRKAVVSWTWRIKVLLHLETELMGTIRERAEDEAINVFARNLHDLLMAAPAGMRATMGLDPGLRTGVKVAVVDATGKLVATDTIYPHTGQAAKAATSVAALCAKHQVELVAIGNGTASRETERFFLDVQKQFPQIKAQKVIVSEAGASVYSASELAAQEFPDLDVSLRGAVSIARRLQDPLAELVKIDPKSIGVGQYQHDVSQSQLAKKLDAVVEDCVNAVGVDLNTASVALLTRVAGLTRMMAQNIVSWRDENGRFQNRQQLLKVSRLGPKAFEQCAGFLRINHGDNPLDASTVHPEAYPLVERILAATEQALNELMGNPGSLRDLNARDFTDERFGLPT

SEQ ID NO: 151489 - protein, 63 aa, Glycine max
  Coding DNA Sequence Number=SeqID_59804
MITYTCSDAILPRKGPITRTMSKRLQEDWARAAEEGPRVLMNLRVGYPRNIGFFSPCIFGHLD

SEQ ID NO: 151490 - protein, 104 aa, Glycine max
  Coding DNA Sequence Number=SeqID_59805
MATIALLSRYGRWCLVSDVQQASFVADLGAAIVDDWVFLADPGRFQISIPVHLQVILGASSTLVLIKIQHLEIQRNDHEALFLLQNARVLIVGDTEGPPKCLAG

SEQ ID NO: 151491 - protein, 106 aa, Glycine max
  Coding DNA Sequence Number=SeqID_59806
MGGANSNFEILKLGLPENFQSWISSGGSNPALLGELGGNLLPLFPINRLKGAVLGVPDPPGDVFQLFWVKKIVSVKKIQPRCFRKQIREGFPPLSTVLHPFFVLQW

SEQ ID NO: 151492 - protein, 82 aa, Glycine max
  Coding DNA Sequence Number=SeqID_59807
EHRSLEQTDKWLAPTSGFTRDSPQISASLYQLDLAPYASEPYNAQWNAPGLLRDKHTLRSCRILGEMEVVFVIGSAVGRLCG

SEQ ID NO: 151493 - protein, 129 aa, Glycine max
  Coding DNA Sequence Number=SeqID_59808
MRLVGPPTRHLAGVLDATSGDVPTYFPVVDVEGAHEGHHMSIEISSFHGQLRWGPMIVTVRPERVVRQFGYIQSFPPPPVSADYMEWFFRISHPFMTPTQAGDQQRDAPAADPEDYIQPPSPFSMFKYP

SEQ ID NO: 151494 - protein, 113 aa, Glycine max
  Coding DNA Sequence Number=SeqID_59809
  Subcellular localization annotation: CTP_CleavageSite=25; ConfidenceScore=5.04e-01
KWPQGSLPQRGPGRTRQPKELVPLRSMKVTALGALYTSSALRPSGDGRFSGSDAAPAVGITGYSHGQWIPFDADTISQLLGYPLVLEEGQECEYGQRRNRSDGFDEEAIAQML

SEQ ID NO: 151495 - protein, 101 aa, Glycine max
  Coding DNA Sequence Number=SeqID_59810
  Gene Ontology: Mol. function=aspartic-type endopeptidase activity; Biological process=RNA-dependent DNA replication
  Homolog annotation: Hit_ID=Q6WAY3; Match level="QueryCoverage=98%, HitCoverage=5%, E-value=1e-13, Identity=33%"; Hit description =Gag/pol polyprotein
MGAYSVDEKLLVHFFQDSLAGADVAWYTNLEASQIRSWKDLATAFIRQDLAAQVVQPMTEREMITIMVDTLPTFYYEKLIGYMPANFADLVFAGERIESGL

SEQ ID NO: 151496 - protein, 290 aa, Glycine max
  Coding DNA Sequence Number=SeqID_59811
AACAAGSGVPNRSLCGIAAVGTGGTCAGGLDVAGRAIGGRRDRIELATIDRVGALGAGSDTGDLTITARAADRHSVGTVGDRARAQRNAACGTGGGTHTYRRGIGAGCLAAVAGRGTQATAGLGIAAQRRRTIGRGIGAETTGLRLGAAGRGLRTAGGTVGALGLCAGTGGTGTEFAGAGATAHGYAVDTSGLRRVAERRRIVAGGQGIEAHGSGIGGHGIGAAAQRGGAVADGIGRIAGSQCVVAVHQCTGFAIGIAAGLELQAGLVGDAGDRIQLALVHRIVASCPPR

SEQ ID NO: 151497 - protein, 239 aa, Glycine max
  Coding DNA Sequence Number=SeqID_59812
MVMGDFISRLSFPENTETFSSLTSYPELRRSEFLIGGYVGARASLLSTTPPFVAMTQELVAPRRYLTVIRTLLSSRGGGPDDKQRPSLVILHPRYAEIPYETKFGHSAPKIRGDTLRLSAPFCHPEAAGPMTSRDQVWSFCTQDTRRYLTVIRTLLSSRGGGPDDKQRPSLVILHPRYAEIPYGYLHPFARQTQLCPMASRDQRPSLVILHPRYAEIPYGYLHPFARQTQLCPMASRDQ

SEQ ID NO: 151498 - protein, 231 aa, Glycine max
  Coding DNA Sequence Number=SeqID_59813
MGNPVKKDQELRGIRNGIIGGYHEWLKVHIRGLDWLAKLKVVSEESFEAPEEDEEVQALKSEERRNLPRRSSRWPLHTFGRSVPGYGKRMQLPREPLNKRPRGLARKSMAGINFAELYGELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGY

SEQ ID NO: 151499 - protein, 107 aa, Glycine max
  Coding DNA Sequence Number=SeqID_59814
MPPLLFIFVFLSSLPKVLSFSRSAPNLSQKNYNLGLIHRCIVVKFEHHICNPIPRILTVGNCKNITEKKESHEDSKNGDFNPFSVSLTFGNSIGAVGGKTRGISRNR

SEQ ID NO: 151500 - protein, 266 aa, Glycine max
  Coding DNA Sequence Number=SeqID_59815
MQQPRAIEQPEAYAANIYNRPPQPQQQNQSQQNNYDLSSIRYNPGWRNHPKLKWSSPQQQQQQQPAPSFQNVVGPSRPYIPPPIQQQQQPQKQPTVEAPPQPSLEELVRQMTMQNMQFQQETRASIQSLTNQMGQLATQLNQQQSQNSDKLPSQSVQNPKNVSVISLRSGKQCQGPQPVAPSSSANEPAKLHSTPEKGESSTGNSDLQKQHIPPLPFLPRAVSKKKIGRGRERDLGNIQKSGGKHTSAGCNKANSKICQILEGAVH

SEQ ID NO: 151501 - protein, 44 aa, Glycine max
  Coding DNA Sequence Number=SeqID_59816
MPKDRGRIVIIKKGEIVDKESSRADVLMMPKDHMRLKDLFNTKQ

SEQ ID NO: 151502 - protein, 255 aa, Glycine max
  Coding DNA Sequence Number=SeqID_59817
MKIVISIPLMNCDLAGGEHHKDSCYFYSINNFDWKQEPVMYDYHEKESPPDLEIILADFMTYQARSKGYCYFMQQQGTQFERNQSSAGYQWESYRKSDYHNKAEGVLNLDDLLMQFKDTVESIQEAFRRTETQIKEKPEVSSTPEYPYLATVGYVGGKNKDRLELSVEDQKISFDLFKAMKHSDMGDSYFEEEEVEQEIALLASTMVLQSPLEKEPGYGRDCLACDEELDDSKDSCVDQVAFEELEKLRPVGGIL

SEQ ID NO: 151503 - protein, 43 aa, Glycine max
  Coding DNA Sequence Number=SeqID_59818
MATPMSTACYLDKDETGQSIDVKQYRDFNQIPNSHILVSLKES

SEQ ID NO: 151504 - protein, 382 aa, Glycine max
  Coding DNA Sequence Number=SeqID_59819
MANQGNWVPFMDVLALLIFGVVLFPNVDGLIDLAAIDAFLAYHHSKESPVVAVLADLFDTFDRRCEKSSARIICCLPALCVWLVSHLFQQDIRHPCPLLSHRSCTEKRRMDWDQLLAGIGGRTISWFPRWKEGKEGVLFSCGRVPHEGSTDGRKHVSFPCEGSRRTNSKTIQRIHKAWETPLRKDQELRGIRNGIIGGYHEWLKVHIRGLDWLAKLKVVSEENFEAPEEDEEVQALKSELGKAKLAKEKFKLAATHARKECAGLREENAITARALEQETKRARKEEYGRNKFRRALWGSNSELKLRREERDQSRAHSMVLKEELVACSRSKRSLSQRLCETETNMLAIIAKYQEELGLAAAHEHRITDEYAQVYAEKEARGR

SEQ ID NO: 151505 - protein, 48 aa, Glycine max
  Coding DNA Sequence Number=SeqID_59820
MIHLERLRAPINAFRMHNDRAVIKDLSYPNFVRGPLLDDMRPFFGPCE

SEQ ID NO: 151506 - protein, 285 aa, Glycine max
  Coding DNA Sequence Number=SeqID_59821
  Gene Ontology: Mol. function=leucine dehydrogenase activity; Cellular component=cytoplasm; Biological process=amino acid metabolic process
  Homolog annotation: Hit_ID=A1FXC5; Match level="QueryCoverage=48%, HitCoverage=37%, E-value=2e-73, Identity=98%"; Hit description =Glu/Leu/Phe/Val dehydrogenase, dimerisation region
  Pfam annotation: Domain name=ELFV_dehydrog_N; Domain location=130 -252; Score=184.4; E_value=2.9e-52; Accession=PF02812.9; Description =GluLeuPheVal dehydrogenase, dimeri
AISAEGSASPCRLAAAAATACRDTAANRDGAATVERASQPRSDRHQAGVIAARPVVVVPLPSLTALPLHANPATRRRRSIGRTFIFFNRKVADVDGTGRGNGLEWRRATRPPAPTTSLFLFWDPTVHWPFAAVVFCHNHDAGLKAIIAIHNTTLGPALGGVRMRPYASTDEALADALRLSRTMTYKNALAGLNVGGGKAVIIGDPKVDKTEVLFRAFGRYVDSLGGRYITAEDVGTDVNDMENIYLESQFVTGVHQVHGGSGDPAPFTAYVRCSTDGVDALQVRP

SEQ ID NO: 151507 - protein, 23 aa, Glycine max
  Coding DNA Sequence Number=SeqID_59822
GDARLTGASSKKGILAESPPTFI

SEQ ID NO: 151508 - protein, 114 aa, Glycine max
  Coding DNA Sequence Number=SeqID_59823
MESGDMWGYRMVTRTFRQPGANEPVDAQRQTSSSVAFVIQGQRVMWQAEIPYGHLHLSSTEGNEFDSFYSRRPETFKPDDALDSSLVGGDDQVRWRREVLWLSHFIAFKTLKFC

SEQ ID NO: 151509 - protein, 177 aa, Glycine max
  Coding DNA Sequence Number=SeqID_59824
  Homolog annotation: Hit_ID=Q6UUU1; Match level="QueryCoverage=33%, HitCoverage=40%, E-value=1e-18, Identity=78%"; Hit description =Putative uncharacterized protein
MSIEFNDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 151510 - protein, 218 aa, Glycine max
  Coding DNA Sequence Number=SeqID_59825
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=4e-13, Identity=27%"; Hit description= UPI00006A17C9 related cluster
MLLSSNVIYICVRVVMLVRMIRTRLFTAARMKSCPGMHSSCVIASLSGCARTVGPPPILGGGPGTVWIWSPLKVRTHSPLKARACSPLKFKTCRLSKARECSPMIARTCNPLKVRACSPTKVKAHDPLTARTCSPLKLKVHDPLKARTCSPLKVKARTYSPLEVRACSPLVVRTCSPLKARTCSPLKARTCSPLPVRVVVPKVRACSPTKARTYSPLE

SEQ ID NO: 151511 - protein, 159 aa, Glycine max
  Coding DNA Sequence Number=SeqID_59826
MAPTRHPLDPDKSNRALGFPALITGLCQSFGVPVAPTKVIRPPITRAFIEKYCTQRQAQGDAPQAAGAPPPPHQAGQAGAFDMEQYLRHLMSLSMQSQGFASFSCPTPDQFRAEVAWPGDWPEAQAGEAPPEAPGDGEEAHEDEEMADLLDFLGGSGDT

SEQ ID NO: 151512 - protein, 95 aa, Glycine max
  Coding DNA Sequence Number=SeqID_59827
MAIVVAASTATKVDLTHPFGLNQVNRPVSDMVGQGGEALGSMGGLHFVQVPQPMGETHKVPRDHTLAAFEPPLGYATEGQAFGGIPLPNTLEGPQ

SEQ ID NO: 151513 - protein, 46 aa, Glycine max
  Coding DNA Sequence Number=SeqID_59828
MERAAQQRQWLTAEKENAGLAEAIFDQKDEALTENEKGTQELDSKG

SEQ ID NO: 151514 - protein, 181 aa, Glycine max
  Coding DNA Sequence Number=SeqID_59829
MARRDQVWSFCTHDTRRYLMVIRTPLPFRHSRVRWHAETKFGHSAPMIRGDTLWLFAPFCHPEAAGPMTSRDQVWSFCTHDTRRYLTGYPHPFAIQTQSCPMARRDQVWSFCTHDTRRYLTVIRTPLPFRHSRVRWHAKTKFGHSAPMIRGDTLRLSAPLCHSDTVVSDGTQRPSLVILHP

SEQ ID NO: 151515 - protein, 120 aa, Glycine max
  Coding DNA Sequence Number=SeqID_59830
MPPKIEVLLLELLLLQVLQKFPNSLCVVPPISKLMGIKSPAVDLFCIHEKHNNNYPIQRNNKICSGRQRKRGEKRHHPLRNKPWNKELHHQDEPWIRSLERMLQLRKRKRERKKEGGARN

SEQ ID NO: 151516 - protein, 213 aa, Glycine max
  Coding DNA Sequence Number=SeqID_59831
  Subcellular localization annotation: CTP_CleavageSite=64; ConfidenceScore=5.41e-01
MEGANTFLKRKYNSRTWNVLYDRFPSVFPTFSTKKRWWRLRTFSSFGKRTREPHLARPQKGRLRQMASRKHKSIGSRPTAQYDTRRFFSLDAWTRYTDNVLGRNILSERKVEIYHSELDEFMAELERRNFHKRLTNLVDGSIDQALVKDTYANLYSSEDHPPKQSRVRGHLVKIDADSLNIFLETPVILQVAYRLQKDRGCLMHTWPRVHLEL

SEQ ID NO: 151517 - protein, 656 aa, Glycine max
  Coding DNA Sequence Number=SeqID_59832
  Gene Ontology: Mol. function=oxidoreductase activity, acting on the aldehyde or oxo group of donors, NAD or NADP as acceptor; Cellular component=cytoplasm; Biological process=amino acid biosynthetic process
  Homolog annotation: Hit_ID=A8GL84; Match level="QueryCoverage=50%, HitCoverage=98%, E-value=1e-168, Identity=90%"; Hit description=N -acetyl-gamma-glutamyl-phosphate reductase
  Pfam annotation: Domain name=DapB_N; Domain location=241-331; Score= -34.8; E_value=0.038; Accession=PF01113.11; Description =Dihydrodipicolinate reductase, N-terminus
  Pfam annotation: Domain name=GFO_IDH_MocA; Domain location=241-359; Score=-12.8; E_value=0.015; Accession=PF01408.13; Description =Oxidoreductase family, NAD-binding Rossmann fold
  Pfam annotation: Domain name=Semialdhyde_dh; Domain location=242-385; Score=200.7; E_value=3.6e-57; Accession=PF01118.15; Description =Semialdehyde dehydrogenase, NAD binding domain
  Pfam annotation: Domain name=Semialdhyde_dhC; Domain location=402 -550; Score=130.2; E_value=6.1e-36; Accession=PF02774.9; Description =Semialdehyde dehydrogenase, dimerisation domain
  Pfam module annotation: Pfam domain module=DapB_N::GFO_IDH _MocA::Semialdhyde_dh::Semialdhyde_dhC; Domain location=241-331::241 -359::242-385::402-550
RADIQVQLAAGADAVGRVAAADMAEGFAQLHQAADGFVHQIDGVDAARRIAGVAGLADDANGVGHMALVCAHRLQRGRFADDGEIRTNGGGGGEITCAGHRRFFICGSQNVQRLGQFARVDIAHRIQNKGEEAFHVGGAQAVELVVVLGQGEGIARPAAFVVRHRIGMAGQQQAAAAFADAGQQVEFVARFWHRLYVDAKAQAGIGGADRLRCDQRPVQLNKWSKPTRKGTRYPDVKGHMLNTLIVGASGYAGAELTAYLNRHPHMNITALAVSAQSADAGKLLSDLHPQLKGIVDLPLQPLTDVAKAAQGIDVVFLATAHEVSHDIAPAFLAAGCVVFDLSGAFRVQDADFYSQYYGFEHQHGALLEQAVYGLAEWQSDKIKQAQLIAVPGCYPTAAQLALKPLIEKQLLNLDQWPVINATSGVSGAGRKACMTTSFCEVSLQPYGIFTHRHQPEIAAHLGVPVIFTPHLGNFPRGILETITCRLKAGVTAQDVAAAYHAAYDDKPLVRLYDQGVPALKAVVGLPFCDIGFAVQGEHLIAVAVEDNLLKGAAAQAVQCLNIRFGFPETHEEALERLFTALDSYRQQHQRPLVIVHGGGCVVDELMKQLSLPVVKKNGLRVTPADQIDIITGALAGHRQQNAAGVGDLNTKSTPSA

SEQ ID NO: 151518 - protein, 42 aa, Glycine max
  Coding DNA Sequence Number=SeqID_59833
MNSTIESFLKTKLATGDVNLSRSGSFDTGYGGLDDATSGEGR

SEQ ID NO: 151519 - protein, 360 aa, Glycine max
  Coding DNA Sequence Number=SeqID_59834
  Gene Ontology: Mol. function=hydrolase activity, hydrolyzing O -glycosyl compounds; Cellular component=extracellular region; Biological process=carbohydrate metabolic process
  Homolog annotation: Hit_ID=Q8ZS09; Match level="QueryCoverage=100%, HitCoverage=50%, E-value=1e-146, Identity=72%"; Hit description =Putative exochitinase
  Pfam annotation: Domain name=CBM_5_12; Domain location=307-354; Score= 31.2; E_value=3.8e-06; Accession=PF02839.5; Description=Carbohydrate binding domain
FPAENINIGYAGYTRNGRNVELESLSPLKGTYNPGNGDTTGTFESGTNEWYDVIYNYLDLENQKGRNGFNVYTDQVADADYLYNPESKLFMSLDTPRSVKAKGEYAASLGLGGMFTWTIDQDNGVLLNAAREGLGYEIESEVIDMEPFYFEGINVEKDESEEDDKATDVNHAPKAAIELLVVGGSTVQLSGANSSDEDDDELSYSWGVPSEITVADKTAEVIEFVVPEVSAKTAFQFTLFVRDCYNEPSTQQRFVLTAVPALASQGEPEPADEEEDETDIIPVPDEDTTPAEDDASADDAADQDAPHALWDANTVYGASWGTFETVSWKGHNYQVKWWSQGDQPDLNCGQSGAWTDLGAY

SEQ ID NO: 151520 - protein, 75 aa, Glycine max
  Coding DNA Sequence Number=SeqID_59835
MVITFGTRVIPSWGRVAEDLPARAGGRIVDGWGRPWISLGWRSLCRGRSFYLRLRIGNCSPARIPEKMYWGLRLL

SEQ ID NO: 151521 - protein, 289 aa, Glycine max
  Coding DNA Sequence Number=SeqID_59836
MAPRKLSAKRSRKDAAAEGTSAAPEFDSHRFRSAEHQQHFEAIKGWSFHRERRVQLRDDEYTDFQEEIARRRWTSLVTPMAKFDPDIVLEFYANAWPTEEDALSQFLADPLVLEEGQECEFSQRRNWADGFDEEAIAQLLCIPGPWDFQPLIMGLCQSFGVPITLSKAHGDAPQATDAPPPPHQVDPAGSFDMERYLRHLVRQQATNHRGQVQTHECLYQLSLSLQSQGFDPFACPTPDQFRAEVAWPEDWPEAQAGEAPAEAPDDMEEARMDEEMTNLLDFLGGSGAT

SEQ ID NO: 151522 - protein, 75 aa, Glycine max
  Coding DNA Sequence Number=SeqID_59837
  Subcellular localization annotation: CTP_CleavageSite=52; ConfidenceScore=5.39e-01
MKRAIPKSTTKSVYRTSNVSQRALCGRARVRLTGALSKGGKMRGVATNEGISTSHVDKSGAFAPTYTPLERKSDQ

SEQ ID NO: 151523 - protein, 340 aa, Glycine max
  Coding DNA Sequence Number=SeqID_59838
  Homolog annotation: Hit_ID=Q6WAY6; Match level="QueryCoverage=58%, HitCoverage=35%, E-value=2e-10, Identity=26%"; Hit description =Putative uncharacterized protein
EGKEGVLFLCGDYPNVPLIGTRGFINYNPALAIRQLGYPMRGAPIEESFSPFLVRDLGAQSLKVIQRVHKAWRSPLRKDKELRGIRNGVIGGYHGWLRVHTRGLDWLSKLKVIDEENFEAPEEDEEVQVLKLELGKARLAKEKFKSAATHIRRECAELREENAATARALEQETKRARKEEHGREKFQGALWGSNNELKLRREESDRGVWLNTWKATEQSMLAIIGQYKEELNQSVTHEQKLVEDFAQVYAEKEARGRVIDALHQEATMWMDRFALTLNGSQDLPRLLAKAKAMAEEQMKADLSALKDQMASISEVMLKLQKTIEDKATATASNTTREAEP

SEQ ID NO: 151524 - protein, 309 aa, Glycine max
  Coding DNA Sequence Number=SeqID_59839
MAKFDPEIVLEFYANAWPTEEGVRDMWSWVRGQWIPFDADAIGQLLGYPLVLEEGQECEYGQRRNRSDGFDEEAIARLLCIPGQDFARTAAGRRVQIMRTNMTTLTQIWMTLLLSNILTTDHNSDLPMPKCMARTRHPLDPDKSNRALGFPALITGLCQSFGVPVAPTKVIRPPITRAFIEKYCTQRQGQGDAPQAAGAPPPPHQAGQAGAFDMEQYLRHLVRQQAANHRAHVRTHDCLYQMSLSMQSQGFAPFSCPTPDQFRAEVAWPGDWPEAQAGGTPPEAPGDGEEAHEDEEMADLLDFLGGSGD

SEQ ID NO: 151525 - protein, 241 aa, Glycine max
  Coding DNA Sequence Number=SeqID_59840
  Homolog annotation: Hit_ID=Q5XM22; Match level="QueryCoverage=46%, HitCoverage=89%, E-value=3e-24, Identity=42%"; Hit description =Resistance-like protein HAAS-2
  Pfam annotation: Domain name=DUF1723; Domain location=29-78; Score =45.8; E_value=1.6e-10; Accession=PF08330.1; Description=Protein of unknown function (DUF1723)
MLIGRSVPKIEGLVAVTGLSPLIRCSIVIGDPGLISAFVEMWQRETNTFHLPIGELMITLDDVLSLLHLPISDAFHSFHALYVDKAIFLLIELLEVSAEEARAETTRSRGAYVRLGWVRDIYEMRCQARRWVVAAHAYLLHLAFHELGQSGGYAWGVVALVHMYDQFDEASRTTTRQIGGYLTLLQCWIYEHFPSVHQCVTDDVYEETSPRASRWLTMKAHMKGITGASYRARCDTLTVTN

SEQ ID NO: 151526 - protein, 61 aa, Glycine max
  Coding DNA Sequence Number=SeqID_59841
  Subcellular localization annotation: CTP_CleavageSite=22; ConfidenceScore=5.19e-01
MAAIQMTSLVSMTCWACLSLPLVMGPSKSVNRTNRIHFGKYSSKLSDNGGFKLLKSIEYNS

SEQ ID NO: 151527 - protein, 70 aa, Glycine max
  Coding DNA Sequence Number=SeqID_59842
MKGKETQNRMPRNDKLEDSRIRNCTNHCLMACNLCLTASRYLAPFVAQYVKFRGMPEIKRKHCYTSREIP

SEQ ID NO: 151528 - protein, 156 aa, Glycine max
  Coding DNA Sequence Number=SeqID_59843
  Homolog annotation: Hit_ID=A5BGH9; Match level="QueryCoverage=51%, HitCoverage=15%, E-value=1e-07, Identity=37%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLASEDPHKHLKEFHIVCSTMNPQMSKRITYF

SEQ ID NO: 151529 - protein, 19 aa, Glycine max
  Coding DNA Sequence Number=SeqID_59844
THLVAHDPGNLNKMSTSSE

SEQ ID NO: 151530 - protein, 85 aa, Glycine max
  Coding DNA Sequence Number=SeqID_59845
MTETSMQAGNTDVYGFLEPQSIQRSGQSQFESESYIKNWMQNSKWDVYLYGAYWQMVVILPKENVVIWFCSLHNKPDNYLKGIIN

SEQ ID NO: 151531 - protein, 129 aa, Glycine max
  Coding DNA Sequence Number=SeqID_59846
  Homolog annotation: Hit_ID=A2Q3D2; Match level="QueryCoverage=75%, HitCoverage=18%, E-value=5e-09, Identity=36%"; Hit description =Putative non-LTR retroelement reverse transcriptase, related
MDIQQQGSDEWEWLGDQSRNYSTRSAYNLIWEATAGGQQEEWCKELWKIKIPSKIAVFAWRLLRDKLPTKKNLHRRQMQIQDMRCPFCRGAKEEAYTTFSPAYLHTDRRIKGQEVEVLVVGGNMGYLEA

SEQ ID NO: 151532 - protein, 104 aa, Glycine max
  Coding DNA Sequence Number=SeqID_59847
  Subcellular localization annotation: CTP_CleavageSite=56; ConfidenceScore=5.15e-01
MKRCPFTALGSMALITSIPHMENGHDAAKTFRGRGGALTLSAVATYPSAGGRRVTRGMRVPRKEYARSRHQRLFEENVGKTGKDAIYELLSERFGSCIYARGRY

SEQ ID NO: 151533 - protein, 248 aa, Glycine max
  Coding DNA Sequence Number=SeqID_59848
MSRGSGDLGDVRWGAIAQNQAWPIPTQPGHSQPVRTCDVPQQASSWQSTNKGTKVHKAGRLGLKIETKRRVAAGNRLPFVLIDYIVLYAAGNRLPFMCNRLHNIAMVAQLIHDCVVMECLEGVWETLEGNERCQFRGIVRLTTTSLVHLEQPARTLQQPVEWILPTPTPYRLVEPVQLIEVSSSEEDLEEDLEELPPEPAMDAPDLPEDGEDPLPDVDSPEDIMSASEADSTEESGPGGTANSDDSPS

SEQ ID NO: 151534 - protein, 87 aa, Glycine max
  Coding DNA Sequence Number=SeqID_59849
MPKIKRKHCYTIRPLGPSRLFLQKAIASGGSSLARLGELDGKLLPYFPKNRGRSEEEKGSALLAFRNHLKLVRKIVSVKKIQAEALP

SEQ ID NO: 151535 - protein, 169 aa, Glycine max
  Coding DNA Sequence Number=SeqID_59850
  Pfam annotation: Domain name=G-patch; Domain location=26-70; Score =15.8; E_value=0.0023; Accession=PF01585.14; Description=G-patch domain
MAFQSFEVVSYASVEPSPSLPSLSNAAIMVARVMLRNGFEPGIGLGKDCLGNADVVDIKGNPYKYGLGYEPGMPGRRNVPSRFRADKVWPGRISQCFTSVGMVSEEEVAAIEEECEGRFFEEPNNEGLTIDFDRDISQTINEEEEEDVLSPELERLVAQEEREMKPHQE

SEQ ID NO: 151536 - protein, 180 aa, Glycine max
  Coding DNA Sequence Number=SeqID_59851
PREWGPFADILALLIFGIVLFPNVDSLVDLAAIDAFLAYHHSKESPVVAILADLFDTFDRSAIDWFPRWKEGKEGVLFSCGDYPNVPLIGTRGTQSLKVIQRVHKAWRSPLRKDKELRGIRNGVIGGYHGWLRVHTRGLDWLSKLKVINEENFEAPEEDEEVQALKLELGKARLAKEKFK

SEQ ID NO: 151537 - protein, 122 aa, Glycine max
  Coding DNA Sequence Number=SeqID_59852
MALRLCLSAARMSSHEQALRQRSICAAKHRNFARLIVHSTGGNMKDRAYESVSSGDEVCCIIGQAVIELSDEQQPVTRSTLSLKLLAMADRDRDDERVLLYWIARKAINQPHQLNIGVGGWR

SEQ ID NO: 151538 - protein, 405 aa, Glycine max
  Coding DNA Sequence Number=SeqID_59853
  Gene Ontology: Mol. function=transporter activity; Cellular component= integral to membrane; Biological process=transport
  Homolog annotation: Hit_ID=A4SHA3; Match level="QueryCoverage=91%, HitCoverage=92%, E-value=1e-133, Identity=65%"; Hit description =Major facilitator superfamily protein
  Pfam annotation: Domain name=LacY_symp; Domain location=8-396; Score=- 323.2; E_value=0.087; Accession=PF01306.10; Description=LacY protonsugar symporter
  Pfam annotation: Domain name=MFS_1; Domain location=16-360; Score =119.2; E_value=1.2e-32; Accession=PF07690.7; Description=Major Facilitator Superfamily
  Pfam annotation: Domain name=Sugar_tr; Domain location=19-400; Score=- 166.5; E_value=0.018; Accession=PF00083.15; Description=Sugar (and other) transporter
  Pfam module annotation: Pfam domain module=LacY_symp::MFS_1::Sugar _tr; Domain location=8-396::16-360::19-400
  Subcellular localization annotation: CTP_CleavageSite=65; ConfidenceScore=5.04e-01
MTTAVTPNHQRVRIFTLAGTIITQFALGSVYTWSLFNGQLAQKLDAPVSQVAFSFGLLSLGLAIASSLAGKLQERFGVRNVTIGAGILMAIGFWLTAHADNLMMLYLSAGILVGLADGAGYLMTLSNCVKWFPERKGLISACSIGAYGLGSLGFKFICGALLSTQGLENTFVIWGVLAMTMIIAGALMMRDAPLQQAGSRQQQATQEFTLAQSVRLPQYWMLALMFLTACMSGLYVIGVAKDIGEGLVHLSTQTAANAVTVIAIANLSGRLILGVLSDKMARIRVISLAQLVSLSGMSILLFTHMNETTFFLSLACVAFSFGGTITVFPSLVSDFFGLNNLTKNYGLIYLGFGIGSVLGSLVASVFGGFTVTFSLIMTLLVISLVLSLSIRLPNRQNLVAPVLHN

SEQ ID NO: 151539 - protein, 279 aa, Glycine max
  Coding DNA Sequence Number=SeqID_59854
  Gene Ontology: Mol. function=transferase activity, transferring nitrogenous groups; Cellular component=cytoplasm; Biological process= biosynthetic process
  Homolog annotation: Hit_ID=P77434; Match level="QueryCoverage=99%, HitCoverage=68%, E-value=1e-143, Identity=88%"; Hit description =Uncharacterized aminotransferase yfdZ
  Pfam annotation: Domain name=Aminotran_1_2; Domain location=1-259; Score=-11.1; E_value=1.2e-06; Accession=PF00155.12; Description =Aminotransferase class I and II
YPIHIYGAVIAGAQVRSVPLDAGGDFFNELERAIRESYPKPKMMILGFPSNPTSQCVELDFFERVIALAKQYNVLVIHDLAYADITYDGWKAPSIMQVPGARDVAVEFFTLSKSYNMAGWRIGFMVGNKELVAALARIKSYHDYGTFTPLQVAAIAALEGDQQCVRDIAEQYKRRRDVLVKGLHEAGWMVDLPKASMYVWAKIPDHYAHLGSLEFAKRLLQEAKVCVSPGIGFGDYGDTHVRFALIENSDRIRQAVRGIKAMFRADGILPGTHEGADPK

SEQ ID NO: 151540 - protein, 246 aa, Glycine max
  Coding DNA Sequence Number=SeqID_59855
  Gene Ontology: Mol. function=transporter activity; Cellular component= membrane; Biological process=transport
  Homolog annotation: Hit_ID=Q6D8X8; Match level="QueryCoverage=97%, HitCoverage=58%, E-value=1e-100, Identity=79%"; Hit description =Manganese transport protein
  Pfam annotation: Domain name=Nramp; Domain location=38-246; Score =168.0; E_value=2.4e-47; Accession=PF01566.9; Description=Natural resistance-associated macrophage protein
MSESRTAERAARGARKIKLALLGPAFIAAIGYIDPGNFATNIQAGAAYGYKLLWVVVWANIMAMLIQLMSAKLGIATGKNLAEHIRDRFPRPAVWFYWVQAEIIAMATDLAEFIGAALGFKLLLGISLLQGAVLTGIATFLILMLQNRGQKPLELVIGGLLLFVAAAYIVELFFSQPRVSDLVVGMALPSLPTSDAVFLAAGVLGATIMPHVIYLHSALTQYGNKGSKAERYSSTKLDVAIAMTIA

SEQ ID NO: 151541 - protein, 66 aa, Glycine max
  Coding DNA Sequence Number=SeqID_59856
  Homolog annotation: Hit_ID=Q51617; Match level="QueryCoverage=57%, HitCoverage=55%, E-value=5e-13, Identity=94%"; Hit description =Putative uncharacterized protein
MTVKTSDTCSSRRRSQLVCKRMPGADKPVRARQRVLAGCATVGKGDRCGPLRYYASWRKGDVLQGD

SEQ ID NO: 151542 - protein, 116 aa, Glycine max
  Coding DNA Sequence Number=SeqID_59857
MPADAPPPPHQADPAWSLGMERYLQHLVRQQAANHRGQVQIHECLYQLSLSQQGQGFVPFVCPTPNQFRAEVAWPGDWPKAQAGEAPAGAPGDAEEARMDEEMTDLLGFLGGSGAM

SEQ ID NO: 151543 - protein, 115 aa, Glycine max
  Coding DNA Sequence Number=SeqID_59858
MGEVEEVQGKMKADMEAMKEKMATMMAMMSMRKIMEANAVTFAATSTVAKVNPIPPSGLNQMNHPTLDMHAFPPYGLPPNYTPPNVAYTPNKNVNNSTPIPIESQQPQTDHAHVS

SEQ ID NO: 151544 - protein, 181 aa, Glycine max
  Coding DNA Sequence Number=SeqID_59859
METIIQNPQLNSAEFYVVTELIPQQQPSSPQPSCPQLQLPPPQQLSYNNIDLNNSVSSYNNLESQDPFDIYTSYTQILSENDSFFHGQQTSFDQQNHPSSPFTPPSQLPQTQTSNRDEHPIANEDPIIRFHDENMDEFTEDEDQQLFDHINHQSDDQSDDQTDDEGVGRPTTPPSPPLQYQ

SEQ ID NO: 151545 - protein, 122 aa, Glycine max
  Coding DNA Sequence Number=SeqID_59860
  Homolog annotation: Hit_ID=A5BTL1; Match level="QueryCoverage=64%, HitCoverage=41%, E-value=4e-32, Identity=87%"; Hit description =Putative uncharacterized protein
MGVSLAARKHPVLTTLRDTKAQRYEKRGRDDIIYVRTAPRGVDPASNQVFDQGTGEFPLPLEGQPGRERGGNGLPKKPAPGRANFLGCGRRRADVGTQTGAQHYSAHAKKFLDSLTDDFEPA

SEQ ID NO: 151546 - protein, 53 aa, Glycine max
  Coding DNA Sequence Number=SeqID_59861
MVVRTSVILNSKELYDPQSQDPERTWVVNGQRLKLYHGKEFSRTQDTVHLIAK

SEQ ID NO: 151547 - protein, 137 aa, Glycine max
  Coding DNA Sequence Number=SeqID_59862
VETMLESFQQQDQMSVLELYIEKDVTGGSMFHSANSLTSCGNNLSNNKAQPPRNVSNLHGDEDDDYLVSNSYVEESLDKDDSVYGISDTDDEVTDMIQPVRIVHPAEGVEGIQNPFWNDVLRYNNINWSHPDEEDIC

SEQ ID NO: 151548 - protein, 117 aa, Glycine max
  Coding DNA Sequence Number=SeqID_59863
  Gene Ontology: Mol. function=oxidoreductase activity; Cellular component=mitochondrial matrix; Biological process=metabolic process
  Homolog annotation: Hit_ID=Q9LLR2; Match level="QueryCoverage=39%, HitCoverage=8%, E-value=4e-19, Identity=95%"; Hit description =Aldehyde dehydrogenase
MTMITNSSSVPIKIGQCCCAGSRTFVHESIYGEFVEKAKARALKRVVGDPFKNGVEQGPQSRPAGMQAWHWPSFYNVVTGKTLALPNLIALQHIPLSPAGVIAKRPAPIALPNSCAA

SEQ ID NO: 151549 - protein, 57 aa, Glycine max
  Coding DNA Sequence Number=SeqID_59864
MKHKLKNKGGEWKFISCHLQKGGDCRSKLHDESRLIQGVLMITKMMTKSSKVKNTSC

SEQ ID NO: 151550 - protein, 209 aa, Glycine max
  Coding DNA Sequence Number=SeqID_59865
MVKEECKEVSVSSKRLAKKESHFEIKTNIKETYPLRQPPHFLLCKKALVSIATPLRLEFIPQVKKLLDKGLVCKSLNPCALLVPKIGIIRHQIPMIGGMMNLLSGATLFCKITHAPNIFMIYVHSVSLGRNNQHENKENGMFYSITFLSFLNSDQGLPMDPKRIKVIPEWPTPPSVEERIHEFQEPLDLRSNPFQGVGNDEILPLKGIG

SEQ ID NO: 151551 - protein, 446 aa, Glycine max
  Coding DNA Sequence Number=SeqID_59866
  Gene Ontology: Mol. function=oxidoreductase activity; Cellular component=periplasmic space; Biological process=electron transport
  Homolog annotation: Hit_ID=A8GGU1; Match level="QueryCoverage=97%, HitCoverage=52%, E-value=0.0, Identity=73%"; Hit description =Molybdopterin guanine dinucleotide-containing S/N-oxide reductase precursor
  Pfam annotation: Domain name=Molybdopterin; Domain location=106-445; Score=221.5; E_value=1.9e-63; Accession=PF00384.13; Description =Molybdopterin oxidoreductase
MADQSQEPGMNLTRRRFLAGASALMAAPLLAGLWPRSALAEAISQAMPQFIALRQAESGILTGAHWGAFEAIVRDGKMVDVRPIKDDPYPNELITMAPYQVHAENRIKYPMVRKSWLEGGAKNGKPELRGRDEWVRVSWDKALHLVAGEISRLQKEHGPSSIYAGSYGWKSVGMFHNPRTLLQRMMNLAGGFVGYSGDYSTGAAQVIMPHVVGSVEVYEQQTAWPNVIDNSELVVMIGCNPMITLKNSWNLPDHVGQTGFEALKKKGTRMICIDPVRSDSARELGAEWIAPRSYTDCALMAGVAHTLLAENLHNPDFLKTYTVGFDKFEAYLNGKEDGVVKDANWAADISGVDAETIKQLARDMAKHRTMIMGGWGIQRQHHGEQAHWMMVTLAAMLGQIGLPGGGFGFSYHYSSGGSPSVRGGILAGISAGSPTSPAAKDITPFP

SEQ ID NO: 151552 - protein, 420 aa, Glycine max
  Coding DNA Sequence Number=SeqID_59867
  Gene Ontology: Mol. function=nucleoside-triphosphatase activity; Cellular component=type II protein secretion system complex; Biological process=protein secretion by the type II secretion system
  Homolog annotation: Hit_ID=P45759; Match level="QueryCoverage=84%, HitCoverage=72%, E-value=1e-131, Identity=69%"; Hit description =Probable general secretion pathway protein E
  Pfam annotation: Domain name=GSPII_E; Domain location=146-420; Score =457.6; E_value=1.6e-134; Accession=PF00437.11; Description=Type IIIV secretion system protein
MVFIRPTIIRDDEVYRSLSRDKYTGFKEMQKERSDQRSGKLINVDDIDALDDRAFNNTPAMPAAKNPFSGGETNTTLEHMLEVASVARDCTQFTRLASQQFTEKLEQLYQPSGGSAQLIAEDMNNSDDLSALSDEIPTNEDLLNEQSDAPVIRLINAVLSEALKEHASDIHIEVFETTMSIRFRVDGVLRPVVQPNKKLAALLISRIKIMAKLDIAEKRLPQDGRITLKIGHRNVDVRVSTLPSQHGERVVLRLLDKSSLRLSIDKLDMSEEDMRDLRHLIALPHGIILVTGPTGSGKSTTLYALLSALNSPERNVLTVEDPIEYELEGIGQTQVNSRVDMSFARGLRAILRQDPDVVMVGEIRDAETAQIAVQASLTGHLVLSTLHTNSASGAVTRLRDMGTESFLLSSSLVGVIAQRL

SEQ ID NO: 151553 - protein, 73 aa, Glycine max
  Coding DNA Sequence Number=SeqID_59868
  Subcellular localization annotation: CTP_CleavageSite=15; ConfidenceScore=5.20e-01
MRGGGCTATCLGKLLASSRSNLARPSELVTSSLSFLVGLRAGKCPQSDPFAPLLNIFHISFRNITKPYELHDN

SEQ ID NO: 151554 - protein, 67 aa, Glycine max
  Coding DNA Sequence Number=SeqID_59869
  Subcellular localization annotation: CTP_CleavageSite=61; ConfidenceScore=5.63e-01
MPTWAFQDVPPESGCFWRKQPGSPGRARKSKPRCFRNISVTFPWVISRIFSTVLRRSSFVSLSRSQS

SEQ ID NO: 151555 - protein, 109 aa, Glycine max
  Coding DNA Sequence Number=SeqID_59870
FIEKYCTQRQVQGDAPQATDAPPPHQAGPTGLFDTEQYLRHLSQGFTSFPCPTPDQFRAEVAWPGDWPEAQAGEAPAGAPAEAPDEADEAGEDEEMTDLLDFLERSGAT

SEQ ID NO: 151556 - protein, 126 aa, Glycine max
  Coding DNA Sequence Number=SeqID_59871
  Gene Ontology: Cellular component=plasma membrane
  Homolog annotation: Hit_ID=A3MFE4; Match level="QueryCoverage=84%, HitCoverage=87%, E-value=6e-10, Identity=38%"; Hit description =Putative uncharacterized protein
  Subcellular localization annotation: CTP_CleavageSite=66; ConfidenceScore=5.10e-01
GYTPSPWVLVTLTVERTTCPRHQRAARPQRTTCPRLERTTRPHHQRTTCPRHQRTTCPRHQRTSCPCHQRAARPHLQRTTCPRLERTARPHLQRTTCPRLERTTCPHLQRTTRPRLERAICPHLGY

SEQ ID NO: 151557 - protein, 73 aa, Glycine max
  Coding DNA Sequence Number=SeqID_59872
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARAKSAALFSLEDQAQFSLRFYYYC

SEQ ID NO: 151558 - protein, 167 aa, Glycine max
  Coding DNA Sequence Number=SeqID_59873
  Gene Ontology: Mol. function=helicase activity; Biological process =viral genome replication
  Homolog annotation: Hit_ID=Q9LX60; Match level="QueryCoverage=62%, HitCoverage=5%, E-value=5e-19, Identity=43%"; Hit description =Putative uncharacterized protein F4M19_60
  Subcellular localization annotation: CTP_CleavageSite=42; ConfidenceScore=5.30e-01
MQNYQHAKRRDSAKARTNRKRVMQQKRHDHAQSSSQPTVNCTSEYNSSGSNFMTPFEDCQSPTNQPVINTKGYFDIGEQLIQCRYCNAQMWYDERISKNKNYQNPRFSLCCGDGRVELPLLQNPPEYLQQLLFHDDTIDSKNYQHNLRAYNMMFAFTSARIKLDKNN

SEQ ID NO: 151559 - protein, 67 aa, Glycine max
  Coding DNA Sequence Number=SeqID_59874
DQGVPMNPKRIKVIPEWPTPPSLVRNHVPSWEDAQEMGVEGRSPEYEEPWDLRSNPFQGGGNDAILP

SEQ ID NO: 151560 - protein, 146 aa, Glycine max
  Coding DNA Sequence Number=SeqID_59875
  Gene Ontology: Mol. function=helicase activity; Biological process =protein amino acid phosphorylation
  Homolog annotation: Hit_ID=Q2A9E0; Match level="QueryCoverage=54%, HitCoverage=5%, E-value=2e-17, Identity=54%"; Hit description =Putative uncharacterized protein
  Pfam annotation: Domain name=DUF889; Domain location=1-100; Score= -84.8; E_value=9.9e-06; Accession=PF05970.5; Description=Eukaryotic protein of unknown function (DUF889)
MECLSSDSVDKSETSEDSYFQSITTEFLTSLNTSSLPTHSIKLKIGSPIMLLRNLDQNQGLCNGTRLVVTKMAKHVIAAEIILVCRNLPFGGMRRETRGMRVPRKEYARSRHQRLFEENVGKTGKDAIYELLSERFGSCIYARGRY

SEQ ID NO: 151561 - protein, 156 aa, Glycine max
  Coding DNA Sequence Number=SeqID_59876
MEDNPGNQFNKDHGGSSNRPIQQGPNIFQRTTKLEESLTQFMQVTMSNHKSIESTLKNLEVQVGQLAKQIVDKSSNSFGANTENNPKEECKVVMTRSKRLVETEDEESVVYKEQMGEKKDIEVKENDVKGKENQEKGKKIMVQNREMENQEKEKKG

SEQ ID NO: 151562 - protein, 174 aa, Glycine max
  Coding DNA Sequence Number=SeqID_59877
MATSRRVIYQSLQAACMVSRGGDERDECLFHLGESQDMETCPVVEELLQRLMDCGQLEVFIGGKEEPQICMQSEEKKVPLTPKALVICFTRKGTGSTPIYPQAAPKPTPFAYQSDKVVPWKYTPPASSERVATEVDSLSAKVTNITGLSGVTRSGRVFASPHPAELPSKGKAPM

SEQ ID NO: 151563 - protein, 57 aa, Glycine max
  Coding DNA Sequence Number=SeqID_59878
MARSRIVSGTWGRIHVGIGSRPTDRCPFPALDKQRTSLQGSPVSFAFTVSFTIVCFK

SEQ ID NO: 151564 - protein, 102 aa, Glycine max
  Coding DNA Sequence Number=SeqID_59879
MKAQVEKDEGPEAETLSRLLIVAEGPSNPCGVYPDLSSFTGSGVYPDLSSFTGSGVYPDLSSFTGSGVYPDLSSFTGSGVIQKLYSLYQVIRPRRVNVFLAE

SEQ ID NO: 151565 - protein, 65 aa, Glycine max
  Coding DNA Sequence Number=SeqID_59880
  Homolog annotation: Hit_ID=A6FJQ2; Match level="QueryCoverage=58%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLFMESISRI

SEQ ID NO: 151566 - protein, 79 aa, Glycine max
  Coding DNA Sequence Number=SeqID_59881
  Subcellular localization annotation: CTP_CleavageSite=62; ConfidenceScore=5.28e-01
MSQRLHKLPNVLCQALSLQGRKQRMFACQPSKTAKKNVYTDNHSVFPPVSVTQMSSMTDLVSAEDDVNLCVPTGLSADD

SEQ ID NO: 151567 - protein, 101 aa, Glycine max
  Coding DNA Sequence Number=SeqID_59882
MTLLLNNILPSDRNADLLAKVSVGLCHPDIGIAPARHPVDPEKSNRVLGFPALIIGLGQFYGVPAAPSKVIRPPTNRAFMKKYCAPRQAQGDTPQQPGDCR

SEQ ID NO: 151568 - protein, 105 aa, Glycine max
  Coding DNA Sequence Number=SeqID_59883
MSCLPWSLPEWVSQTEQLNLNNVNTIITHIGLHCSTHWQMVIILPKENLVVRFCSLHNRLDNYLKGIINSALKGLDDTPQPKSKYFNDVRPLEAERLKALRIQWT

SEQ ID NO: 151569 - protein, 132 aa, Glycine max
  Coding DNA Sequence Number=SeqID_59884
MHETEGPIIVLLTNARIKEGQGSYPCSVSNSLKASKLTINLPMAPIEEFNQKLSELGVEIRSVLTCRSQWSSQPSGSAQLSSRETFISKSEAKTISEINNLCEELVYVTVGTITRIVMDNHSWCYASLHSVP

SEQ ID NO: 151570 - protein, 95 aa, Glycine max
  Coding DNA Sequence Number=SeqID_59885
MEVRDKEYHLLSQRMIRATLLLNTPTKKTMIMRGQDIYSSQEEATSSPSSSGNEGEAMGDEHIEEVYPMKKHKLGIQVESHYHFPPKSLQASMAQ

SEQ ID NO: 151571 - protein, 130 aa, Glycine max
  Coding DNA Sequence Number=SeqID_59886
  Subcellular localization annotation: CTP_CleavageSite=81; ConfidenceScore=5.13e-01
MTGPLDESISCFLIRVDPWRTARPRLKRATCPPLQRATCPHLQRVARPCLQRTARPRLQRTARLHLQRIARPRLQRATRPRLQRAARLAFIGLHALAFRGLHALAFRGLHVFRLQRAARPRLQRIACPRL

SEQ ID NO: 151572 - protein, 30 aa, Glycine max; identical to SEQ ID NO: 127113
  Coding DNA Sequence Number=SeqID_59887

SEQ ID NO: 151573 - protein, 101 aa, Glycine max
  Coding DNA Sequence Number=SeqID_59888
MNNTLLFSVKEQSLETIKLRKLLAKEEEEEVQEDVQRDSKVVKEYMKKYSSCLVKKNHWKSYNLEKNLKTIGRVTSLDFYSKLVTDTLVIDYQYIVIDYTI

SEQ ID NO: 151574 - protein, 100 aa, Glycine max
  Coding DNA Sequence Number=SeqID_59889
MSTEKYQSGLFNDRCRPDLSSFIGSGVYPDLSSLTGSGVYPDLSSFTGSGVYPDLSSFIGSGVYPDLSSFTGSGVYPDLSSFTGSGVIQNLRSLFKQSAP

SEQ ID NO: 151575 - protein, 37 aa, Glycine max
  Coding DNA Sequence Number=SeqID_59890
MGAKYLEAVKQRLHAIKQWSPNEIRRPELEEEAVLGA

SEQ ID NO: 151576 - protein, 71 aa, Glycine max
  Coding DNA Sequence Number=SeqID_59891
MFEKEQCDEEMTKSKGKDPLEGLGGPMTRARARKVKEALQQVLSLLFEYKPKFQGEKSKVVSCIMAQMEED

SEQ ID NO: 151577 - protein, 54 aa, Glycine max
  Coding DNA Sequence Number=SeqID_59892
MGIAPTKTPSGPEEVQQGPWGFQLWDRACKTPSRPEEVQQGLGVASSKYGLCQF

SEQ ID NO: 151578 - protein, 130 aa, Glycine max
  Coding DNA Sequence Number=SeqID_59893
MTKYSPILQHSEWRSWPDPLSYKVLLLQQRAVAKSGVHVSQREELLSSLSLYFKTDFEFERGGRDDKGIGQRHLSSHRRSGPNLIKGCLALPKGVKSDRLRASSCPWIIQMSLQMIFSGTDIPQSKGPEG

SEQ ID NO: 151579 - protein, 84 aa, Glycine max
  Coding DNA Sequence Number=SeqID_59894
AALTKNKFEVLSNLDEEYEGNFLVCTNQADMTGRLLVSSLALESRILHYLILRIMLPRSSNLAQAIHEVPRHVGSRKEALMRNP

SEQ ID NO: 151580 - protein, 101 aa, Glycine max
  Coding DNA Sequence Number=SeqID_59895
MQNSRVTLRVESQHFASVNDANPYVAFIPYFWFIDEIWELNYVKFTGKTIGVNVEDDDSYMDTYVSPLTAQITPNVVREEEADDVHANRNDHDEGELINIV

SEQ ID NO: 151581 - protein, 92 aa, Glycine max
  Coding DNA Sequence Number=SeqID_59896
MPISPCGSISWSVSSRHRIAPTKTPSGPEEVQQGPGVSTSDYEPQSDVTECLSPPARSSSPPLIGISSRSNAPPGKRRAKHHSSLGMTGSGQ

SEQ ID NO: 151582 - protein, 112 aa, Glycine max
  Coding DNA Sequence Number=SeqID_59897
RVHLLGLLTENKRGYISCGSVLVEGTPTRLFKENKGGYIPCGSLLVKEFYKVEKKSQGPQVAWGLDVGTGCCRTRIVIIKKREIVDKESSRADVLMMPKDHMRLKDLFKAKQ

SEQ ID NO: 151583 - protein, 140 aa, Glycine max
  Coding DNA Sequence Number=SeqID_59898
  Pfam annotation: Domain name=Retrotrans_gag; Domain location=53-131; Score=-1.2; E_value=0.071; Accession=PF03732.8; Description =Retrotransposon gag protein
MQRRSTAGDLIPIDLEINATCRRRNSERIRIFLQDLEAATTPEEEPLSSEASSSFPIAGHSHIESIEDTIMVEKPRRVTLEDYSSSIVPQFFTNESLGEALERFRGLLRKTPTHGFSEPIQLNIFIDGLRPQSKQLLDAS

SEQ ID NO: 151584 - protein, 263 aa, Glycine max
  Coding DNA Sequence Number=SeqID_59899
AYHAKPIMQRKIFCHDWLSATLCAKPMASKKRKSTASRPQAEYTDNILCRNILPERNMQIYHTEFDEFKVELERHNLHKRLANLQDGIIDVVVVKEFYANLYTTEEQAPKQARVRGHLIKIDANNLNEFFHMPVVLEEGEFLPTYSRFCRLRTNPQKIKARLCIPCKGFVLNAEGQPWMLLRKDLTTLAQTWSVFSYSNLALTSHTSDLNMDRAKLVYGLVTNMDMNIRALISCQISSIAQSNSSRLGFLALIIALCKAKGVT

SEQ ID NO: 151585 - protein, 23 aa, Glycine max
  Coding DNA Sequence Number=SeqID_59900
MGESKKGKERKFLIKETRRNVQK

SEQ ID NO: 151586 - protein, 113 aa, Glycine max
  Coding DNA Sequence Number=SeqID_59901
MPISPCESIGWSVPSRHRDCARKTPSGPGEAQQGPRVSSSGYGPLLVLQGARSPQQGIAPARHPVDLEKYNRVLGFPALITGLYQFYGVSITPNKVIRPPTNRAFIKRYCAPR

SEQ ID NO: 151587 - protein, 178 aa, Glycine max
  Coding DNA Sequence Number=SeqID_59902
MTLLLSNVLPSDHNSDLPLPKCQLVYAILTRMSVHVAQVIADVIYLFAGMPPTRHPLDPDKSNRALEFPALITGLCQSFGVPVTPSKVIRPPITRAFIEKYCTPRQAQGDAHQAADAPPPPRQADPTGSLGMEHYLQHLVRQQAANHRGQVQIHKCLYRFSLSQQGQGSAPFACPTPE

SEQ ID NO: 151588 - protein, 125 aa, Glycine max
  Coding DNA Sequence Number=SeqID_59903
NSYDHDYEFELGTSNADQLVHDFVQQLHLRSHLQNLLTCSPTRGIAASSILQPVDIDSEWPADGVPRNAVSLAQQALSASKQAVSTTGEMKLIEIDDDDPLPSGGSSRVDLQACKLGTGRRFTTS

SEQ ID NO: 151589 - protein, 112 aa, Glycine max
  Coding DNA Sequence Number=SeqID_59904
MDFTKIVEISSGLLEYWTEARVVAEPPIPLKIIEATRSNMEWILPTPTPYRLVEPVQVIEVSSSEEDPEEDPEELPPEPVVDALDLSKDDEDPLLDVDFPEDIMSASEVDST

SEQ ID NO: 151590 - protein, 216 aa, Glycine max
  Coding DNA Sequence Number=SeqID_59905
DKDTIDDTICEKYDISKEKWAQFCQSRRYPSWKDVRKKTQAIQKQNSAPYVLSHGDSLEEQASQGSFVAHGRQDVLTAGIGRPKHPGHVRVAGASVAIKQYFGLAPRTSHSSSSMALEDLEQLTQKIRDQLEESIKEKMQSEGLTLPLKPEVGPLAASVSTKESYVDPSVNDPNMGDSEKCGLYVEENPPCLVTLGRLYEGSKTVHNIPLRHDQVK

SEQ ID NO: 151591 - protein, 177 aa, Glycine max
  Coding DNA Sequence Number=SeqID_59906
MASRKRKSIGARPTAQYDTRRFHPLDAWNRYTNNILGKSILPERKVEIYHTKFDDFKAELEGRNLHKCLTNLADGIIDVALEEFDYLGRGVECSLLLQPGPYISYVKPYCGQSQVDLWPSLSYGHEHREEATSKIILMMPKNQELSKFQRFKNQVSRIKIQEQSRSRFKNQEKTQSR

SEQ ID NO: 151592 - protein, 107 aa, Glycine max
  Coding DNA Sequence Number=SeqID_59907
MTEKIHLFFQRFWIGLMVFKPLLVKEVVIIKKGEIVEAKLHDESRLIQICFDDNKDDDKKLKGQSKNEFKMFKIESRTLQDIRGKLISRIKRSLNQDKYEKVFSKTK

SEQ ID NO: 151593 - protein, 25 aa, Glycine max
  Coding DNA Sequence Number=SeqID_59908
MALYRATRDSRDACSTKGIRAESPP

SEQ ID NO: 151594 - protein, 76 aa, Glycine max
  Coding DNA Sequence Number=SeqID_59909
MESGDMWGYRMVTRTFRQPGANEPVDAQRQTSSSVAFVIQGQRVMWQAEIPYGHLHLSSTEGNEFDSIRMMLVIRF

SEQ ID NO: 151595 - protein, 75 aa, Glycine max
  Coding DNA Sequence Number=SeqID_59910
MRGANTFLKCKDNSRIWNILHDRFPLVFSNVFLSINVGGDSAHFPPMEDAPVSLALLARKRVGCDSWRLHWGLFL

SEQ ID NO: 151596 - protein, 106 aa, Glycine max
  Coding DNA Sequence Number=SeqID_59911
ELLDDATVRRSFPDFPLCIKHEDLSEIAHGGQFSDISLQLWILHPETCIRAGNSSAYLWIPRATVLGFRGLGNRSLSLESYIKTWMQIQNVMSFVIATLNGGITGR

SEQ ID NO: 151597 - protein, 162 aa, Glycine max
  Coding DNA Sequence Number=SeqID_59912
  Homolog annotation: Hit_ID=A5AWV0; Match level="QueryCoverage=75%, HitCoverage=8%, E-value=1e-11, Identity=31%"; Hit description =Putative uncharacterized protein
MTETSVRAGNSDVYGFLDPQSVQRSGQSQFESESYMKNWMQNSKRDVYLGVYLNGAHWQMVVILPKENLIVWFCSLHNRPDNYLKGIINSALKGLDDTPQPKSKVGARWIIVKCNRQKGSTECGYYVMHWMSTIILGSFKNNWEITIGIRDIKALCILWGIL

SEQ ID NO: 151598 - protein, 92 aa, Glycine max
  Coding DNA Sequence Number=SeqID_59913
MAKFDPDIVLEFYANAWPTEKRVRDMRPWVRGVAMCPSRARLTGALPKGGKMRGVATNVYLWKTSGKPKETGQQKQGSCSYVPSFGEEIRPT

SEQ ID NO: 151599 - protein, 250 aa, Glycine max
  Coding DNA Sequence Number=SeqID_59914
  Homolog annotation: Hit_ID=UPI00006A2D9E; Match level="QueryCoverage =52%, HitCoverage=77%, E-value=1e-08, Identity=14%"; Hit description =UPI00006A2D9E related cluster
MPSPSKDWTSSPSEDYTSSPSKDCTSLPSEGYTPSPSEDDTSSPSEDCIGLHVLAFRGLHAITFRGLHVLSFKGLHILTFRGLHVLALRGLHVLEFRGLHVLPFRGLHALTFRGLHILAIRGLHVLAFRGLHALAFRGLHVIVLRRLHVLTFKGLHVLAFRGLHVLAFRGLHILAFTGCTSSPSKGYTPSPLEDCTSLPSEDCMSFPSEGCTPLPLEGYTPSPSEGYMSLPLEDYTSSPSKDFTSSPSEG

SEQ ID NO: 151600 - protein, 15 aa, Glycine max
  Coding DNA Sequence Number=SeqID_59915
MGTELEFVIMVIAVS

SEQ ID NO: 151601 - protein, 74 aa, Glycine max
  Coding DNA Sequence Number=SeqID_59916
  Subcellular localization annotation: CTP_CleavageSite=20; ConfidenceScore=5.28e-01
MKLLLLATGVLSSWLNSLVRSLPLSERGRPSQNSPCRLLPLLLLMEGFALLPARLISFGPCHSLKTPSSFSDSD

SEQ ID NO: 151602 - protein, 172 aa, Glycine max
  Coding DNA Sequence Number=SeqID_59917
  Subcellular localization annotation: CTP_CleavageSite=61; ConfidenceScore=5.36e-01
MRSDCLVQFSILNLFRSPMNCVFVHVSSTFEFGAMRSDCLVQFSILKLFRSPMNSVFVHVSSSFEVGALRSDCLVQFSILNPFSKPMNCVFIHVSSTFEFGAMRSDCLVQFSILNLFRSPMNFIFVHVSSTYEFGAMRSDCLVQFSILNPFSEPHELRFRSCVLHLRVWSYA

SEQ ID NO: 151603 - protein, 92 aa, Glycine max
  Coding DNA Sequence Number=SeqID_59918
METLGVDKIEAVADRGYFKIEDIEACDVGWRRYIPDMNGSHSFKEKQDDRFYPVCPCCKLTNEGNGQTIGLERSHRDWHSHSRFGLSCRRIT

SEQ ID NO: 151604 - protein, 373 aa, Glycine max
  Coding DNA Sequence Number=SeqID_59919
MAPKKLSSKRSRRDAAAEGTSATPEFDSHRLRSAKHQQRFEAIKGWSFHKERRVQLMDDEYTDFQEEIARRHWTSLVTPMAKFDPDIVLEFYANAWPTEEGVRDMRSWVRGQWIPFDVDALSQFLGDPLVLEEGQECEFSQRRNRDDGFDEEAIAQLLCIPGQDFARTAAGRRVRIMRTSMITLTQMWITLLLSNVLPSDHNSDLPLPKCQLVYAILTRMSVYVAQLIADAIYLFAGMPPTRHPLDPDNSNRALGFQALITGLFLSFRVPVTPSKVIRPPITRAFIEKYCTPRQAQGDAPQAANAPPPPHQADQVGSLGMERYLKHLVRQQEANHRGQVQIHECLYQLSISQQGQGFAPFVCPTPDQFRAEVA

SEQ ID NO: 151605 - protein, 88 aa, Glycine max
  Coding DNA Sequence Number=SeqID_59920
MANEPVDTWRFTSSSALSVILTREVRRRYPSGYPYKHSFAIPQTQSPIACRDKCRLLHPLSIAANELVDTWRFTSSSVLSVILTREVR

SEQ ID NO: 151606 - protein, 86 aa, Glycine max
  Coding DNA Sequence Number=SeqID_59921
  Gene Ontology: Mol. function=aspartic-type endopeptidase activity; Biological process=DNA integration
  Homolog annotation: Hit_ID=Q60D13; Match level="QueryCoverage=68%, HitCoverage=7%, E-value=3e-07, Identity=48%"; Hit description =Putative gag and pol polyprotein, identical
MVGKTLGASRHVCYDRYVLKHTQMLKIRNVALGDSTLTTVAGTGNVELKFTSGKTLILKDVKLFPENTGEGLPVDLVRSIGTLLKG

SEQ ID NO: 151607 - protein, 73 aa, Glycine max
  Coding DNA Sequence Number=SeqID_59922
PPIGVIQKRQSDEDKARNKGKEPLEGLGGPMARARTKKAKEALQQVLTMLFEFRPKLQVEKLRIVNCTMFQEE

SEQ ID NO: 151608 - protein, 136 aa, Glycine max
  Coding DNA Sequence Number=SeqID_59923
  Homolog annotation: Hit_ID=A0ST23; Match level="QueryCoverage=33%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVYKGTELEFVIMVIAVSFGKPVVPAALMNRPTRGERRFAYWALFRFLAH

SEQ ID NO: 151609 - protein, 161 aa, Glycine max
  Coding DNA Sequence Number=SeqID_59924
MNILTAHDQGWNQELSPYNQYEEERTPNLESVFEEFIAYHANSKANQNSMKNHEIHFEHESREKDEEKEEEQAQQQWDKYSTVENQQENILQINNLPHQLIIKKGRQGELEETLSAILSLITSIFLEMIWNVLPDYMKFMEFLAKRRNFKEDVFYVTFMPP

SEQ ID NO: 151610 - protein, 140 aa, Glycine max
  Coding DNA Sequence Number=SeqID_59925
MSDGFCGTHLHIMVRTRGLGRALGLVTGRGVGKGDRDDSDDTLQHRRPTAPARRQRVAVTTDHVDEPVIPALDVQDDPMEAPATVEDIPADIPVDAGVKVAKDQHQGFSGGPSDPFVLTAYADHVACSVWTGEERPELKL

SEQ ID NO: 151611 - protein, 71 aa, Glycine max
  Coding DNA Sequence Number=SeqID_59926
MALARDFYRETTRGAFWYWKYQNVHVCNFDSQSALSKHVCKFRKGNACDVGNGPKEACLKEVQEGQGGRRN

SEQ ID NO: 151612 - protein, 77 aa, Glycine max
  Coding DNA Sequence Number=SeqID_59927
MGEVEDVQEQMKANMEAMKEQMATMMEAMMSMKKIMEANAVTIVATSTVAKVNPMPPSGLNQMNHPTLDMVGKDLGK

SEQ ID NO: 151613 - protein, 104 aa, Glycine max
  Coding DNA Sequence Number=SeqID_59928
GLFPEEPWCLPTWMAKSYLHPDFLSVVSLVTIFQRNERGFEAFSPHGQDHLGLPSGVKTKHEWQKPVKVLKDERKRGWGHDRPIVALLCAKQTGNVAARQLRIL

SEQ ID NO: 151614 - protein, 140 aa, Glycine max
  Coding DNA Sequence Number=SeqID_59929
  Gene Ontology: Mol. function=lipid binding; Cellular component =anchored to membrane; Biological process=lipid transport
  Homolog annotation: Hit_ID=A7QR85; Match level="QueryCoverage=61%, HitCoverage=57%, E-value=2e-31, Identity=67%"; Hit description =Chromosome chr13 scaffold_149, whole genome shotgun sequence
  Pfam annotation: Domain name=Tryp_alpha_amyl; Domain location=11-88; Score=22.9; E_value=0.0012; Accession=PF00234.13; Description =Protease inhibitorseed storageLTP f
MGDSAKDKQRCAESLTGVATCLPYLGADAKAPTADCCSGLTQAMKTNNKCVCLILKDRDDPDLGLKINMTIAVGLPSLCKTPDNLSQCSVDGSSQNGRKQGTDETATAKNSASYIGKRLLVDSVKNIYTLECTKSLTDSQ

SEQ ID NO: 151615 - protein, 144 aa, Glycine max
  Coding DNA Sequence Number=SeqID_59930
VKFGDMRGYRMVIRTIRQPGANETVDAQRLTSSSVPFVNQGQANSRRYRMVILIFRQQGANEPVDAQRLTSSSARFVIQGQGVRWQAEIPYGRLHLSSTKANEFDGIRMMSFTLIVWRHSSPMTHEILLCWAGTIKFDCVWKRC

SEQ ID NO: 151616 - protein, 134 aa, Glycine max
  Coding DNA Sequence Number=SeqID_59931
  Gene Ontology: Mol. function=transcription repressor activity; Biological process=regulation of transcription, DNA-dependent
  Homolog annotation: Hit_ID=Q1H004; Match level="QueryCoverage=88%, HitCoverage=80%, E-value=4e-48, Identity=77%"; Hit description =Transcriptional repressor nrdR
  Pfam annotation: Domain name=ATP-cone; Domain location=30-120; Score =96.9; E_value=6.3e-26; Accession=PF03477.7; Description=ATP cone domain
MPAGRLLEDPRCQVCDKRFTTYETAELHLPQVVKQNGTREEFKREKLRVSFTRALHKRPVPTEYVDKAMDRIIQKVLGLGVREVPARLLGETVMQELKQMDQVAYIRFASVYRSFSDVDDFHNAIRDLDVTDSD

SEQ ID NO: 151617 - protein, 134 aa, Glycine max
  Coding DNA Sequence Number=SeqID_59932
  Homolog annotation: Hit_ID=A0EVF5; Match level="QueryCoverage=64%, HitCoverage=10%, E-value=5e-07, Identity=36%"; Hit description=Opie2 gag protein
  Pfam annotation: Domain name=zf-CCHC; Domain location=62-79; Score =26.7; E_value=8.7e-05; Accession=PF00098.14; Description=Zinc knuckle
MKRSIALKASSSMQEEEEEESDDEEDFSRFVKKFHKFVKNRRMERSHNFDNGKRSQEGSPTLKCYKCNRPGHIKAHCPTNESCPEKNQKKSHEERRSKKAYIAWDDNDSSDGSEKEINLLSKYYESDENISQED

SEQ ID NO: 151618 - protein, 177 aa, Glycine max
  Coding DNA Sequence Number=SeqID_59933
PRLERACTPSPWVLVTLNVRGLHVLALRGLHVLTIRGLHALTSRGLHVLALRGLHVLTIRGLHALTSRGLHVLALRGLHALTLGLHVLTIRGLHALTSRGLHVLALRGLHALTLGTSYPQRQRTTRPRLERTTRPHHQRAARPYLQRTTCPRLERATRPHLGYYLPSPSEDYTSSPL

SEQ ID NO: 151619 - protein, 49 aa, Glycine max
  Coding DNA Sequence Number=SeqID_59934
  Gene Ontology: Mol. function=nucleic acid binding; Cellular component= nucleus; Biological process=mRNA processing
  Homolog annotation: Hit_ID=A5AQI8; Match level="QueryCoverage=93%, HitCoverage=9%, E-value=8e-16, Identity=86%"; Hit description =Putative uncharacterized protein
RFRDKKEVAEPEADPERDLRTVFAYQMPLKATETNVYEFFSKAGKVSCF

SEQ ID NO: 151620 - protein, 76 aa, Glycine max
  Coding DNA Sequence Number=SeqID_59935
MTGPLDESISCFLIRVDPWVLVPITFRGLHVLAIRGLHILTSERTTRPRHQRAARPHLQRTTRPRLERATRPHLGY

SEQ ID NO: 151621 - protein, 147 aa, Glycine max
  Coding DNA Sequence Number=SeqID_59936
MVGYTPSSFADLVFTYERIKVGLKIGKFNHPAWTNEKTGENEEGEDEGETHAVTAIPIRPSFPPTQQCHYSTLLLTYHPVIHNEFTLIPMSYADLLPYPLDNSMVAITLARFPQPPFFRGYDSNATCAYYAGISGHSIEHRMTLKRK

SEQ ID NO: 151622 - protein, 206 aa, Glycine max
  Coding DNA Sequence Number=SeqID_59937
  Homolog annotation: Hit_ID=A5C169; Match level="QueryCoverage=59%, HitCoverage=10%, E-value=2e-07, Identity=29%"; Hit description =Putative uncharacterized protein
MTGRLLAGSLAFECRIMHYLIVCILLPLSSNFAQVSEEDLVVMWVLLTSRQIDWAQLVRYRMQKALRSKTPLPYPHLITLFLRHFDVLLDSETFVQVKRSFSNGAGVVTSFGYRKERDGSWVKKDIPAQAAKDRSPSPPPQRDDSSSLMKSILDRLDGLHTYVGERFDTLESRIDTQFADMDTHIDRLEEDVSFIRQCFDLPPPPS

SEQ ID NO: 151623 - protein, 61 aa, Glycine max
  Coding DNA Sequence Number=SeqID_59938
  Subcellular localization annotation: CTP_CleavageSite=39; ConfidenceScore=5.12e-01
WAKRASIAKCSFRALRATEESGRASISRPRTKRMINALSAAVVFSLAQCTTGAKLKSTYSR

SEQ ID NO: 151624 - protein, 92 aa, Glycine max
  Coding DNA Sequence Number=SeqID_59939
  Subcellular localization annotation: CTP_CleavageSite=45; ConfidenceScore=5.06e-01
MTFGSPAGGQPQGARADPYSLYQLSVSLQSQGFASFPFPTLDQFRAEVAWPRDWPEAQAGEAPVEAPGEAYEAHMDEEMTNLLDFLGGSGAI

SEQ ID NO: 151625 - protein, 69 aa, Glycine max
  Coding DNA Sequence Number=SeqID_59940
STLEDPPWSLLAIGHNCVCLAKGGADNRKVSPQATSSWVMATKGGVVDKSEALAPTYPPMRNSDLRSSG

SEQ ID NO: 151626 - protein, 106 aa, Glycine max
  Coding DNA Sequence Number=SeqID_59941
MKRVKSEANTEKKKITTPNEGKEVPYPLVPSRKDKERHLARFLDIFKKIDITLPFGEALQQIPPLCQIFKIYTNKEEPMNGSGMEKEEREEKPLQGEDESRRSSPP

SEQ ID NO: 151627 - protein, 227 aa, Glycine max
  Coding DNA Sequence Number=SeqID_59942
MGPKSTLRLMRTLGPSLKSLAQSSWSLLSNALARISTACDLIPIDLEIKATCRRHNQERIRNFLQDLEAAAIPKEEPQSAKAYSSFPVAGHSHLDPIEDHIMAEEPRRVTLEDYSHTSHASVLQPRNNFNAGGSSGFQHGQQYNQQQGQWRNHPGNQFNRDQGVPSTRSQQQGPSLYDRTTKLEETLAQFMQKNPKEECKAVMTRSRMEIHIDESEAKKKVEEHKQQ

SEQ ID NO: 151628 - protein, 123 aa, Glycine max
  Coding DNA Sequence Number=SeqID_59943
MPPTRHPLDPNKSNRALGFAELIMGLCQSFGVPVTPSKAANHRAHVQTHDCLYQLSLSLQSQGFSSFPCPTLDQFRVEVAWPGDWPEAQAGEAPAEAPSEADQARMDEEMTDLLDFLGGSGAT

SEQ ID NO: 151629 - protein, 93 aa, Glycine max
  Coding DNA Sequence Number=SeqID_59944
  Homolog annotation: Hit_ID=A5BSW9; Match level="QueryCoverage=81%, HitCoverage=5%, E-value=2e-08, Identity=38%"; Hit description =Putative uncharacterized protein
VLEKVNNNSYRLDLQQEYGLSTTFNTSGLIPFASGADIEEEELTDFKSNHRQGEGDDAILPRKGPVTRAMSKRLQEDWARAAEEAPRVLMNLR

SEQ ID NO: 151630 - protein, 188 aa, Glycine max
  Coding DNA Sequence Number=SeqID_59945
MEQKVIVGEIQQREFSGFQHGQQYNQQQGQWRNHPGNQFNRDQGGPSTRPQQQGPSHYDRTTKLEGTLAQFMQVSMSNQKSTKSAIKNLEVQVGQLAKQLADRSSSSFTVNTKKNPKEECKAMMTRSKMEIHVDESEVEKKMEEYKQQLAPKPALEPVFDFVELEEINEEAKDDKEEETPIKKKKKKE

SEQ ID NO: 151631 - protein, 61 aa, Glycine max
  Coding DNA Sequence Number=SeqID_59946
MGVQIAPRPTWALQKIPPEGCCFWRKQPGSPGRAGRQASPLSRRRLGDFSIGKCTIALELD

SEQ ID NO: 151632 - protein, 16 aa, Glycine max
  Coding DNA Sequence Number=SeqID_59947
STLEDPLKEALLGGNL

SEQ ID NO: 151633 - protein, 166 aa, Glycine max
  Coding DNA Sequence Number=SeqID_59948
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPLHFLREILLIGLLYSMARVITIGGTELEFVIMVIAVSFGKPVVPAALMNRPTRGERRFAYWALFRFLAH

SEQ ID NO: 151634 - protein, 44 aa, Glycine max
  Coding DNA Sequence Number=SeqID_59949
MEILHRSSSFFTVLHPFFVRSSFFNGFLFFPFDVLKPFIKSFLA

SEQ ID NO: 151635 - protein, 146 aa, Glycine max
  Coding DNA Sequence Number=SeqID_59950
  Homolog annotation: Hit_ID=Q6WAY6; Match level="QueryCoverage=78%, HitCoverage=19%, E-value=5e-17, Identity=40%"; Hit description =Putative uncharacterized protein
MVGFAPFSPRGKACLPARKSPFMHRERRRKLGQLLENKEGVSINWFPRWKEGGVGVLISCGGFPNVPLIGTRGCISYNPVLAIRQLGYPMRGTPLEEEIAPVISRGFNKTNMERLQKVRKAWEVLRKKDKELRGSNNGPSVATISG

SEQ ID NO: 151636 - protein, 103 aa, Glycine max
  Coding DNA Sequence Number=SeqID_59951
  Gene Ontology: Mol. function=chitin binding; Cellular component =extracellular region; Biological process=chitin metabolic process
  Homolog annotation: Hit_ID=UPI000069F178; Match level="QueryCoverage =94%, HitCoverage=50%, E-value=5e-10, Identity=34%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=77; ConfidenceScore=5.20e-01
MARTYSPLKVRACSPTKVKAHDPLTARTCSPLKLKVHDPLKARTCSPLKVKVRACSPLMVRTCSPLKVRACSPLTVRVRACSPLMVRTCSPLKARTCSPLTVR

SEQ ID NO: 151637 - protein, 34 aa, Glycine max
  Coding DNA Sequence Number=SeqID_59952
AVRLWFKLLSLMSYPNFVRGPLLDDIRLFFGPCE

SEQ ID NO: 151638 - protein, 39 aa, Glycine max
  Coding DNA Sequence Number=SeqID_59953
MEVDEPWLGLWLPLNYQKWVYDPNMVGSWCLTHATKNVV

SEQ ID NO: 151639 - protein, 86 aa, Glycine max
  Coding DNA Sequence Number=SeqID_59954
  Subcellular localization annotation: CTP_CleavageSite=27; ConfidenceScore=5.19e-01
MGMFNSSKHGKNLAKIPIISPKTPYPRKSRGKEVHPNLKFRSPTRRDVLHDFENALLSRFGAEMMAKGWSFVGQQWWMREKKKKAA

SEQ ID NO: 151640 - protein, 32 aa, Glycine max
  Coding DNA Sequence Number=SeqID_59955
MTKRVSMTEIVGQPTKARLLLLRILNEELRPT

SEQ ID NO: 151641 - protein, 61 aa, Glycine max
  Coding DNA Sequence Number=SeqID_59956
MALGEKGFDGLQTFVGERFDNLELQVDMRFDEMESRITKVEEDVFYIHTSFDLPPPPPPSS

SEQ ID NO: 151642 - protein, 89 aa, Glycine max
  Coding DNA Sequence Number=SeqID_59957
MFLQEVYSLACNQLHEDCNRLPAAEDCKSKLHDESRLIQRSFDDNKHDGKKLKGQEHFMITKMMISKNQRMSSRCSRLNQEHFKVQEEI

SEQ ID NO: 151643 - protein, 47 aa, Glycine max
  Coding DNA Sequence Number=SeqID_59958
MSCTGLLSAPLHLTKRTVFSSLAKQERRAKPKITNRPELEALAGLRA

SEQ ID NO: 151644 - protein, 96 aa, Glycine max
  Coding DNA Sequence Number=SeqID_59959
VDSRGSPVRQQAANHRAHVRTHDCLYQMSLSMQSQGVAPFSCPTPDQFKAEVAWPGDWPEAQAGEAPPEAPGDGEEAHEDEEMADLLDFLGGSGDT

SEQ ID NO: 151645 - protein, 102 aa, Glycine max
  Coding DNA Sequence Number=SeqID_59960
  Subcellular localization annotation: CTP_CleavageSite=78; ConfidenceScore=5.28e-01
MLVRMIRTRLFAVARVKSCPGMHSSCVIASLSGCARTVGPPPISGGQRTLNSLKVWMWSTLKMSTCSPLKVRACSPLKARMCSPLEVRACSPLMARTCSPLK

SEQ ID NO: 151646 - protein, 55 aa, Glycine max
  Coding DNA Sequence Number=SeqID_59961
MTKARQKGVRKANEIKIKAREKREVVAAQLAQACWVASTRRHRLLLEHPRRPKWV

SEQ ID NO: 151647 - protein, 179 aa, Glycine max
  Coding DNA Sequence Number=SeqID_59962
DRELRGSSNGIIGGYHKWLRVQTQGLDWLPNLKTVRDNEVKALEESDEAQALKAKLERARVVKEKFKAAIVSSSSEEVKGIIAGQRHDLEGRAKGNMWAIIDECKEKLNLAATHEQRLEDEYAKISAEREARERVIHSLHQEATMRMDRSQEVPRLLAKAKAMADTYSAPKEIHGLLSY

SEQ ID NO: 151648 - protein, 142 aa, Glycine max
  Coding DNA Sequence Number=SeqID_59963
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRA

SEQ ID NO: 151649 - protein, 87 aa, Glycine max
  Coding DNA Sequence Number=SeqID_59964
MVFFFVGILALNVFGLFLFCFCLVRGEQVTDAQDLGWQSKGEDHFRSWARFMVSWDFGSRLVERMDMIYVRVLVWFRDERECPTLFP

SEQ ID NO: 151650 - protein, 109 aa, Glycine max
  Coding DNA Sequence Number=SeqID_59965
MARVCEIEFRATYPNFMKIQHFGFLRERKRLQCERYFSQLKDYITILNGENSRNWASNMVLKFHDDPTVNESEIVVFLRQVRWPTGKRKGFGRREKKRNCEAEEAEKSV

SEQ ID NO: 151651 - protein, 115 aa, Glycine max
  Coding DNA Sequence Number=SeqID_59966
VTNITGLSGVTRSGRVFAPPPSVEFPSKGKAPMIQEPTDIATPSKEVDPLGVKGAEKKEGLQGKAVTLEEAHEFLRLMPTKRSHDMETCPAVEEMLQRLMDWGQLEVSKGGREEP

SEQ ID NO: 151652 - protein, 63 aa, Glycine max
  Coding DNA Sequence Number=SeqID_59967
  Subcellular localization annotation: CTP_CleavageSite=40; ConfidenceScore=5.21e-01
EMALRKLASKRSRKDKALLPNMTATVLGVLSTSSALRPSRDAHFSGSDAYSSGTTSILTSRRR

SEQ ID NO: 151653 - protein, 130 aa, Glycine max
  Coding DNA Sequence Number=SeqID_59968
MELQRLNQNEETKKRKRSIALKASSSMQEEEEKEESDDEEDFSLSVKKFHKFVKNKRMERTLTMGRDLKKAHCPTNESWPEKNEKKSREERRSKKAYIAWDDNDSSDGSEKEINLLSKDYESVENISQED

SEQ ID NO: 151654 - protein, 83 aa, Glycine max
  Coding DNA Sequence Number=SeqID_59969
MAITEATGLQMRTRVEMIGRKESDENHETGQIQAKDPSGEGRRPKWRRTKPPEWRRMKAQVEKDEGPEAETLSRLLIFAEGPN

SEQ ID NO: 151655 - protein, 416 aa, Glycine max
  Coding DNA Sequence Number=SeqID_59970
  Homolog annotation: Hit_ID=Q6WAY4; Match level="QueryCoverage=69%, HitCoverage=63%, E-value=3e-27, Identity=28%"; Hit description =Putative uncharacterized protein
MGTNQTGKRFYQVKIKGLDVTSLKELGRLMRPLQMQAFRKAYGKILDLTIVEIFTEAVVSLTQYYDQPLRCFTFGDFQLVPTVEEFEEILGCPLGGRKPYLFSGFLPSLSKIAIVVRDSARELDRVKQTRNGVVGLPRKYLEGKARDMVNQEEWVLFVDVLALLIFGVFLFLNVDAIARVRRVDWDQHLAGIGGRTINWFPRWKEGKEGVLFSCGDYLNISLIGTRGCINYNLALAIRQLGYPMRGTPAEESLSPFLVRNFGTQSFKIIQRVHKAWESPLRKDKELRGIRKGIIGGYHEWLKVRTRGLDWLSKLKIINEENFEAPEEDEEVRALKTELGKARLAKEKFKLVATDVQKECAELREENAATARALEQETKRARKEEHGRDKFRGAFWGINNELKLRREERDQSRAHSM

SEQ ID NO: 151656 - protein, 100 aa, Glycine max
  Coding DNA Sequence Number=SeqID_59971
  Subcellular localization annotation: CTP_CleavageSite=66; ConfidenceScore=5.66e-01
MRIDCLALFANSPFSTFIRSPMNSLTSAFQSYSTNESGAARIDCLAIFANSPFSTFIRSPMNSLPSAFHASSTNESGGPRIDYQALYSPILHSPLLFGAP

SEQ ID NO: 151657 - protein, 139 aa, Glycine max
  Coding DNA Sequence Number=SeqID_59972
MVVRAFDDSHRDLLIRPTLDSFGWGSPFNTAPEVEICGGRAIDYSLGRRRHSCELSFFYALCGGHGGVLGNIFSGIGIGEQCLRRVSPGTTTLIWGRIDDSSGDVGIWIRARNGFGMERKWRSDFGRVHKEPRKVRTGI

SEQ ID NO: 151658 - protein, 212 aa, Glycine max
  Coding DNA Sequence Number=SeqID_59973
LHALIFKGVHALTFRGLNVLALRGLHVLAFGGLHALVFRGLYVLPFRGLHVLAFGGLYVLTFKGLHVLTFRGLHVLTFRGLRVLIFRGPTMRAQPEEGYRAATVHTGARGRAHKTSSGPGEVQQGPGVSSFGYGPLSFLQGAHSPQQGHPVDPKKSNRVLGFPALITGLCQFYRVPVTPNKVIRPPTKRAFIKKYCAPRQVEGETPQQPGDG

SEQ ID NO: 151659 - protein, 171 aa, Glycine max
  Coding DNA Sequence Number=SeqID_59974
  Pfam annotation: Domain name=DUF1905; Domain location=15-95; Score= -11.7; E_value=0.034; Accession=PF08922.2; Description=Domain of unknown function (DUF1905)
IQRTNHLRILCLNTLEGTSFVVQVEGTYTWVVLTENKRGYISCGSVQVEGTSTWLFKENKGGYIPCGSLLVKDFTRLKEISRTGVCLGTECDLADLDLEIEVTCKRNNAERQRNFLQERAVPILEEPRSSESSSSFLERRESETAVPEVDIMAEEQPRRVTLEDYSSSIVP

SEQ ID NO: 151660 - protein, 86 aa, Glycine max
  Coding DNA Sequence Number=SeqID_59975
MNQALDDREALLGGSVVIFSQEMAPKKLSTKRSRRDATGEGSIAASEFDSHRFRSVEHQQRFEAIKGWSFHRERRVQLREDEYPDF

SEQ ID NO: 151661 - protein, 64 aa, Glycine max
  Coding DNA Sequence Number=SeqID_59976
MIMRGQDIYSSQEETTSFPSSSGSEDDVRGEESSEDVYPHEEGDLLMVRRLLGVDLVAIVVAQD

SEQ ID NO: 151662 - protein, 313 aa, Glycine max
  Coding DNA Sequence Number=SeqID_59977
  Gene Ontology: Mol. function=aminoacyl-tRNA ligase activity; Cellular component=cytoplasm; Biological process=tRNA aminoacylation for protein translation
  Homolog annotation: Hit_ID=A7PM27; Match level="QueryCoverage=97%, HitCoverage=85%, E-value=3e-85, Identity=48%"; Hit description =Chromosome chr14 scaffold_21, whole genome shotgun sequence
  Pfam annotation: Domain name=Suc_Fer-like; Domain location=23-234; Score=165.0; E_value=2e-46; Accession=PF06999.3; Description =Sucraseferredoxin-like
MAASAAFDDAKHGFSRPEMYKENLAGTLDAYDRHVFLCYKNHLAWPPRLEASDADPLPKRVATVWRARKNDIAVKTKITVCEAREEAGFSDGDALIFPDMIKYRGVEESNVDVFFNDVIVSGKEWSGGKQGKGVLKGSHIFVCAHGSRDVRCGVCGPVLMDKFNEEIQLRGLKDQISVLACSHIGGHKYAGNVIIFSPGSDGKIMGHWGQMGPPGAEIKVADDHKLANGVYNNKANLSNNENVTGCCQGVNGVSCCRTASFDDKTAEAYKKQGSNNISWCLPVLKKRDILTAGGILGALAAVAVAFRFYRRAS

SEQ ID NO: 151663 - protein, 295 aa, Glycine max
  Coding DNA Sequence Number=SeqID_59978
  Homolog annotation: Hit_ID=A7QD90; Match level="QueryCoverage=75%, HitCoverage=37%, E-value=1e-07, Identity=26%"; Hit description =Peptidyl-prolyl cis-trans isomerase
  Subcellular localization annotation: CTP_CleavageSite=22; ConfidenceScore=5.20e-01
DGRRLGSPLATTIASSTLSLAIAATASGRVAFLLRCSLEGWWASCLALKKEAWGRVFRFSSTFGVSAKEGGEDDDNKVRPRRRKSIGFKLGEFDHDGAIDDKCHRNQTIQNDNDMVDSNNRDRYGDRSRGHGGNGDNKARSERGARDLDSPADTKDRDRLMGRRGDDDYKWKDECDSRKRDEDDGYRGKDEQDSRKRDEDDSYRERRTSRDDRRNTDSSHLERRNEGDYSKRPEDSGKQDMKMDYGRRKGSPGDEDYKNGRDDEDYKHRREERGHKRQDIVSDDYPHRRHHGDRR

SEQ ID NO: 151664 - protein, 552 aa, Glycine max
  Coding DNA Sequence Number=SeqID_59979
  Gene Ontology: Mol. function=oxidoreductase activity; Cellular component=integral to membrane; Biological process=electron transport
  Homolog annotation: Hit_ID=A7PL07; Match level="QueryCoverage=89%, HitCoverage=98%, E-value=1e-134, Identity=47%"; Hit description =Chromosome chr7 scaffold_20, whole genome shotgun sequence
  Pfam annotation: Domain name=p450; Domain location=36-496; Score =107.5; E_value=3.9e-29; Accession=PF00067.13; Description=Cytochrome P450
MAMLVYEAVIVTAVLCMLYFLHRKRCCRHPLFPDYPIIGMLPPVLCNLWRAHDLISDVLKQHGGTGEFTGPWFTIMNCLISSDPINVHHVMSKNFHNYVKGPVFRDIFQAFGDGIFTADSEAWKYNRDLFHSLFKNRSFEFFLEKTIQNKVQNSLLPMLDHMHQQRKVVDLQDVFGRFTFDNICSLVLGYDPNCLSVDIPEVAIEKAFNEAEESIFYRHTVPKCVWKLQKWLQIGQEKKMTEACKTLDQFIHACIASKRVELSNDNEMGEAHHVDLITALMREKQTHDDRFIRDAVFNLFVAGRDTITSALTWFFWLVATNPLVEAKILEEIKEKLETNEKTLGVLSVEKVKKLVYLHGAICETLRLFPPIPFERKLAIKADMLPSGHRVNPRTMILISLYAMGRLEETWGKDCLEFKPERWISEKGGIVYVPSYKFIAFNAGPRTCLGKDLSFIQMKMVAAAILYKYHVQVVEDYVATPSLSIVLLIKDGLKTTNWEPPQPGFIECAKEGQCFDVGVWFCVITMEHSLRHKLFFNLDFKIPKKPSCGDRTI

SEQ ID NO: 151665 - protein, 122 aa, Glycine max
  Coding DNA Sequence Number=SeqID_59980
  Gene Ontology: Mol. function=oxidoreductase activity; Cellular component=integral to membrane; Biological process=electron transport
  Homolog annotation: Hit_ID=A2XCB9; Match level="QueryCoverage=79%, HitCoverage=28%, E-value=3e-17, Identity=34%"; Hit description =Putative uncharacterized protein
MNKTNCMIDQRRQNSLSLALPTWTIYLHGAICEALRFFPPIRVETKQAIKADDMLPGDHRVNSGPRTCLGKDLSFIQMKLVAAAILQKYRVQVVEDHVATPSLSIVLLTKNGLKLHIPKREI

SEQ ID NO: 151666 - protein, 485 aa, Glycine max
  Coding DNA Sequence Number=SeqID_59981
  Gene Ontology: Mol. function=protein transporter activity; Cellular component=cytoplasm; Biological process=intracellular protein transport
  Homolog annotation: Hit_ID=Q2QP84; Match level="QueryCoverage=98%, HitCoverage=50%, E-value=1e-155, Identity=60%"; Hit description =Vesicle tethering family protein, putative, expressed
MDLMSGYKGVVGLLVGNENSSNEDRYVERLLDRISNGKLPEDRRNAITELQAVVSESQAFQLAFGAMGFPIMLSVLKEERDDVEMVRGVLETLVSALTPINHSKGASNEVHPALMNTDLLSREADCISLLLSLLEEDDFYVRYYTLQLLTALLTNSPQRLQEAILTIPRGITRLMDMLMDREVIRNEALLLLTHLTREAEEIQKIVVFEGAFEKIFSIIREEGNSDGGVVVQDCLELLNNLLRSNASNQVLLRETVGLDSLILILKLRGSSFTFNQQKTINLLSALETIKLLLKGGSESDPGKDMNKQTNKTTLVQKKILDHLLILGVESQWVPVPVRCAAMRCIGDLIAGDSKNRDLLASKVLGEEPHVEPALNSILRILLRTSSMQEFIAADYIFKSFCEKNADGQSMLASTLIPQPYSMNHAFLEEDVNMSFGSLKIVNCFFFSMLLHSLTLGENGDLETCCRAASVLSHMLKDHLQCKERS

SEQ ID NO: 151667 - protein, 881 aa, Glycine max
  Coding DNA Sequence Number=SeqID_59982
  Gene Ontology: Mol. function=methionyl aminopeptidase activity; Cellular component=cytoplasm; Biological process=proteolysis
  Homolog annotation: Hit_ID=A7PXX3; Match level="QueryCoverage=19%, HitCoverage=41%, E-value=2e-91, Identity=90%"; Hit description =Methionine aminopeptidase
  Pfam annotation: Domain name=DUF827; Domain location=105-528; Score= -13.5; E_value=1.8e-09; Accession=PF05701.2; Description=Plant protein of unknown function (DUF827)
  Pfam annotation: Domain name=Peptidase_M24; Domain location=728-879; Score=10.0; E_value=5.6e-10; Accession=PF00557.15; Description =metallopeptidase family M24
  Pfam module annotation: Pfam domain module=DUF827::Peptidase_M24; Domain location=105-528::728-879
MDGSASKPGNTTRGIGLVKAGVNLCGNRNIADVNSPSLKKDFSTVYSLGVLLIRALDNNIVLLNIPQKHSSKAKELHRASNDIVRYEETKWAAESAKAQAEAELSNAKQTVKDLFSMIGESIYKAKAEMRDMAPLKKYVKPSKDDNEYSQVMRELEHAKRELFQLKLDVGSVLEEKLRAEKEIEASRSTMLSFSRVAQKLRKEIEEASEEQVVVELARMDALNELRDIETVENTRNKLKEAIEEIDETKELEMKLATTLSDIDMLKNELKFVKKTGKRVHERGGESMEHIEEDQSRDVGVLEATKEEIEAAKKDLASIREQGFKFMASMDVTRNELKHVSAATNHLKNTESKIGAKVRNLSYKLLRAKSKLEAVSAAEEKAKSIVSNLSKTLDKLKSETEAAKKEKELIINGEVAGTKEEIKKALLEIKGSEERFQGAMQELEAVKSSEALALEKLKILTENAMKERISNLTKPSSLIIISKFEYEYLRNHAGKANEIAEKKVEAAKAWVEAVRESEKEIVMKTKIAATEGKAKEKLVAKRVNNELELENWSKYGTGISRKSIKTPSRGANSKFHQKASSPHRPVSPFIVKKKNKEWNPKATGLLPPSTIAPSRSFIAAPHRTAPENGTSSHVVEGAADADADAELSPPSQKGDDAKEVSKKKKKKSKSKKKKELLQQTDPPSISVINLFPSGDFPEGEIQQYKDDNLWRTTSEEKRELERLQKPLYNSVRRAAEVHRQVRKYIKGILKPGMLMTDICETLENTVRKLISEDGLQAGIAFPTGCSLNWVAAHWTPNSGDKTILQYDDVMKLDFGTHVDGYIVDCAFTVAFNPMFDPLLEASREATNTGIKHKAKYQYHYYKNVERTIPQKLGIVVGEPKAL

SEQ ID NO: 151668 - protein, 151 aa, Glycine max
  Coding DNA Sequence Number=SeqID_59983
  Gene Ontology: Mol. function=structural constituent of ribosome; Cellular component=large ribosomal subunit; Biological process =translation
  Homolog annotation: Hit_ID=O48879; Match level="QueryCoverage=84%, HitCoverage=78%, E-value=5e-62, Identity=96%"; Hit description =Ribosomal protein L22
  Pfam annotation: Domain name=Ribosomal_L22; Domain location=35-139; Score=213.4; E_value=5.3e-61; Accession=PF00237.10; Description =Ribosomal protein L22pL17e
MAFSFTFCVFIHVVTRIFKFNGAEQESNKYVEAYAVGRNIRMSANKARRVIDQIRGSKYDETLMVLELMPYRACEAILKIVFSAGANASNNLGLSKGSLVISKAEVNEGKTMKRVKPVARGRAHPIKKRTCHITITVKGLPSESVEEAKPA

SEQ ID NO: 151669 - protein, 86 aa, Glycine max
  Coding DNA Sequence Number=SeqID_59984
  Gene Ontology: Mol. function=hydroxymethyl-, formyl- and related transferase activity; Biological process=biosynthetic process
  Homolog annotation: Hit_ID=A7PR59; Match level="QueryCoverage=75%, HitCoverage=16%, E-value=5e-23, Identity=84%"; Hit description =Chromosome chr14 scaffold_26, whole genome shotgun sequence
MSIHYLPTLYIFHHWAPDLLELLFHKGSKLLIGELPSILDGSAIVKAQPQDDSKATLAPKINPDESWLSFDQEASVLHNKELEQER

SEQ ID NO: 151670 - protein, 743 aa, Glycine max
  Coding DNA Sequence Number=SeqID_59985
  Gene Ontology: Mol. function=protein heterodimerization activity; Cellular component=microtubule; Biological process=cell division
  Homolog annotation: Hit_ID=A7QNQ6; Match level="QueryCoverage=99%, HitCoverage=99%, E-value=0.0, Identity=69%"; Hit description =Chromosome undetermined scaffold_133, whole genome shotgun sequence
  Pfam annotation: Domain name=WD40; Domain location=115-153; Score =49.8; E_value=9.4e-12; Accession=PF00400.23; Description=WD domain, G-beta repeat
  Pfam annotation: Domain name=WD40; Domain location=157-195; Score =56.0; E_value=1.3e-13; Accession=PF00400.23; Description=WD domain, G-beta repeat
  Pfam annotation: Domain name=WD40; Domain location=199-237; Score =50.5; E_value=5.9e-12; Accession=PF00400.23; Description=WD domain, G-beta repeat
  Pfam annotation: Domain name=WD40; Domain location=241-278; Score =10.8; E_value=1.5; Accession=PF00400.23; Description=WD domain, G -beta repeat
  Pfam annotation: Domain name=WD40; Domain location=30-69; Score=30.7; E_value=5.2e-06; Accession=PF00400.23; Description=WD domain, G-beta repeat
  Pfam annotation: Domain name=WD40; Domain location=73-111; Score =30.9; E_value=4.7e-06; Accession=PF00400.23; Description=WD domain, G-beta repeat
  Pfam annotation: Domain name=eIF2A; Domain location=39-225; Score= -94.7; E_value=0.044; Accession=PF08662.2; Description=Eukaryotic translation initiation factor
  Pfam module annotation: Pfam domain module=WD40::WD40::WD40::WD40::WD4 0::WD40::eIF2A; Domain location=115-153::157-195::199-237::241 -278::30-69::73-111::39-225
MTTKRAYKLRILHLLSSFFVCVCDLAGLDELCPEEFVAHASTVNCLKIGRKSSRVLVTGGEDHKVNLWAIGKPNAILSLSGHSSGIDSVSFDSSEVLVAAGAASGTIKLWDLEEAKIVRTLTGHRSNCTSVDFHPFGEFFASGSLDTNLKIWDIRKKGCIHTYKGHTRGVNAIRFTPDGRWVVSGGEDNTVKLWDLTAGKLLHDFKCHEGQIQCIDFHPNEFLLATGSADRTVKFWDLETFELIGSAGPETTGVRSLTFSPDGRTLLCGLHESLKVFSWEPIRCHDMVDVGWSRLSDLNFHEGKLLGCSYNQSCVGVWVVDISRIEPYALNNVNHLNGHSETKSSSGNMTVLNEITAKARLSVSQNPDQLLKETRSLGRLSVSQDSDPLKEGKCLASTGSAPSTPQRINLNSGPKTVPGGSTTVLNTTAQKKSSLKSHTTSSAPLINKSDIIPVIVPRTSMRSEPVADSRKEVGVSGRTMPFPSQSKAADVRKFPNNRDDVDKPLSPVIESAASKGSELSGFADKNNFPASVSSTQVKQRAHSISTEKATVSATDEDSIADVMEQHDEFLSSMLARSAKLQQGSLNVIKMSTGHGCRKMVFRCWERNDVKEVIGIMARMDDHAVIADVVSIIMEKIDIITLEICAGLLPLLTDLLQSEMERHLGISLEMLLKLVRIFGSVIYSTVSATQPVGVDIEAENRLERCNLCFTELEKVKRFLPSLSRRGGSIAKSAQELNLALQDVS

SEQ ID NO: 151671 - protein, 202 aa, Glycine max
  Coding DNA Sequence Number=SeqID_59986
  Pfam annotation: Domain name=UBA_3; Domain location=135-179; Score= -6.5; E_value=0.1; Accession=PF09288.1; Description=Fungal ubiquitin -associated domain
MKVGTAIEVKMVWYQLLNNECPNEFKEQAHKVLHLKLKVMDEIDKADSSPAMLAMLAKVGIHAPAFSDPQFLCDANSLTYVLGQPKYILYSAKKKLREGGDDFDWNTDDELEIENYNSSSSCLTLPNGDAGEASSSAVLANSKVLDHFVNMGFSREMVSKVIQEYGEENEDKLLEELLSYKLIGGTEWPWTAMGFKLQNGFY

SEQ ID NO: 151672 - protein, 144 aa, Glycine max
  Coding DNA Sequence Number=SeqID_59987
  Gene Ontology: Mol. function=transporter activity; Cellular component= integral to membrane; Biological process=transport
  Homolog annotation: Hit_ID=A9PD12; Match level="QueryCoverage=99%, HitCoverage=44%, E-value=5e-34, Identity=46%"; Hit description =Putative uncharacterized protein
  Pfam annotation: Domain name=TPT; Domain location=31-133; Score=73.9; E_value=5.5e-19; Accession=PF03151.7; Description=Triose-phosphate Transporter family
  Subcellular localization annotation: CTP_CleavageSite=36; ConfidenceScore=5.47e-01
MPTFWVVSSLVPVVGGVALASMTEVSFNWIGFTTAMASNVTNQSRNVLSKKLMTNEEASQGLNVRELCVRSVLAAFCFHAYQQMVSPVTHSVGNCVKRVVVIVSSVIFFQIPVSPVNTLGTGLALVGVFLYSRAKRIKSVQKTN

SEQ ID NO: 151673 - protein, 168 aa, Glycine max
  Coding DNA Sequence Number=SeqID_59988
  Gene Ontology: Mol. function=histone-lysine N-methyltransferase activity; Cellular component=nucleus; Biological process =multicellular organismal development
  Homolog annotation: Hit_ID=A7PM43; Match level="QueryCoverage=70%, HitCoverage=69%, E-value=1e-56, Identity=89%"; Hit description =Chromosome chr14 scaffold_21, whole genome shotgun sequence
  Pfam annotation: Domain name=DUF260; Domain location=10-110; Score =233.9; E_value=3.6e-67; Accession=PF03195.5; Description=Protein of unknown function DUF260
MASSSYSNSPCAACKFLRRKCMPDCIFAPYFPPEEPHKFANVHKIFGASNVSKLLNEVQPHQREDAVNSLAYEAEARIKDPVYGCVGAISVLQKQVLRLQKELDATNADLIRYSACNEMPNLGGRSRMCSDDGGGGGSSSLAHSHGFYYPNWNNDPCGNNNGYPRGDI

SEQ ID NO: 151674 - protein, 2455 aa, Glycine max
  Coding DNA Sequence Number=SeqID_59989
  Gene Ontology: Mol. function=binding; Cellular component=GPI-anchor transamidase complex; Biological process=attachment of GPI anchor to protein
  Homolog annotation: Hit_ID=Q7XZF5; Match level="QueryCoverage=69%, HitCoverage=99%, E-value=0.0, Identity=42%"; Hit description=RST1
  Pfam annotation: Domain name=Gaa1; Domain location=1853-2396; Score= -12.6; E_value=1.3e-11; Accession=PF04114.5; Description=Gaa1-like, GPI transamidase component
MESYGPLLEKTQVPQPALQKLAVDSIFSKLRSAPSHLDPESEPGRRAISQCLASPSPHVVDHSVRHLCRLAADSAVAVPRASLELLSALQGSDPKLVPIFVKGLGFLARHDFRHKNSASQQFTSSTLTHPFVREVQSELLHQVLLFMLQNKDVGMVRVCEFLRPLLNVSIIRLSVSESSLSSSFAMQLVSSMAAFCCSFPHETVPVFKLLIECLKFLPHESSEDYRKLVFVVEHMVEAYIVVLKSLAGKKSNDLGLPWLPGLASTIASLFTIIVQSELEHEQISILKLLLLILKWKYDNDAAISEPKFSLFEETLFLLPVVSLMSSPSKSVKGLATDLLLLLEKLLVKMFVAPKDKPIVKGGDHYLSTPGVIVLRLLRHLWYQRMQEIDVISMYSLAEMPLLLSAVLNVLLIHQSMAAAAVDCLSSIAIMDPKLGVPLLLTIMFYSNIFIRNDINHHDMLGVLLPKGFTNFTSERDICISMAASIRDVCHKSPDRGVDLILSVSSCIESQDPVIKAIGLQSLAFLCEADVIDFYTAWDVIAKHVQGYQDDPILAHSLCLLLRWGAMDAEAYPEASKSVLQILWDVVTYGQGRQWGKARISALEALAQYEVPQLENSIPDFKKMNLELFFSETNPKVLKAMEEFHVKLITYEHINRRRVVKEKRVTGSKIEKLMDVFPQVIFSSGVINKARELPGASLLCFSFPPKDMNEHLASKRLRDVHAGYENALVEVAASQLSRNILLALMALQSWKGFMRRWMKAYTLSYDAKAQSSVLDKTSKAASDILKSMIAIADEAIPRAAENIALAIGALCVVLPPSVHMVKSAASKFLLEWLFQHEHEHRQWSAAISLGLISSCLHVTDHKERYHNITGLLEVLSDSKSSLVKGACGVGLGFSCQDLLTRVETSDTSTVMKETEYVPESVLLGRIIRALATMIQQRTRCSSDVLDSLCSCFPLGSYDMSAKGYEQLSENSEDLEEDIWGVAGLVLGLANSISAIYRAGELETVIKIKNLLMSWLPYLHSLVESSTFQWKESEHVLALGSCIALPTVVAFCQRMELINDVELDRIVVGFKELISELIAVKKSGILHHSLLMASCVGAGTVLSCILNEGVYSIEVERVKCLLELFRKCYLNPFPFLVHLGGMLGVVNAVGAGAGILVNMNFPNYSRQSGYQKESSSVMGPLLSSSDFEPYLTSLVQEMFLVAQNSDNHQLQQFASWVLAFLRHHLWSKELLGVDSDRSVAATNSKSVSQSFSEDNIVLKLSLWLTSFKYTEPGTIVHISRVIAVLRCLSTAPRLPSLDWGSIIRRCMRYEAKVAELLPKDSASKNGTLREECIMFAMAHANQFDSLLTFLDELSDFSRFRTLEINLQSCLLNHLADLVKVYSNSRLEKLFGDVSNHLSSFTSYKESSTYPKSLLCISCWKGLYECLDEVSVDSSGYISHIERCMEVLFTLLPVVQSSGSVSSADVSSVEEWSEAVRCLGKAPQIWLLDFLKVSHEEFVQSAGKSIEVQKKVCAKIKLVKTGSLSLTELGKMKSYILNSKSQGLWDILFEVVAALYHAEGSVKKQWLIDAVEISCVSSFPSTALQFLGLLSAACCKYMPFMIVDQQMVLNDLPVTLVSLLADQNWNAVAETVVSHFFSSTERIYDWSVQIADGSYIPDSQPIDGSENHMAVFLLQVMHHTCVLLKSYLPLDKQLRLASMFSDVVTLSSLSVSLNPNPQPISGILALGFPFGTGQKGSFSSLTPTFSGVVALLLLPILAKNTYISENALMPGSANNMLSTHHVSDANKLIKDLTDLEFRSGASPIDSQKLIAHYMSALDAEVTFHKFYPQFDQFHPLHFFTSPNSGIISENATCSSFGINTVGIIRAPCGDGKEASVLVTPYNPNKVGLGEAFSLGIAYSVFSLLSRVTWLAKDIVWLVADSQYGEYSGVAAWLRAYQAPSIQRLDIVNSETCNGSSIFNELGQGLYLDGKLYGGFRHAGTMAAALVIKVAEQGNQYEDSLNIYAEASNGQMPNLDLINIVNYLAVHKQGLRIKVKKMWSLLGSRWLYTLGVIFESLGKISRSLNPQWKFGIPATEYVEGAATLASSLYYQGLGVPTGPHGAFRDYQVDAITLEISPKVSLTKMIRRNEFILRGGRLIEGVIRSINNLLEKFHQSFFLYLLTSPSKFVSVGVYMIPFALLVAPLPIVAAYLHVNASDSTPQTTSALEVNASPKSWKWLNSARKVLVIHLWGAVISLLPFFLCQVPNTTPTMNFVLWGLLSAFSLLILYMILGSPIFEAAASRPEKNKWASLKSVTISTAFIGLSLMSVINFATAEIGALHIVPICLMARPLKLDFQARSWRTLLRASCNIALGFIVFPPVAFVLLKGAFEDFYGMNFGDYWNWVESLWVWNSATYLYISQDKIVLWNPATRELELIPPALKYKMLHWRMVHGFCYDRVNHDYKEPLSGTKWLLGFDIEF

SEQ ID NO: 151675 - protein, 190 aa, Glycine max
  Coding DNA Sequence Number=SeqID_59990
MAIQAYPVWEELCMTVVELGLRQGFKKIICKSDSQLAIDLILGDNQRGKICDLTHQAASTASCRTTAGFGRGPIQRSQIPANSLILINSTAQSTTDGGLNAEADEVDEAGAGDLGEDLDLIFGGAGAVAAVGAFGGVVFRGAGGDKFGRLDGGEELDGVQGGSIDSAVAALAQEGVGGEAIGGGDDVGNG

SEQ ID NO: 151676 - protein, 84 aa, Glycine max
  Coding DNA Sequence Number=SeqID_59991
MAVSGGDWTEEEEELRVRARAWCVRLSCALVETFIYCNITLSTLTDSVDEQGSIAMSFCNNVIGRPPLAREEKKDLFACNLLKV

SEQ ID NO: 151677 - protein, 135 aa, Glycine max
  Coding DNA Sequence Number=SeqID_59992
  Gene Ontology: Mol. function=peptidyl-prolyl cis-trans isomerase activity; Cellular component=nucleus; Biological process=protein folding
  Homolog annotation: Hit_ID=Q9C8M7; Match level="QueryCoverage=91%, HitCoverage=24%, E-value=5e-54, Identity=79%"; Hit description =Peptidyl-prolyl cis-trans isomerase
  Pfam annotation: Domain name=Pro_isomerase; Domain location=2-135; Score=51.5; E_value=3.4e-13; Accession=PF00160.12; Description =Cyclophilin type peptidyl-prolyl cis-tr
MSVLIVTSLGDLVVDLHTNKCPLTCKNFLKLCKIKYYNGCLFHTVQKDFTAQTGDPTGTGTGGDSVYKFLYGDQARFFSDEIHIDLKHSKTGTVAMASAGENLNASQFYITLRDDLDYLDGKHTKRTVKVKSGQG

SEQ ID NO: 151678 - protein, 116 aa, Glycine max
  Coding DNA Sequence Number=SeqID_59993
MKSGDMRRYPGASKPVDTQRLTSSSAPFVTQGQRVRWQAEIPYGYPHLSLTKANEFDGIGMMLVLLLSSRDNETGDMRRIPYGYPHLLSTKANEFDGFTFFIQRHSSPTMRKILLC

SEQ ID NO: 151679 - protein, 115 aa, Glycine max
  Coding DNA Sequence Number=SeqID_59994
MTRGNPGNLQPFDLEIDRTFHRLVRHSVHPDHSVHFEHSEYSVASDSEYSDFKHFTTNFYTENMAQPPPRERTLREMAAPDFTCESLCIQYPDEGVPYVLKTGLIHLMPKFHGLA

SEQ ID NO: 151680 - protein, 74 aa, Glycine max
  Coding DNA Sequence Number=SeqID_59995
MMTKVMNKKLKRSKNNSSESKNISSESRTSQEFKTQEESLQTRIKIQDSRSQESRSRFKTQDSRIKKGLNQDKY

SEQ ID NO: 151681 - protein, 163 aa, Glycine max
  Coding DNA Sequence Number=SeqID_59996
LENEVRKLGELLVIDYQGIVMEAQLIHDRVEMECLEGAWDTLEGNARFRFRGTIRFTATSLVHPDEPARTLQRTVEWILPTPTPYRLVEPVQVIEVTSSEEDPEEDLEELPPEPAVDALDFLEGDEDPLPEVDSPEEVMSASEADSTEDSGPREMATSGGSSS

SEQ ID NO: 151682 - protein, 117 aa, Glycine max; identical to SEQ ID NO: 102280
  Coding DNA Sequence Number=SeqID_59997
  Gene Ontology: Cellular component=cytoplasm
  Homolog annotation: Hit_ID=Q57MB2; Match level="QueryCoverage=100%, HitCoverage=34%, E-value=1e-55, Identity=93%"; Hit description =Nucleoid-associated protein ndpA
  Pfam annotation: Domain name=NA37; Domain location=3-117; Score= -151.3; E_value=0.024; Accession=PF04245.4; Description=37-kD nucleoid-associated bacterial protein

SEQ ID NO: 151683 - protein, 53 aa, Glycine max
  Coding DNA Sequence Number=SeqID_59998
MAEPSKKRPGSSSTGAAAAHRRHGPSGAPQDLFLLLCHLQDHQHCFLPMISVY

SEQ ID NO: 151684 - protein, 75 aa, Glycine max
  Coding DNA Sequence Number=SeqID_59999
MPHQENHDYEGQDIYSSQDEATTSPSSSQIEEAKGKESSEEIYPQEEGQSLMVKEECKETLVSTVTPLGLEVIPQ

SEQ ID NO: 151685 - protein, 70 aa, Glycine max
  Coding DNA Sequence Number=SeqID_60000
  Subcellular localization annotation: CTP_CleavageSite=32; ConfidenceScore=5.19e-01
MTKVMNKKLKRSKNNSSESKNKSRVQESRRIQDSRRKSTIKSQDSRFKISRFMIKIQDSRFKNEEKTQSR

SEQ ID NO: 151686 - protein, 151 aa, Glycine max
  Coding DNA Sequence Number=SeqID_60001
  Subcellular localization annotation: CTP_CleavageSite=50; ConfidenceScore=5.81e-01
MTSPHASHPPPPPLSPPPSPSTPSDALASPSAVKQTRKFSRLRSLSSRPLGAERPVVHVDPATGKADGPHRKKLRTYLGIVTRDKVDITYENWKETEFEIPEASDSKTKRKLLQTVGERGRQFKSDLTRKWALAADQDGVEDTVCEKYDIS

SEQ ID NO: 151687 - protein, 134 aa, Glycine max
  Coding DNA Sequence Number=SeqID_60002
MSNYKSTESALKNLETQNPKEECNVVMTRNKKPVAVEDEGIVALKEQTVVKDSTGKTNEEVTDAISQRREKQIMVVEKEIKDKEKEIEVGKDKEKKEKQKVEKNKDEEKCRSEKAREKRKEKASEEGTEVPYPV

SEQ ID NO: 151688 - protein, 230 aa, Glycine max
  Coding DNA Sequence Number=SeqID_60003
  Homolog annotation: Hit_ID=A5ASR8; Match level="QueryCoverage=83%, HitCoverage=43%, E-value=4e-07, Identity=25%"; Hit description =Putative uncharacterized protein
  Subcellular localization annotation: CTP_CleavageSite=27; ConfidenceScore=5.34e-01
GTSSTPAATGHRHHGPSEAPTTPIHPSLSSPQSSTIFSSDDQRLRYNSQFSSRIILDPKYLDTNFFNDETFDCYQVFQNSGLVDFMSLKLPYYPELVKVFYSNLKIQDGIISFEVHGISMIIDQSLFFSLTKLPSQGAPFEGTIVDDWKFDYSSHDARRMVCNDQAEMTGRLLAGSLTFHYRIMHYIIVRILLDLILMWAFLTSRQIDWAHLFRYQMHKALRANAPLPYP

SEQ ID NO: 151689 - protein, 253 aa, Glycine max
  Coding DNA Sequence Number=SeqID_60004
  Gene Ontology: Mol. function=2-deoxy-D-gluconate 3-dehydrogenase activity; Cellular component=cytoplasm; Biological process=metabolic process
  Homolog annotation: Hit_ID=P37769; Match level="QueryCoverage=100%, HitCoverage=100%, E-value=1e-132, Identity=92%"; Hit description=2 -deoxy-D-gluconate 3-dehydrogenase
  Pfam annotation: Domain name=KR; Domain location=12-194; Score=-90.4; E_value=0.042; Accession=PF08659.1; Description=KR domain
  Pfam annotation: Domain name=adh_short; Domain location=11-177; Score= 100.0; E_value=7.3e-27; Accession=PF00106.16; Description=short chain dehydrogenase
  Pfam module annotation: Pfam domain module=KR::adh_short; Domain location=12-194::11-177
MILDAFSLQGKVAVVTGCDTGLGQGMAVGLAEAGCDIVGINIVEPTETIERVTALGRRFLSLTADLRKIDAIPDLLARAVAEFGHIDILVNNAGLIRREDAINFSERDWDDVMDLNIKSVFFMSQAAAKHFIAQGNGGKIVNIASMLSFQGGIRVPSYTASKSAVMGVTRLLANEWAKHNINVNAIAPGYMATNNTQQLRADEQRSAEILDRIPAGRWGLPGDLMGPVVFLASSASDYINGYTVAVDGGWLAR

SEQ ID NO: 151690 - protein, 54 aa, Glycine max
  Coding DNA Sequence Number=SeqID_60005
ISFRLLNCSRLLHGRAKISDSRCRNLPFGGRATRDSRDACSTKGIRADSPPTFI

SEQ ID NO: 151691 - protein, 221 aa, Glycine max
  Coding DNA Sequence Number=SeqID_60006
  Gene Ontology: Mol. function=transferase activity, transferring glycosyl groups; Biological process=metabolic process
  Homolog annotation: Hit_ID=A7PII8; Match level="QueryCoverage=37%, HitCoverage=31%, E-value=2e-27, Identity=51%"; Hit description =Chromosome chr13 scaffold_17, whole genome shotgun sequence
DAGSRQARQGASAGVGGCRGWLNYAASEQIVLRVHHMRAIGAGLFAITPAGERGMCCKAIKLGNARVFPVTTLSTLEDPRNTFKELESSVYVSFGSIAAISKTEFLEIAWGLANSKQLFLWVIRPGLIHGSEWLEPLPSGFLENLGGRGYIVKWDQKVNAKYASSVWKVGGRETCRASCINESANARGEAVCVLGALPLPRSLTRCARSFGCGERYQLTQR

SEQ ID NO: 151692 - protein, 137 aa, Glycine max
  Coding DNA Sequence Number=SeqID_60007
MGEVEEVQEQMKADMEAMKEKMATMVEAMMSMKKIMEANTVAIAATSTVVKVNPMHPSDLNQMNHPTSDMVGKDLGSTDDPMMWKFKTRTPSRHMACLLRRMSITPLPYSLKANNLNLIMHMSLNPWGRHMECPTTI

SEQ ID NO: 151693 - protein, 152 aa, Glycine max
  Coding DNA Sequence Number=SeqID_60008
STLEDPPTVERRRGRSVMLKRRIPKCPLDRDEGKDKELRGSSNDIISGYHKWLKSRTQGITWLPKLKSLSGKEVEIFEESEEVKALKVELEKTRVVKEKLKVAITKGPKGRMEQEQGPRGSVDNSNELKLRKAKRDESRMESLVLEDKLKAC

SEQ ID NO: 151694 - protein, 146 aa, Glycine max
  Coding DNA Sequence Number=SeqID_60009
MDPDKSNRALGFPALITGLCQSFGVPVAPTKAAGAPPPPHRAGPAGSFDMEQYLRHLVRQQAANHRAHVQTHDCLYQLSLSMQSQGFASFSCPTPDQFRAGVAWPGDWPEAQAGEAPPEVPDDGEEAHEDEEMADLLDFLGGSGAT

SEQ ID NO: 151695 - protein, 85 aa, Glycine max
  Coding DNA Sequence Number=SeqID_60010
  Homolog annotation: Hit_ID=A7P9F8; Match level="QueryCoverage=45%, HitCoverage=15%, E-value=8e-07, Identity=62%"; Hit description =Chromosome chr3 scaffold_8, whole genome shotgun sequence
  Subcellular localization annotation: CTP_CleavageSite=68; ConfidenceScore=5.22e-01
MEVEVMVPPVDFNFDSNCSSPFITAPSSPQFFAASNKPNFGCINESANARGEAVCVLGALPLPRSLTRCARSFGCGERYQLTQRR

SEQ ID NO: 151696 - protein, 135 aa, Glycine max
  Coding DNA Sequence Number=SeqID_60011
  Homolog annotation: Hit_ID=UPI00006A2D9E; Match level="QueryCoverage =93%, HitCoverage=93%, E-value=2e-11, Identity=17%"; Hit description =UPI00006A2D9E related cluster
GLHALAIGGLHVLTFRGLHILSIRGLHALTFRGLHILAFRGLHILTFRGLHVLTFEGLHAFAFRGLHVLTFGGLHALAFRGLHTLAFRGLRALAFKGRHVLNFRGLHTLTFRGLRVLTFSGLHIHTLREFKVLCP

SEQ ID NO: 151697 - protein, 34 aa, Glycine max
  Coding DNA Sequence Number=SeqID_60012
MEILHRSSSFFVRSSSFFGLQQQNLTDRSHYNHG

SEQ ID NO: 151698 - protein, 56 aa, Glycine max
  Coding DNA Sequence Number=SeqID_60013
MQCLILGVLFVHSSKDVFGTALLGTLFNKYMTVFKAYIHKDTANGPGCCPVSSYLP

SEQ ID NO: 151699 - protein, 105 aa, Glycine max
  Coding DNA Sequence Number=SeqID_60014
MDVLSPTLFAKKVNDPAVKQATVNGPGTRKEVGQSNGTSKNSDHDEILKLIQKSEYKVAESPALLPKTFPQNTPSHRYLPGMRYLKAVPYKYSATMLEGGPGGAI

SEQ ID NO: 151700 - protein, 66 aa, Glycine max
  Coding DNA Sequence Number=SeqID_60015
MHPKFPDEDIMALFEEKRTHEDIDKWIVCFDGASNALGHRVGAVLVSPDDQCIPFTARQSSSSIGM

SEQ ID NO: 151701 - protein, 82 aa, Glycine max
  Coding DNA Sequence Number=SeqID_60016
MEQNVPAKNSTGDHMSNIPFDIMERSTRKGQMEKPSHSKGIQCHDVKVWTHQSPLSNAPTHLKKQEERTFCMSVDDTKDTRK

SEQ ID NO: 151702 - protein, 93 aa, Glycine max
  Coding DNA Sequence Number=SeqID_60017
MPSKVILMMPKNQELSKFQRFNNQVSRIKNQDSRFKESSFKNQDSRIIKIKIQESREDLIKIESQLLMCNRLDLDGNRLDLDGNRLPVTDFEK

SEQ ID NO: 151703 - protein, 143 aa, Glycine max
  Coding DNA Sequence Number=SeqID_60018
MVDTLPVFYYEKLVGYMSSSFVDLVFAGERIEVGLKRGKFDYVSSTSANAKRIGTTGAKGKEGDAHAVSSTPAWVKPPQTPHGTHQYAQHHPSFSAHTGNASSSAPVQPKAPTQREAPQAPTPNTTRPAGNSNAIRNFPPRPF

SEQ ID NO: 151704 - protein, 185 aa, Glycine max
  Coding DNA Sequence Number=SeqID_60019
  Homolog annotation: Hit_ID=A0ST23; Match level="QueryCoverage=24%, HitCoverage=93%, E-value=5e-20, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVTTLIPRAGGFEGSVGDRKKRVVMVMFVKDRRGSGSEVKKRRIRDRVVVVEVYVNRGIGERVEFDVVPDMLTHINCVALTARFPVGKPVVPAALMNRPTRGERRFAYWALFRFLAH

SEQ ID NO: 151705 - protein, 67 aa, Glycine max
  Coding DNA Sequence Number=SeqID_60020
LIVIIWVDDPSVLGFWVDDPAWIGDPEVVEELFLTVGSGRANLNPLHVLCPPLREAPDALGDIRICL

SEQ ID NO: 151706 - protein, 247 aa, Glycine max
  Coding DNA Sequence Number=SeqID_60021
  Subcellular localization annotation: CTP_CleavageSite=33; ConfidenceScore=5.10e-01
MSSPLEGYTSSPSQGTRRAHLQRTTRPYLQMVHALTLKGLQVLAFRGLHVLTFRVLHVLTFRGQHVLTLKGPHALAFRGLHTLTFRGLLVPAFKGLHVLTFRGLHVLTLRVLHTLTIRGLHVPDFRGLHVLSFRTTRPHFQKATRPRLHRGKCPHLQSTTRPRFPRTPRPRFRGATRPPLRTTCPHLQRTTRPRLQRATRSHLQMIHVLTFRWLHAPAFTGLDALTLRGLHVLAFVGLDALPFRGLH

SEQ ID NO: 151707 - protein, 122 aa, Glycine max
  Coding DNA Sequence Number=SeqID_60022
VVYKSKGERKNIELVEEEEARIGADSSSATSIKSEIIRRKQGMQHRSIKQRGSDCSMHSEAEALEHMKKRDTGHQSVSLKNKTRDSTVLKVGDLAKVVIKQDMKGRKHKYEFDNNKREKPEK

SEQ ID NO: 151708 - protein, 278 aa, Glycine max
  Coding DNA Sequence Number=SeqID_60023
  Homolog annotation: Hit_ID=UPI00016621D1; Match level="QueryCoverage =63%, HitCoverage=38%, E-value=1e-10, Identity=32%"; Hit description =UPI00016621D1 related cluster
MRGTVHKPQANLGDKPRDFNGLIKRQTAPLPSLQNGQATKSNRIYTLREFPEGFAKDKIRFPKSSVQSSEFVMTAPLNESISCFLLRVDPWVLVPIAFRGLHALAFRCLHALAFRGLRVLDFRGLYVLAFRGLYVLASRALHVLAFRRQHTLDFRGLRVLDFRGLYVLASRGLHVLPSRGLHVLASRGLHVLTSRGLYVLVFIGLHVLACRGLHVLTFRGLHALAFKGLRVLTFRGLRVLASRGLHVLTSRGLHVLASKGLQVLAFRGLHILDSRGLH

SEQ ID NO: 151709 - protein, 91 aa, Glycine max
  Coding DNA Sequence Number=SeqID_60024
MTMPMLDQFHLCIHDSIENIVDVKVDGSCGYRAIVVLLGMGEDSWSLVHNHLLKELVKWSDEYINLLGGIDKLEELKRSLLVDGLSMVNAS

SEQ ID NO: 151710 - protein, 42 aa, Glycine max
  Coding DNA Sequence Number=SeqID_60025
  Subcellular localization annotation: CTP_CleavageSite=8; ConfidenceScore=5.03e-01
MQEMAPKKLSAKRSRRAPRLKGPVPPPSLIVTVSRALCTSSA

SEQ ID NO: 151711 - protein, 118 aa, Glycine max
  Coding DNA Sequence Number=SeqID_60026
  Gene Ontology: Cellular component=mitochondrion
MSTRGFLHFEDLSDQQKDKVLNAQVKIEKAIEKALPSDGYSRDELSQRNKRDEIRGFLVYCNGKLLSMKTYDSYVKEVELGTHRSQPYKGYPQIITRPVPEMGRGRRSEHVGLLHLTI

SEQ ID NO: 151712 - protein, 101 aa, Glycine max
  Coding DNA Sequence Number=SeqID_60027
  Homolog annotation: Hit_ID=A5BDM5; Match level="QueryCoverage=96%, HitCoverage=5%, E-value=1e-09, Identity=34%"; Hit description =Putative uncharacterized protein
MGGLGIRDLPSLNKALLFKWKWLMFHQPDQLWTRILISMYNGWRGLEYGPRKQYFSTWWADLRAIFQQQNVVSADNQIRWKLGRGDKFLFWEDPWGDEGVL

SEQ ID NO: 151713 - protein, 112 aa, Glycine max
  Coding DNA Sequence Number=SeqID_60028
MNVLSGATLFCKITRAPNIFMVCVHRDPLGSDQGVPTNPKRIKVIPDWPTPPSVEGRSLEYEEPRDLRSNPFQGGGDDAILPPRVLDRRLQEAWARATKEGPRVLMNLRVDF

SEQ ID NO: 151714 - protein, 223 aa, Glycine max
  Coding DNA Sequence Number=SeqID_60029
  Homolog annotation: Hit_ID=Q6WAY6; Match level="QueryCoverage=85%, HitCoverage=35%, E-value=8e-22, Identity=34%"; Hit description =Putative uncharacterized protein
AKARILAGKGEWAPLIDILALLIFGGVLFPNVDGLVDLAAIDAFLADHNDKESPVVAMLADLYDTFDRRHACSLESHRSCTENGGANWDQLLANKEGASINWFPRWKEGRTGVLISCGGFPNVPLMGTRGCISYNLVLAIRQLGYPMRGASLEEEIAPVISRGFNKTNMETLQKVRKAWEVVRKKDKKTQGQTAKRKEVEAPEEDEEVQALRTEFEQAQTGIL

SEQ ID NO: 151715 - protein, 130 aa, Glycine max
  Coding DNA Sequence Number=SeqID_60030
MYNHYEKGTAPDLESVLADFMTYQASSKGDCYSMQQQGTQFGKDYSFEDYQWELEWQPCYHNEAEGLSNLDDLLMEFKGIVDSMQQAFKRAETQIGKLVDDMTKVVVRSEEERIISNWAWIRNWAEPAWT

SEQ ID NO: 151716 - protein, 69 aa, Glycine max
  Coding DNA Sequence Number=SeqID_60031
MNDEERLKIFAKSPTETLRKRLCLDFLHGNNFPHKIGEELATQLAQASQVASSRSNCLLEEESGRPKWA

SEQ ID NO: 151717 - protein, 155 aa, Glycine max
  Coding DNA Sequence Number=SeqID_60032
MESRKRARMEDIPSSSTLAPPSVTVGQDVQGSQTLVPMLQSLFRGQFIIMHSLEELAHNRPIITMEHFLEQVAWLEAQLALVRPSEAAPPEPTPMQVDPKLAYPQSPVVNPLSFPEHEVVPPSLPLIIISDASLDEAATPPHSPAGKTADLPTSL

SEQ ID NO: 151718 - protein, 73 aa, Glycine max
  Coding DNA Sequence Number=SeqID_60033
  Homolog annotation: Hit_ID=UPI0000ECBAF8; Match level="QueryCoverage =56%, HitCoverage=48%, E-value=1e-16, Identity=100%"; Hit description= UPI0000ECBAF8 related cluster
MDAFVCSCLFFVLCSLSRPAGMQAWHWPSFYNVVTGKTLALPNLIALQHIPLSPAGVIAKRPAPIALPNSCAA

SEQ ID NO: 151719 - protein, 63 aa, Glycine max
  Coding DNA Sequence Number=SeqID_60034
  Subcellular localization annotation: CTP_CleavageSite=41; ConfidenceScore=5.23e-01
RAIDAPPPPVEFTSAHPQKGLSIAYTTWPTSRLPSPKPKISKSARSVTNKPSSVQLKTLKKRY

SEQ ID NO: 151720 - protein, 119 aa, Glycine max
  Coding DNA Sequence Number=SeqID_60035
DAGSRQARQGASAGVGGCRGWLNYAASEQIVLRVHHMRAIGAGLFAITPAGERGMCCKAIKLGNARVFPVTTLIPEHLGRWMKSLSMSNIAWSILLNFDVRPNIGHESELIAVVFRLCS

SEQ ID NO: 151721 - protein, 130 aa, Glycine max
  Coding DNA Sequence Number=SeqID_60036
  Homolog annotation: Hit_ID=A0ST23; Match level="QueryCoverage=34%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGEVLGTELEFVIMVIAVSFGKPVVPAALMNRPTRGERRFAYWALFRFLAH

SEQ ID NO: 151722 - protein, 169 aa, Glycine max
  Coding DNA Sequence Number=SeqID_60037
  Gene Ontology: Mol. function=transporter activity; Cellular component= outer membrane-bounded periplasmic space; Biological process=transport
  Homolog annotation: Hit_ID=A4WAB6; Match level="QueryCoverage=100%, HitCoverage=65%, E-value=2e-87, Identity=95%"; Hit description =Extracellular solute-binding protein, family 3 precursor
  Pfam annotation: Domain name=SBP_bac_3; Domain location=1-163; Score =54.6; E_value=3.5e-13; Accession=PF00497.11; Description=Bacterial extracellular solute-binding proteins, family 3
MNITEQRRKSIDFTQPIYRIPSQLVGKAGTAVEATPEGLKGKTIGVLQGSIQETYAKEHWEKQGVTVVSYKDQNMAWGDLLNGRIDASLVMSAAGQAGFLSKPQGKGFGFIGKPVSDDTILGSGIGFGLRKGDEATKKQLDAAIDKVRADGTIAKLADKYFPGIDVSVK

SEQ ID NO: 151723 - protein, 146 aa, Glycine max
  Coding DNA Sequence Number=SeqID_60038
MQTKHILNSPDSDIDTFLEQPNPQLLPSLPHYGSNPKRGIDPTAVDYFDAAISFKRGRINNATHDVDDGQHATFELQNPTSLSLDPGGPSAINNDNHRGEEKQGKRPLFQIDFISKALLEAELGLAQNSDDKADMEPENENVDMRY

SEQ ID NO: 151724 - protein, 101 aa, Glycine max
  Coding DNA Sequence Number=SeqID_60039
MAPEKLSSKRSRRGAAAEGSSAAPEFDSHRFRSAEHQQCFEAIKGWSFHRERCIQLREDEYTNFQEEIARKHWTSRVTPMAKFDLEIVLEFYANAWPIEEG

SEQ ID NO: 151725 - protein, 75 aa, Glycine max
  Coding DNA Sequence Number=SeqID_60040
DRNGQQLKKDALPPQDERTPSPPPQRDDSALMTEVLSALRGLCSYVGERFDSLDTRFAGMDIRLTQLEEDVGYIR

SEQ ID NO: 151726 - protein, 243 aa, Glycine max
  Coding DNA Sequence Number=SeqID_60041
MTSPLNESISCFHKRVDPWVLVPSPSKDYMSSPSEGCTPSPSEDYTSSPSEDYTSSPSEDNTSSPSEDYTSSPSENYTSSPSEGCMPSPLEGYVSSPSEGYMHALRGLRVLTFRGLHALAFKGLHTLTFRILHVLTFRGLHVLAFRGLHALTFRGLHVLTFRGVRAHKTPSGPEEVQQGPGVSRSGYGPPSVLQDARPPPQQGIAPTRQLVDTEKSNRVLVFLALITGLCQFYEAPVAPQQGH

SEQ ID NO: 151727 - protein, 52 aa, Glycine max
  Coding DNA Sequence Number=SeqID_60042
EALIPDDANLTRNGSLDTGYEGYGGFWMTPLPVKEDKSGTELEFVIMVIAVS

SEQ ID NO: 151728 - protein, 165 aa, Glycine max
  Coding DNA Sequence Number=SeqID_60043
  Homolog annotation: Hit_ID=UPI00016621D1; Match level="QueryCoverage =95%, HitCoverage=41%, E-value=6e-13, Identity=35%"; Hit description =UPI00016621D1 related cluster
MVNTLVFRGLLALVFKGLHVLTIKGLHAHAIRGLPILTIRGLHALTFIGLHALTFRGLHVLTFRGLHDLAFRGQHVLAFAFVGLHAHTFRGLHVFAFRGLHVLTFKGLHTLTFRGLHVLTFRGPNILIFRGLHVLIFRGLHVLTFRGLHALTFRGLHVLALRGLH

SEQ ID NO: 151729 - protein, 138 aa, Glycine max
  Coding DNA Sequence Number=SeqID_60044
  Gene Ontology: Biological process=transposition, DNA-mediated
  Homolog annotation: Hit_ID=Q1J7G7; Match level="QueryCoverage=27%, HitCoverage=67%, E-value=3e-10, Identity=68%"; Hit description =Transposase
MVKVGTSYVPINVSYSPKVGPGLGGINRDTRIYLFWEWILFLSAVPPVQLLTGWCVTAKAPPDISAGKCSGRVPFAIQVAQLLGRAIGAGLFAITPAGERGMCCKAIKLGNARVFPIAQTHHGKEEGGTSTLGERSTT

SEQ ID NO: 151730 - protein, 126 aa, Glycine max
  Coding DNA Sequence Number=SeqID_60045
LVNLCCFWKDGDLDLNASPQALDKFLGHVLAFKVRIQSKFKNAVVLRYSKDLDLINAILEMLPDSEACSKIDPSNVDCNDAAHAECQSLSVIADHDPVAGLPLTPKKRMSSDEADDELGSSQISPA

SEQ ID NO: 151731 - protein, 122 aa, Glycine max
  Coding DNA Sequence Number=SeqID_60046
MRLRAHEQFQKRDPGRGLVDLLNDLELALLNNPSYFSERPFTEIFSFAAGIVLGCEHATAVGHAAQPRDIGYLGRQRTDVGGFFLPFAWRRIPPRNCVAVLVWKWNRFNYRGVQGVWGAASL

SEQ ID NO: 151732 - protein, 89 aa, Glycine max
  Coding DNA Sequence Number=SeqID_60047
  Subcellular localization annotation: CTP_CleavageSite=69; ConfidenceScore=5.09e-01
PTKPRPNDFGRKLIGISKHSGKIDSTSSAEFRQSRLCKSNQISLNMFRIAILSPIKFVRQYQSIACLNSCFEVGRARTPVRGTGCFWVF

SEQ ID NO: 151733 - protein, 84 aa, Glycine max
  Coding DNA Sequence Number=SeqID_60048
MYNSIITYIGLHYRAHWQIVFILPKENVVIRFCSLYNRPDNYLKGIINSALKGLGNTPQSKFKAGARWIVVKCNRQKGSTECGY

SEQ ID NO: 151734 - protein, 61 aa, Glycine max
  Coding DNA Sequence Number=SeqID_60049
MFSTNKGWWRLRASFLLWKAHPAKSALSAIPTQEGIALSEKGRPKCNSNPRGNCAERELAR

SEQ ID NO: 151735 - protein, 142 aa, Glycine max
  Coding DNA Sequence Number=SeqID_60050
AEFDIPEVYDQRTKRKILQIVGERWRQFKSDLTSKWALADDKESVDDTVCQKYDINKEKWAQFCQSRRDPSWEAAKQIADKIASQGSFVAHGRQDVLIAAIGQPEHPSRVCAAGASVTIKQYFGLDPRTSRTSSSMAPEDLE

SEQ ID NO: 151736 - protein, 228 aa, Glycine max
  Coding DNA Sequence Number=SeqID_60051
  Gene Ontology: Mol. function=RNA-directed DNA polymerase activity; Biological process=regulation of transcription, DNA-dependent
  Homolog annotation: Hit_ID=A5AL87; Match level="QueryCoverage=85%, HitCoverage=4%, E-value=2e-33, Identity=39%"; Hit description =Putative uncharacterized protein
MEPKYWDKNPFKATAKKFSAPFDPAGYNYWDYIDAWTNVFWHQNSKFKHSWLIYFKNNTVYNFPNWFLQWWNYFGPIPQIFPEEVQQGFQQFNKLFNSKESRIPADLKYFSSFALSWIFSWQYKYGKTENCKQYPPLQRHAFVKWWSQFDTSKAAPDQVKNWFQSNPEFLKPADPETSLFLNQKSQLAAFLASSKSKESLAQNLKEVLQLLQQEEDEDPQKRRPNHQK

SEQ ID NO: 151737 - protein, 36 aa, Glycine max
  Coding DNA Sequence Number=SeqID_60052
RGAGSGICVDVGGILGISVEEEGGSVEEEGPPVSGA

SEQ ID NO: 151738 - protein, 213 aa, Glycine max
  Coding DNA Sequence Number=SeqID_60053
MINDGTYEFGDPTVMWLRMPPDSWVTVTKSGVVDKSRTFAPMYPQFVMRELRTYVVLDSCETKNSLGVFFTKMRTCFSKETKLPTDQSNICFWMKNNVSIGEGDIFISKRPFRGNTGSNKDRRKSLKVYQSHTVRGEKVTSAQDFVGNQRERTTLGPGQGLTFSPWVKVYDKLGFWLKACRTAGHDYMPGFGQRFGDKGDVLHYFHDTCNNDD

SEQ ID NO: 151739 - protein, 99 aa, Glycine max
  Coding DNA Sequence Number=SeqID_60054
MYMMRLSALNEYGIGVIDILIGSVCHIGWCIVGKQAIWWEDMLVLNLRIMGAAHGDIGFRLIMASIIVAICSFMAFMSAFIYFCTSSTSPITLALARVR

SEQ ID NO: 151740 - protein, 217 aa, Glycine max
  Coding DNA Sequence Number=SeqID_60055
  Gene Ontology: Mol. function=oxidoreductase activity; Cellular component=cytoplasm; Biological process=metabolic process
  Homolog annotation: Hit_ID=A4WA81; Match level="QueryCoverage=88%, HitCoverage=39%, E-value=6e-89, Identity=84%"; Hit description =Fructuronate reductase
  Pfam annotation: Domain name=Mannitol_dh_C; Domain location=1-174; Score=168.3; E_value=2.1e-47; Accession=PF08125.4; Description =Mannitol dehydrogenase C-terminal domai
MKLRMLNGSHSFLAYLGYLAGYQHINDCMEDEHYRIAAHALMLNEQAPTLKVKGVDLGRYADLLIARYSNPALRHRTWQIAMDGSQKLPQRMLDSVRWHLVHQKPFPLLALGVAGWMRYVGGVDEQGNAIDVSDPQLAVIQAAVKGSAEGESRVKALLGIEAIFGKELPREAVFVDAVMKCVPDAAAKGCESDRGTVRVSTVIQHMPPFAAACLRTV

SEQ ID NO: 151741 - protein, 90 aa, Glycine max
  Coding DNA Sequence Number=SeqID_60056
MDIFEDTDIPVILGRPFMLTASCIVDMGKRKLELGFEDQKIDFDLFVEDKPAPEHNVCLQVMEGGQEVLKPRTKRIFGHALSHESQALSA

SEQ ID NO: 151742 - protein, 65 aa, Glycine max
  Coding DNA Sequence Number=SeqID_60057
MASSSSSSSHVNIKSGPIDADVLWMQPKHVSEYVWNGEEDRKLHIRRVVPTYKCGWFTINRSNKS

SEQ ID NO: 151743 - protein, 193 aa, Glycine max
  Coding DNA Sequence Number=SeqID_60058
MDEVEELQEKMKADMEAMKEQMATMMEAMMSMKKIMEANAVIVAATSAVAKVNPMLPSGLKQMNHPTSNMVGKDLGSTDDPMRCKFKTSTPSHHMACLPTIHHPMWHTLSMKISITPLRYSLRTNNLIRAHISQTMGKTHEIPHLNLADFEPWLGYATEGQAVGGVPFENTLESPQFRPQPQPLHFCGGKSPS

SEQ ID NO: 151744 - protein, 177 aa, Glycine max
  Coding DNA Sequence Number=SeqID_60059
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIGWGSSRVDLQACGAWHWPSFYNVVTGKTLALPNLIALQHIPLSPAGVIAKRPAPIALPNSCAA

SEQ ID NO: 151745 - protein, 109 aa, Glycine max
  Coding DNA Sequence Number=SeqID_60060
MWMDRFALTLNGSQELPRLLAKAKAMADTYSAPEEIHGLLGYWKNTITKRATRHPYRTRSKSRTMGDQEETQEQMKADMSALKEQMASMMEAMLSMKQLIEKNAATAAA

SEQ ID NO: 151746 - protein, 135 aa, Glycine max
  Coding DNA Sequence Number=SeqID_60061
  Homolog annotation: Hit_ID=Q2QVF2; Match level="QueryCoverage=53%, HitCoverage=8%, E-value=6e-08, Identity=38%"; Hit description =Transposon protein, putative, CACTA, En/Spm sub-class
  Subcellular localization annotation: CTP_CleavageSite=20; ConfidenceScore=5.49e-01
MASPPTSPPPPPAPSNELASSSAVKRTRKASHLRSLSTRPPGAERPVVHVDPATDKTDGPHRKKLRTYLGIVVRDKVDVTYENWKDVPTAQKDLIWEDIQAEFEILEASDSRMKKKLFQTVGKRRRKFKSDLTRK

SEQ ID NO: 151747 - protein, 106 aa, Glycine max
  Coding DNA Sequence Number=SeqID_60062
MAAMMEATMSVKKMMEANEVAIAATSVLAKVNLMSPSGINQMNHPTSDMVGKDLGIGGIPLENTSEGPQYHPQLHLLHSTTSKNPHAMAEMGKLDHLEERLRAIEG

SEQ ID NO: 151748 - protein, 118 aa, Glycine max
  Coding DNA Sequence Number=SeqID_60063
  Homolog annotation: Hit_ID=P03851; Match level="QueryCoverage=71%, HitCoverage=100%, E-value=4e-44, Identity=98%"; Hit description =Uncharacterized 9.4 kDa protein
  Subcellular localization annotation: CTP_CleavageSite=11; ConfidenceScore=5.13e-01
VDSRGPPALGRSAAASGISSLKGGNTVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 151749 - protein, 80 aa, Glycine max
  Coding DNA Sequence Number=SeqID_60064
MGAKHLKMTKYKLHATKPRSPDEIRIAKRNVYTDNHSGISACQRDSKVSMTDLVSAEDDVNLRVSTGLSAATDEGRRRRR

SEQ ID NO: 151750 - protein, 225 aa, Glycine max
  Coding DNA Sequence Number=SeqID_60065
MWMDRFALTLNGSQELPRLLAKAKAMADTYSASEEIHGLLGKNTITKRAIRHPYRTRSKSRTMGDQEETQEQMKADMSALKEQMASMMEAMLSMRQLIEKNAATAAAVSSAAEADPTLLATAHHPPSNIVGRGRDTLGHDGSPHLGYNRVAYPYGLPPNYSPPVLQEDAGHIASPVLEREPPQQPDEVHKDPQDYARRDVEFYPPIPEGPAPGTLPQPNIAAPPI

SEQ ID NO: 151751 - protein, 104 aa, Glycine max
  Coding DNA Sequence Number=SeqID_60066
MASMMDAMLGMRQLMENNAATAATVSSAAKADPTLSATVHHPIPNVVGQERSTLRHINNPHPGYNRVAYPYGLPPNYTPPVIRDDAGHVPAPILEGEPPRQLDE

SEQ ID NO: 151752 - protein, 85 aa, Glycine max
  Coding DNA Sequence Number=SeqID_60067
MKYAIKHCVIDYTCLELACLGTSQVLPDRLCPGWVGIGQAWFWAIAPHLTSPRSPDPRDISPGTTLWSTIKAGSFTLRHFLISSL

SEQ ID NO: 151753 - protein, 103 aa, Glycine max
  Coding DNA Sequence Number=SeqID_60068
MDKSLKVGEDEWREERRSTKFYASKEQWFSLLIQDQVQDSPLSVLRCHEASHGPKIYPKAHENPRAFSCISGLIFLESSFQCPYGVGLHQIISLRHTNWFAKD

SEQ ID NO: 151754 - protein, 94 aa, Glycine max
  Coding DNA Sequence Number=SeqID_60069
MARNVFASCPYFRDLHGRELKGLLVIIPKVVISLLMVSRVESPTVATYPSAGGRRETHGCIFQGRKTRGIATNVYSRKTLEKPEKAGSTNFKCE

SEQ ID NO: 151755 - protein, 198 aa, Glycine max
  Coding DNA Sequence Number=SeqID_60070
  Subcellular localization annotation: CTP_CleavageSite=22; ConfidenceScore=5.04e-01
HHCHGTSGDPPTPIPHSLSSPRSSTLFSSIDQRQRYHSQFCNRIILDPKYLDLEFFDGETFDYFQVFQNSKLVEFMSLKLPYFPELVRVFYNNLKIQDGVLYFEVHKIPIIVDQSLFYSLTKLPSQGVPFEGTLVDDWKHDYSSHDAQKMVCNDHADMSGKLLAGSFTFDYRIMYCIICRILLPRSTNLSQASEEGIL

SEQ ID NO: 151756 - protein, 61 aa, Glycine max
  Coding DNA Sequence Number=SeqID_60071
KRKSAQYANRLSPRVGRFINAAGTTGFPTGKRAVSATQLIYDHDYEFELGTVKAEADKDRD

SEQ ID NO: 151757 - protein, 94 aa, Glycine max
  Coding DNA Sequence Number=SeqID_60072
MDTYVSPWTAQITETKVTKASETKDIELVEEEQARIGADPSSGTSNKSENYKEEARKKTQKHKPKRVESVNADAKAFGDDWKILIALCIVKLKQ

SEQ ID NO: 151758 - protein, 148 aa, Glycine max
  Coding DNA Sequence Number=SeqID_60073
MATHLGIELQLRTCVKLLLYFSLIFEGLSAVTIPQDSLVLTLHRLTRLRPQFETGNQSLRSDLYFGLCIIDHGQSPHGHVIGPRHFSGLKESTLTIYPAATSPKIGGIELSLGLARFTVPVVYTHSNLAVLFRDWDNIGHPFWVSSYS

SEQ ID NO: 151759 - protein, 88 aa, Glycine max
  Coding DNA Sequence Number=SeqID_60074
  Homolog annotation: Hit_ID=A5BEV8; Match level="QueryCoverage=75%, HitCoverage=8%, E-value=1e-08, Identity=43%"; Hit description =Putative uncharacterized protein
MNLFGGIKRFEQLKLSLLVDGFSKVSVDKWMDITEMGYVIASWYNVILVSLSRQQSMTFFPLRSQPPPDSSGHHMICVGHVFGNHFVQ

SEQ ID NO: 151760 - protein, 196 aa, Glycine max
  Coding DNA Sequence Number=SeqID_60075
MTRGDKIWSFRTLCHSDTAVSDGAQRQNLVIRHPLSSRGGESDDTRRQNLVIPHPFAIQTQLCPMARRDKIWSFCTLCHPEAAGPMTRGDKIWSFRTPLPFRHSRVRWHAETKFGHSAPFCHPEAAGPMTCGDKIWSFRTPFPFRHSCRQRARWQAKANVVILHPSSIAADKPVDTRRFTSSSALTRSVILTFESC

SEQ ID NO: 151761 - protein, 262 aa, Glycine max
  Coding DNA Sequence Number=SeqID_60076
  Homolog annotation: Hit_ID=A0T4R2; Match level="QueryCoverage=36%, HitCoverage=64%, E-value=7e-11, Identity=41%"; Hit description =Lysozyme
QHPDVMRFVAEDRPVADIRAAFEARLTPWTPGSAHWLCLVVRDALTGFRWASPAIFIGRRIAQKSVFFSHPRRREKATASNPCRRSAAMPLKKAAYADSPPPLPPGMSPQDVCWKKFGFASKANYARAITWRGAGRMTGYLGLSLEKYRDEHGLWVIGYGHVIRDREQFHGPVTPLEADALLHEDIRLCEALLRENVTRPLTQQQHDTLVMMMFSFGEIPSLPEAIFQAVARPPEKRLQMRFYRGRTDVEVAPNLFVSLGIL

SEQ ID NO: 151762 - protein, 25 aa, Glycine max
  Coding DNA Sequence Number=SeqID_60077
KAKLTLCAKPECYSVEAELSASMLR

SEQ ID NO: 151763 - protein, 109 aa, Glycine max
  Coding DNA Sequence Number=SeqID_60078
  Subcellular localization annotation: CTP_CleavageSite=63; ConfidenceScore=5.34e-01
MSDGDVGFTLATALVAATATALASIIFFMLIMASIIVVICSFMASMSASVATYPSAGGRRETRGMRVPRKEYARSRHQRLFEENVGKTGKDAIYELLSERFGSCIYARG

SEQ ID NO: 151764 - protein, 192 aa, Glycine max
  Coding DNA Sequence Number=SeqID_60079
  Homolog annotation: Hit_ID=UPI0000ECC274; Match level="QueryCoverage =21%, HitCoverage=50%, E-value=4e-13, Identity=85%"; Hit description =UPI0000ECC274 related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPGNYRLESNPVRHDLSPLAAATGNRISRA

SEQ ID NO: 151765 - protein, 194 aa, Glycine max
  Coding DNA Sequence Number=SeqID_60080
GTSTWVVVTENKRGYISCGSVQVEDTSTWLLQREQGRVHPLWIFKGFYKVEKKSQGPQVAWGLDVGTGTVLKQQSCLAIVDSMEFFELNPIFQNPKSMSYSVLPLQLGVGLAFGGLICKDKSESGNSMVFSLVGVLVSGRHREGVGVDEDGGEGEGTLERAGLAMSIYMDGHDLASVQPWVVGDVLDLLFRKSM

SEQ ID NO: 151766 - protein, 61 aa, Glycine max
  Coding DNA Sequence Number=SeqID_60081
  Homolog annotation: Hit_ID=A6FJQ2; Match level="QueryCoverage=62%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARDCIKKVMGRGD

SEQ ID NO: 151767 - protein, 48 aa, Glycine max
  Coding DNA Sequence Number=SeqID_60082
ARLTGALSKGGKVRGVATNVDKSGAFAPTYPPLERKSDLRSSSLSVNR

SEQ ID NO: 151768 - protein, 105 aa, Glycine max
  Coding DNA Sequence Number=SeqID_60083
MARFLSVLNMELRYKDTTSSPSSSGSKDGVRGEESSEALMEKDKAPEWRRMKAQSSLLNQSQTYQGNPYGVYPDLSTFTGSGIIQISIACIKRSAPTQVHIKKAP

SEQ ID NO: 151769 - protein, 109 aa, Glycine max
  Coding DNA Sequence Number=SeqID_60084
  Homolog annotation: Hit_ID=A5AM14; Match level="QueryCoverage=93%, HitCoverage=15%, E-value=1e-09, Identity=38%"; Hit description =Putative uncharacterized protein
MQKRFTHIVNHLASLGKTFQNEDLVNKVLRCLNREWQPKEHEMELLRLNQHEETDKKKKGIALKASSAIHEDSDKEDSIDLDNDEDISLFCKKIQQVPESQRKSKATQF

SEQ ID NO: 151770 - protein, 86 aa, Glycine max
  Coding DNA Sequence Number=SeqID_60085
MGKRKLELGFEDQKIDFDLFVEDKPTLEHNVCLQVMGEAYPWLSGTYCRQVQFLMALIEVHDVKRQSWQLSEIHCGNMSAKRVPLS

SEQ ID NO: 151771 - protein, 229 aa, Glycine max
  Coding DNA Sequence Number=SeqID_60086
  Homolog annotation: Hit_ID=UPI00016621D1; Match level="QueryCoverage =61%, HitCoverage=28%, E-value=3e-08, Identity=31%"; Hit description =UPI00016621D1 related cluster
VLAFRGLHALTFGGLHVLPFRGLHVLAIIGLHTLPFKGLHALAIRGLHALTFKGQHVLAFRALHVLIFRGLHVLAFRGLHILGFRRIHVLAFRGLHIHAVRGLHVLAFRGLYVLAFTEDYTSSPTEGYTSSAFRGIHILTFRGCHPRLQRATRPPLQRTTRPRLQRSYMHPHLQRTTLPRLEDYTFSPSEDYTSYAVRGLHVLAFRGYTPSPSIRVLPLEDYTPSLSED

SEQ ID NO: 151772 - protein, 202 aa, Glycine max
  Coding DNA Sequence Number=SeqID_60087
MKAQVEKDEGPEAKALSRQLMLLKAQTNLKAQTYQGNPCGVYPDLSSFTGSGVYPDLSSFTGSGVYPDLSSFTGSGVYPDLSSFTGSGVIQTFVACIKRSTPTQIDWAHLVRYRMLKALRANAPLPYPQLITLFLRHFQIPFDDEPFVQVKRSFAIGAGAVTSFGYRKDRNVQWLKKDALPPQDERTPSPPSQREDSTLMNE

SEQ ID NO: 151773 - protein, 81 aa, Glycine max
  Coding DNA Sequence Number=SeqID_60088
MKKDCYNQKQGQTCCSRLHSLKAQEAELCVPIYAEAEYIAAGAAVHKSVWMKVQSCLSRSIGRGGIDKTLFVEQDVMTLSL

SEQ ID NO: 151774 - protein, 81 aa, Glycine max
  Coding DNA Sequence Number=SeqID_60089
MASKKRKTPTTPSQVRYDRSKFTSLEAWERYTDIVVPRKILPEWNMVIYHTEFDEFKEELDRRKWDEELTSFDEGIIDVAI

SEQ ID NO: 151775 - protein, 48 aa, Glycine max
  Coding DNA Sequence Number=SeqID_60090
MVKKRLSFEMPKVPSARLSARLALSPIPLTYAKREGGAKRKVANSKPI

SEQ ID NO: 151776 - protein, 20 aa, Glycine max
  Coding DNA Sequence Number=SeqID_60091
MGMASIKFGIVAGEQWAKGS

SEQ ID NO: 151777 - protein, 241 aa, Glycine max
  Coding DNA Sequence Number=SeqID_60092
  Homolog annotation: Hit_ID=Q2HW90; Match level="QueryCoverage=91%, HitCoverage=44%, E-value=1e-26, Identity=32%"; Hit description =Putative uncharacterized protein
MGSSQTPSLKKRFYQVKFKSLGITSLKELGQLMGQLQRQAFRKAYGKIWDLAMVEVSTEAIASLAQYYDQPLRCFTFGDFQLSPMVEEFEEILGCPLGGRRPYLFSGFYPSLARISKIVQISVQELDHRKQVENGVVGIPRKYLEAKARILAGKGEWAPFIDILALLIFRGVLFPNVDGLVDLAAIDAFLAYHDHKESPVVAMLTDLYDTFDRRCEKSSTRIVCCTPALYVWLVLHLFHQE

SEQ ID NO: 151778 - protein, 146 aa, Glycine max
  Coding DNA Sequence Number=SeqID_60093
MTDPLDESISCFLIRVNPWRAACPHLERTTRPRQQRAAHPHLERTTRPRQQRAARPHLQRTTCPRLERATRPHLGGLHVLAFKGSCTFNFRGLHVLAVKGSCAFTFVGLHALTFRGLHVLTFRGLHVLAIRGLHVPHFQRGTCPHL

SEQ ID NO: 151779 - protein, 117 aa, Glycine max
  Coding DNA Sequence Number=SeqID_60094
  Subcellular localization annotation: CTP_CleavageSite=77; ConfidenceScore=5.03e-01
MPERQHVMYYTLPTFTQEPSQMPPMYSYPHDFQPGYSFAGIFGSSPPSTGTPSFTQSGQLSTPNAPLAGVNLRHDFSAEADQVDERANRKRKNPDRVARNWDRPCGTSSRHHKHSDD

SEQ ID NO: 151780 - protein, 219 aa, Glycine max
  Coding DNA Sequence Number=SeqID_60095
  Homolog annotation: Hit_ID=Q6WAY6; Match level="QueryCoverage=56%, HitCoverage=20%, E-value=2e-11, Identity=32%"; Hit description =Putative uncharacterized protein
MARVAKVVKISVQELDHVKQSRNGIIEIPSKHLEGKAKALADQGEWASFIDVLALLIFGVALFPNMEGLVNLATIDAFLAYHHSKESPVVTILVDLYDTFDRRCEKSGAKIVCCMPTLYVWLVSHLFRQESRPTCPLRGAEALEESKEVQALKAELERARAVKEKFNSTAIKFRKEYDELRDINMATTKALEQETKRARKGRTWPEQVPRSFMGQQQRA

SEQ ID NO: 151781 - protein, 138 aa, Glycine max
  Coding DNA Sequence Number=SeqID_60096
MEGLVDLAAIDAFLAFHHGKESPVVAILAMYDTFDRGCEKSSARIVCCALALYVGPSIRYKVTARASKRERVIDSLHQETTMWMDRFALTLNRSQELPPLLAKAKAVANTYSAPEEIHGLLSYCQHMIDLMDHIIGNH

SEQ ID NO: 151782 - protein, 304 aa, Glycine max
  Coding DNA Sequence Number=SeqID_60097
  Gene Ontology: Mol. function=transferase activity, transferring nitrogenous groups; Cellular component=cytoplasm; Biological process= amino acid metabolic process
  Homolog annotation: Hit_ID=A8GK99; Match level="QueryCoverage=100%, HitCoverage=82%, E-value=1e-147, Identity=80%"; Hit description =Aromatic-amino-acid transaminase
  Pfam annotation: Domain name=Aminotran_1_2; Domain location=1-300; Score=244.4; E_value=2.4e-70; Accession=PF00155.12; Description =Aminotransferase class I and II
MEGLQPYRSAIQQLLFGAQHPMLQQGRIAPIQTVGGSGALKVGADFLKSYFPDSQVWVSDPTWENHVAIFSGAGFKVNTYPYFDSESLGVKFDAMLAALKQLPKHSIALLHPCCHNPTGSDLTPAQWDEVVKVIAEREIIPFLDIAYQGFGGGMEQDAYAIRAIAAAGLPCCEEAAGRVLGQLKATVRRNYSSPPNFGAQLVAKVLNDAQLKTQWLDEVESMRTRILEMRHALVDTLKSALPQRNFDYLLAQRGMFSYTGFSAAQVDRLREEFGVYLIHSGRMCVAGLNHNNVRQVAEAFAAVQ

SEQ ID NO: 151783 - protein, 17 aa, Glycine max
  Coding DNA Sequence Number=SeqID_60098
MAIEGFTMRRKVKDRKG

SEQ ID NO: 151784 - protein, 241 aa, Glycine max
  Coding DNA Sequence Number=SeqID_60099
  Subcellular localization annotation: CTP_CleavageSite=35; ConfidenceScore=5.16e-01
MDMNIGALILGQISSIAQSNSSKLGFSALITTFCRGRGVTSDSLTYESLSPAINFAYIKKNCWNVDDLTINFRGVRKARARPASVPSSSTPPASSTFATPTPAPSGPSAQDSQRFKSMLQRTILTVEQFMEKVAWPGTQPSLVRKGGAPSAQVPQQVDHASLEATIPEPFVFKEGGTQQLADPPTPVHEMPADPSTPLLEILEDLSTLVLGLTTTPPATPMLHFIDEEGTQDQDTQQDDQS

SEQ ID NO: 151785 - protein, 161 aa, Glycine max
  Coding DNA Sequence Number=SeqID_60100
  Gene Ontology: Mol. function=motor activity; Cellular component=cell projection
  Homolog annotation: Hit_ID=UPI00016621D1; Match level="QueryCoverage =100%, HitCoverage=40%, E-value=1e-15, Identity=35%"; Hit description= UPI00016621D1 related cluster
MIGTSTLIFRGLHALAFRGLHVLAVRGLHVLTFRGLHVLAIRGLHVLAIRGLHILAIRGLNALAFVGLHALTFRGLHVLTFRGLHVLTFRGLHALTFRGLHVLYFRGLHSLAFIGLHALTFRGLLVLTFRGLHVLTYRGLHALTFRGLHVLHFRGLHVLAF

SEQ ID NO: 151786 - protein, 82 aa, Glycine max
  Coding DNA Sequence Number=SeqID_60101
  Pfam annotation: Domain name=zf-CCHC; Domain location=10-27; Score =10.8; E_value=0.035; Accession=PF00098.14; Description=Zinc knuckle
KRGEDSSSVPKCYESNQPGHLRVDCLSFKKRMERSERKTFNAKKAKKSYITWEDNDMDSCEDSKNEVVNLSLMAKNYESDEE

SEQ ID NO: 151787 - protein, 111 aa, Glycine max
  Coding DNA Sequence Number=SeqID_60102
  Gene Ontology: Mol. function=ATP-dependent peptidase activity; Biological process=ATP-dependent proteolysis
  Homolog annotation: Hit_ID=A7NT45; Match level="QueryCoverage=73%, HitCoverage=27%, E-value=3e-20, Identity=69%"; Hit description =Chromosome chr18 scaffold_1, whole genome shotgun sequence
MTMITNSSSVPEDRPSEINVGGDDVEGLAREVEGYMKDVIRLSNRLGGKKGENKEIGNLRRNLFPTPFSFFVGSTFEGAPREQQALLELGGSSRVDLQACKLGTGRRFTTS

SEQ ID NO: 151788 - protein, 88 aa, Glycine max
  Coding DNA Sequence Number=SeqID_60103
LHDVQFVAKLMNLDVVSLMKSKLHMKSIIWGINPEAISIQVDFQDFRTTSSIYGRDSGKITLVTNSRETRQVHLQGHYNRCQVSMTEP

SEQ ID NO: 151789 - protein, 172 aa, Glycine max
  Coding DNA Sequence Number=SeqID_60104
  Homolog annotation: Hit_ID=Q2AA09; Match level="QueryCoverage=40%, HitCoverage=25%, E-value=2e-08, Identity=44%"; Hit description =Retrotransposon gag protein
  Pfam annotation: Domain name=Retrotrans_gag; Domain location=76-170; Score=44.9; E_value=2.8e-10; Accession=PF03732.8; Description =Retrotransposon gag protein
MQRRSTAGGLIPIDLEINATCRRRNTDRIRKILQDLEAATTPEEEPRSFEVSSSFPIPGKSHTDLIEEVIIAEESRRVTLEDYSSSSVPQFFTSIPQPETWDEVVEKLLKKYFPKSKTAEGKVAISSFHQFPDESLSEALERFCGLLRKTPTHGFSEPIQLNIFIDGLRPQS

SEQ ID NO: 151790 - protein, 95 aa, Glycine max
  Coding DNA Sequence Number=SeqID_60105
  Gene Ontology: Mol. function=aspartic-type endopeptidase activity; Biological process=RNA-dependent DNA replication
  Homolog annotation: Hit_ID=A5BFN6; Match level="QueryCoverage=87%, HitCoverage=14%, E-value=2e-10, Identity=41%"; Hit description =Putative uncharacterized protein
VDSRGSPAYENSKIYKEKTKKFHDSLIAKKDFVVGQKVLSYNFRLGLMSVEIKSESTDKGFKVNGHRLKPFLTNPSLVDVVVEETSLLHPTSLPP

SEQ ID NO: 151791 - protein, 57 aa, Glycine max
  Coding DNA Sequence Number=SeqID_60106
MPYVEAAEESLETAFQSFEVPCLSDATIMMARVMLGNGYGPGMGLGKDNGGITNLIN

SEQ ID NO: 151792 - protein, 69 aa, Glycine max
  Coding DNA Sequence Number=SeqID_60107
MACDSLEEQASQGSFVARGRQDVLVAAIERPEHHGRVRVAGVSVMIKQYFGLARHFAIECTLANGHHFA

SEQ ID NO: 151793 - protein, 96 aa, Glycine max
  Coding DNA Sequence Number=SeqID_60108
MAPRKLSAKRSRKDIAAEGTSAAPKFDNHRFRSAKHQQRFEAIKLDVVILTGERPCMPPTRHPLDPDKSNRALGFPALITGRLPSFGQVAQVTPRR

SEQ ID NO: 151794 - protein, 80 aa, Glycine max
  Coding DNA Sequence Number=SeqID_60109
MAEIDQGKTMTGHDWSHIIWFLLAGSRRQTLARKGAGDMVSSLGRAELAWASNPCTQILKNEGGEHFGIQKLPPPPSFKR

SEQ ID NO: 151795 - protein, 185 aa, Glycine max
  Coding DNA Sequence Number=SeqID_60110
  Homolog annotation: Hit_ID=A7UQU7; Match level="QueryCoverage=61%, HitCoverage=20%, E-value=1e-20, Identity=45%"; Hit description=IMP dehydrogenase/GMP reductase, putative
  Pfam annotation: Domain name=DUF1723; Domain location=108-157; Score =54.8; E_value=3e-13; Accession=PF08330.1; Description=Protein of unknown function (DUF1723)
MPTTSTHRQQEVAPVAEDDLVLTKDVHAHAEEAIDDAEGFPGGPRDLSVLTDYGDHVAVIVWNDEERPELKLSSHGRKVLKFGRPAPEIEGLVAITGLSPLIACSVDTGDRGLISTFVERWHKETSSFHLPVGELTITLDDVVSLLHLPIIGAFHSFEPLHVDEAVLMLVELLEVSREEARAETT

SEQ ID NO: 151796 - protein, 86 aa, Glycine max
  Coding DNA Sequence Number=SeqID_60111
MAILGPLRSSIGACRPRIFFINGFLCFLEDEWQRNGERKRERRCHFKEKMSLEEAHHHRRSQIRAWRKKEMNEGRGREEHEILCSK

SEQ ID NO: 151797 - protein, 110 aa, Glycine max
  Coding DNA Sequence Number=SeqID_60112
MPSELDLSPFRALTAASDCTESHCGVNAYWRKYRSSAPFLAHCSGCAIGRSGTAAMRCGPHFKGGNYGTSWQNQGDVNARDKNMWVKTPAKGFPANRKRGQPSCMRRFFD

SEQ ID NO: 151798 - protein, 51 aa, Glycine max
  Coding DNA Sequence Number=SeqID_60113
  Subcellular localization annotation: CTP_CleavageSite=32; ConfidenceScore=5.07e-01
MGKRALCPDVLQHNIPKSSSPSHLLPRTQSSRSSQDPNTNSKLGVSYHIPN

SEQ ID NO: 151799 - protein, 84 aa, Glycine max
  Coding DNA Sequence Number=SeqID_60114
  Subcellular localization annotation: CTP_CleavageSite=47; ConfidenceScore=5.01e-01
MKWKCCKDLVLAKFDIAEATKVKTKVMSTVATRWRQFKSTLTSKFVFAKSEGQQTQDVVTKYGLDPEAWKQFEETRLTPNWEVS

SEQ ID NO: 151800 - protein, 119 aa, Glycine max
  Coding DNA Sequence Number=SeqID_60115
MGLRKRGREWRIALSNHYAWLQTRVGGGCMNENAIHGDSEKGVRMENCNKQSLRMTPNSWVEDASNENAIHGAPKKVENGELLLSNHYAWLQTRGWRMHERKRSSWGSEKRGVENGELH

SEQ ID NO: 151801 - protein, 93 aa, Glycine max
  Coding DNA Sequence Number=SeqID_60116
MAKFDPDIVLEFYANAWPTEEGVRDMRSWVRGQWISFDADAISQFLGYPLVLEEGLECEYGQRRNRSDGFDEEAIAHLLCIPGQDFARTVPGD

SEQ ID NO: 151802 - protein, 182 aa, Glycine max
  Coding DNA Sequence Number=SeqID_60117
MIDVGVHSVISLILAFILDRVAHHHSTKENCVAPTGNDPGTGDLDKCGLYIEENPSRLVGVEEVKDAEALVPVPTDEVTLVGQTLNTFLAWPTHLGKRLSEQAAVSPAKPPESPDEEVDDPLYLMTLTIPQLFLKPLQVMWDATIFKVFNQNFPLYIKHEDLSEIAHGGQCLSISVIQLWIL

SEQ ID NO: 151803 - protein, 111 aa, Glycine max
  Coding DNA Sequence Number=SeqID_60118
MPRQAQGDAHQAAGALPPPRQADPVGPLGVERYLQHWVRQQAVNHRGQGQGSAPFVCPTLEQFGAEVAWSGDWPNAQAGKEPAGSPGETDESRMDEDMIDLLDFLRGSGAA

SEQ ID NO: 151804 - protein, 76 aa, Glycine max
  Coding DNA Sequence Number=SeqID_60119
MAAEWRRKRERRRHFKEKMSLEEAHHHRRPWIRAWRKKEMNEGRGREEHKILCSKRALKSEPTNPRSIPRFSTKCA

SEQ ID NO: 151805 - protein, 171 aa, Glycine max
  Coding DNA Sequence Number=SeqID_60120
  Homolog annotation: Hit_ID=Q6WAY6; Match level="QueryCoverage=87%, HitCoverage=26%, E-value=3e-09, Identity=27%"; Hit description =Putative uncharacterized protein
MGINQTGKRFYPVKIKGLDVISLKELGRLMGPLQMQDFQLVPTIKEFEEILRCPLGGRKLYLFSEFLPSLSKIAVVVRDSTRELDRVKQTQNGIVGLPRKYLEGKARDMANQEEWVPFMDVLALLIFRVVLFPNVDGLVDLATIDAFLAYHHSKESPVVAVLANLFDPFDR

SEQ ID NO: 151806 - protein, 120 aa, Glycine max
  Coding DNA Sequence Number=SeqID_60121
  Subcellular localization annotation: CTP_CleavageSite=45; ConfidenceScore=5.02e-01
MPISPAKYQLVCVVPTWGSHPKRHPVDPEKSNRALGFPALVTGLYQSYRGSRLQGTQWTRRSPTGSWSCQALITGLCQFYGVPVTSSKGIRPPTNRAFIKKYCVSRQAQGETPQQPGDGR

SEQ ID NO: 151807 - protein, 321 aa, Glycine max
  Coding DNA Sequence Number=SeqID_60122
  Homolog annotation: Hit_ID=Q6WAY6; Match level="QueryCoverage=74%, HitCoverage=39%, E-value=2e-25, Identity=32%"; Hit description =Putative uncharacterized protein
STLEDPTAKALADQGEWVSFIDILALLVFGVILFPYVEGFVDLAAIDAFLAYHHSKESPVVAVLANAYDTFDRRCEKSGARIVCCTPALYVWLASHLFRHESRLVYPLQGHRMCAEKWKAIWEQLLASMVGASINWFPQWKEGRVGVLSLYEGFSNIPLMGARGCINYNPVLAIRQLGYPMRGALSEESTTPFIARGFGDPNARIFQRVQKAWSAVQMKDKELRGSSNGIIGGYHKWLRAQMQELDWLPKLKTSSEEEAETPEESEEVEALKVELDRAQAVKEKFKMTAIKVWKECDELKDINVANAEALERETKRARKEE

SEQ ID NO: 151808 - protein, 317 aa, Glycine max
  Coding DNA Sequence Number=SeqID_60123
  Pfam annotation: Domain name=Transposase_23; Domain location=37-107; Score=-8.1; E_value=0.0092; Accession=PF03017.5; Description =TNP1ENSPM transposase
MQSQELALPPKPEVGLSDPCVSTKESCVAPSGNDPGTGDSDKCGLYIEENPSRLVSLGRIYEGSTTVHNIPLLHGQVKIGVEEVKVAEALVPLPTDEVTLVGQILNTFLAWPTHLVKRLSEQTIVSPAKPPEIPDEEVDDPLYLMTLTIPQLFLKPLQVMWDATIFGVFNQNFPLYIKYEDLSEIAHGGQCLSVSVIQLWIIHLTETSVRAGNSDVYGFLESQSIQRSGQSQFESESYIKSWIKSSKRDVYLGAYLKGPDNYLKGIISSSVLFSLHFHWHNSTTSIMFLVFNTSALKGLDDTPQPKSKATAWWIVVK

SEQ ID NO: 151809 - protein, 60 aa, Glycine max
  Coding DNA Sequence Number=SeqID_60124
MEELINKTQLSPKIIPTSSRRLDGSTKESHFLSSTAVILLPRMKVHNHHKYQLHGTKIVR

SEQ ID NO: 151810 - protein, 59 aa, Glycine max
  Coding DNA Sequence Number=SeqID_60125
MMQMHKSATGGCGHISLDVSRGIIPFEEHIAAVGTASNNMLSKRKTLDEGSLLSSKSET

SEQ ID NO: 151811 - protein, 77 aa, Glycine max
  Coding DNA Sequence Number=SeqID_60126
MMQLCITTGSGTYHIKKLKDLIKQVAPTRVPPNGIHGSQLVRRLFFRQPGHSKYSENLIEYDITELKNDEDVLKVLA

SEQ ID NO: 151812 - protein, 28 aa, Glycine max
  Coding DNA Sequence Number=SeqID_60127
MNEVDGDEETVAKLNGNNGQSVGPCSIS

SEQ ID NO: 151813 - protein, 54 aa, Glycine max
  Coding DNA Sequence Number=SeqID_60128
MGTTTGLWEFYGSITGVPEAPKSHFSTKRGCGGHLARPGELGCFNLKQEIAKNL

SEQ ID NO: 151814 - protein, 353 aa, Glycine max
  Coding DNA Sequence Number=SeqID_60129
  Gene Ontology: Mol. function=protein-N(PI)-phosphohistidine-sugar phosphotransferase activity; Cellular component=cytoplasm; Biological process=phosphoenolpyruvate-dependent sugar phosphotransferase system
  Homolog annotation: Hit_ID=A7MLK8; Match level="QueryCoverage=69%, HitCoverage=65%, E-value=2e-82, Identity=66%"; Hit description =Putative uncharacterized protein
  Pfam annotation: Domain name=PTS_EIIA_2; Domain location=108-247; Score=242.0; E_value=1.3e-69; Accession=PF00359.13; Description =Phosphoenolpyruvate-dependent sugar phosphotransferase system, EIIA 2
PSISSPIPGMPDGKPANTRCVQLDEQQRCKIFGSPLRPAVCAGLQPQAEITLVTGAALQQRVSAPAVKNPKSAAKCAEHQKSATPIAHFLACNRAETIHFQQARRNMFQLEVQAIHTGASASDKEQAIRQVAAALTAAGNVAEGYVDGMLAREQQTTTFLGNGIAIPHGTTDTRDLVLKTGVQVYQFPQGVDWGDGQTAYVAIGIAAKSDEHLALLRQLTHVLSDDSIAEQLKSASAEELRALLMGEKQAAEFQFDTSLIATDVAASDLMTLQALNAGRLQAAGAVDASFVADVVSHAPLGLGQGIWLSDSTHGNLNSAVAVSRSATPLTHQGEPVALLLTVAATDQRPLEVL

SEQ ID NO: 151815 - protein, 46 aa, Glycine max
  Coding DNA Sequence Number=SeqID_60130
MTGDSSKFTHISPKKSGHVTYGDNNKGRILGVGKIGTNSWSWKNRP

SEQ ID NO: 151816 - protein, 235 aa, Glycine max
  Coding DNA Sequence Number=SeqID_60131
MVMDQSLFYDLTQLSSEGVPFEGTLNHDWKFDFSVHDAHRLVCTYQADMTGRLLAGSLAFESRILYYLIILLLCGLFISAEKLDWAHLVRYRMHKALRLNAPLPYPHLVTLFLQHFNIPLDSEPCVPMKRSFLIGATVIASFGYCKEHDGSWVKKGAQPIDEEGHLPVGEDSSLLQRILDRFDGLQTYVGERFDPLELQVDMRFDEMDSRITTVEGDVTYIRTCFDLPPPPPPSS

SEQ ID NO: 151817 - protein, 98 aa, Glycine max
  Coding DNA Sequence Number=SeqID_60132
ASGRRIRALGDSGIRTHIARQHALAEGQQLAGQQRFIDDKAFAFAQFSLFQHLSQLRLDALEQLVDEALQAILFKHQRVAGHDARQPRVAFRKAQNQQ

SEQ ID NO: 151818 - protein, 236 aa, Glycine max
  Coding DNA Sequence Number=SeqID_60133
  Homolog annotation: Hit_ID=Q84VH5; Match level="QueryCoverage=94%, HitCoverage=39%, E-value=8e-98, Identity=72%"; Hit description =Envelope-like protein
MDLIKAAGLLKTVTKLGDCYESLVREFIVNIPSDITNRKSDEYQKVFVRGKCIRFSLAIINKYLGRPTEGVVDIAVSEHQIAKEITAKQVQHWPKKGKLSAGKLSVKYAILHRIGTANWVPTNHTSTVATVNIPIWGGYTDSVMKRESPLSLHYKLFEGTHVPDIVSTSGKAAASGAVSKDALIAELKDTCKVLEATIKATTEKKMELERLIKRLSESGIDDGEAAEQEDEAAEEE

SEQ ID NO: 151819 - protein, 101 aa, Glycine max
  Coding DNA Sequence Number=SeqID_60134
  Homolog annotation: Hit_ID=A9HWG0; Match level="QueryCoverage=47%, HitCoverage=12%, E-value=6e-08, Identity=64%"; Hit description =Probable MFS permease
MLAVSLLAVALLTLAMPWFHGVLAWSLLRLAAGYGSASAFICVAASRAVGPGDPRAPAVSAITYAGVGARHRADRAGVPGIDGRGRGRQCQLDRAGRAGIL

SEQ ID NO: 151820 - protein, 69 aa, Glycine max
  Coding DNA Sequence Number=SeqID_60135
MSEFTSNCPPQILANLHQLDFAPYVSGSYNAQWNAPELLHDKHMLHFSCILGKMEVEESLLGLWLPLYY

SEQ ID NO: 151821 - protein, 242 aa, Glycine max
  Coding DNA Sequence Number=SeqID_60136
  Homolog annotation: Hit_ID=Q5QJQ3; Match level="QueryCoverage=42%, HitCoverage=81%, E-value=8e-56, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVVKEEGQSSIEGPSYGKKVIEEGVKLTANVDLQREDECGICLEPCTKMVLPGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPP

SEQ ID NO: 151822 - protein, 262 aa, Glycine max
  Coding DNA Sequence Number=SeqID_60137
  Homolog annotation: Hit_ID=UPI00006A2939; Match level="QueryCoverage =64%, HitCoverage=91%, E-value=1e-11, Identity=29%"; Hit description =UPI00006A2939 related cluster
MTGPLDESISCFLIRVDPWGYTTSPWVLVTLTVRGLHVLALRGLHVLAIRGLHVLTFVGLHTLTFRGLHVLRGLPALALGTSYPHLQRTTRPHLQRATRPRHQRTACPHLRKLHALTFRGPHVLTFRGLHALAIRGLHVLTFVGLHALAIRGLHVLTFVGLHALTFRGLHALAIRGLHVLTFRGLHALTLRGLHVLANRGLHALTLGGLHVLAIRGLHALTSKGLHILALRVLHVLTFRGLRVLIFSVLHIHTLRGFKVLCP

SEQ ID NO: 151823 - protein, 61 aa, Glycine max
  Coding DNA Sequence Number=SeqID_60138
MENSSLTVNHLIQPYFNLLSENQLRVGKLPGSHIINETSKRVELRPQKETTPEYLAFHRFK

SEQ ID NO: 151824 - protein, 235 aa, Glycine max
  Coding DNA Sequence Number=SeqID_60139
  Homolog annotation: Hit_ID=A7UQU7; Match level="QueryCoverage=57%, HitCoverage=24%, E-value=1e-16, Identity=39%"; Hit description=IMP dehydrogenase/GMP reductase, putative
  Pfam annotation: Domain name=DUF1723; Domain location=155-204; Score =49.2; E_value=1.4e-11; Accession=PF08330.1; Description=Protein of unknown function (DUF1723)
MVRTRGLGRALGQVTGKGVGRGDHDDSDDAPQRRRPTASARRQRVAVTADHVDEPVIPSPDVQDDPMEAPVAVEDIPADTGAEAAEDAHEGFPGGPSDPSVLTLYADHVACSERPELKLSSHGKKVHSLGRHVLAIEGLVAGTGLSPLIMCSVDTGDRGLLSVFMERWHRETSNFHLPVGELTITLDDVSSLLHLPVIGDLHAFEPLHVDDAIHMLVNLLMVSPKFARAETVGIL

SEQ ID NO: 151825 - protein, 141 aa, Glycine max
  Coding DNA Sequence Number=SeqID_60140
MGSMKRPLPSYYAYRVRISPGPLQGGMPPTRHSLDPDKSNRALGFPALITGLNQSFGVPVTPSKVIRPPITRAFIEKYCTPRQAQGDAPQAANAPPPPHQVDPAGSLGMERYLQHLVCQQAANHRGQVQIHECLYQLSLSQ

SEQ ID NO: 151826 - protein, 71 aa, Glycine max
  Coding DNA Sequence Number=SeqID_60141
MRVQIATRPTWAFQNIPPEGDCFWRKQPSSPGRAGGRSEGKKGLALLVIRDHLKLVKKIVSMKKIQAEALP

SEQ ID NO: 151827 - protein, 125 aa, Glycine max
  Coding DNA Sequence Number=SeqID_60142
MEAMKEQMATIMEAMMSMKKIMEANAVAVAATGVVAKAKIWKVWTAPIMRKFKTSMPSHHMAGLPTLHYPMWHTLPVRMSITPLLYPLRANNPKLIMHKSLKPWGRHMNSPPQSSRLQALPQICH

SEQ ID NO: 151828 - protein, 43 aa, Glycine max
  Coding DNA Sequence Number=SeqID_60143
CVVLMMLHKKKNGSENGNNKENEDTTITDVLKVEAHYEGCAPV

SEQ ID NO: 151829 - protein, 56 aa, Glycine max
  Coding DNA Sequence Number=SeqID_60144
LLVLVPVATYPSAGGRRVTRGMRVPRKEYARSRHQRLFEENVGKTGKDAIYELLSE

SEQ ID NO: 151830 - protein, 71 aa, Glycine max
  Coding DNA Sequence Number=SeqID_60145
  Subcellular localization annotation: CTP_CleavageSite=36; ConfidenceScore=5.02e-01
MVVQLLMSAQRKMLSSGFDDTPQSKSKATARWIVVKCNRQKGSAACGYYVMHRMSTIILGSFKNNWKTIIA

SEQ ID NO: 151831 - protein, 81 aa, Glycine max
  Coding DNA Sequence Number=SeqID_60146
MEAMKEQMTTMMEAIISMRKMMEADSPIWPQSSKSSSLGYGRSGSKHSFLPYGLPPDYTPPNVAHALDENVDNSTLIPIES

SEQ ID NO: 151832 - protein, 83 aa, Glycine max
  Coding DNA Sequence Number=SeqID_60147
MAAQLIHDRVVMECLEVHPKEPARTLQQPVEWILPTPTPYRLVEPVQVIEVSSSEEDLEDDPEELPPEPAVDADAILPRKGIG

SEQ ID NO: 151833 - protein, 131 aa, Glycine max
  Coding DNA Sequence Number=SeqID_60148
MTLLLSNIPRPATVNANLRGLHALAKGSHPQRYPVDLKKSNRALGFPALVTGLCQPYRAPVPPASSCRRGIGIVPARHLVDPKKANRGVPVAPSKVIRPPLPIELSSRSTAPPGRRRAKHYISIGMAGSGQ

SEQ ID NO: 151834 - protein, 366 aa, Glycine max
  Coding DNA Sequence Number=SeqID_60149
MKREIHASYSSHNSCKSLSEELHDYYEGRHRSHLRPHSHRREKERNPQEANINLPYFHGKDNAEANFDWEIRVEQQLKKKSTSKSYGSHSYPKKDQGQGILGVTPSKPKDDKGKRIEKTHYFSMPHHKNHDYEGQEIYSSQDEATTSPSSSESEEAKGEKSSEEIYAQVKGQPSVVKQKCKEVNVSSKSLAKKETHFTINTNIKESFPLRQPPHFLFCKKTLASIATPLGLEFIPQVKKLLDEGLVSKSLYPCALLWLKIGIIRHQVPKIGGMMNVLNGATLFCKITRAPNIFMVCIHRDSLGSDQGVPMNPKRIKVILEWPTPPSIRKVWGFHDLTNFYKRYRGKEPRVCRTSRFEVKSFQRWRG

SEQ ID NO: 151835 - protein, 60 aa, Glycine max
  Coding DNA Sequence Number=SeqID_60150
MWKVLPEYTSFKVSLAKRQKCKEDDSTLEMLHDNCESTSFLEARVSQKVEHKSQREKRLA

SEQ ID NO: 151836 - protein, 62 aa, Glycine max
  Coding DNA Sequence Number=SeqID_60151
MTWSNFPARTSKFMNKLVCIKEWQFVNKDIGVKKPGNIFEQQLIHTSLGCKRVNVYPSILSA

SEQ ID NO: 151837 - protein, 44 aa, Glycine max
  Coding DNA Sequence Number=SeqID_60152
MTSVKGAGVVASFGYQKDMDGQWVCKQDLPPPNPDERTPSPPPQ

SEQ ID NO: 151838 - protein, 138 aa, Glycine max
  Coding DNA Sequence Number=SeqID_60153
  Subcellular localization annotation: CTP_CleavageSite=51; ConfidenceScore=5.55e-01
MATPPASPPPPPPPALASASLSTLKRTRKATRLRSLATRPPGAERPVVHVDLAIGKADSPHKKKLRTHLGIVTGDKAEFDIPEASDANKDSVDDTVCEKYGISKEKLAQFCQTRRNPLWEDVRKKAQAIQKQNIAPHV

SEQ ID NO: 151839 - protein, 202 aa, Glycine max
  Coding DNA Sequence Number=SeqID_60154
  Homolog annotation: Hit_ID=A7UQU7; Match level="QueryCoverage=77%, HitCoverage=25%, E-value=1e-13, Identity=34%"; Hit description=IMP dehydrogenase/GMP reductase, putative
  Pfam annotation: Domain name=DUF1723; Domain location=164-202; Score =35.6; E_value=1.7e-07; Accession=PF08330.1; Description=Protein of unknown function (DUF1723)
MARTRGLGRAIGRLVGIDRPADQDAADVPERRKPTASALRLSVHQMTTEGRDMVEDVSDMTDDVPELAAEAPEMRADAQGADSGEGSDGDDAAEGFPGGPRDPSVLTSFAEHLAHVVWSGHERPDLKLVSHGRKVTLIGRLVLEIEGLVAATGLSPLIDCSVITGDPGLISAFVERWHGETSTFHLSVGELTITLDDVSNPS

SEQ ID NO: 151840 - protein, 49 aa, Glycine max
  Coding DNA Sequence Number=SeqID_60155
MLVMQSYPARALGRRLQVDWARDPREGPKVLMSLRLSSSFSSQGGELSY

SEQ ID NO: 151841 - protein, 92 aa, Glycine max
  Coding DNA Sequence Number=SeqID_60156
MIIRGQDSYSSQDEGTTSPSFSESGDAIGEESSEAIYPQEVRDLLMARRLLGGQSCVEAKLHDESRLIQRCFDDNNDDSKRWMTKVMTKSSR

SEQ ID NO: 151842 - protein, 125 aa, Glycine max
  Coding DNA Sequence Number=SeqID_60157
  Subcellular localization annotation: CTP_CleavageSite=41; ConfidenceScore=5.18e-01
MEESSKKRKGSSSTTATAGHHRHGPSEAPTTPIHPSLSSPRSSTLFSLDEQRLWYNSQFSSRIILDPKYLDTNFFNDDTFDCYQVFQNNGLVDFMSLKLPYYLELVKFFYNNLKIPDGIISSEVH

SEQ ID NO: 151843 - protein, 151 aa, Glycine max
  Coding DNA Sequence Number=SeqID_60158
MAEREMITIMVDTLPTFYYEKLIGYMPTNFTDLVFTGGRIDSGLRKGKFEYASNGAPNNNKRAPGVGARKKEGDTHTVTTAPTWMKAPQNIQSSYQPNPPNFSIRTGSSLPTQVNNMMAWNFFFKCKYVHDVVCDSKIFRMWLSVNFDTMP

SEQ ID NO: 151844 - protein, 109 aa, Glycine max
  Coding DNA Sequence Number=SeqID_60159
  Gene Ontology: Mol. function=nucleic acid binding; Biological process= DNA integration
  Homolog annotation: Hit_ID=A5BVC0; Match level="QueryCoverage=78%, HitCoverage=9%, E-value=3e-12, Identity=33%"; Hit description =Putative uncharacterized protein
ILGSEDLQLLYGSSWRGKKLQLSELDEIRLDAYENAKLGLMSGKLRSKWIGPFVVTNVFPYGTVEIKSDSTNKSFKVNGHRPKPFLTNPSLVDVVVEETSLLHPTLPPP

SEQ ID NO: 151845 - protein, 104 aa, Glycine max
  Coding DNA Sequence Number=SeqID_60160
MTQELVARGDTLQLSTPRHSVTPSVIDEQRPMWSSAPFPEMSASSGGDFFKSHKGGGPDDMRKTKLWSFRTPFSPFRHRLCPMARRDKLWSFLRPFVNRGRQAR

SEQ ID NO: 151846 - protein, 196 aa, Glycine max
  Coding DNA Sequence Number=SeqID_60161
MTLLLSNIQPSDHNSDLPLPKCQLVYAILTQMSIHVAQLIADVIYLFAGMAPTRHPLDPDKSNRALGFPALITRLCHSFGVPVAPSKVIRPPITRAFIEKYCTQRQAQGMLRRPQMRRHLIRLVQPDHLIRSSICGIWFASRRPTTGHMAEVAWPGDWPKARVGEAPVEAPDEADEAREDEEMTDLLDFLGGSGAT

SEQ ID NO: 151847 - protein, 184 aa, Glycine max
  Coding DNA Sequence Number=SeqID_60162
MGTNQTGKRFYQVKVKSLDTTSIKELGRLMGPLQMQAFRKTYGKILEVSSRGKKTIPFLRVSPLFEQNCNCGQGFSKRYLEDKARGMANQGDWVPFMDVLALLIFGVVLFPNVDGLVVLAAIDTFLAYHHSKESPVVAVLVDYLTHLTEGAKRVAHRSSVACPPSVFGWFRTCSNKTQGIHVRS

SEQ ID NO: 151848 - protein, 330 aa, Glycine max
  Coding DNA Sequence Number=SeqID_60163
  Gene Ontology: Cellular component=mitochondrion
  Homolog annotation: Hit_ID=Q6Z8F0; Match level="QueryCoverage=15%, HitCoverage=47%, E-value=1e-14, Identity=76%"; Hit description =Putative uncharacterized protein P0459B01.18
ERAGARGTPRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGETMCDTQAGVPSALMASGATCVQRLDGSRDSAIHTKYRIFATFFIDARAEISVAESHCIAGVCVCREDEEAGRTGRRGHPLPPDGSVDFSQRRGQRTAHVAAIRTLHRTIQSVGATG

SEQ ID NO: 151849 - protein, 21 aa, Glycine max
  Coding DNA Sequence Number=SeqID_60164
FCDADWASDVDDRSSTSGTDK

SEQ ID NO: 151850 - protein, 113 aa, Glycine max
  Coding DNA Sequence Number=SeqID_60165
MRLRAHEQFQKRDSSRGFVELFNDLELALLNNAEELAGFLKRYLFLVTAISSLGKTFHRNIPIRSGDHFDILSFRHFCLPFSVCGLCWEVRGCEYATAAGHAAQPRDIGYLGR

SEQ ID NO: 151851 - protein, 177 aa, Glycine max
  Coding DNA Sequence Number=SeqID_60166
MDKSLKVGEDERRERERRSTKFCASKEISGPNLGPWAQKSTLRFMKTLGPSSATLAQSSWSLLLMALVTGPFLGRIASSDSNKKMPKKNWNRGRPRKTLKRRYISCGSVQVEGTSTWLLKENKGGYIPCGSLLVMDFTRLLEISRTGGCLETGCRHGLWPNQYLHGVETRLNRYGRN

SEQ ID NO: 151852 - protein, 26 aa, Glycine max
  Coding DNA Sequence Number=SeqID_60167
MTRKLPEDWIGDAGKGPRVVMSLRAP

SEQ ID NO: 151853 - protein, 548 aa, Glycine max
  Coding DNA Sequence Number=SeqID_60168
  Gene Ontology: Mol. function=phosphoinositide phospholipase C activity; Biological process=intracellular signaling cascade
  Homolog annotation: Hit_ID=A7UQU7; Match level="QueryCoverage=55%, HitCoverage=54%, E-value=2e-39, Identity=34%"; Hit description=IMP dehydrogenase/GMP reductase, putative
  Pfam annotation: Domain name=DUF1723; Domain location=140-189; Score =48.5; E_value=2.4e-11; Accession=PF08330.1; Description=Protein of unknown function (DUF1723)
MISMQIMVRTRGLGRALGQRVAVTTDHVDEPVIPDPDVQDDLMEAPAVVEDIPTDIPADAGPEAVEDQPQGFPGGPSDPSVLTAYADHVACSVWTGEERPELKLSSHGRKVHSLGRPVPAIEGLIAGTRLSPLIACSVDTGDRRLLSAFVERWHRETSSFHLPVGELAITLDDASSLLHLPIIVDFHAFEPLHVDDAVQMLVDLLMVSPESARAETVQCCGPYVRLQWAGHWTTAARAYLLHLLGCTLFANKSETNIHVVYLEALRDLSMTNRYAWGVAALVHMYDQLNDASMTHSRQLGGYITLLQCWIYEHFPSIAESTADKDYDEASPRACRWIATKKTVKSIRTPSYRERLDRLRIPMSVGSRMGSIGRSETSTSDHATPVSCAGAYCCVLPIGEGRAAVWWMHYEDHIVLAGEVCVVPGACSSDYIDWFFRISHPFMTPGHAVDPLPHGHAPQPRVVPQAPQTDIPRVPEPGASSTSMEEPRHAVEVCDDIAERLERHLSLGVVTRGSLTHEVIEECLRLARSVTQDHLVYVRCRRRRHTDQA

SEQ ID NO: 151854 - protein, 61 aa, Glycine max
  Coding DNA Sequence Number=SeqID_60169
MRPKRILRSLGLGVSYNCKGRGCHRSSLEEEVALLNFSLKMEFVQNEGMKAPIDSFSHKDQ

SEQ ID NO: 151855 - protein, 99 aa, Glycine max
  Coding DNA Sequence Number=SeqID_60170
MFINCCCCTTFLATGNRLHPLNYRIQCKSQPERNCTKCEKLHLAPKVDSRLARRAHLVRFVDYKYVLQREKHDFSRFFSLNAHPSPNVSSTTHNHRWPP

SEQ ID NO: 151856 - protein, 125 aa, Glycine max
  Coding DNA Sequence Number=SeqID_60171
MVETFSGRTVNYRRKLFRKNNCEIPEQLILEVSSGRSCSESITMNFRKNFFWKKIVEFVVQEFHSCSSGTTSSGSSQFFRKKFLPFYCSHSLKIYTRKRKKKIINAYVRQNRNNNDEHTNGTTNI

SEQ ID NO: 151857 - protein, 115 aa, Glycine max
  Coding DNA Sequence Number=SeqID_60172
MGSEIYPEVHENPRTFFSSSSSIVLEPLAHESGGIAHQFVDDTMVLGKPWNLTTSLKKSFEMWEASSTLWHGIKCVILLNLSTTTKIESTPLWVLGSPRTKSILMSTQGTDGMGK

SEQ ID NO: 151858 - protein, 206 aa, Glycine max
  Coding DNA Sequence Number=SeqID_60173
  Gene Ontology: Mol. function=hydrolase activity; Cellular component =cytoplasm; Biological process=mRNA catabolic process, nonsense -mediated decay
  Homolog annotation: Hit_ID=A7PCF0; Match level="QueryCoverage=22%, HitCoverage=3%, E-value=1e-12, Identity=78%"; Hit description =Chromosome chr2 scaffold_11, whole genome shotgun sequence
  Pfam annotation: Domain name=PRA1; Domain location=33-166; Score=7.4; E_value=2e-05; Accession=PF03208.10; Description=PRA1 family protein
  Subcellular localization annotation: CTP_CleavageSite=28; ConfidenceScore=5.69e-01
MSLASFPKPHYGSLPSPSSSNSTTYFVTCATTSTRSSFATHQPWEEVFTLYSFTHPYSIEEATMRVRRNLDHFRMNYSMMVLFVLFLSLLWHPFSIIMGQVPNQYPFLYFFPILEGCSTQIRLAMDCFRKCLLGYHIENIQVLYLKKQLRARQISEQQINKVEELWKKNPDAFFEDLEKLGVDDGPQSVALKMKMHIMCLGIRMAC

SEQ ID NO: 151859 - protein, 38 aa, Glycine max
  Coding DNA Sequence Number=SeqID_60174
MAEPSSDAATTSATRKNKVDPGWKYCHSLVEGDTNTIV

SEQ ID NO: 151860 - protein, 626 aa, Glycine max
  Coding DNA Sequence Number=SeqID_60175
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A9LLI7; Match level="QueryCoverage=98%, HitCoverage=67%, E-value=1e-166, Identity=52%"; Hit description=RRP6- like protein 2
  Pfam annotation: Domain name=3_5_exonuc; Domain location=3-162; Score= 159.3; E_value=1e-44; Accession=PF01612.11; Description=3'-5' exonuclease
  Pfam annotation: Domain name=HRDC; Domain location=218-287; Score =59.5; E_value=1.1e-14; Accession=PF00570.14; Description=HRDC domain
  Pfam module annotation: Pfam domain module=3_5_exonuc::HRDC; Domain location=3-162::218-287
MSFFWFTLNLKVIQVEVDLEHNQYRSFQGLTCLMQISTRTEDFIVDTLKLRIHIGPYLREIFKDPAKRKVMHGADRDIAWLQRDFGIYICNLFDTHQASKLLNLERNSLEHILHHFCEVTANKEYQNADWRLRPLPDEMIRYAREDTHYLLYIYDLMRIKLFALSKESESSESSDTPLVEVYKRSYDVCIQLYEKELLTENSYLHIYGLQGAGFNAQQLAIVSGLCEWRDIVARAEDESTGYVLPNKSVLEIAKQMPLTTSKLRRLVKSKHPYVEHNLDTVVSIIRHSIQNAASFEEAAQQLKEAQAVTASDVVPVTDGTEDPPSHTRHSKESSQHQATSVPIKIKSNSLIFEPPKDSLTIAEQNRDANVGALSTAKGNGAAVQVLKKPTGAFGALLGSSASKRKLGPGKGKEEIKLEQIRSSVSLPFHSFLGSSEKSEPTEEIPSVASEMSEPQKPVSDVVSASPVDEIIMLESDTGAKDMEQNNLENSNEHREKDSVVSTSGKEDEDEPVSLSELSSNLKKCFHSNDQNNKIRQPKKTEQPSGLVQLKPFDYEAARKHVKFGEHKKHASSKGSDGHMEVVEDSGSKKQRSTTGQGQASDLSKQLPQGRRRQAFPASGNRSSTFR

SEQ ID NO: 151861 - protein, 317 aa, Glycine max
  Coding DNA Sequence Number=SeqID_60176
  Gene Ontology: Mol. function=hydrolase activity
  Homolog annotation: Hit_ID=Q2HVC5; Match level="QueryCoverage=99%, HitCoverage=97%, E-value=1e-112, Identity=66%"; Hit description =Cupin, RmlC-type
  Pfam annotation: Domain name=DUF1637; Domain location=49-312; Score =362.6; E_value=6.6e-106; Accession=PF07847.3; Description=Protein of unknown function (DUF1637)
MEQGGDRVGHVNKVIGYGKRVIVKKRKPYHHHHRRIHNKKTVPNKVPKALQELFVSCRETFKGPGGTVPSPQDVQKLCHILDSMKPEDVGLRSDLQFFKPENIVKENQRVTCTTIYSCENFSLCLFFLPAKGVIPLHNHPEMTVFSKLLLGQMHIKSYDWVDSEVSHNLLHQPSQFRLARLKANNVFTAPCDTSVLYPQSGGNIHEFTAITPCAVLDVLGPPYSKDDGRDCSFYRDHPYTAFPRLFSMDLFDSNKNKSKSNIVYGFATYKQPGFYAASGKVKEENDSYGWLEEIEMPENSQMDGIEYLGPPIIETAL

SEQ ID NO: 151862 - protein, 373 aa, Glycine max
  Coding DNA Sequence Number=SeqID_60177
  Pfam annotation: Domain name=zf-CCHC; Domain location=286-303; Score =14.0; E_value=0.012; Accession=PF00098.14; Description=Zinc knuckle
MKQELKEAIKIEFSQRGSQYSPPIEADIQQMGARVNTKGSNVETGVNPLGEEDVVDVISTMGLYVQCDHSTHLVALGKIYGGGSTIHNVAYADDMVRVSVEKVFDSDAKVLFPTTHLLQHKVAKPVRRSNDVEADDPLRGLIMSLCDIYDKPVELLFNGTKFGIHDVDASVFLTYSDVNEIISVQAWVMVPCMDSLSLSPYTMQRINMVNPNNTLKHGLRNPNERGHWQLVVLCPMKEVIVWFCSLCKKPDIHIKAAINNSAMNPLKTTLHGHIDQVAPKWIEVKDQCFKCNQPGHFASQYEPEDVDSADDSQLTSTQMRFNNYIHPCLSTYNFTKCVIIGKRGLDMLLNTRNPHGGLFAENYEALTSFGPSF

SEQ ID NO: 151863 - protein, 265 aa, Glycine max
  Coding DNA Sequence Number=SeqID_60178
  Homolog annotation: Hit_ID=A7PB81; Match level="QueryCoverage=48%, HitCoverage=15%, E-value=5e-30, Identity=51%"; Hit description =Chromosome chr16 scaffold_10, whole genome shotgun sequence
AREAKENLLNIQAERESYDAQIEDLKLLLKATNEKYESMLDEARHEIDVLVCSIENSKSAFENSKAEWEHRELQLVSCIKKNEEEKGYQEKEIKRLFYLLKETEEEANANREEEDQLKENLKEVEPEAIQLEAESIKKLEELSKLLEEATTRNHTEENGDLTDSEKYYDLLPKGVVVDVYYNGDVVSTSEGVLFDCPNGPKFIKISEEMLLVALRKAITNAIGGGRSLFEDDCMKLKDNNEVGKMFFTFPQFSSKGLINLYAMVG

SEQ ID NO: 151864 - protein, 87 aa, Glycine max
  Coding DNA Sequence Number=SeqID_60179
MVLASGSVALHISLYNVARQAEPQLYRLTRSISANTMRVLMSDKTGNRVHLTYLIVLADIERVVALKLNKCVSYIAQQVQSLDDDQF

SEQ ID NO: 151865 - protein, 97 aa, Glycine max
  Coding DNA Sequence Number=SeqID_60180
MGDLLGVDLRQEFSAETEQAEAGRQRVIVLGFEGLGLRGYGLGFRGLRLRVVDYGLGLGLRGYGLGLRGFRVRFYGLGIRLRAWGLGFGVTTRLVAT

SEQ ID NO: 151866 - protein, 92 aa, Glycine max
  Coding DNA Sequence Number=SeqID_60181
MLNPNNKREHSDGQIQMVIRSALRINHYRVIAAGGGAQLCMRFFLVSSDMVENVVATTSGWVQSWIVFTAEKKEITKQRYWGIISPEKFTGG

SEQ ID NO: 151867 - protein, 96 aa, Glycine max
  Coding DNA Sequence Number=SeqID_60182
MFLALSRMGQWSEKFLSKMNWVQPGHLLIHSWETKNLSNLLVAAPFGLNHVSYPFIEINDIVGFHSPMRHTLSFRLMSDAVKISQEAPQSIKTMMS

SEQ ID NO: 151868 - protein, 1003 aa, Glycine max
  Coding DNA Sequence Number=SeqID_60183
  Homolog annotation: Hit_ID=Q2HVW1; Match level="QueryCoverage=12%, HitCoverage=51%, E-value=3e-07, Identity=26%"; Hit description =Putative uncharacterized protein
MATHGNTPQDPFHVLRKGGVYYQNRRRAEEAPPHPRFVESHLSVHLKVAEGERKWYTNTWVGRLKNLGAFERVEEDIPWELGVYVVPKYIGDDMILLLGLSVSKAEEIILEESQHGTSPFQSLEKWNPTMRPGHRLVWVQCWGVPLEVWDIRNFRKIMVAVGDLIEVDNDVEELRRLDRARILIRTPWRPLFHHTVAVHISGEVHTVHIVEEGWSDAGTRIPLRRGVTDSSEELDFDDNNSGILCAAMATISDIRHRPNSLNGDWIVVADNQQLSPLPDGPRVMENPVGNAQDSWAHLPNIDICARTRKSPKKKGKGSKATSSAAKGGPGYVEKERAAAQRGDDHETPNGSLMTSTVPHNTKVFESGPITEVGLTNHTTFITSQPFNASPPHHETPNVPLMSSKVAHDTQVTEAGPTIEVGLTNHTVATNSLPQCQPIPSNNRERKGVESDPISGMVTASAATGYSSMDRGTSQQGMQNNPMLSLETEGSNVGQIKEASSQWELAKIMGVSCDSDQATIINKIKAMKAKDRIYHPFTSLDFPMTPPRRSSGITSESGATCGVKDTHHLAKQLDGIIIGGLKMYVNISRYNREGPRQRDPGNKPRDREDSNQVVVDRATDALQQPLPRTSKFHVLNSPKHRPQRHQLAEGCVDRAANKSCHGAKQLTNGGQHGGASLFYTMEKWSPTLRTGFKLTWVQVWGIPLQARDLKYIRRILVTMGDMVDVDDDTEAKRRLGRARVLIKTPWRPIINHTVDVHISGESFKVFVVEESGGGSHDCRRRRCSLSGSSEEIVSNDSSLGHLTRRSSNSRNHRDDRWTIPTKLGGTNDQDRGGTSVPDSRNDDVDDVHQTILLPSSSHSTATYPANMRTAQGMVKCVGDINTAGGGYMFHVKGKKDGDVASTSNVAEANESGAGNFKIKEAQVEVCEKTLHVEWEPSSTKATLMRFDKSQTQHLQRMAQGGTAAMSHNYSTTQEANYSTTQEAALNEDIQETDELLHFQEASDI

SEQ ID NO: 151869 - protein, 122 aa, Glycine max
  Coding DNA Sequence Number=SeqID_60184
MLHPTAAINEGGEAYLDGRSGGDVSTEAANARKRNQQVKGMSSNAHTQEENKPTGRRRREEKEAAQGGNIFHNLVGRLSDKQTSRSLLAMLHEQFAKERTQVSLEHQLSKFPSKGGIPTQGV

SEQ ID NO: 151870 - protein, 53 aa, Glycine max
  Coding DNA Sequence Number=SeqID_60185
MQDGTYVEPEMPKIPLALASVEEAPAQGPSNVEHPRHVVDITKSVEPKCSLFT

SEQ ID NO: 151871 - protein, 45 aa, Glycine max
  Coding DNA Sequence Number=SeqID_60186
MSRNFTDCLTMGVKFLEAVKRRLHAIKQWSPDDIRAILCPSWGFN

SEQ ID NO: 151872 - protein, 129 aa, Glycine max
  Coding DNA Sequence Number=SeqID_60187
  Homolog annotation: Hit_ID=A5AKJ5; Match level="QueryCoverage=32%, HitCoverage=7%, E-value=6e-10, Identity=59%"; Hit description =Putative uncharacterized protein
  Pfam annotation: Domain name=RVT_2; Domain location=1-86; Score= -174.8; E_value=0.0034; Accession=PF07727.5; Description=Reverse transcriptase (RNA-dependent DNA pol
MDKEMKALERNETWKIVKRPMDKKPTYCKWIYTVKHKSDGTLIDTRQDYEKMKNKKVIVAGVSLREACAISENHLLSEALIPLSELENLEENMPTICALSMSSARSTIHLSSLALSVPSSLSGNSLTRA

SEQ ID NO: 151873 - protein, 71 aa, Glycine max
  Coding DNA Sequence Number=SeqID_60188
MESQQDSTPLHFRQSPSLMNLPPRTEHNYQMKRIAKQEQHTFVYDSDKDDNGGNDEDDDDNKQCRQQSSDC

SEQ ID NO: 151874 - protein, 66 aa, Glycine max
  Coding DNA Sequence Number=SeqID_60189
MSLALTPMNQIVPYVPPQPSDPLMEKISRLERAVNKLSRDKYDVADLENLSLYPKVRLPYDDDVHS

SEQ ID NO: 151875 - protein, 173 aa, Glycine max
  Coding DNA Sequence Number=SeqID_60190
MDCNEEDCEEGVYSDVQAAPGSSEDPRCLLDAICGALTCAGLSSDFVLLGTAPLGACCYHLAAAGDLCVVPGQCAPNYIDWFFVISHPFMTVLQTDPPRDAYVTQPSHIPHEAAPTSTHADPDADEPRHAVAFHAIAEALEQHLNALGTSTHEEVIQNASGLSRVSQKTAMCM

SEQ ID NO: 151876 - protein, 765 aa, Glycine max
  Coding DNA Sequence Number=SeqID_60191
  Gene Ontology: Mol. function=5-methyltetrahydropteroyltriglutamate -homocysteine S-methyltransferase activity; Cellular component =cytoplasm; Biological process=methionine biosynthetic process
  Homolog annotation: Hit_ID=Q71EW8; Match level="QueryCoverage=99%, HitCoverage=99%, E-value=0.0, Identity=91%"; Hit description =Methionine synthase
  Pfam annotation: Domain name=Meth_synt_1; Domain location=2-318; Score=599.3; E_value=3.6e-177; Accession=PF08267.3; Description =Cobalamin-independent synthase, N-termina
  Pfam annotation: Domain name=Meth_synt_2; Domain location=432-756; Score=748.7; E_value=3.8e-222; Accession=PF01717.9; Description =Cobalamin-independent synthase, Catalytic
  Pfam module annotation: Pfam domain module=Meth_synt_1::Meth_synt_2; Domain location=2-318::432-756
MASHIVGYPRMGPKRELKFALESFWDGKSSADDLKKVASDLRASIWKQMIDAGIKYIPSNTFSYYDQVLDTTAMLGAVPPRYGWNGEEIGFDTFFSMARGNASVPAMEMTKWFDTNYHFIVPELGPDVNFSYASHKAVNEYKEAKALGVDTVPVLIGPVSYLVLSKPAKGVDKSFCLLSLLPKVLAIYKEVVADLKQAGASWIQFDEPILVLDLGSQTLQALTAAYAELESTLSGLNVLIETYFADIPAEAYQTLTALNGVAAFGFDLVRGTKTLDLIKGGFPSGKYLFAGVVDGRNIWANNLTASLDTLNSLEGIVGKDKLVVSTSCSLLHTAVDLVNETKLDNEIKSWLAFAAQKIVEVNALAKALSGQKDEAFFSSNADAQASRKFSPRVTNEAVQKAAAALKGSDHRRATNVSTRLDAQQKKLNLPILPTTTIGSFPQTVELRRVRREYKANKISEEEYVSSIKEEIRKVVELQENLDIDVLVHGEPERNDMVEYFGEQLSGFAFTVNGWVQSYGSRCVKPPIIYGDVSRPKPMTVFWSSTAQSMTKRPMKGMLTGPVTILNWSFVRNDQPRSETTYQIALAIKDEVEDLEKAGITVIQIDEAALREGLPLRKSEQANYLDWAVHAFRITNVGVQDTTQIHTHMCYSNFNDIIHSIIDMDADVITIENSRSDEKLLSVFREGVKYGAGIGPGVYDIHSPRIPPTDEIADRINKMLAVLEKNILWVNPDCGLKTRKYPEVNPALTNMVAATKLIRSKLSSGK

SEQ ID NO: 151877 - protein, 181 aa, Glycine max
  Coding DNA Sequence Number=SeqID_60192
  Gene Ontology: Mol. function=protein serine/threonine kinase activity; Cellular component=nucleus; Biological process=protein amino acid phosphorylation
  Homolog annotation: Hit_ID=UPI0000048393; Match level="QueryCoverage =53%, HitCoverage=20%, E-value=1e-20, Identity=49%"; Hit description =leucine-rich repeat family protein / protein kinase family protein
  Pfam annotation: Domain name=LRR_1; Domain location=11-33; Score=4.7; E_value=41; Accession=PF00560.24; Description=Leucine Rich Repeat
  Pfam annotation: Domain name=LRR_1; Domain location=35-57; Score =20.5; E_value=0.0061; Accession=PF00560.24; Description=Leucine Rich Repeat
  Pfam annotation: Domain name=LRR_1; Domain location=59-81; Score =12.5; E_value=1.5; Accession=PF00560.24; Description=Leucine Rich Repeat
  Pfam module annotation: Pfam domain module=LRR_1::LRR_1::LRR_1; Domain location=11-33::35-57::59-81
MTFPNLKNLKLLLRLELRNCLITGPIPNYIGEIESLKSIDLSSNMLTGSIPDSFQDLGNLNYLFLTNNSLSGPIPDWILSIKRHIDLSLNNFTKTSANNCQMPDVNLASSLSRTANTSYVPSCGLVLNQYRWNESFKSEIICCASSIGSSVNSKFLADFSSSVGKKSLQHFNSEESDPEEI

SEQ ID NO: 151878 - protein, 566 aa, Glycine max
  Coding DNA Sequence Number=SeqID_60193
  Gene Ontology: Mol. function=kinase activity; Cellular component =membrane; Biological process=signal transduction
  Homolog annotation: Hit_ID=A5BPP1; Match level="QueryCoverage=79%, HitCoverage=39%, E-value=1e-118, Identity=37%"; Hit description =Putative uncharacterized protein
  Pfam annotation: Domain name=KIP1; Domain location=1-53; Score=20.6; E_value=0.001; Accession=PF07765.3; Description=KIP1-like protein
MDAKVKQMIKLIEEDADSFARRAEMAYRALAKRYDHATGVIRHAHKTMAEAFPNQGAFLDLDEPQKDASAHFHAIKRNGGYTGEPDSPLNKTGLKQLNDLYIPREQENLPKFARRGFNFFETREESNEQNSGSNNTLSESERVTKDETEILALKKAIAKLEDEKEAGLLQYQQSLEKMSNLELEVSTAPENSRKLDERASKAEAEVQALKEAQIKLQAESEASLLQYQECLEKISNLEKNISSLQKEAGELNERATKAETESESLKQELARVEAEKKATLVQYNQCLETISKLEERIKEAEENARRIKEHADIAEKEIEALELQVTKLNEEKEDAALHYQQCMEIISSLEYNLSCAEEEVHRLNSKIVDGVEKLEFRTEMSSLGDIKSHSAERLRFIEAETAFQTLQQLHSQSQEELRSLASELNSKVEILGNVESRKPDLEDEVHRAYDDDDYEGSFCDNPLLEKTSNESNLASIDSHRKCFPFQFGRVGNRQKIVILVTLLVFIIVVAFAVVIWIGLGKNPIDSEVTAQGFNVKSLRSMSKKVRVQTKEQAESEGSNEGASTKV

SEQ ID NO: 151879 - protein, 223 aa, Glycine max
  Coding DNA Sequence Number=SeqID_60194
  Homolog annotation: Hit_ID=A7UQU7; Match level="QueryCoverage=62%, HitCoverage=24%, E-value=2e-17, Identity=37%"; Hit description=IMP dehydrogenase/GMP reductase, putative
  Pfam annotation: Domain name=DUF1723; Domain location=137-186; Score =30.9; E_value=4.6e-06; Accession=PF08330.1; Description=Protein of unknown function (DUF1723)
MVKTRGLGHVLGRIVARGLGRGDGDDFDEPEADIAGDEPMVDADAQDTGPKNGAQDIGAHDVADEPEGFPGGPRDLSVLTEYVDHVAASVWSGQERPELKLSSHGRKVHNLGRHVLAIEDMVVGTGLSPLIACSIDINNRGLISSFVERWHWETSIFHLPVGEVLIMLDDIASLLHLHIVGAIHDFQPLRTDEVVGLLVELLMVSVEVIMAETGKCGGPYICL

SEQ ID NO: 151880 - protein, 96 aa, Glycine max
  Coding DNA Sequence Number=SeqID_60195
MSLTQPRDSPRHPPVVHNDTFIELDPPQQPVAAMAMPEPHAPTPVDIDMPRYAVEGCQRIAERLEHLINMRMITTGTEAYTVAKECLRIARGVTEQ

SEQ ID NO: 151881 - protein, 57 aa, Glycine max
  Coding DNA Sequence Number=SeqID_60196
  Subcellular localization annotation: CTP_CleavageSite=40; ConfidenceScore=5.22e-01
MTKEVIHSHNSIVPRLHFSSSSSPMFFSGFRLLGKLAEASCLLRVEGISLPRQVWLA

SEQ ID NO: 151882 - protein, 44 aa, Glycine max
  Coding DNA Sequence Number=SeqID_60197
MSSCNRLHCLARLDLELILKQGFVLLKQPYVNLEAMLNLWSNLV

SEQ ID NO: 151883 - protein, 138 aa, Glycine max
  Coding DNA Sequence Number=SeqID_60198
MNVLSGATLFCEITRAPNYFMICVHRDSLGSDQGVLMNSKRIKVIPEWPTPPTPLIELVRNHVPSWEDAQEMGFQTLPYFNFPNTTNMYPRVSRTSGFEVKSFSREGMMQSYPARALDRRLQVDWAKEEIQGKALGFS

SEQ ID NO: 151884 - protein, 75 aa, Glycine max
  Coding DNA Sequence Number=SeqID_60199
MSGFTSDSPQISASPHQLDLAPYALGSYNAQWNAPKLLRGKHMLRSSHILGKMEVEEPWLGLWLPLNYQADMGPS

SEQ ID NO: 151885 - protein, 49 aa, Glycine max
  Coding DNA Sequence Number=SeqID_60200
  Homolog annotation: Hit_ID=A5B6M9; Match level="QueryCoverage=100%, HitCoverage=12%, E-value=2e-09, Identity=60%"; Hit description =Putative uncharacterized protein
MEVLMIQIEEDEEVTMTRFLNGVNSDIRDVVELQEFVAMEDLLHKAIRV

SEQ ID NO: 151886 - protein, 187 aa, Glycine max
  Coding DNA Sequence Number=SeqID_60201
MTDLVSAEDGINLRVSSSLSPRLTKVTEDDVSLCVLSGFSSYRQQKLFTDTQSGISARQRVSKFSMTYLVSAEDGIYLRVSSSLSPRLTKVTEDDVSLYVLSGFSSYRQQKVYTITTRVFPPVSVTQMSVRQILQQKVYTDNNSGISARQRDSKVSMTDLVSADDDVNLRVSTGLSAAIDEGRRRRR

SEQ ID NO: 151887 - protein, 86 aa, Glycine max
  Coding DNA Sequence Number=SeqID_60202
MYVSQPYPSAGGRRVTRGMRVPRKEYARSRHQRLFEENVGKTGKDAIYELFSERFGSCIYTRGRSTRVFPFAPTYSSIWDEKIRPT

SEQ ID NO: 151888 - protein, 141 aa, Glycine max
  Coding DNA Sequence Number=SeqID_60203
VHIAKKNEGYAKQANKKRKEVVLEPGDDPGDLRANVFQEGGNDENPKIVQIQGPMTRSRTKHSVDTLQQMVADILSKAQVDKDKSPNGEGRRPKWKRTKPQVEKDEGPSGEGRKTQVKKDEGPKAKALLSISIVAEGPRLI

SEQ ID NO: 151889 - protein, 178 aa, Glycine max
  Coding DNA Sequence Number=SeqID_60204
GKIKLKTPEEATELIQNMSTSDHAILRDSTHQPTKKSLIELSSHDALLAHNKLLSKQLEILTETLGCTIYGEAHETGQCTPTEENTQEIHYMRNQQRQGPIQQGPNIFQRTTKLEETLTQFMQVTMSNHKSTESTLKNLEVQVGQLAKFVEVKDEDSVVHEKKTTDKKSTDGKKNEVR

SEQ ID NO: 151890 - protein, 85 aa, Glycine max
  Coding DNA Sequence Number=SeqID_60205
MVFFGHLIHNYISVHSLKKGHALRRPYRTRARARVMGEVEEIQEKMKADMEAIKEKMATMMEAMMSVKKIMEANAVAIARYQRCC

SEQ ID NO: 151891 - protein, 144 aa, Glycine max
  Coding DNA Sequence Number=SeqID_60206
VDYKNKGETKDIELVELEQAQIGADPSSETSNKSENYKEEAQNATQKHKPKKVESVNADAKAFGVEPLEHTKKRDTGHQSVSLENKTGDSTVLKIGNSAKVVIKQDMKGRRHKYGFNNNKREKVEKKRVVDDETGDKNQLDEVL

SEQ ID NO: 151892 - protein, 69 aa, Glycine max
  Coding DNA Sequence Number=SeqID_60207
MAGTFFLLKQQNNLENYERDATQYMSMFLLTSALKGFNDKHSNKSKANGKRISVKNFIDPRTLEPQRIK

SEQ ID NO: 151893 - protein, 113 aa, Glycine max
  Coding DNA Sequence Number=SeqID_60208
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPAHLASTSKFLEQMGLHSPSFPATFRP

SEQ ID NO: 151894 - protein, 117 aa, Glycine max
  Coding DNA Sequence Number=SeqID_60209
MWAWERCPTLAPKRTPSQVENTPLGHRWLRRGNQHIGNDDVRIFRRKLDIMKRHEDMFKSKGKDPLEGLGGPMTRARARKAKEALQQVLSILFEYKPKFQGEKSKVVSCIMAQMEED

SEQ ID NO: 151895 - protein, 176 aa, Glycine max
  Coding DNA Sequence Number=SeqID_60210
  Pfam annotation: Domain name=G-patch; Domain location=13-57; Score =18.8; E_value=0.001; Accession=PF01585.14; Description=G-patch domain
METSPLPPSLSNAAIMVARVMLKHGYELGMGLGKDGLGNADVVDMRGNPYKYGLGYEPGMLGRRNAPSRFWADRAWPGHVSQCFTSAGIMFEEEVATIGEECPQDPPSFVRPCHPDSQVGNWRVISQSKVYTADSIYEGRFFEDPNDKGLTIDFNRDVSQTMNEEEEEDVLSPELE

SEQ ID NO: 151896 - protein, 256 aa, Glycine max
  Coding DNA Sequence Number=SeqID_60211
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=Q9M4Q9; Match level="QueryCoverage=37%, HitCoverage=14%, E-value=1e-32, Identity=77%"; Hit description=Malic enzyme
  Pfam annotation: Domain name=Malic_M; Domain location=60-209; Score= -87.6; E_value=9.1e-06; Accession=PF03949.6; Description=Malic enzyme, NAD binding domain
DAGSRQARQGASAGVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKLPQQQGPIWTFCLFVHQANNAYIFPGFGLGLIMSGTIRVHDDLLLAASEALVAQVSQENFDKGLIYPPFTNIRKISAHIAANVAAKAYELAIGGSRYRARIRNHGHSCFLCEIVIRSQFHTTYEAGSIKCKAWGA

SEQ ID NO: 151897 - protein, 118 aa, Glycine max
  Coding DNA Sequence Number=SeqID_60212
IFYKKVEYVLEDCNEVLVKINKFVVNKEGLVCVETLCMPVTKPERFELDAFELDEPEDAGSKCNLILCKRHSSFPFPTECHHTLLIAHCVQRQRESPITYCALSLLSLLTLFFSMFFL

SEQ ID NO: 151898 - protein, 193 aa, Glycine max
  Coding DNA Sequence Number=SeqID_60213
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPLLWGKLRMRQSIPRGMQAWHWPSFYNVVTGKTLALPNLIALQHIPLSPAGVIAKRPAPIALPNSCAA

SEQ ID NO: 151899 - protein, 29 aa, Glycine max
  Coding DNA Sequence Number=SeqID_60214
GLGEKTHHFTLLYGEMVIDKLPDSQKQDA

SEQ ID NO: 151900 - protein, 72 aa, Glycine max
  Coding DNA Sequence Number=SeqID_60215
MTELVKVANKSEALAPTYPPMRNSDLRADNRMVSPRATRFLGHGNKSGVVDKSEALAPTYPQMRNSDLRSSG

SEQ ID NO: 151901 - protein, 160 aa, Glycine max
  Coding DNA Sequence Number=SeqID_60216
  Subcellular localization annotation: CTP_CleavageSite=48; ConfidenceScore=5.59e-01
MNLLPSAVHASSTNESGALRSYCVALFANTPFSTFFRSPMNLLPIAVHASSTNECGAPRSYCVVLFANFPFSTFIRRPMNSLPSAVHVSSTNESGAWRSYCVTLFANSPFTNLIRRPMNSLPSAFHVSFVIKRGAFGDWEICFSVIFRIGSFAKHKKKKE

SEQ ID NO: 151902 - protein, 118 aa, Glycine max
  Coding DNA Sequence Number=SeqID_60217
MEKLMFDMVNESSSTMNALDRQSSVEVMEQEGGLCDGIEVDQFHQPSGSNEVAIANEDGISYGSELIEVDKMVLSGIFFGDRMSLKLQEYLKKHFREFRHVHCCPLKQDWVKDQAANK

SEQ ID NO: 151903 - protein, 57 aa, Glycine max
  Coding DNA Sequence Number=SeqID_60218
MRPITATHSQNVFLKGFPLCALSPCVIDYTQPVIDYQCPITLCNRLHTLGNRLPEAI

SEQ ID NO: 151904 - protein, 113 aa, Glycine max
  Coding DNA Sequence Number=SeqID_60219
MKKMIERRKESLLKLRSSNQEESDKENSIEIDEDDDLSLFVKRFNKFLRKSEKKNFSEKKAKKAYITRDDNDLESSENSENEVINLSLMAKSYESDEEMHLLICIENQSNLQN

SEQ ID NO: 151905 - protein, 62 aa, Glycine max
  Coding DNA Sequence Number=SeqID_60220
MAVGQHTALTVWETNFVGEAFVVEWAIFVGWVPKWEGFRCWLNNSVDAGNIGMWGCEGFVGI

SEQ ID NO: 151906 - protein, 91 aa, Glycine max
  Coding DNA Sequence Number=SeqID_60221
  Subcellular localization annotation: CTP_CleavageSite=39; ConfidenceScore=5.21e-01
MTHQDFQVQAIGQFAQATCAPEFGLPRPFNQRLLVLHVGGVAVKQRESSTTRDPRSLKSFFRNKKKMKSLLKEVDCKMKINQKFLIEYASG

SEQ ID NO: 151907 - protein, 149 aa, Glycine max
  Coding DNA Sequence Number=SeqID_60222
MAAMMEAMKEQMAAMMEAMMSVKKIMEANAVASAATSVVAKVNPTSPSDINQMNHLTSDMVGKDLGSTGGPHDVQIQNEHAFPPYGLPLNYTPPNVAYTPNKNVNNSTPIPPWLGYATEGQAVGGIPLQNPLQGPQYHPPATPLAFHNK

SEQ ID NO: 151908 - protein, 280 aa, Glycine max
  Coding DNA Sequence Number=SeqID_60223
  Gene Ontology: Mol. function=chitin binding; Cellular component =extracellular region; Biological process=chitin metabolic process
  Homolog annotation: Hit_ID=UPI00006A17C9; Match level="QueryCoverage =56%, HitCoverage=100%, E-value=3e-10, Identity=31%"; Hit description= UPI00006A17C9 related cluster
MAVRLFPAADHPNAAVVFRPAPVWGAVLLDESSISRGPDALAGGDRYSVELTETRLIEARNQSWKPQGPVDFFRFTGCLCGGRLALRSLGRMLLSSNVIYICVRVVMLVRMIRTRLFVAAQVKSCPDMHSSCVIASLSGCARTVGPPPISGGGQEPLKGNYWTLNSLKVRMWSTLKMRTRSPLKVRACNPLKARMYSPLEVRACSPLKVRACIPLLARTCSPLKVTACSPLLARTCSPLKVRACSPTKVRTCSPLMARVCSPLKARASSPLKARTCSPLE

SEQ ID NO: 151909 - protein, 86 aa, Glycine max
  Coding DNA Sequence Number=SeqID_60224
MTMHTRLILPGEYGVHATFNVGDLSPYLDDDGIQELRAIPFKGGGDGTKIDQEELKINTSDIQREVNGVGAVWNPHQGLSLITWLF

SEQ ID NO: 151910 - protein, 277 aa, Glycine max
  Coding DNA Sequence Number=SeqID_60225
RKVEIYHTELDEFKAELERRNFHKYLTNLVDGSIDLALVKEFYANLYSSEDRPPKQSKVRGNLVKIDANSLKTFLETPVVLAEGETLPAYSRYCRLPTDYREIEAASCIPSRGFILNSEGHPGKILRKDLTTLAQVWSVLSYSNLAPTSHTSNLTVDRARLIFGLVSRMDMSIGALIFGQMTSIAQSNTSRLGFPALITTLCRARGVVSDSLTFECLSPIINLAYIRKNCWNPKDLIVSIRGVRRARARPIELPSTSAAPTPASTPAAPSIPVQTDS

SEQ ID NO: 151911 - protein, 82 aa, Glycine max
  Coding DNA Sequence Number=SeqID_60226
MIENVIHGAPKKLENGECTKAITTHGSKLEDGRHMNENAIHGAPKKGLRMENCTKQSLTHGSKLEDGGHMNENAIHGAPKKV

SEQ ID NO: 151912 - protein, 171 aa, Glycine max
  Coding DNA Sequence Number=SeqID_60227
MEEGFSHGSVPIILGRKHPFLSDLHTCHSLCIESESKFEFDSVSNFYAENESEFESGSDFLGVVPLDVDFLESECTNHVAGSTSTSDLLYEVQAKEPSSSPTTVPPTVQPSPTPELKPLPATLKYAYLEDKEKFSVIISAFLDVKQEEKLLLVLKKHKKAIGWTLADIPWY

SEQ ID NO: 151913 - protein, 111 aa, Glycine max
  Coding DNA Sequence Number=SeqID_60228
  Subcellular localization annotation: CTP_CleavageSite=31; ConfidenceScore=5.14e-01
MMTKVMNKKLKRSKNNSSESKNNSSESKNISSESRTSQEFKNQEEFKTQEESLQSRIKIQDLKNQDQDSRLKIQECRKDSIKITHESLTKPLPKSFYSLVIDYHIVVIDYQ

SEQ ID NO: 151914 - protein, 135 aa, Glycine max
  Coding DNA Sequence Number=SeqID_60229
MTHHSSSVHGERTSHKDPLSRILDDLSSLKLWKEKLERKEKGKEMVKINQDEREQIKEEERRKIVKELRKEKHVSYSSHNSCKSLSEELRDNYEGRHRSHLRPHSHRRENDRKPQEANINLPYFHGKYNVEAYLD

SEQ ID NO: 151915 - protein, 74 aa, Glycine max
  Coding DNA Sequence Number=SeqID_60230
NNVEGGVWGQNPFMGGSLDWQWATTNAEISQAISDIQPLFDNEVASAVGFLEDISHITLQQHEADSWTWKHESN

SEQ ID NO: 151916 - protein, 81 aa, Glycine max
  Coding DNA Sequence Number=SeqID_60231
  Homolog annotation: Hit_ID=UPI0000ECBAF8; Match level="QueryCoverage =50%, HitCoverage=48%, E-value=1e-16, Identity=100%"; Hit description= UPI0000ECBAF8 related cluster
MFGMFVYKAAVLVQAYRDNERLRLSRPAGMQAWHWPSFYNVVTGKTLALPNLIALQHIPLSPAGVIAKRPAPIALPNSCAA

SEQ ID NO: 151917 - protein, 189 aa, Glycine max
  Coding DNA Sequence Number=SeqID_60232
MWMDRFALTLNGSQELPRLLAKAKAMADTYSTPEEIHGLLGYWKNTITKRAARDPYRTRSKSRTMGDQEETQEQMKADMSAREEQMASMMEAMLSMKQLIEKNAATAAAVSSAAEADPTLLATTHHPPSNIVGRGRDTLGHDGSPHLGYNRAAYPYGLPPNYSPPVLQEDAGHIASPGHEREPPQQLDE

SEQ ID NO: 151918 - protein, 99 aa, Glycine max
  Coding DNA Sequence Number=SeqID_60233
  Subcellular localization annotation: CTP_CleavageSite=8; ConfidenceScore=5.31e-01
MSCRHALSASSARSASRLSPPRVSASLALSESSLTRAKRENGAKCDIEQKRKGGVERALNSRQSLKSKEQRGFSIERCIVSLELDRVGLGYRMSGYGVQ

SEQ ID NO: 151919 - protein, 157 aa, Glycine max
  Coding DNA Sequence Number=SeqID_60234
MRGAPAEESLSPFLVRDFGAQSFKIIRRVHKAWEIPLRKDKELRGIRNGIIGGYHEWLKVRTRGSELKLRREERDQPRAHSMVLKEELAACSRSTGNLSQRLCETKTNMLAIVSKYQEKLNLATTHEHKVADEYAQVYVENEARGRVIDSLHQEATM

SEQ ID NO: 151920 - protein, 277 aa, Glycine max
  Coding DNA Sequence Number=SeqID_60235
  Homolog annotation: Hit_ID=Q5XM22; Match level="QueryCoverage=29%, HitCoverage=46%, E-value=4e-20, Identity=60%"; Hit description =Resistance-like protein HAAS-2
PTASAHRRRVTVIVDDVVPAVPADSSAVPETEAVVARDEPMVDADAQDTGPDTDAQDIGTQDAADEPEGFLGGPKDPSVLTEYADHVAANVWSGQECPELMLCSHGRKEHNLGRLVPAIDDMETSSFHLPVGEVSITLDEDASLLHLPIVGTFHDFQPLRTDEVVVLLVELLMVLAEVAMTETGQYGGPYVRLQCLRDVYQCRCQTQHWIAAARAYLLHLLGCTLFANKSATHVHVSHLQALCYLTLAGRYAWGAADLVHMYDQLNDASLYTSRQLA

SEQ ID NO: 151921 - protein, 105 aa, Glycine max
  Coding DNA Sequence Number=SeqID_60236
MSRRCSPSNPHTKRNILIKAESSESSSRIRWRKFPNPPFQSFSEGVTLKHEPPLPIAIQDTGWRVSPVALAILADVEGAACSICETATHRVSPLPLARHLQKIQG

SEQ ID NO: 151922 - protein, 128 aa, Glycine max
  Coding DNA Sequence Number=SeqID_60237
MMQSYPAKALDRRLQEDWARDAREDPRVLISLRVDFGPIGKVCARLSLYILDYGYILGGTSRGYIYLGCYTKNKRGYISCGSVQVEGTSTWLFKENKGGYIPCGSLASKGFYKVKRNLKNRWLLGDSM

SEQ ID NO: 151923 - protein, 55 aa, Glycine max
  Coding DNA Sequence Number=SeqID_60238
PNHKTMEEIHVEDDEEQGMKALDLLHQWCPLLLEDQWKLNVEGVKVIGDDTSRRR

SEQ ID NO: 151924 - protein, 75 aa, Glycine max
  Coding DNA Sequence Number=SeqID_60239
MGKHIVHDGLPSHGQSTAGYGHIMSEVSLMKGSRSKDNCYLSADTSEKPVTPPHVYSPEKMKSEYGINWEIWTSA

SEQ ID NO: 151925 - protein, 80 aa, Glycine max
  Coding DNA Sequence Number=SeqID_60240
MKNFHRIAYGNVSEALRKHLGLDFLHENTFFHPRQLKCIAKGEKGRCLPPRGFLRKISKRTPITKFTPFFILYGKVRKPY

SEQ ID NO: 151926 - protein, 105 aa, Glycine max
  Coding DNA Sequence Number=SeqID_60241
MCQKSKGSVVTQSVKFRNVAEAKRKYCYAIRPLGPSRFFLQKAVASGGSNLDHLGELGGKLLPYFAINRGRSEEEKGSAFLALRIHLKLLRKIVALKKIQVEALP

SEQ ID NO: 151927 - protein, 100 aa, Glycine max
  Coding DNA Sequence Number=SeqID_60242
MLAIISKYQEELNLATAHEHKVADEYARVKDAITKRTPRHPYRTRSKSRTMDDQEEVQEQIKADMSALKELMASMMDAMLGMRQLMENNAATAAAVSSAC

SEQ ID NO: 151928 - protein, 176 aa, Glycine max
  Coding DNA Sequence Number=SeqID_60243
MVIDQSLFHDLTKLPSDGVPFEGTLNDDWKFDFSAHDARQLVCTNNADMTGRLSCRVSEEDLIIMWAFHIGRQLDWAHLVRYRKHKALRLNAPLPYPQLVTLFLRHFGIPLDSESYIPIKRSFLIGAAVIASFGYRKESDGSWVKKGVPPADDEGHLPVEDNSTLLQRLMDKFDGL

SEQ ID NO: 151929 - protein, 139 aa, Glycine max
  Coding DNA Sequence Number=SeqID_60244
  Homolog annotation: Hit_ID=UPI0000ECBAF8; Match level="QueryCoverage =29%, HitCoverage=48%, E-value=3e-14, Identity=92%"; Hit description =UPI0000ECBAF8 related cluster
VGTGERTRELPGGNACLWKNASNAAFLRFMAFCWPFAHMFFHALSPDSVDNRITAFEKRKSAQYANRLAPRVGRFINAAGTTGFPTGMQAWHWPSVYNVVTGKTLALPNLIALQYIPLSPAGVIAKRTAPIALPNSCAA

SEQ ID NO: 151930 - protein, 78 aa, Glycine max
  Coding DNA Sequence Number=SeqID_60245
TYQGNPCGVYLDLSSFTGSGVYPDLSSFTGSGVYPDLSSFIGSGVYPDLSSFTGSGVYPDLSSFTGSGVIQISGTCIK

SEQ ID NO: 151931 - protein, 252 aa, Glycine max
  Coding DNA Sequence Number=SeqID_60246
  Gene Ontology: Mol. function=motor activity; Cellular component=cell projection
  Homolog annotation: Hit_ID=UPI00006A2D9E; Match level="QueryCoverage =77%, HitCoverage=87%, E-value=3e-09, Identity=11%"; Hit description =UPI00006A2D9E related cluster
LYDESISNLLIRVDPWVLVPIALRGLHVLALRGLHVLTFRGLHVLDFRGLHVLALKGLDVLALRRLHVLALRGLHILAFRGLHVLDFRGLHVITLRGLHALAFRGLHVLGFRGLHVLAFRGLHALTVSGLHILAFRGLHVLTVKGLHTPAFRGLHVLAFRRLHVLAFRGLVALVVLDFIGLHILAFRGLHVLALRGLHVLAFRGLYVLTFRGLHVFAFRELKFLGHPLDLGGGPTMRAQPEKEAIAQLLCIP

SEQ ID NO: 151932 - protein, 113 aa, Glycine max
  Coding DNA Sequence Number=SeqID_60247
METLQKVHKAWEVVQKKDKELKGSNNGPIGGYRRWLKAHVLGLDWLPSLRTAKREEVEAPEEDEEENAELRDINIATTEALEQETKRARREEHGRNMFRGALWGSNNELKLRR

SEQ ID NO: 151933 - protein, 326 aa, Glycine max
  Coding DNA Sequence Number=SeqID_60248
  Gene Ontology: Mol. function=motor activity; Cellular component=cell projection
  Homolog annotation: Hit_ID=Q2RWD1; Match level="QueryCoverage=88%, HitCoverage=70%, E-value=2e-17, Identity=29%"; Hit description =Putative uncharacterized protein
PHVLTFVGLHVLAIKGLHVLTFRGLHALAIRGLHVPTFVGLHALAIRGLHVLTFRGLHALAIRGPHVLTFVGLHALSFRGPHILTCRGLHALAIRGLHVLTFRGLHALAIRGLHVLTFVGLHALTFRGPHVLTFRGLHALAIRGPHVLTLVGLHALTFRGPHILNFRGLHALAIRGPHVLTFIGLDALAIRGLHVLTFRGLHALAIKGLHVLTFVRLHALTFRGLHVLAFRGLHALTFRGLHVLVNRGLHALTLRGLHVLANRGLYALTLRGLHVLTNRGLHTLTSRGLHILTLRGLHALTFRGLRVLIFSVLHIRTLREFKVLCP

SEQ ID NO: 151934 - protein, 119 aa, Glycine max
  Coding DNA Sequence Number=SeqID_60249
  Subcellular localization annotation: CTP_CleavageSite=96; ConfidenceScore=5.17e-01
MASIIAAICSFMVSMSASIYSCTSSALPITLALAQIFNMVHDISVKVKLEVTGTLTSLNVFGSRRRSGVTRSIFCPNFCKMVTSMLQLDSMNLFVKARAWFNPITQGMAIDRQYFINNS

SEQ ID NO: 151935 - protein, 101 aa, Glycine max
  Coding DNA Sequence Number=SeqID_60250
MVRTKGLGRALGHVTGRGVGRGDRDDSDDAPQCQWPTASAQRQRVPVTTAHDEPVLPAPDVEVDVFLDVLMAPADVEDTGADIPADTGAQAAEDEHEGFLG

SEQ ID NO: 151936 - protein, 72 aa, Glycine max
  Coding DNA Sequence Number=SeqID_60251
MHGELPDMSTATHTEAVDVQTGDHIEDMIQDLGQEGFWQAHAPYYEKLLKDSKNSLYLGCTTFTRLSMVLFW

SEQ ID NO: 151937 - protein, 79 aa, Glycine max
  Coding DNA Sequence Number=SeqID_60252
MENWRTALGNDIRGAPDSKRLAIMTFAELRLEGVGHMNSASNDIHGAPEKSGEWRIGEQRSAMKFAGLQTRSWRTHEQR

SEQ ID NO: 151938 - protein, 37 aa, Glycine max
  Coding DNA Sequence Number=SeqID_60253
  Homolog annotation: Hit_ID=A4W912; Match level="QueryCoverage=100%, HitCoverage=14%, E-value=9e-09, Identity=83%"; Hit description=Short- chain dehydrogenase/reductase SDR precursor
MTTPRSTALVTGASSGIGAVYADRLAARGLNLVLVAR

SEQ ID NO: 151939 - protein, 66 aa, Glycine max
  Coding DNA Sequence Number=SeqID_60254
MEGGIGSIQDLAPKEEKRIKGLKRLGNEGETTNVAPFKACRPWIFFINGVLCFLNFNHRGMEKKKS

SEQ ID NO: 151940 - protein, 85 aa, Glycine max
  Coding DNA Sequence Number=SeqID_60255
MLYVIDYNDLGTSFVVQVEGTSTWVVVTENKRGYISCGSVLVEGTSTRLFKENKGGYIPCGSMLVQDFTRLKRNLKDRRSLGDWM

SEQ ID NO: 151941 - protein, 100 aa, Glycine max
  Coding DNA Sequence Number=SeqID_60256
  Homolog annotation: Hit_ID=A5C8K0; Match level="QueryCoverage=88%, HitCoverage=5%, E-value=8e-07, Identity=30%"; Hit description =Putative uncharacterized protein
MASSNYLFPKGSSINRSPIFNGVEAIDLNIWEAIEIGPYIPTKVVGNTTIEKPREEWSEEEKRLVQYNLKAKNIITSALGMDEYFRVSNCKSAKDMWDTL

SEQ ID NO: 151942 - protein, 229 aa, Glycine max
  Coding DNA Sequence Number=SeqID_60257
MAGDTGSCGSRESRMQKDWRFDRSVRNTELQKKNPIRRKYTDEARDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFLIQVWEMKNLRRAVAAIGDVIESDDDTEDRRRLDRARVLVRTPLPPLIRSERQGSKVGRTGKEARRPMGGRR

SEQ ID NO: 151943 - protein, 174 aa, Glycine max
  Coding DNA Sequence Number=SeqID_60258
MKRCLCNECIYGHESPENHLFLLAHSGAQCPMCAVKKVIWTFRLPVTKDETNIQCMHDDMMHTRKSTKRGWTTSNNMLSKRQTLDEGSLLSSKSETQHDHRFTSTPYVPIDPYRAPFQLTSPVESPTVATYPSAGGRHEGSRVRLPWEEDARSHHQRLFEENVENTGKGVVYEL

SEQ ID NO: 151944 - protein, 220 aa, Glycine max
  Coding DNA Sequence Number=SeqID_60259
MEGSMIDAANGGIHGDMTLVEARNLIKKMASNSQQFSARNDAIVLRGVHEVATDSSSSTENKKLKGKLDALVNLVTQLAMNKKSTPIARVCGLCSSADHHLDLCPSLQQSGVNEQLEAYAANIYNRPPQQQNQQQQNNYDLSSNRYNPGWRNHPNLRWTSPPQQQQSVPPFQNVASPSKPYVPPPIQQQQSQQRQPATNAPPQPSLEELVRQMTIQNMQF

SEQ ID NO: 151945 - protein, 210 aa, Glycine max
  Coding DNA Sequence Number=SeqID_60260
MAAEWEKEEREETPLQREEAHHHRRPWIRAWRKKEMNEGRGREEHKILCSKRALKSESRCPKIQGLKLIDHHKDRVYTFLGPRMPKDKVHTNVYLGCRWDGYQEVKNKNNTLDQRKEEMKSTQRKSKECRKEENKHKFLYWFGNNPCRHPVSKQPPVLEISNNLVKSFKSKDPQGMFPPLLSLNNQVDVRSTCTDPQEMYPLLFSVLQPK

SEQ ID NO: 151946 - protein, 20 aa, Glycine max
  Coding DNA Sequence Number=SeqID_60261
DARKFVIRANSEATVIVFEL

SEQ ID NO: 151947 - protein, 344 aa, Glycine max
  Coding DNA Sequence Number=SeqID_60262
  Gene Ontology: Mol. function=two-component response regulator activity; Cellular component=intracellular; Biological process=two -component signal transduction system (phosphorelay)
  Homolog annotation: Hit_ID=A0THT9; Match level="QueryCoverage=43%, HitCoverage=64%, E-value=9e-18, Identity=32%"; Hit description=Two component transcriptional regulator, LuxR family
  Pfam annotation: Domain name=Hpt; Domain location=101-184; Score =43.4; E_value=7.8e-10; Accession=PF01627.14; Description=Hpt domain
  Pfam annotation: Domain name=Response_reg; Domain location=177-291; Score=21.3; E_value=8.6e-05; Accession=PF00072.15; Description =Response regulator receiver domain
  Pfam module annotation: Pfam domain module=Hpt::Response_reg; Domain location=101-184::177-291
GPRDYRLQHAGDGRLRIHPPAARRREALVRRAVPVYGLTAMAEERVAQLAQDAGMNGCLFKPLERAQLLQVITGAPMNPTRDDTLLTLENLAANNPQAWRDLVTTARQQNSYDLAQLTQAVAANNFASARHAAHQLLGSARMLRADALQHRCRAAEQAAEHEDGALLQQLLPEVAGAVAELDALFLRALETPIPEEEPQLDLVGAFAQRQQLMAFLQRHPLDILVLDYMLGEDQLDGLQMVKQLRLHYPQLKILVSSAVEKPAIVQLLLKAGVQGFVGKSHDQEVLIDAIHQICRGKRFLTPDMMLELDKFQESDREMHDYLTPRQAGDDITLLLRELSPREIE

SEQ ID NO: 151948 - protein, 60 aa, Glycine max
  Coding DNA Sequence Number=SeqID_60263
  Subcellular localization annotation: CTP_CleavageSite=36; ConfidenceScore=5.06e-01
MVLVAAIATTLTSIISFMLIMTSIILAICSFKAFVSAFICSYTSSTSPITLALARVRTWG

SEQ ID NO: 151949 - protein, 207 aa, Glycine max
  Coding DNA Sequence Number=SeqID_60264
AQPRGDDADVRDVVVDREFGLDNQDPLYTMNEIPMRESRAKEDLRLDGKGKPRTDTKACKEPAELKGQYIGPALPLQHKITTERKGLLVELLANRYDGKTFDNRSFCGYESGGDRSSSGATQQATICATPNSSSETSASFPSYPSFPSVAVSRILFIVTYCVGKRLKQPKQYVQKPSLDPNIVMKNVPDGLISAEPVQEREEEVTTI

SEQ ID NO: 151950 - protein, 115 aa, Glycine max
  Coding DNA Sequence Number=SeqID_60265
ESHPQRHPMDPEKSNRALGFPALVTGLYSPTRGPFPPARSRHHDIGIAPARHPSGPEEVQQECLSPPTNQAFIKKYCIPRQAQGESPQQPGDGWQRATDAPPSPLEFTSAHPQKG

SEQ ID NO: 151951 - protein, 71 aa, Glycine max
  Coding DNA Sequence Number=SeqID_60266
MMTTKDDDKSDEQKSQRSKNNSSESRTIQEFKNQEEFKTQEESLESRIKIQDSRSQESRSRFKTQEKTQSR

SEQ ID NO: 151952 - protein, 82 aa, Glycine max
  Coding DNA Sequence Number=SeqID_60267
  Homolog annotation: Hit_ID=Q51617; Match level="QueryCoverage=71%, HitCoverage=92%, E-value=8e-16, Identity=71%"; Hit description =Putative uncharacterized protein
  Subcellular localization annotation: CTP_CleavageSite=66; ConfidenceScore=5.82e-01
MVGKKAVSSFGPPIVVRSVSRGPFVSRVSVMTVKTSDTCSSRRRSQLVCKRMPGADKPVRARQRVLAGVGAGLTMRHQSRLY

SEQ ID NO: 151953 - protein, 147 aa, Glycine max
  Coding DNA Sequence Number=SeqID_60268
MDRAHKTPSGPGGAQQGPEVPSSGYGPLDRAHKIPNGPGGAQQGPEVSSSGYGPLLVLQGACSPQQGIVPARHPVDPKKSNRVLELPALITGLCQFYEVLVAPSKVISPLTNRAFIKKYCAPGRCRAKHHNSLGMIGSGQQTHRHHL

SEQ ID NO: 151954 - protein, 143 aa, Glycine max
  Coding DNA Sequence Number=SeqID_60269
MDSHCLLSLRLYIKENPPHLIALGRLYEGSTTVHNIPLHHDQVKVGVEEVRDANAPIPVPTQEGAVRSGKSAHRSDHHVDDPLYLMTLTIPRLFLKLLQVMWDATVFGVFNDNFPLYIKHEDLSEIPHGGQCLNISVIQLWIL

SEQ ID NO: 151955 - protein, 307 aa, Glycine max
  Coding DNA Sequence Number=SeqID_60270
  Homolog annotation: Hit_ID=Q6WAY6; Match level="QueryCoverage=63%, HitCoverage=45%, E-value=6e-20, Identity=29%"; Hit description =Putative uncharacterized protein
MEPIASLSQYYDQPLRCFTFEDFQLVPTVKEFEEILGCPLGGRKPYLFSGFYPSTTRVAKYQGSVWRKGQRPWKIKANGLSFIDILALLIFGVVLFLNMEGLVDLAVIDAFLAFHHGKESPVVAILAMYDTFDRGCPSICYKVTARASKKERILSSCEGCPNVPLMGTRGCINYNPVLAIRQLGYPMRGVPSDESITPFIARGFSDHNARDRELRGSSNGIIGGYYKWLRIRTQGLDWLPNLKTVRDDEVKASEESDKVQALKAELERARVVEEKFKAAIVSSSSKEVKGIIMGQRHDLEGRAKSLP

SEQ ID NO: 151956 - protein, 220 aa, Glycine max
  Coding DNA Sequence Number=SeqID_60271
  Homolog annotation: Hit_ID=A5BSR3; Match level="QueryCoverage=58%, HitCoverage=38%, E-value=2e-11, Identity=36%"; Hit description =Putative uncharacterized protein
RNLISQRLLTVGRKGSYYRPWGRDGGSLNQTSRGNRPLQPIWTVSRTLSDVRMKAQAIQKQNTAPNVLSPRGYDYLEQKLLAEKTKKKLEEVAQSRSVDGIIDPPSPVRCHVKWKMARTKKTGEMTTEVVKEIAEKIDSFEEQATQGSFVPHGRQDVLAAAIGRLEHPGRVRAAGAGVTIKQYFGSGPQTSRSASSLPPDELQQLTQQIRDQLEESSQRK

SEQ ID NO: 151957 - protein, 448 aa, Glycine max
  Coding DNA Sequence Number=SeqID_60272
  Homolog annotation: Hit_ID=Q6WAY6; Match level="QueryCoverage=67%, HitCoverage=61%, E-value=1e-24, Identity=28%"; Hit description =Putative uncharacterized protein
FYPVKVKSLGITSLRELGQLMGQLQRQAFRKAYGKIWDLAMVKVSTEAIASLAQYYDQSLRCFIFGDFQLSPMVEEFEEILGCPLGGRKPYLFSGKCLEAKARILAGKGEWAPFIDILALLIFGGVLFPNVDGLVDLAAIDAFLAYHNHKESPAVAMLADLYDTFDRRCEKRNTKIVYCTSALYVWLVSHLFRQEVRHACPLESHRSCTEKGRANWDQLLASKEGASVNWGCISYNPILAIRQLGYPMRGASLEEEIVPVISRGFNKANVETLQKVRKAWEVLQKKDKELKGSNNGPIGGYSKWLKAHVQGLDWIPSLRTSKREEVEAPEEDEEVQALRAELEACREEHDRNKFRGALWGSNSKLKLRREERDQSRETETNMLAIIIKYQEELSLATAHEHRVADEYAQVYAEQEARGRVIDSLPQEATIWMDRFALTLNGSQDFPDC

SEQ ID NO: 151958 - protein, 201 aa, Glycine max
  Coding DNA Sequence Number=SeqID_60273
MGSVLIPSVNKPTEGPCRLRKNVRWGILLPLDVVSKKGTNSPDPRIPRLHLCHMHSIMHSSIPPMRYRSFDLHQLLSHFSKHGNKSNRQEVLPSQGQKPRYHQHQGIRAVDGTSPNASLPQDLRIDLRVDHSRGVHRSHCITYPILRPAFENCNCGPGFSKRFGPHKTDSERHSGPTTEVPRRQGEGYGQSEESGSRLWMC

SEQ ID NO: 151959 - protein, 54 aa, Glycine max
  Coding DNA Sequence Number=SeqID_60274
MFLVFNKALKGLDDTPQPKSKAVARWIVVKTKGSTECGYYVMHWMSTIILGTQK

SEQ ID NO: 151960 - protein, 66 aa, Glycine max
  Coding DNA Sequence Number=SeqID_60275
CRNGTLRREGDARAHRCVFEGRKMRGVATNVYSRKTSEKPEKAWSTNFKCERFGSCIYARGRIYFD

SEQ ID NO: 151961 - protein, 344 aa, Glycine max
  Coding DNA Sequence Number=SeqID_60276
  Gene Ontology: Mol. function=oxidoreductase activity; Cellular component=mitochondrial nucleoid; Biological process=metabolic process
  Homolog annotation: Hit_ID=A4VQQ1; Match level="QueryCoverage=96%, HitCoverage=65%, E-value=1e-157, Identity=81%"; Hit description =Aldehyde dehydrogenase family protein
  Pfam annotation: Domain name=Aldedh; Domain location=5-344; Score =341.7; E_value=1.3e-99; Accession=PF00171.13; Description=Aldehyde dehydrogenase family
MKPGITVSRYVETLAADLPLAVDHFRYFAGCVRAQEGTAAEIDEFTAAYHFHEPLGVVGQIIPWNFPLLMAAWKLAPALGAGNCVVLKPAEQTPLSITLLMELIKDLVPPGVINVVHGYGKEAGEALASHPGIAKIAFTGSTATGGHILELAAKSLIPSTVELGGKSPNIFFEDIMQAEESFIEKAAEGVVLGFLNQGEVCTCPSRALVQESIFEPFMAAVMKRIQTIKRGDPLDTETMIGAQASQQQFDKILSYLEIAQQEGAQVLHGGGVEKIGEAFASGYYIQPTLLKGDNSMRVFQEEIFGPVVGVLTFKDEAEAIAIANDSIYGLGAGVWTRDINRAYR

SEQ ID NO: 151962 - protein, 289 aa, Glycine max
  Coding DNA Sequence Number=SeqID_60277
  Gene Ontology: Mol. function=transition metal ion binding; Cellular component=viral capsid; Biological process=response to stress
  Homolog annotation: Hit_ID=A7MK77; Match level="QueryCoverage=100%, HitCoverage=96%, E-value=1e-125, Identity=76%"; Hit description =Putative uncharacterized protein
  Pfam annotation: Domain name=Mn_catalase; Domain location=1-289; Score=415.9; E_value=5.9e-122; Accession=PF05067.3; Description =Manganese containing catalase
MFRHVKKLQYTVRVSAPNPGLANLLLEQFGGPQGELAAAMRYFTQGLGDEDLGRRDLLMDIATEELSHLEIIGSLVGMLNKGAKGKLAEGTEEEGELYRSITGAGNDSHLTSILYGGGPPLTNSGGVPWTAAYVDTIGEVTADLRSNIAAEARAKIIYERLINVTDDVGVKDALGFLMTREAARQLSFEKALYSIRDNFPPGKLPPIEQYAHNYYNMSEGEDVRGSWNSDDNFDYVADPQPAVDGGDGQPSVTLSPDEQRDIDALAARTASDPLIDPITGAEAGSKKAP

SEQ ID NO: 151963 - protein, 930 aa, Glycine max
  Coding DNA Sequence Number=SeqID_60278
  Gene Ontology: Mol. function=FMN binding; Cellular component=plasma membrane; Biological process=thiamin biosynthetic process
  Homolog annotation: Hit_ID=A4WBZ6; Match level="QueryCoverage=31%, HitCoverage=89%, E-value=1e-101, Identity=66%"; Hit description=ApbE family lipoprotein
  Pfam annotation: Domain name=ApbE; Domain location=1-309; Score =176.3; E_value=7.8e-50; Accession=PF02424.6; Description=ApbE family
MTSDAGVHSYSAVLMGSPILLKLFEDNPTLASQVFRLIKQQENLFTVNRAESEVMAINHAAGRHPVVVSAPVFALISVAHAVSILPDSAFNFTIGPVVKRWKIGFQGREVPPAAEIEALLRLTDPHQVVLDAEQHSVFLPLPGMEIDLGAIAKGYIADVVQAFLRQQGVAQALINLGGNVQTLGSPPHQPQGWGIGLKKPFGRDDELLGTLQVQGKSVVTSGIYERYFERDGRCWHHIFDPRTGYPLDNALLSVTVIADRSLDGDIYTTLLYGMGVEQGLAYLAGQPDIDAPAGFQLAAASLTVLLQQRMVLRLQAIAIHRAAGGTVVNAARRWKTHGRDGRQSTDTACAASAALSLSAAVCCRAGWPGCRASADRDPIADSSAGYPSAIFSAASRSAPLQNAGTGTLRQQIEPVLLLHIDIQQHQVDRRFAIEQELARLLQRRGGTHAVKARYLADKAAVQLGHHGEQADPAILAFGREALVKHGCQMLRRNTRSVIAHFTGQPAVLIVQHDVDFALGLLTHRIQRILHQVADHGDQRRHLLLVAAVRQVTGIADGQTMAAIRGAEADFRLIVISGLQNIGFYLRIIFHVQQAEDHMQLIHELVRALTQGINIVYHAGQTLHQLADFGLVPEGADRADNASLTAHRHGVAQQQSAIDVELLIAPCATAVEHFLQMLVDHRGIINARGTHHAAAHFIAQQLARRLIDQRHLALIVHRHHAFLDGVKDRLALLKQGGNFVWLEAEQDTLQHAHQNEGANRAGKSADQNGPQNAPATLVDLVGDRLQRDADSHHANLPLLGVIHRGKHAQRFGQRALIHGDILVAAQRRFDVRADKVFAHQLRITVRIADAIHVGDADKQQMVALFHRFGDGLDSGPIGRQAQRLLNFGGFRQRARYRHGFILQLAARRGANLEEIKHVYAQQHQHNHRAEH

SEQ ID NO: 151964 - protein, 423 aa, Glycine max
  Coding DNA Sequence Number=SeqID_60279
  Gene Ontology: Mol. function=DNA-directed DNA polymerase activity; Cellular component=cytoplasm; Biological process=response to DNA damage stimulus
  Homolog annotation: Hit_ID=A7MEJ2; Match level="QueryCoverage=98%, HitCoverage=99%, E-value=1e-141, Identity=59%"; Hit description =Putative uncharacterized protein
  Pfam annotation: Domain name=IMS; Domain location=6-352; Score=466.3; E_value=3.9e-137; Accession=PF00817.11; Description=impBmucBsamB family
MMYALVDVNSFYASCETVFRPDLRGRPIVVLSNNDGCIISLSREAKALGIKMGAPWFKHRDELMRHQVVVFSSNYALYGNMSARVMETLDRLAPRVDVYSIDEAFLDVSGIEGYTSLTRFGEQVRDCLWKETHLKVGVGIAPTKTLAKLANWAAKRWTKAENVMDLSDPARQRGLMQRVGVEEVWGVGRRLSNKLNLMGIQTALQLAETPTALIRKHFGVVLERTVRELRGEPCLAFEEVIPHRQNILCSRSFGDRITDYQDMREAIASYAARAAEKLRSERQYCRYIGTFIRTSPHDPHQPYYANAASQTLITPTADSRDIIQATLNCLDRIWIPGKRYLKGGVMLGDFFSDGVAQLDMFADYQPRRNSDQLMALMDKINAHQRGALWFAGQGIQKPWAMKRDMLSPAYTTRISDVPRVKAK

SEQ ID NO: 151965 - protein, 134 aa, Glycine max
  Coding DNA Sequence Number=SeqID_60280
  Gene Ontology: Mol. function=transition metal ion binding
  Homolog annotation: Hit_ID=A7MLF2; Match level="QueryCoverage=80%, HitCoverage=65%, E-value=1e-35, Identity=69%"; Hit description =Putative uncharacterized protein
  Pfam annotation: Domain name=DUF892; Domain location=31-134; Score =97.3; E_value=4.8e-26; Accession=PF05974.3; Description=Protein of unknown function (DUF892)
MHGGRCVMLFITHHEPPVNHRFGEYSMKVKSLLDLFIHDLSDVYSAEKQITRALPKLVRAASDESLKNAFQQHLEETQGQIERLDQVVESHDELRIMRMKCHALEGLVEEAQELIESTEAGPVRDAGLIGAAQK

SEQ ID NO: 151966 - protein, 108 aa, Glycine max
  Coding DNA Sequence Number=SeqID_60281
MNYIPSYKKTWLAKQRALEMIHGNWEESYAELPKLFGALQSCVPGTVVAAQTESLYEGGEIVTHTRRRCTGDILGIFVQISQVQLNGLINYPNKNGYNASMRENVGDI

SEQ ID NO: 151967 - protein, 183 aa, Glycine max
  Coding DNA Sequence Number=SeqID_60282
  Homolog annotation: Hit_ID=A5AZG1; Match level="QueryCoverage=54%, HitCoverage=33%, E-value=3e-08, Identity=34%"; Hit description =Putative uncharacterized protein
  Pfam annotation: Domain name=zf-CCHC; Domain location=127-144; Score =22.6; E_value=0.00058; Accession=PF00098.14; Description=Zinc knuckle
MKREKHASYSSHNSCKSLSEELRDYYEGRHRSHLRPHSHRRENERKPQEANINLSYFHGKDNVEAYLDWEIKVEQKLKRKSTLKSYGSHSYPKKDQGLGILGAAPSKGKTIEKQPPKASMQEKTSSIKCFKCLGRGHITSQCPTKKTMIMRSQDIYSSQDEATTSPSSSENEEAKGEESSEEI

SEQ ID NO: 151968 - protein, 162 aa, Glycine max
  Coding DNA Sequence Number=SeqID_60283
MERSMIDAASGGALADMTPAEARNLIEKMASNSQQFSARNDAIVIRGVHEVATNSSSSAETKKLEGKLDALVNLVTQLAMNKKSTPVVRLCCLCSFADHHTDLCPYVQQSEAIEQPEAYAANIYNRPPQPQQQNQPQQNNYDLSSNRPYVPPPIQQQQQQQE

SEQ ID NO: 151969 - protein, 143 aa, Glycine max
  Coding DNA Sequence Number=SeqID_60284
MDNEEGVQEQMKADLSALKDQMTSITEAMLKLQKTIEDNATTTASNTDREVESVLQPAINLGRDRNTMVFGRRYSPQAYPYGLPPDITPRTAPDDLSQAPTFEGQLPPYADYPLQEDDKGDAHLGPLLPLKDPAPHELPQANI

SEQ ID NO: 151970 - protein, 108 aa, Glycine max
  Coding DNA Sequence Number=SeqID_60285
  Subcellular localization annotation: CTP_CleavageSite=26; ConfidenceScore=5.79e-01
MGSPPASTTPPPPLSPLSPPPTSDASASTSAVKRTRKASRLRSLYTRPPGVERPVVHVDPATGKADSPHKKKLRTYLGIVARDKVDITYENWKEVPTAQKDPIWEDIQ

SEQ ID NO: 151971 - protein, 87 aa, Glycine max
  Coding DNA Sequence Number=SeqID_60286
RASAKHNTPRLSARKTLEEDECRNVPFRGRAKARLTGALSQRLFVENVGKTEGKPVKMKILSSGVVFTFEEGISTSHVCLKGQQPIF

SEQ ID NO: 151972 - protein, 82 aa, Glycine max
  Coding DNA Sequence Number=SeqID_60287
MCRNLPICGRARRGSWVDKSGALAPTYPPSKRKSDLRNSFKRGESSDSFLLGRWSFKALDLKLIHFYLVRKAKALDLKTFFQ

SEQ ID NO: 151973 - protein, 257 aa, Glycine max
  Coding DNA Sequence Number=SeqID_60288
  Gene Ontology: Mol. function=nucleic acid binding; Biological process= RNA-dependent DNA replication
  Homolog annotation: Hit_ID=Q2AA51; Match level="QueryCoverage=66%, HitCoverage=69%, E-value=8e-09, Identity=27%"; Hit description =Retrotransposon gag protein
  Pfam annotation: Domain name=Retrotrans_gag; Domain location=49-134; Score=24.9; E_value=0.00021; Accession=PF03732.8; Description =Retrotransposon gag protein
SILEEEAQSSDYASSYSPSSRESTTDLPEASVMAEEHQHRVTLEDYSNSFVPQFFTREAKKWLYSFKGNSLKTWEEVVEKFLKKYFPESKNAEGKATISSFHQFPDESLSEALERFRGWKIKLKTPKEAIELIENMSTSDHAILHDRVHQPTKKSLLELSSQVALLAQNKLLSKQLEILTEALGCTICGEAHESGHCIPIEEHTQEVHYMGNQLRPPQQGPNIFQRTTKLEETLAQFMQVTMSNHKNIESALKNLEI

SEQ ID NO: 151974 - protein, 151 aa, Glycine max
  Coding DNA Sequence Number=SeqID_60289
  Gene Ontology: Mol. function=oxidoreductase activity; Cellular component=mitochondrial respiratory chain; Biological process =aerobic respiration
  Homolog annotation: Hit_ID=P0ABJ0; Match level="QueryCoverage=100%, HitCoverage=22%, E-value=1e-81, Identity=90%"; Hit description =Ubiquinol oxidase subunit 1 (EC 1.10.3.-) (Ubiquinol oxidase polypeptide I) (Cytochrome ...
  Homolog annotation: Hit description=o subunit 1) (Oxidase BO(3) subunit 1)
LIQFYVSIRDRDQNRDLTGDPWGGRTLEWATSSPPPFYNFAIVPQVHERDAFWEMKEKGEAYKQPAHYEEIHMPKNSGAGIVIAAFATVFGFAMIWHIWWMAIVGFAGIVISWIVKSFDEDVDYYVPVREVEKLENQHFDEISKAGLKNGN

SEQ ID NO: 151975 - protein, 175 aa, Glycine max
  Coding DNA Sequence Number=SeqID_60290
  Gene Ontology: Mol. function=transferase activity, transferring phosphorus-containing groups; Cellular component=membrane; Biological process=two-component signal transduction system (phosphorelay)
  Homolog annotation: Hit_ID=A0TDJ8; Match level="QueryCoverage=84%, HitCoverage=14%, E-value=1e-12, Identity=31%"; Hit description =Sensor protein
  Pfam annotation: Domain name=Hpt; Domain location=83-172; Score=30.1; E_value=8.1e-06; Accession=PF01627.14; Description=Hpt domain
MPRLDGFGLARKLRADDSSIPIVALTANAMPEDAQRVREAGMSTLLLKPLDLPSLEAALHGFDLDRSAQPPLPPVVSEAVQRQMREAFLQTAHRDYAALTQALDCADAPAMIDQLHSFAGALVFLGEPQAARSCQQAEQALRSTGATDAASRAIVIEAVGLIAASIERQVAAQQA

SEQ ID NO: 151976 - protein, 279 aa, Glycine max
  Coding DNA Sequence Number=SeqID_60291
  Gene Ontology: Mol. function=nucleoside-triphosphatase activity; Biological process=riboflavin biosynthetic process
  Homolog annotation: Hit_ID=A4WA94; Match level="QueryCoverage=99%, HitCoverage=21%, E-value=1e-127, Identity=78%"; Hit description=ATP -dependent helicase HrpA
QWDQVPDHLKRTFRVVDEHNRKLQEGKDLHQLKQVLKGKVQETLSKVADDGLEQSGLHLWSFGDLPQNYEQKRGNYQVKAWPALVDEKDSVAIRLFDSEREQQKMMWRGQRRLLLLNIPSPIKYLHEKLPNKAKLGLYFNPYGKVLELIDDCIACGVDKLMADAGGPAWQQENYEQLRDKVRAELNDTVVTIASQVEQILTSVFNINKFLKGRVDMTLALALADIKTQLSGLVYRGFVTGNGYQRLGDTLRYLHGIERRLEKLPVDPHSDRARMLKVQA

SEQ ID NO: 151977 - protein, 169 aa, Glycine max
  Coding DNA Sequence Number=SeqID_60292
  Homolog annotation: Hit_ID=A5C540; Match level="QueryCoverage=86%, HitCoverage=11%, E-value=9e-14, Identity=30%"; Hit description =Putative uncharacterized protein
  Pfam annotation: Domain name=zf-CCHC; Domain location=48-65; Score =9.2; E_value=0.062; Accession=PF00098.14; Description=Zinc knuckle
MMRTKNVDDHNAIAVVESERGRNHSRRHDGPRGRSKSQSRLQRDMSNIQCYYCGENGNVQVRCKQMKEDLKKLKDMNKDGANFQANVVKSVEDEDDHICRYRDMFDTSKTDGEFGHFKLGNDGKMKVEGIWSVRMKLYDGAIQTFPNVRFKVGMQNVQGETLGAARTEE

SEQ ID NO: 151978 - protein, 143 aa, Glycine max
  Coding DNA Sequence Number=SeqID_60293
MAAQLIHDRVEMECLEGVWETLEGNARCRFRGTIRFTATSLVHAEEPALTLQRTVEWILPTPTPYRLVEPVQVIEVSSSEEDPEEDPEELPPEPVVDALDFPEGDEDALPNVDSPKDVMSAFEADSMEESGPRGIATSGDSSS

SEQ ID NO: 151979 - protein, 83 aa, Glycine max
  Coding DNA Sequence Number=SeqID_60294
MLGFTSDSPHVPANPHQLDFAPYSLKSYSAQWNVPELLHDMHMLRSSRILGEMEVDEPWLRLWLPLNYQVVFVIGSAVDRLCG

SEQ ID NO: 151980 - protein, 135 aa, Glycine max
  Coding DNA Sequence Number=SeqID_60295
MARIYILIILNIFPKVFVQHLLCQEKFIGQKLMLFYFLPLLHSYKKIFKRPTLGDCFQEKVFLVANTEHKGPMFLGFIARSRICFLVDHWTQKTSSFGFIARSGYNFLVVITGHKGPMFLGVHCKKWEELQDCNH

SEQ ID NO: 151981 - protein, 177 aa, Glycine max
  Coding DNA Sequence Number=SeqID_60296
  Gene Ontology: Mol. function=nucleoside-triphosphatase activity; Cellular component=plasma membrane; Biological process=oligopeptide transport
  Homolog annotation: Hit_ID=P76027; Match level="QueryCoverage=95%, HitCoverage=50%, E-value=6e-89, Identity=99%"; Hit description =Oligopeptide transport ATP-binding protein oppD
  Pfam annotation: Domain name=ABC_tran; Domain location=49-177; Score=- 19.0; E_value=2.7e-05; Accession=PF00005.18; Description=ABC transporter
MSVIETATVPLAQQQADALLNVKDLRVTFSTPDGDVTAVNDLNFSLRAGETLGIVGESGSGKSQTAFALMGLLAANGRIGGSATFNGREILNLPEHELNKLRAEQISMIFQDPMTSLNPYMRVGEQLMEVLMLHKNMSKAEAFEESVRMLDAVKMPEARKRMKMYPHDFLAACVSES

SEQ ID NO: 151982 - protein, 116 aa, Glycine max
  Coding DNA Sequence Number=SeqID_60297
TDFAPFIIQEQQAEWEQQAEWVNAQRQILRPLSFGSSEAETNNGHSVSRCPGSIVSNKTQRQIMVIQRLVSTERNKFDSSAGREVHWLNGCDPHLTTSRYLAPIVRQFVKFRDMPE

SEQ ID NO: 151983 - protein, 149 aa, Glycine max
  Coding DNA Sequence Number=SeqID_60298
MTPTRHPLDPDKSNRALGFPALITGLCQSFGVPVAPSKVIRPPITQAFVEKYCTQRQAQGDAPQAADAPPPHQAGPAGSFDTEYLQSQGFTSFLCPTPDQFRAEVAWPGDWPEARAGEAPAEAPDEADEAREDEEMADLLDFLGGSGAT

SEQ ID NO: 151984 - protein, 101 aa, Glycine max
  Coding DNA Sequence Number=SeqID_60299
GIAQAERHPPISKSAEGAGECGLFLILRSNSNLHITKKTIKETVVGFTCQAFKHLAGLLRDYLDGTHPLAVGDRINDSSLQKLGYFLLHYIKNHRIESFLW

SEQ ID NO: 151985 - protein, 159 aa, Glycine max
  Coding DNA Sequence Number=SeqID_60300
  Homolog annotation: Hit_ID=Q2JIC4; Match level="QueryCoverage=62%, HitCoverage=18%, E-value=2e-08, Identity=45%"; Hit description =ISSoc9, transposase
VLAFRGLDVLVFRGLHALTFRGLHVLAFRGLHVLAFRGLHVLAFRGPHALAFRRLPILAFKGLHVLAIRGLHTLAFRGLHTHAFRGMHALAFRGVHILTFRGLHICALREFKFPFISSVPGPPPNPGGGPTMRAQLEEEAIVQPLCILGQDFTRAVTKR

SEQ ID NO: 151986 - protein, 72 aa, Glycine max
  Coding DNA Sequence Number=SeqID_60301
  Gene Ontology: Mol. function=RNA-directed DNA polymerase activity; Biological process=RNA-dependent DNA replication
  Homolog annotation: Hit_ID=Q7XG23; Match level="QueryCoverage=45%, HitCoverage=1%, E-value=2e-09, Identity=81%"; Hit description =Retrotransposon protein, putative, Ty3-gypsy subclass
MAHFIPCHKVDDASHISRLFFREVVRLHGVANSDDEGSTDLRTNPLQVGGDDGILPRRGPITRAMARRLQED

SEQ ID NO: 151987 - protein, 66 aa, Glycine max
  Coding DNA Sequence Number=SeqID_60302
MADGKLIEMKGRVNLGLKRSNLSKFGLWQGGFRHLPNLCSKKLSNFVQQKIVFVQKVLCVAGCRKG

SEQ ID NO: 151988 - protein, 24 aa, Glycine max
  Coding DNA Sequence Number=SeqID_60303
MERPGASPMTSTRFFRVVFSEKLE

SEQ ID NO: 151989 - protein, 128 aa, Glycine max
  Coding DNA Sequence Number=SeqID_60304
  Homolog annotation: Hit_ID=B0HC01; Match level="QueryCoverage=25%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPINCYFQYGCYCPCQAVSE

SEQ ID NO: 151990 - protein, 210 aa, Glycine max
  Coding DNA Sequence Number=SeqID_60305
  Homolog annotation: Hit_ID=Q6WAY4; Match level="QueryCoverage=88%, HitCoverage=33%, E-value=6e-21, Identity=33%"; Hit description =Putative uncharacterized protein
MGTNQTGKRFYQVKIKGLDITSIKELGRLMGPHQMQAFRKAYRKILDLTIVKISIKAIASLTQYYDQPLRCFTFGDFQLVPAVEEFEEILGCPLGGRKPYLFSRFLPSLRKIVIVVRDSARGLDRVKQTRNGIVGLPQKYSEGKARDMANQEEWVPFMDVLALLIFGVVLFPNLDGLVDLAAIDAFLAYHHSKESPVVAVLADLFDTFDR

SEQ ID NO: 151991 - protein, 87 aa, Glycine max
  Coding DNA Sequence Number=SeqID_60306
MSWNFTDYLTMGVKYLEAVRRRIERPTSSGYRQIRSPRLTKGADDHKVSLPATRLAVPGWLKGAEDDVSLCWLTKGADNHTEPLHVT

SEQ ID NO: 151992 - protein, 209 aa, Glycine max
  Coding DNA Sequence Number=SeqID_60307
  Homolog annotation: Hit_ID=Q5QJQ3; Match level="QueryCoverage=14%, HitCoverage=24%, E-value=4e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVSQSRRCKRRPVPSLHACRSTLEDPQSAVGYRARIRNHGHSCFLRETCRASCINESANARGEAVCVLGALPLPRSLTRCARSFGCGERYQLTQRRSFAPSWAVCTNPPFSPTAAPYPVTIVLSPT

SEQ ID NO: 151993 - protein, 36 aa, Glycine max
  Coding DNA Sequence Number=SeqID_60308
MARNGAYKFTFQYSIQVLNPLLMFSSRWGMHVTLNP

SEQ ID NO: 151994 - protein, 123 aa, Glycine max
  Coding DNA Sequence Number=SeqID_60309
MPGADKPVRARQRLLAGVRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFMT

SEQ ID NO: 151995 - protein, 320 aa, Glycine max
  Coding DNA Sequence Number=SeqID_60310
  Gene Ontology: Mol. function=zinc ion binding
  Homolog annotation: Hit_ID=Q8UGY0; Match level="QueryCoverage=30%, HitCoverage=91%, E-value=2e-45, Identity=92%"; Hit description=DnaK suppressor protein
MNTESYEKILRDRQRELYRRLHKIEADFEEPRNPDDDDRATERSNDEVLDELGQVGQDELRAIDAALERIAKGTFGTCVKCGSEISEDRLKAVPYTPESVAGSLPPAGKKVARRAGRGGKLSEHIYPAASSRCRGLLPGGEKKQVYAARSTGNWSGRRATQDLSFRNSTERNLIAINRLLQDWTMSDLWRFGRQYDFHEIVADGIVHGVGIVLALIGATALIFYAMVWGTLSAIAAAWIYGLGLVVHLYAVSDAGYPRSHDRGHAGADLARCDLRPPSQMPVSRPLRPGRHRPLSRHGLERRPGGRAAVGASRAGHALAD

SEQ ID NO: 151996 - protein, 216 aa, Glycine max
  Coding DNA Sequence Number=SeqID_60311
MVIDQSLFYDLTQLPSEGVPFEGALIDDWKFDFSVHDARRLVSEEDLIVMWAFHKGLQIDWAHPVRYRMHKALRLNAPLPYPHLVTLFHQHFNIPLDSEPYVPIKRSFLIGASVIASFGYIKEHDGSWVKKGARNVGEEGQEGEDHLFFRRLWIGLMVFKPLLVKGLTLWNCKWICASMKWSQESQRLKKMCLTFVQALIFHHRRHHHLRSLFLYY

SEQ ID NO: 151997 - protein, 52 aa, Glycine max
  Coding DNA Sequence Number=SeqID_60312
MQQGQADILIARFPDPNYGVKMGQADILIARFPDPNYGVKMVNFIINSPYLS

SEQ ID NO: 151998 - protein, 85 aa, Glycine max
  Coding DNA Sequence Number=SeqID_60313
MQSSKRDVYLVAYLNGALKGLDDAPQPKSKAPARWIVVKMSTIILETFRNNWEAYFNNPRPLEPERLKALRIQWAQFYLRVRDQT

SEQ ID NO: 151999 - protein, 122 aa, Glycine max
  Coding DNA Sequence Number=SeqID_60314
IMGRTRGLGRAIGRVVGRDRAADEDAGDVPERRRPTASARRLRVHQMTMEGRDMAEDVAGMTDDVPEQPTEAPEMRADAQGADSGEGSDGDDAAEGFPGGPRDPSVLTSFVEHVAHAVWSGQ

SEQ ID NO: 152000 - protein, 67 aa, Glycine max
  Coding DNA Sequence Number=SeqID_60315
MDKSLKVGEYEWGERERKSKKFCASNKVILMMPKNQELSKVSSKDSRIKNNQDQDSRLNIQEKTQSR

SEQ ID NO: 152001 - protein, 351 aa, Glycine max
  Coding DNA Sequence Number=SeqID_60316
  Gene Ontology: Mol. function=FMN binding; Cellular component=plasma membrane; Biological process=thiamin biosynthetic process
  Homolog annotation: Hit_ID=Q2NTU6; Match level="QueryCoverage=39%, HitCoverage=39%, E-value=4e-48, Identity=63%"; Hit description =Thiamin biosynthesis lipoprotein
  Pfam annotation: Domain name=ApbE; Domain location=165-351; Score =12.4; E_value=7.1e-11; Accession=PF02424.6; Description=ApbE family
  Pfam annotation: Domain name=DUF1348; Domain location=1-84; Score =82.1; E_value=1.8e-21; Accession=PF07080.2; Description=Protein of unknown function (DUF1348)
  Pfam module annotation: Pfam domain module=ApbE::DUF1348; Domain location=165-351::1-84
RKWARELDYRLIKELWAWHHDKLAVRFAYEWRDDSGNWFRSYGNENWHFGADGLMIQRFACIHDLPISAEARLVHWPAGRRPDDHPGLSELGLRQAAFQRHARQRKGGKAQPALPFILGAGCTTLVQCLNVGATDSAESRGGDSAASNGSFRTQYAVPASDQLQAALDEHSADRHGSTAAERVRAKTGAAGAGAGRQNHGNAALQQAIQQQLDRDDGELSTWKKDSVLSRFNQYQGQDPQPVSADMADIVTRALRIGQLTGGAMDITVGPLVNLWGFGPAQQPAHTPSDAAIAAAKAQTGLQHLRVIETVNGQWLQKDLPGLYVDLSTMGEGYATDHLARLMEQQGITNYL

SEQ ID NO: 152002 - protein, 53 aa, Glycine max
  Coding DNA Sequence Number=SeqID_60317
KLNMDEDEDDDVPQPPSNIMEDVNPNESNIGEESHSFDGEGSPEVDPTLASWI

SEQ ID NO: 152003 - protein, 43 aa, Glycine max
  Coding DNA Sequence Number=SeqID_60318
MIAAALSTKRQVKKHCYNIPLYHGTEYWVWTIYFYGKVNIAHQ

SEQ ID NO: 152004 - protein, 132 aa, Glycine max
  Coding DNA Sequence Number=SeqID_60319
MGTNQTGKRFYQVKVKGLDVASIKELGRLMGPLQMQAFHKTYGKILDLTIAENCNCGQRFSKRFGPRKTNSKRHSGPTTEVPRRQGEGYGKSRRLGPVYGCVSIANLWGRPLSERRWFGGPSHHRRFPCIPP

SEQ ID NO: 152005 - protein, 73 aa, Glycine max
  Coding DNA Sequence Number=SeqID_60320
MAMDLKLLFDYPGSLKALPLGLPLMIAADDPITASPKLSVLSSRRIPCLANSLEYPSIVVTETTCDERRDAFV

SEQ ID NO: 152006 - protein, 81 aa, Glycine max
  Coding DNA Sequence Number=SeqID_60321
  Subcellular localization annotation: CTP_CleavageSite=6; ConfidenceScore=5.02e-01
LPSLVTDARGANTFPVGGDSMCFPSLEDAPVSLASPSRRRGKDGHSHPGSRFMVSWDFGSRLVEQMDMIYVRVLVWPAIQG

SEQ ID NO: 152007 - protein, 122 aa, Glycine max
  Coding DNA Sequence Number=SeqID_60322
  Gene Ontology: Mol. function=sequence-specific DNA binding; Cellular component=intracellular; Biological process=regulation of transcription, DNA-dependent
  Homolog annotation: Hit_ID=A6TGD8; Match level="QueryCoverage=98%, HitCoverage=41%, E-value=2e-62, Identity=94%"; Hit description =Putative ARAC-type regulatory protein
  Pfam annotation: Domain name=HTH_AraC; Domain location=13-59; Score =31.9; E_value=2.3e-06; Accession=PF00165.14; Description=Bacterial regulatory helix-turn-helix proteins, araC family
  Pfam annotation: Domain name=HTH_AraC; Domain location=65-109; Score =55.4; E_value=2e-13; Accession=PF00165.14; Description=Bacterial regulatory helix-turn-helix proteins, araC family
  Pfam module annotation: Pfam domain module=HTH_AraC::HTH_AraC; Domain location=13-59::65-109
AQTSSRSQALFEAIRQYIDLHFAEPLSRESVAQSFYLSPNYLSHLFQKCGPMGFNEYLNHIRLEQARMLLKGHDMKVKDVAHACGFADSNYFCRLFRKNTERSPSEYRRQYHSQLTEKSSAP

SEQ ID NO: 152008 - protein, 74 aa, Glycine max
  Coding DNA Sequence Number=SeqID_60323
TKNEVTLCKKGNRNKEKERVLKQTQPNTRAKRASGAKREKKAGATRGVKLEDAESVMRAKPSYALSARSNRSIG

SEQ ID NO: 152009 - protein, 229 aa, Glycine max
  Coding DNA Sequence Number=SeqID_60324
MEAMKEKMTTMMEAMMSMRKMMEVNMATVVAASAATEIDQAHLSGFNQVNPPASDMVQNKHFFPQYGLPPNYTPPNVAHAPDENVDNSAPIPVESQKPQTDHAHVSQTMGETYEVPHHNLADFEPCLGYAIQGQAVGGVALPNTLEGPQFRPQPQPLHFAEGRVPPAMVERGKFYHREERLRAIEGGGDYAFADMAELCLVPDIVIPLKFKVLDFDKYKGTTCPIESPD

SEQ ID NO: 152010 - protein, 287 aa, Glycine max
  Coding DNA Sequence Number=SeqID_60325
MRGAPTEESLSPFLVRDLGAQGLKVIQRIHKAWRSPLRKDKELRGIRNGVIGGWLSKLKVVDEENFEAPEEDEEVRALKLELGKARLAKEKFKSAATHIRKECTELQRKTRHCRALEQETKRARKEEHGREKFRGALWGSNNELKLRREDRDRSRVHGMILKEELVACARSKRSLALHLEATEQSMLAIIGQYKEELNQSMAHEQKLVEDFAQVYAEQEARGRVIDALHQEATMWMDRFTLTLNGSQDLPRLLAKAKAMAEVCTGPEGDPWANQLLSTHDRLDGPYH

SEQ ID NO: 152011 - protein, 159 aa, Glycine max
  Coding DNA Sequence Number=SeqID_60326
MTGLRHLKVRLLETTPLALHRAVIRVGKPSLEELDWDIEVIWPEMRAPTFMSMQETRPKISLALSTVRSKVCDVGAKLEYERTLHTWAKVVKSFLRILPRWPLVFKMNPQLEYVGKVSPSANTTGVSKNVLRLSASIFTRWPLTLACFGEGPSELYRFA

SEQ ID NO: 152012 - protein, 124 aa, Glycine max
  Coding DNA Sequence Number=SeqID_60327
  Subcellular localization annotation: CTP_CleavageSite=68; ConfidenceScore=5.33e-01
MAECHILIFSGDYHLSSPRLASGSLGPPNNFMVKKPTHSGKLIASALSFNSPGRAAFAPSAHFPLNRRAREAEEGFQGSEVEGIERTKKEEEERRGNEVEVLLNRDCDQSLHRSLFGDLRATIG

SEQ ID NO: 152013 - protein, 189 aa, Glycine max
  Coding DNA Sequence Number=SeqID_60328
  Homolog annotation: Hit_ID=Q2AA09; Match level="QueryCoverage=85%, HitCoverage=56%, E-value=3e-08, Identity=29%"; Hit description =Retrotransposon gag protein
MERSMIDAASGGALGDMTPAEARNLIEKMASNSQQFSARNDAIVIRGVHEVATNPSASSETKKLEGKLDALVNLVTQLALNRKIYTCRKDLCPSMQQPRAIEQPEAYAANIYNRPPQPQQQNQPQQNNYDLSSNRYHPGWRNHPNLRWSSPQQQHIAACSFLPKCCWPKQIIHSSTNPTTATAPETANS

SEQ ID NO: 152014 - protein, 55 aa, Glycine max
  Coding DNA Sequence Number=SeqID_60329
  Subcellular localization annotation: CTP_CleavageSite=40; ConfidenceScore=5.26e-01
TTSIKSPTVATYPSAGGLAGLASASSMGGRCVESPPTFIRGKRRKNRKRCGLRTF

SEQ ID NO: 152015 - protein, 207 aa, Glycine max
  Coding DNA Sequence Number=SeqID_60330
  Homolog annotation: Hit_ID=Q84VH5; Match level="QueryCoverage=100%, HitCoverage=32%, E-value=8e-68, Identity=65%"; Hit description =Envelope-like protein
MATSPKETSAPGSPAVPSSPSSTKAPSIQEQPDFHIQPIQVIPGQAPGPEKLVPRRQQGVKIAENPSPATSPREVNPEMDKKIRKDVPTSSTPNVSVPDAEKDVPTSSTPNAEAVSSPSKEESTEKEDPATKETPAPRAPEPAPGDLIDLEEVESDEEPIANRLAPGIAERLQSRKGKTPIKRSGRIKTMAQKKSTPITPTTSRWSK

SEQ ID NO: 152016 - protein, 120 aa, Glycine max
  Coding DNA Sequence Number=SeqID_60331
  Gene Ontology: Mol. function=helicase activity; Biological process =viral genome replication
  Homolog annotation: Hit_ID=Q8RV60; Match level="QueryCoverage=80%, HitCoverage=7%, E-value=8e-16, Identity=43%"; Hit description =Putative uncharacterized protein At2g05640
MEDYKESMNCTLAIYHYSTLYSFLMEKTDIELTYFTVLLHPAKKESYTMVESERLSYIRNNQKKLRVDKYSSLQSSLDTGTAKGLTKGKRVILPSTFVGSPRYMDQLYFDGMTICSHVGF

SEQ ID NO: 152017 - protein, 68 aa, Glycine max
  Coding DNA Sequence Number=SeqID_60332
MSVKNLVGCLGVHDKTDHALGDQSRSCCFARMLQSCGIDTGLKEYSNWVYLPPRPRLRRVRQDLSLLI

SEQ ID NO: 152018 - protein, 128 aa, Glycine max
  Coding DNA Sequence Number=SeqID_60333
MTRCSQNFTNCLMMGAKHLTRTKERSHVIKQRVAGDHDLSFPDFHKLPNDGCQAPHKDQRKVACHQAKVPGRKLGYDTNFAPLGRRESRVTMTCRSRNFTNCLMMGAKHLTRTKERSHVIKQRSPDEN

SEQ ID NO: 152019 - protein, 118 aa, Glycine max
  Coding DNA Sequence Number=SeqID_60334
VEFKKNLFHDKIVETEELFKRWNEYLFSTRLRVSQPPLINCDFCGGEHYNDNCHLYSMNDSWWEQELSPYNQYEEERTPNLERVFEEFMAYHASSKANQNSMKNHEIHFDKSYSIENF

SEQ ID NO: 152020 - protein, 87 aa, Glycine max
  Coding DNA Sequence Number=SeqID_60335
MRPYLYGEVDLSPHLLAAAVEGTDHHGTWPRWEVLNGNFSNVLLGITFKLEPLSMSTLAMTWSMHLTDHAKPCYVLSPRQGFPLQQR

SEQ ID NO: 152021 - protein, 126 aa, Glycine max
  Coding DNA Sequence Number=SeqID_60336
MKTSPLYIKHEDLSEIALSGLSISVIQLWILHLTETSMRASNSDVYGFLKPQSIQRSEQLQFESESYKKNWMQNSKRDVYLGAYLNGPDNYLKGIINSALKGLDDTPQAKSKAGVRWIVVKLTFNI

SEQ ID NO: 152022 - protein, 439 aa, Glycine max
  Coding DNA Sequence Number=SeqID_60337
  Homolog annotation: Hit_ID=Q2HW90; Match level="QueryCoverage=40%, HitCoverage=35%, E-value=3e-16, Identity=32%"; Hit description =Putative uncharacterized protein
MGPLQRQAFRKVYGKILDLAAAEVFTEAVVSLAQYYDQPLRCFTFGDFQMVPTIEEFEEILGCPLGRRKPYLFSGLLPSLSKITAVIGDSAKELDRMKQTRNGIVGLPQKYLEGKARDVASQEKWGPFADVLALLIFGVVLFPNVDGLIDLAAIDAFLAYHHSKESPVVAILADLFDTFDRRWTRGCINYNPALAIRQLGYPMRGAPTEESLSPFLVRDLGAQGLKVIQRIHKAWRSPLRKDKELRGIRNGVIGGYHGWLRIHTRGLGWLSKLKVVDEEKFEAPEEDEEVRALKLELGKARLAKEKFKSAATHIRKECTELQEENVATARALEQETKRARKGEHGREKFRGALWGSNNELKLRREERDRSRVHGMILKEELVACARSKRSLAQHLEATEQSMLAIIGQYKEELNQSMAHEQKLVEDFAQVYAEKEARGR

SEQ ID NO: 152023 - protein, 235 aa, Glycine max
  Coding DNA Sequence Number=SeqID_60338
  Gene Ontology: Mol. function=carbamoyl-phosphate synthase (glutamine -hydrolyzing) activity; Cellular component=chloroplast; Biological process=pyrimidine nucleotide biosynthetic process
  Homolog annotation: Hit_ID=A8G9M9; Match level="QueryCoverage=96%, HitCoverage=59%, E-value=1e-107, Identity=87%"; Hit description =Carbamoyl-phosphate synthase, small subunit
  Pfam annotation: Domain name=CPSase_sm_chain; Domain location=11-159; Score=316.2; E_value=6e-92; Accession=PF00988.13; Description =Carbamoyl-phosphate synthase small chain, CPSase domain
SEYSLEGVLIKSALLVLEDGTQFIGRAIGATGSAVGEVVFNTSMTGYQEILTDPSYSRQIVTLTYPHIGNVGTNAADEESSQVHAQGLVIRDLPLIASNFRNTEDLSSYLKRHNIVAIADIDTRKLTRLLREKGAQNGCIIAADSPDAALALAKAQGFPGLKGMDLAKEVTTQEAYSWQQGSWTLEGDLPEAKTPAELPFHVVAYDYGAKRNILRMLVDRGCRLTVVPAQTPADE

SEQ ID NO: 152024 - protein, 119 aa, Glycine max
  Coding DNA Sequence Number=SeqID_60339
MRGAPTEESLSPFLVRDLGVQGLKVIQRIHKAWRSPLRKDKELRGIRNGVIGGYHGWLRIHTRGLDWLSKLKVIDEENFEAPEEDEEVRALKLDLGKARLAKERMYRVTRGKRGHCKSP

SEQ ID NO: 152025 - protein, 130 aa, Glycine max
  Coding DNA Sequence Number=SeqID_60340
ELDLIEERLRAVEGFSDYPFTDMGRLVMQSYPARALDRRLQVDWVRDPREGPRVLMSLRSLVRLSQHALLAGEAKARLMGALSKGGKMHGVATNEGISTSHVDKSGAFAATYPPLERKSDLRSSFLCVNQ

SEQ ID NO: 152026 - protein, 58 aa, Glycine max
  Coding DNA Sequence Number=SeqID_60341
MAQGLRSNARHDTCQGLSFINFVHSKSESISGVWENLQKQIYPSGVSSTLSALMGFGF

SEQ ID NO: 152027 - protein, 177 aa, Glycine max
  Coding DNA Sequence Number=SeqID_60342
  Gene Ontology: Mol. function=hydrogen ion transporting ATP synthase activity, rotational mechanism; Cellular component=proton -transporting ATP synthase complex, coupling factor F(o); Biological process=ATP synthesis coupled proton transport
  Homolog annotation: Hit_ID=P09003; Match level="QueryCoverage=97%, HitCoverage=86%, E-value=6e-56, Identity=67%"; Hit description=ATP synthase protein MI25
  Pfam annotation: Domain name=Mt_ATP-synt_B; Domain location=4-174; Score=87.2; E_value=5.1e-23; Accession=PF05405.5; Description =Mitochondrial ATP synthase B chain precursor (ATP-synt_B)
MGQSFASLVSTVAAAESAIGLAIFVITFRVRGTIAVEFINSIQGKTFKVTLDGRIQAIQEESQQFPNPNEVVPPESNEQQRLLRISLRICGTVVESLPMARCAPKCEKTVQALLCRNLNVKSATLPNATSSRRIRLQDDLGTKFHLLVRRRFCPQCISKAEKIELIRESLVVLRMVR

SEQ ID NO: 152028 - protein, 58 aa, Glycine max
  Coding DNA Sequence Number=SeqID_60343
MWHWGIGFYRRPCLSRSEFIIYLEKFYDDVRKVNYIYAWGRGCHKEEEEEEERQVEKP

SEQ ID NO: 152029 - protein, 77 aa, Glycine max
  Coding DNA Sequence Number=SeqID_60344
  Subcellular localization annotation: CTP_CleavageSite=63; ConfidenceScore=5.21e-01
MGVQIEIRPTWAFQNIPPEGGCFWRKQPSSPGRVGKSKPRRFRNVSVVDFAKIFNRSSTFFVHSSSFFGLQPISKKA

SEQ ID NO: 152030 - protein, 115 aa, Glycine max
  Coding DNA Sequence Number=SeqID_60345
GLRPQRYPVDPEKSNRALGFPALGSRLQDTQWTQRSPAGSWSCQTLITGLCQFYGVSVTSNKGIRPPTNRAFIKKYCAPRQAQGETPQQPGDGQQRATDAPPSPLEFTPAHPQKG

SEQ ID NO: 152031 - protein, 93 aa, Glycine max
  Coding DNA Sequence Number=SeqID_60346
  Homolog annotation: Hit_ID=A5BTR2; Match level="QueryCoverage=49%, HitCoverage=2%, E-value=8e-13, Identity=76%"; Hit description =Putative uncharacterized protein
MYVQEEDRLIMEESEKVNLTTSTFGKDRKKSVGTNKGRIPNQQGMESLRKPVGSEQCIYSGSRMSSHVEAIGTCVLVLSSGFKLHLEKVLLCS

SEQ ID NO: 152032 - protein, 149 aa, Glycine max; identical to SEQ ID NO: 132977
  Coding DNA Sequence Number=SeqID_60347
  Gene Ontology: Mol. function=endonuclease activity
  Homolog annotation: Hit_ID=Q9AY32; Match level="QueryCoverage=42%, HitCoverage=95%, E-value=7e-27, Identity=96%"; Hit description=RRNA intron-encoded homing endonuclease

SEQ ID NO: 152033 - protein, 196 aa, Glycine max
  Coding DNA Sequence Number=SeqID_60348
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7PGB8; Match level="QueryCoverage=27%, HitCoverage=8%, E-value=1e-19, Identity=90%"; Hit description =Chromosome chr6 scaffold_15, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARVFPVTTLIDDAVRRILRVKFVMGLFENPHADISLVNQLGSEEHRQLAREAVRKSLVLLKNGGRETCRASCINESANARGEAVCVLGALPLPRSLTRCARSFGCGERYQLTQR

SEQ ID NO: 152034 - protein, 157 aa, Glycine max
  Coding DNA Sequence Number=SeqID_60349
MAPTRHPLDPDKSNRALGFLALITGLCQSFGVPITPSKGDAHQATDAPPPPRQADPTGSLGMERYLRHLVRQQAANHHGQVQIHECLYRFSLSQQGQGSTPFACPTPEQFGAEVAWPGDWPEAQAEEEPAGSLGEADESHMDEEMTDLLSFLGGRGA

SEQ ID NO: 152035 - protein, 99 aa, Glycine max
  Coding DNA Sequence Number=SeqID_60350
VAGGVGANPGACTVGSSDIIIGVDGRAASGAGEDGSTTGDGGSAGTGDEDMTKSKGKDTLEGLGGPMTRTRARKAKEALRQVLSTLFEYKPKFQGEKSK

SEQ ID NO: 152036 - protein, 164 aa, Glycine max
  Coding DNA Sequence Number=SeqID_60351
GLGFPALITGLCQSFGVPVTPTKVIRPPITRAFIEKYCTQRQAQEDVPQAAGAPPPSHQAGPAGSFDMEQYLRHLVRQQAANHRAHVQTHDCLYQLSLSMQSQGFASFSCPTLDQFRAEVAWPGDWPEAQAGKAPPEAPGVGEEAHEDEEMADLLDFLGGSGAT

SEQ ID NO: 152037 - protein, 67 aa, Glycine max
  Coding DNA Sequence Number=SeqID_60352
MEDLVTYWRLPNQMNRPKLLLQNLKAMKGWPILLPFPIWQPQTRKQGDKHNSKTKQKQRNESKQMEF

SEQ ID NO: 152038 - protein, 305 aa, Glycine max
  Coding DNA Sequence Number=SeqID_60353
  Gene Ontology: Mol. function=nucleoside-triphosphatase activity; Biological process=riboflavin biosynthetic process
  Homolog annotation: Hit_ID=A1FX56; Match level="QueryCoverage=91%, HitCoverage=20%, E-value=1e-147, Identity=93%"; Hit description=ATP -dependent helicase HrpA
GQVLASEQISLFGLVLAPKKPVHYGRIAPGEAHDIFVRQALVTGEINTRASFVADNQKVLEVAREEEAKLRRAGIVADEDWQARWYLDRVPPQIHSASGLDAWWKGLAPEQRKTLHWSLADLLPGEGSEQERYPKYLALGQARLPLHYRFEPGADDDGVTLDVPLHLLNALDPVQLGWLAPGFVADKASALIRSLPKAMRRNYVPAPDFGRAFYEAFPQPSADAITGELARFLSRATGATVTALDFEPGSIEPHLHMNLRLRDEQGKVLATSRDLDALRAKFGGRAGDAFAARAGREMAADGGIL

SEQ ID NO: 152039 - protein, 49 aa, Glycine max
  Coding DNA Sequence Number=SeqID_60354
MENAKHMATPLSTACYLDKDETSQSIDVKQYQDYNQIPNNHILVPLKES

SEQ ID NO: 152040 - protein, 57 aa, Glycine max
  Coding DNA Sequence Number=SeqID_60355
MAEARKVQENELRFLENAINSLSEHAALSEFINTHCVYRHSRKNTLSAPAALSEFIF

SEQ ID NO: 152041 - protein, 99 aa, Glycine max
  Coding DNA Sequence Number=SeqID_60356
MVIDYQQFIQILKPVIDYTSLVIDYQRRFSENNFQESHLFKWFMNGHQRGFLNTREGLSLRGSDFVKGVLRRKWKISSRLLEDCRHGNWPNQVRIPLFP

SEQ ID NO: 152042 - protein, 53 aa, Glycine max
  Coding DNA Sequence Number=SeqID_60357
MGAKYLEVVKRGSHPNNGWSPDEIRTRSPLDGEKGVRNDHNLSPLASQLAIFE

SEQ ID NO: 152043 - protein, 420 aa, Glycine max
  Coding DNA Sequence Number=SeqID_60358
  Homolog annotation: Hit_ID=Q2HW90; Match level="QueryCoverage=78%, HitCoverage=61%, E-value=5e-26, Identity=29%"; Hit description =Putative uncharacterized protein
MASQEKWGPFVDILALLIFGLVLFPNVDGLVDLAAIDAFLAYHHSKESPVVAILADLCDTFDRRCEKNSARIVCCLPALCVWLISHLFQQDMRHPCPLQRYLSCAEKGRVDWDQHLAGIGGSAINWFSRWKEGKEGVLFSCGDYPNIPLIGTRGCINYNPALAIRQLGYPMRGAPTEESLLPFLVRNLGAQSLKAIQRVHKAWRSPLRKDKELRGIRNGVIRGLRSSGEDEEVRALKLELGKARLAKEKFKSAATHIRKECTELQEENTATARAFEQETKRARKEEYGREKFRGALWGSKNEFKLRREERDRSWVHGMILKEELVACARSKRSLAQHLEAMEQSMLTIIGQYKEELNQSVAHKQKLVEDFAQVYAKKEARGRVIDALHQEATMWMDRFALTLNGSQDLPRLLAKAKAMAE

SEQ ID NO: 152044 - protein, 109 aa, Glycine max
  Coding DNA Sequence Number=SeqID_60359
AERRRKLLQDRTVASILEEETHFSDLLSPDSPSSREPATQLPKAITMAKEHDQRITLEDYSSSLDYLMKTPYAHLATFIEICNTVKIAGVPDEAIRLSLFSFSLAGEAK

SEQ ID NO: 152045 - protein, 190 aa, Glycine max
  Coding DNA Sequence Number=SeqID_60360
  Homolog annotation: Hit_ID=A5ARL5; Match level="QueryCoverage=100%, HitCoverage=12%, E-value=3e-18, Identity=31%"; Hit description =Putative uncharacterized protein
MDSLIIRLLRVPHVSKDENPADSMETSAMVASRGRGGGCNSRRGRSGRGGCPHCTYYNRMGHTQENCYLLHGFPDKVTHVSRSEKAEFRFFDEEYQEYLKLKFEKPSNQAQSSSVPCFSTACISQSIEGPSPWIFDSGAFDHIYGNKSSFSSFSILKIPHIVTVANGSKVASQGSGQEHGTGQLIGEGHE

SEQ ID NO: 152046 - protein, 189 aa, Glycine max
  Coding DNA Sequence Number=SeqID_60361
  Subcellular localization annotation: CTP_CleavageSite=62; ConfidenceScore=5.55e-01
MGQLATQLNRQQSQNSDKLPSQSVQNPKNVSVISLRSGKQCESSTGNSDLQKQHIPLPFPPRAISNKKMEEAEKEILKTFRKVEELCTNKRKLKGSEIISMGRNDSALIGKSVPEIPEKCKDPGTLSMEFGDITVHFNILDAMKHPSEDLSVFRAEIIDHIVDEYMNDLHSNLHACHSSCIESEFLGIL

SEQ ID NO: 152047 - protein, 147 aa, Glycine max
  Coding DNA Sequence Number=SeqID_60362
MTCRSRNFTNCLMMGAKHLTRTKERSHVIKQRSPDENYWIAPTKTPSGPEEVRQGPGVSSSGYGPLSVLQGACTPPARSRHHRDRACKTPSGPEEVQQGLGGSTEYLSPPARSSGPPTNRAFIKKYCAPGRRRAKHHISIGMAGSGQ

SEQ ID NO: 152048 - protein, 179 aa, Glycine max
  Coding DNA Sequence Number=SeqID_60363
MGVQALALAGGAHQALIEGDVGTQAGDFLIALGQRGLHLGVGGAADAVGGFQRGLLLAQFGQLRLQRLGTLLGSLQALALGVARRGHPAATQHGQYQAEQPDAADHQQAATVGRWLWCAGQADLHAHGRTVGHGWIPGHREGDTGTAPVANDALVYDRTGGFPAQWRATVCGVQACHRR

SEQ ID NO: 152049 - protein, 79 aa, Glycine max
  Coding DNA Sequence Number=SeqID_60364
GRGGGGARARARGERERERERGSTECGYYVMHWMSTIILGTFRNNWEAYFNDPRPLESERLTALRIQWAQFYLRVRDQA

SEQ ID NO: 152050 - protein, 207 aa, Glycine max
  Coding DNA Sequence Number=SeqID_60365
AFRLTDSNKECYTDNHSGFSARQRDSNVSMTDLVSAEDDVNLRMSTGLSAAIDEGRRRRRQTLRAIRLFALQTAKKNVYTDNHSGISARQRDSNVSMTDLVSSKDDTAIKNVYTDNHSGFSARQRDSNVSMTDLVSAEDDVNLRMSTGLLAAIDEGRRRRRQTLRAIRLFALQTAKKNVYTDNHSGISARQRDSDVSMTDLVSAKDD

SEQ ID NO: 152051 - protein, 58 aa, Glycine max
  Coding DNA Sequence Number=SeqID_60366
MVVVTLTTMVGWNSGNNDGGGGGEMMMVMIIAIECGNGGDNDNGGNKMVVVMAVIDVG

SEQ ID NO: 152052 - protein, 172 aa, Glycine max
  Coding DNA Sequence Number=SeqID_60367
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTGEPYPVTIVLSPT

SEQ ID NO: 152053 - protein, 162 aa, Glycine max
  Coding DNA Sequence Number=SeqID_60368
VMAPKNLLSKRARKEATEEGSSAAPQEDMEFDGHRFRSEEHQCYFEAIKSWSFLKERQVQLRKGAYAEFQEEIARRQWTQLAGPMAKYDPEIVMEFYANAWPTEEGASRFDEEVIGQLLCISGQDFARSVTGRRVQIMHTSMTTLTQIWDDTASQQHPPQRS

SEQ ID NO: 152054 - protein, 238 aa, Glycine max
  Coding DNA Sequence Number=SeqID_60369
EWASFIDILALLIFGGILFPNMEGLVDLAAIDAFVAFHHGKEIPVVAILAMHDTFNQRREKSGARIVCCTPALYVWLVSHPFFSKKVGSSIRYKVTARRKNRDSIFMRRISKCSLNGNKGKDRELRGSSNGIIGGYHKWLRVRTQGLDWLPNLKTVRDDEVKASEESDEVQALKAELERARLKPWNEKPRRPERKNTTKTSFEGLYRASIVSSSSEEVKGIITGQRHDLEGRAKGLPS

SEQ ID NO: 152055 - protein, 106 aa, Glycine max
  Coding DNA Sequence Number=SeqID_60370
  Gene Ontology: Mol. function=nucleic acid binding
  Homolog annotation: Hit_ID=A5C7C5; Match level="QueryCoverage=47%, HitCoverage=7%, E-value=2e-10, Identity=56%"; Hit description =Putative uncharacterized protein
MVSLKKSWYIDSGCSKHMTGDASKFTQISPKKSRHVTYGDNNKGRILGVRKIESLEEMHIHGEDHKDKGDGNNEDFDIDEIKIDVEIPREWRTSRYHPLDNIIGDI

SEQ ID NO: 152056 - protein, 72 aa, Glycine max
  Coding DNA Sequence Number=SeqID_60371
MPIGWTSQKSGADIEEEELTDLRSNPLQGEGDDAILPRKGPITRTMSKRLQEDWARAAEEGPRVLMNLRVDF

SEQ ID NO: 152057 - protein, 70 aa, Glycine max
  Coding DNA Sequence Number=SeqID_60372
  Homolog annotation: Hit_ID=UPI0000ECBAF8; Match level="QueryCoverage =58%, HitCoverage=48%, E-value=1e-16, Identity=100%"; Hit description= UPI0000ECBAF8 related cluster
MAAKPFNDLTFGGQHIQGMQAWHWPSFYNVVTGKTLALPNLIALQHIPLSPAGVIAKRPAPIALPNSCAA

SEQ ID NO: 152058 - protein, 220 aa, Glycine max
  Coding DNA Sequence Number=SeqID_60373
  Gene Ontology: Mol. function=motor activity; Cellular component=cell projection
  Homolog annotation: Hit_ID=UPI00016621D1; Match level="QueryCoverage =75%, HitCoverage=40%, E-value=2e-15, Identity=35%"; Hit description =UPI00016621D1 related cluster
IPGTSTLASRGLHVLTFRGLHVLAFRGLHVLTFIGLHALTFRGLHVLAFIGLHALTFRGLHVLTFGGLHVLTFGGLHVLTLRGLHTLAFRGLHPLTFRGLHVLTLRGLHVLAIRGLHGYKSSNIRGLHVLTFRVLHVLTFRVLHILTFRGLHAIAFRGLRVLTFSGLHIHALRGFKGDQLCEHDQRGRQLLCIPGQDFTRAIAKKRVRIMRTNMTTLTQI

SEQ ID NO: 152059 - protein, 170 aa, Glycine max
  Coding DNA Sequence Number=SeqID_60374
  Gene Ontology: Mol. function=helicase activity; Biological process =viral genome replication
  Homolog annotation: Hit_ID=Q2A9E0; Match level="QueryCoverage=98%, HitCoverage=11%, E-value=4e-38, Identity=50%"; Hit description =Putative uncharacterized protein
MYNLMFAFTSRGIKYDTSYNTGKGPPTFRIHGQTHHLIGSLLPMPNNPPKFAQLYIYDTDNEIINRLSQNPMHDMLDEQIIIAIKDMLDHHNHYAQKFMMARDKLQSATLPDLKIKLISQRQTYGRLYNLPTTIEVAALIVGDEHSADKRDIIIEKQSGLLKRIHELHPA

SEQ ID NO: 152060 - protein, 80 aa, Glycine max
  Coding DNA Sequence Number=SeqID_60375
VLKGLHDAPQPKSKAPARWIVFKCNRQRGSTECDYYVMHCMSTIILGSFKNNWEAYFNDPRPLELERLKALRIQWPQYYL

SEQ ID NO: 152061 - protein, 141 aa, Glycine max
  Coding DNA Sequence Number=SeqID_60376
CFVSKRPFRGNTGSNKIEENNSKCINLTQELSLFWKRVSSSIVNDFFSWETPLFLLPRTGMEILILGQGLWWFEVLGQKACRTTEHDVCQGVGLASGSGIKGMSHIYFHDTHTTMMIWKFYAKLVMHAPMWTLKRQVFMVM

SEQ ID NO: 152062 - protein, 51 aa, Glycine max
  Coding DNA Sequence Number=SeqID_60377
MKMLLIPHDVAPMELFDGSRMEKEKYDWRRHFKKKMSLEEAHHHMKPWIRA

SEQ ID NO: 152063 - protein, 89 aa, Glycine max
  Coding DNA Sequence Number=SeqID_60378
IKTKPKGYIESDYVQDDVPYQVEEMSHVNKVIEVESISRLQDLRGNVEEVNPGNLLTNEEESNNLNGESNNIEQDNEGELEDDFEVLQF

SEQ ID NO: 152064 - protein, 65 aa, Glycine max
  Coding DNA Sequence Number=SeqID_60379
MYMCGEWNVLNILEMAPRKLPSKRSRKDKAGEGTSSAPEYDSHRFRSAVHQQRFEAIKGWSFLRE

SEQ ID NO: 152065 - protein, 267 aa, Glycine max
  Coding DNA Sequence Number=SeqID_60380
MERSMIVAASGGALSDMTPVEARNLIEKMASNSQQFSARNDVIVLRGVHEVATDSSSSAENKKLEGKHDALVNLVTQLAMNQKSASAPVVRVCGWRNHPNLRWASPLQQQQQQQQQRQQATEVAPQPSLEDTKASIQSLTNQMGQVATQLNQTQSQNSNKLPSQTVQNPKNVSAITLRSGKQTKVPPLVAAPAPEPVKLHSTPEKEDEIVAQKRKLPNKNFHAGGPSSSSSDLQQPPIPLPFPPRAIPNKKMEEAEMEILETFRGIL

SEQ ID NO: 152066 - protein, 58 aa, Glycine max
  Coding DNA Sequence Number=SeqID_60381
MRRFLVDRASIENVNVVQQEAELEPPPNVVNEFNPNEIVRDPGHRKQINEYALDIQDQ

SEQ ID NO: 152067 - protein, 130 aa, Glycine max
  Coding DNA Sequence Number=SeqID_60382
MFFKYGIDNVFVHRFQPTYGCSNIISNIIRAKFDEPAPSWLKVSVDLCDRWFGEFKFLFHILCRKSIDDTHKKSEPLELFLRQKRSDVSSIGACRPRIFFINRFLCFLKDEWQRNGEEEELRGDTTSRRR

SEQ ID NO: 152068 - protein, 752 aa, Glycine max
  Coding DNA Sequence Number=SeqID_60383
  Gene Ontology: Mol. function=identical protein binding; Cellular component=extracellular region; Biological process=negative regulation of catalytic activity
  Homolog annotation: Hit_ID=A7NTY1; Match level="QueryCoverage=99%, HitCoverage=99%, E-value=0.0, Identity=60%"; Hit description =Chromosome chr18 scaffold_1, whole genome shotgun sequence
  Pfam annotation: Domain name=PA; Domain location=339-450; Score=12.9; E_value=0.016; Accession=PF02225.13; Description=PA domain
  Pfam annotation: Domain name=Peptidase_S8; Domain location=124-593; Score=76.4; E_value=9.3e-20; Accession=PF00082.13; Description =Subtilase family
  Pfam annotation: Domain name=Subtilisin_N; Domain location=28-117; Score=65.6; E_value=1.6e-16; Accession=PF05922.7; Description =Subtilisin N-terminal Region
  Pfam module annotation: Pfam domain module=PA::Peptidase _S8::Subtilisin_N; Domain location=339-450::124-593::28-117
MATHICLSLCFFYITTYHLAISTLAQSDNYIIHMDISAMPKAFSSQHTWYLSTLSSALDNSKATSDNLNSVINSKLIYTYTNVINGFSANLSPKELEALKTSPGYVSSMRDLRAKRDTTHSPHFLGLNPNVGAWPVSQFGKDVIVGFVDTGISPESESFNDEGLTKIPSRWKGQCESTIKCNNKLIGAKFFNKGLLAKHPNTTNNVSSTRDTEGHGTHTSSTAAGSVVEGASYFGYASGSATGVASRARVAMYKALWEQGDYASDIIAAIDSAISDGVDVLSLSFGFDDVPLYEDPVAIATFAAMERGIFVSTSAGNEGPFLAVLHNGIPWVITVAAGTLDREFQGTLTLGNGVQVTGMSLYHGNFSSSNVPIVFMGLCNKMKELAKAKNKIVVCEDKNGTIIDAQVAKLYDVVAAVFISNSSESSFFFENSFASIIVSPINGETVKGYIKSTNSGAKGTMSFKRTVLGTRPAPSVDDYSSRGPSSSCPFVLKPDITAPGTSILAAWPQNVPVEVFGSHNIFSNFNLLSGTSMACPHVAGVAALLRGAHPEWSVAAIRSAIMTTSDMFDNTMGLIKDIGDGYKQASPLALGAGHVNPNRGLDPGLVYDVRVQDYVNLLCALGYTQKNITIITGTSSNDCSKPSLDLNYPSFIAFINSNGSSAAQEFQRTVTNVGEGKTIYDASVTPVKGYHLSVIPKKLVFKEKNEKLSYKLTIEGPTKKKVENVAFGYLTWTDVKHVVRSPIVVTTLKLDF

SEQ ID NO: 152069 - protein, 30 aa, Glycine max
  Coding DNA Sequence Number=SeqID_60384
MEAQEESVRPRIYSQVSDLPKISWEEAKKD

SEQ ID NO: 152070 - protein, 160 aa, Glycine max
  Coding DNA Sequence Number=SeqID_60385
  Gene Ontology: Cellular component=chloroplast
  Homolog annotation: Hit_ID=A9PFP7; Match level="QueryCoverage=75%, HitCoverage=71%, E-value=3e-38, Identity=65%"; Hit description =Putative uncharacterized protein
  Subcellular localization annotation: CTP_CleavageSite=61; ConfidenceScore=5.68e-01
MASTSSALTISSSSTLLDGKAPRQSPAASPQCVSLPPPPLHSQNRSWKTTAYCRKVARKVMAMATGEAPAEATPTEVPEIVKTLQETWDKVDDKYAVSSLALVGVIALWGSVGLISAIDRLPLIPGILEIVGIGYTGVSEVYLIAGIDYTIYAHNNRQGI

SEQ ID NO: 152071 - protein, 354 aa, Glycine max
  Coding DNA Sequence Number=SeqID_60386
  Gene Ontology: Mol. function=protein dimerization activity; Cellular component=cellular_component; Biological process=lignin biosynthetic process
  Homolog annotation: Hit_ID=Q2HTB3; Match level="QueryCoverage=100%, HitCoverage=97%, E-value=1e-115, Identity=57%"; Hit description=O -methyltransferase, family 2; Dimerisation
  Pfam annotation: Domain name=Dimerisation; Domain location=21-72; Score=87.8; E_value=3.4e-23; Accession=PF08100.2; Description =Dimerisation domain
  Pfam annotation: Domain name=Methyltransf_2; Domain location=89-331; Score=389.6; E_value=5e-114; Accession=PF00891.9; Description=O -methyltransferase
  Pfam module annotation: Pfam domain module=Dimerisation::Methyltransf_ 2; Domain location=21-72::89-331
MEEEKSFTYAMQLVNSSVLSMAMHSAIELGIFDIIAKAGEGAKLSAKDIAAKLPCKNSEGATMLDRILRLLVCHSIIDCTVVADQQHGPPPHLQRFYAMNPVAKYFASIDGAGSLGPLMVLTQDKALLHSWYQLKDAILEGGIPFNRVHGKHVFEYSDMNSSFNQLFMAAMTNRATLIMKKIVESYKGFEHLNSLVDVGGGLGVTLNIVTSKYPHIKGINFDLPHVIEHASTYPGVEHVGGDMFESVPQGDAILMMCVLHDWSDEWCLKVLKNCYASIPSDGKVIVVDGILPFEPKTTGASKSISQFDVLMMTTNPGGKERSEEEFMALAKGAGYSGIRFTCFVSDLWVMEFFK

SEQ ID NO: 152072 - protein, 455 aa, Glycine max
  Coding DNA Sequence Number=SeqID_60387
  Gene Ontology: Mol. function=oxidoreductase activity; Cellular component=cytoplasm; Biological process=flavonoid biosynthetic process
  Homolog annotation: Hit_ID=A7PXU9; Match level="QueryCoverage=99%, HitCoverage=99%, E-value=1e-108, Identity=70%"; Hit description =Chromosome chr15 scaffold_37, whole genome shotgun sequence
  Pfam annotation: Domain name=2OG-FeII_Oxy; Domain location=195-272; Score=84.5; E_value=3.5e-22; Accession=PF03171.11; Description=2OG -Fe(II) oxygenase superfamily
MAATKPLLTDLASTIDRVPSNFIRPIGDRPKLHQLHSSLASIPIIDLQGLGGSNHSQIIQNIAHACQTYGFFQIVNHGIQEEVVSKMVNVSKEFFGLPESERLKNFSDDPSKTTRLSTSFNVKTEKVSNWRDFLRLHCHPLEDYIQEWPGNPPSFREDVAEYSRKMRGLSLKLLEAISESLGLERDYIDKALGKHGQHLAINYYPPCPEPELTYGLPAHADPNAITILLQNEVPGLQVLYDGKWLTVNPVPNTFIVNIGDQIQVEPASFVLVEGDSAAEVRQRAAGGGAGGRSGNGGERGVGRGGGRSGGGSGSGLAGAVMALLREAATAAVVAAGCCESPVGKVELDEEAVEEIDSTRGAVWARLGFKKKQEVISNDRYKSVLHRALVNCEKERMSIPTFYCPSPDALIKPAPKLVDNEHPAQYTNFTYREYYDKFWNRGLSKETCVDMFKAQD

SEQ ID NO: 152073 - protein, 543 aa, Glycine max
  Coding DNA Sequence Number=SeqID_60388
  Gene Ontology: Mol. function=DNA binding; Cellular component=nucleus; Biological process=regulation of transcription, DNA-dependent
  Homolog annotation: Hit_ID=A7PXV5; Match level="QueryCoverage=57%, HitCoverage=61%, E-value=3e-58, Identity=47%"; Hit description =Chromosome chr15 scaffold_37, whole genome shotgun sequence
  Pfam annotation: Domain name=B3; Domain location=182-290; Score =112.9; E_value=9.4e-31; Accession=PF02362.12; Description=B3 DNA binding domain
MELMQEVKGYSDGREEEEEEEEAAEEIITREESSSKHHYPFSSTSNLSLSSSAPSISSNYTSTTTTAARPHHHHHSTESHNSSSGLGLLHQHQEAAGSNFIINNNHHHHQHHHHHTTKQLDFMDLSLGSSKDEGNLQGSSSSVYAHHHHAASASSSANGNNNNSSSSNLQQQQQQPAEKEHMFDKVVTPSDVGKLNRLVIPKQHAEKYFPLDSSANEKGLLLNFEDRNGKLWRFRYSYWNSSQSYVMTKGWSRFVKEKKLDAGDMVSFQRGVGELYRHRLYIDWWRRPDHHHHHHHGPDHSTTLFTPFLIPNQPHHLMSIRWGATGRLYSLPSPTPPRHHEHLNYNNNAMYHPFHHHGAGSGINATTHHYNNYHEMSSTTTSGSAGSVFYHRSTPPISMPLADHQTLNTRQQQQQQQQQEGAGNVSLSPMIIDSVPVAHHLHHQQHHGGKSSGPSSTSTSPSTAGKRLRLFGVNMECASSTSEDPKCFSLLSSSSMANSNSQPPLQLLREDTLSSSSARFGDQRGVGEPSMLFDLDPSLQYRQ

SEQ ID NO: 152074 - protein, 514 aa, Glycine max
  Coding DNA Sequence Number=SeqID_60389
  Gene Ontology: Mol. function=DNA binding; Cellular component=nucleus; Biological process=regulation of transcription
  Homolog annotation: Hit_ID=A5AXN6; Match level="QueryCoverage=54%, HitCoverage=92%, E-value=3e-49, Identity=48%"; Hit description =Putative uncharacterized protein
  Pfam annotation: Domain name=NAM; Domain location=12-142; Score =244.2; E_value=2.8e-70; Accession=PF02365.6; Description=No apical meristem (NAM) protein
MENNIISICDHMPVGFRFRPTDEELVNYYLKHKLLADDFPVHIIPEIDLCKVEPWDVPERSVIKSDDPEWFFFSPVDYKYLKSKRFNRTTKRGYWKTTGNDRNVKIPGTSNVIGTKKTLVFHEGRGPRGVKTNWVIHEYHAVTSHESQRAFVLCRLMKKAEKKNEGGIEAPTFDEGEPSVHLFSDYGNQARAEGIASFMDIFTLCHVDIIPGVDMEEIFQAVDRAEKFSPPVQRSQTGIGLEDFFANSPLFNAHFGSENINMQTSLEVTDDEELVNSFWVDDEEFVINEERRHCFVNSSTQPKSFRRVYNESSEIDAEVVSNLNEHISADEYPALKMFQSSYDVRGGTSRLASNHKANKEKKESIIPDDFWAVETSSCDSTADEPIEISSSPSTPTRMKNQCHLRPDKFILQRTVAGRPQTQKKVSNNAVSHVEVRKELLTVKSEKDQKNAQNASLRGNFKNKSQQSSDVNNNGSFFYMETASNRSLFPRSVYLVNVVIGILLLIVISWDVLSC

SEQ ID NO: 152075 - protein, 82 aa, Glycine max
  Coding DNA Sequence Number=SeqID_60390
MQGNSGVPRKRKSIIVPSNSIAKEHIRMNERMKKAALVLLSSFHSVIHGCLSHSHLRKRRKWAHNTKWPNFSLVDLMGFPQV

SEQ ID NO: 152076 - protein, 538 aa, Glycine max
  Coding DNA Sequence Number=SeqID_60391
  Gene Ontology: Mol. function=hydrolase activity; Cellular component =endoplasmic reticulum membrane; Biological process=cell division
  Homolog annotation: Hit_ID=A7QSP6; Match level="QueryCoverage=92%, HitCoverage=93%, E-value=1e-172, Identity=60%"; Hit description =Chromosome chr4 scaffold_162, whole genome shotgun sequence
  Pfam annotation: Domain name=Metallophos; Domain location=60-300; Score=56.2; E_value=1.1e-13; Accession=PF00149.19; Description =Calcineurin-like phosphoesterase
MKQLELTLLLCLFWALTLLYGEMFAYWVPPIFTCSWPHLLRTSSSSMVETDSGNYQADYVKVAVIADPQLMDKTSLRLPAKSLALELVEFYTDLNMRRSFVASVLPFKPDVILLLGDYFDGGPYLSDEEWQESFNRFRHIFGLNAQGKYTDMPVYYIPGNHDIGYESLHSLKPEVIRRYEETFGIRNYRFTVGKVDFIAVDAQTLDGHPQNLLTSQTWDFVKNISADDVVHPRVLLTHIPLYRRDDTYCGPDRSSPIINQRIRHSLNGNTNDISMSENIGELRAGTIVRKLILSGHDHDQCTVSHQSKSGPVNEHTLGTISWQQGNLYPSFMLLSVDNSTHPNASIPKEALLTHLCYLPMQTHIYIWYIVLFILTLLAALFWPTSGTSFWHQCCGLFGYCKQLIACIFSRSETKEKDEDANYEYEMMWDAEGTMHLVKKTLNASTVNSNDQSLGERGYVVMRAAARKNTAQEGDLSVNVDMASGIGLDPVAKMPPRTGKSKTKIIVQRLIRTLRMLTVISAVNVPLYMMLLFKDWIDK

SEQ ID NO: 152077 - protein, 584 aa, Glycine max
  Coding DNA Sequence Number=SeqID_60392
  Gene Ontology: Mol. function=protein binding; Cellular component =cytoplasm; Biological process=protein transport
  Homolog annotation: Hit_ID=A7PZJ4; Match level="QueryCoverage=85%, HitCoverage=56%, E-value=0.0, Identity=78%"; Hit description =Chromosome chr15 scaffold_40, whole genome shotgun sequence
  Pfam annotation: Domain name=Sec10; Domain location=101-580; Score =229.3; E_value=9.1e-66; Accession=PF07393.2; Description=Exocyst complex component Sec10
MREPRDGARTDSSKPSKAAPPPQSFPLILDIDDFKGDFSFDALFGNLVNDLLPSYKLEESESDGGDALPNGHLRVPSDASKYSQGIVSPLFPEVEKLLSLFKDSCKELLELRKQIDGRLYNLKKDVSVQDSKHRKTLAELEKGVDGLFDSFARLDSRISSVGQTAAKIGDHLQSADAQRETASQTIELIKYLMEFNSSPGDLMELSPLFSDDSRVAEAASIAQKLRSFAEEDIGRHGIPVPSAMGNATASRGLEVAVANLQDYCNELENRLLSRFDAASQKRELTTMAECAKILSQFNRGTSAMQHYVATRPMFIDVEIMNADTKLVLGDQAAQASPSNVARGLSSLYKEITDTVRKEAATITAVFPSPSEVMSILVQRVLEQRITALLDKLLEKPSLVNLPSMEEGGLLLYLRMLAVAYEKTQELARDLQAVGCGDLDVEGNELTSNMPDFLHCKLVNPSLKGTLVWNIDANGLTESLFSSHKDEYPEYEQASLRQLYKVKASCTGLGIPIESMAEIKLWHCTERCLVGTRHKLGYAYLTKDLFSFLKATGKSSGLESQLFKGISKDLEVQVLTFSLDNWDCF

SEQ ID NO: 152078 - protein, 273 aa, Glycine max
  Coding DNA Sequence Number=SeqID_60393
  Gene Ontology: Mol. function=transferase activity, transferring nitrogenous groups; Cellular component=cytoplasm; Biological process= biosynthetic process
  Homolog annotation: Hit_ID=A8IKE1; Match level="QueryCoverage=81%, HitCoverage=45%, E-value=1e-118, Identity=94%"; Hit description =Alanine aminotransferase 1
MRKEKIPHQAPFAIQAAQLLGRAIGAGLFAITPAGERGMCCKAIKLGNARVYQENVYVPEKKFHSFKKVSRSMGYGENDITLVSFQSVSKGYHGECGKRGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 152079 - protein, 255 aa, Glycine max
  Coding DNA Sequence Number=SeqID_60394
  Gene Ontology: Mol. function=sequence-specific DNA binding; Cellular component=nucleus; Biological process=regulation of transcription, DNA-dependent
  Homolog annotation: Hit_ID=A4Q7P2; Match level="QueryCoverage=59%, HitCoverage=82%, E-value=1e-34, Identity=49%"; Hit description =Transcription factor, MADS-box
  Pfam annotation: Domain name=SRF-TF; Domain location=23-75; Score =69.0; E_value=1.5e-17; Accession=PF00319.9; Description=SRF-type transcription factor (DNA-binding and dimerisation domain)
MASFGANTVTKPIKKRKRTIEIKKVEQINRRYVTFSKRKLGLFNKLTELSVLCQVEAAVIITSQNGKLYTCGYPDADAVVRRYLSGGLSRGLDSESKKRQQDAIETLRPEYEATQNHLKEEQKRLQEIKETRKSSLCFPSWWNLPTEGMGLEDLEQFKTSLERLKFNLVGALQEKQMNSVPSMPNALMVPPMPSTVLPPVSHAAMVPPMMPPQFQNMPLLSVQRLSGNQVQDDYWRSAAIASNGFGSLKSYGYAT

SEQ ID NO: 152080 - protein, 184 aa, Glycine max
  Coding DNA Sequence Number=SeqID_60395
  Gene Ontology: Mol. function=identical protein binding; Cellular component=extracellular region; Biological process=negative regulation of catalytic activity
  Homolog annotation: Hit_ID=A7NTY1; Match level="QueryCoverage=96%, HitCoverage=29%, E-value=3e-50, Identity=51%"; Hit description =Chromosome chr18 scaffold_1, whole genome shotgun sequence
MACPHVAGVAALLRGAHPEWSVAAIRSAIMTTSDMFDNTMGLIKDIGDGHKQTSPLALGAGVQDYVNLLCALNFTQKNITTITRSSSYNCSRLSLDLNYPSFIALFTGNGSSINSRVTLIGSFRERVIPSKLLFKQKKEKLSYELRIEGPKIEGFGYLSWTDVKHVVRSPIVVTNQSPSNSTFV

SEQ ID NO: 152081 - protein, 173 aa, Glycine max
  Coding DNA Sequence Number=SeqID_60396
TYQGNPCGIYLDLSSFIRSGVYPDLSSFTGSGVYPDLSSFTGSGVYPDLSSFTVSDVYPDLSSFTGSDVYPDLSSFTGSGVIQNSKACIKRSAPSQVHIKINDRGLKKKNHRMTSIEHLFGVAVKIYNLRRLGFFVRPQSKLWFDRQWHVLICLATKTLAHLGKKLDSPILIE

SEQ ID NO: 152082 - protein, 86 aa, Glycine max
  Coding DNA Sequence Number=SeqID_60397
MTANIVPVLLRIDAKRAPTKCSLKCIRIRISAVTYFVRYLRTDASGDGVTTDRSLPLLCAKQTENVAARQPRILCILQLSFTICLF

SEQ ID NO: 152083 - protein, 159 aa, Glycine max
  Coding DNA Sequence Number=SeqID_60398
MTIRAPTPWVNLVKDNRSPSKGFGMKFSPPPSDDEVLLEETDLQPLEEAWGHSLIGYVAGRFQGKKALLDCCQKWGVKFSYSAHESGWLVFKFESKDRNHDQVCNCRRLLKDPVLLKVMPCIASWNSEVWQLKQLMRRSFAGLNSRKSTSWSFGTLKVE

SEQ ID NO: 152084 - protein, 196 aa, Glycine max
  Coding DNA Sequence Number=SeqID_60399
  Homolog annotation: Hit_ID=Q6WAY6; Match level="QueryCoverage=68%, HitCoverage=24%, E-value=9e-10, Identity=31%"; Hit description =Putative uncharacterized protein
SKCGQDLGTRVRPSEAKEEWGGRDTMAALGGKGRPIYPLQGHRMCAEKGKENWEELLAGFQNFPLMGTRGCISYNPILAIRQLGYLMRGALLEKINILFIARGFSEGNAKMLQRIRKVWNIVERKDKELRGSSNGVIGGYHKWLKARTQGITWFPKLKSPSREAEVPEESKEVQALKAELERTRVVKEKLKTTVTR

SEQ ID NO: 152085 - protein, 252 aa, Glycine max
  Coding DNA Sequence Number=SeqID_60400
  Gene Ontology: Mol. function=D-alanine-D-alanine ligase activity; Cellular component=cytoplasm; Biological process=cell wall organization and biogenesis
  Homolog annotation: Hit_ID=A8GBI1; Match level="QueryCoverage=90%, HitCoverage=62%, E-value=4e-85, Identity=68%"; Hit description=D -alanine--D-alanine ligase
  Pfam annotation: Domain name=ATP-grasp; Domain location=28-210; Score= -5.8; E_value=4.5e-07; Accession=PF02222.13; Description=ATP-grasp domain
  Pfam annotation: Domain name=ATP-grasp_3; Domain location=28-211; Score=-43.8; E_value=0.013; Accession=PF02655.5; Description=ATP -grasp domain
  Pfam annotation: Domain name=CPSase_L_D2; Domain location=28-236; Score=-101.7; E_value=0.00068; Accession=PF02786.8; Description =Carbamoyl-phosphate synthase L chain, ATP binding domain
  Pfam annotation: Domain name=Dala_Dala_lig_C; Domain location=28-236; Score=394.5; E_value=1.6e-115; Accession=PF07478.4; Description=D-ala D-ala ligase C-terminus
  Pfam annotation: Domain name=GARS_A; Domain location=27-206; Score= -108.5; E_value=0.0092; Accession=PF01071.10; Description =Phosphoribosylglycinamide synthetase,
  Pfam annotation: Domain name=RimK; Domain location=26-238; Score= -48.0; E_value=0.0012; Accession=PF08443.2; Description=RimK-like ATP- grasp domain
  Pfam module annotation: Pfam domain module=ATP-grasp::ATP-grasp _3::CPSase_L_D2::Dala_Dala_lig_C::GARS_A::RimK; Domain location=28 -210::28-211::28-236::28-236::27-206::26-238
MARCRDCCAWPICRLSGRMCWVPAVSMDKDFTKRLLRDAGLKVAPWLSVTQTQRAALDVQAVIARFGLPLFIKPANQGSSVGVSKVTQPDEFDAALDLAFRFDRKVLIEQGISGREIECAVLGNEAPEASPCGEIVVHDAFYSYDTKYISESGAQVVVPADISAEASEAIRAVAITAFQALECFGMARVDVFLTETGDIIVNEVNTLPGFTNISMYPKLWQAAGLSYSDLITRLIELAQQRHQQSSQLKSSV

SEQ ID NO: 152086 - protein, 69 aa, Glycine max
  Coding DNA Sequence Number=SeqID_60401
  Subcellular localization annotation: CTP_CleavageSite=25; ConfidenceScore=5.07e-01
MKKVMNKKLKHQRTTQVNQRTSQVNQEQVKSSRIKKNSRLKKKAYNQESRFKIQDLRNQDKDSRLKIQE

SEQ ID NO: 152087 - protein, 48 aa, Glycine max
  Coding DNA Sequence Number=SeqID_60402
MDEDQWAYYSAMSEEVDMDFQNEEEDCGVNEAHVDCSDAFNTSQVFET

SEQ ID NO: 152088 - protein, 208 aa, Glycine max
  Coding DNA Sequence Number=SeqID_60403
  Gene Ontology: Mol. function=phosphoprotein phosphatase activity
  Homolog annotation: Hit_ID=A5APQ3; Match level="QueryCoverage=44%, HitCoverage=6%, E-value=1e-11, Identity=35%"; Hit description =Putative uncharacterized protein
MGMRTMPNVSPVSYSSTTTKRATCLQAMIIYLSFVVIRCHEMRRAKWHQPDRVMRQFGMQQPIPGPVMQPNNIHDLTLKGKEGKNWMRLMQPALNEWNSHYERRVEQMPPQTGTLSLNSKYMRWYRRKTKGEIAETLHFMVSPVGRKICTFDDLLPCIEKITLLSDEEDKILEAHEDAPPSQPQFEHQQFNILQQSVETRGLARRGIL

SEQ ID NO: 152089 - protein, 314 aa, Glycine max
  Coding DNA Sequence Number=SeqID_60404
MAPNNNRRAPVVGTRKKEGDAHAVTTAPTWMKAPQNIQSSYQPNPPNFLIRAGNSLPTQVKGPPAAERAPAQRTAPAAPRPVNNTAPGATYKYAQHPKDNFPPIPMAYSKLWPSLLENHLVVAIPGKVLQPPYPKWYDSGANVNAVKEDGPSRTKRLGDVATSRRFIYQSLQAARMVPRGGDERDECLFHLGESHDMETYPMVEELLQRLMDCGQLEVFIEGKEEPQICMQSEEKRVPLTPKALVICFTRKGTDSTPIYPQAAPKPTPFAYQSNKAVPWKYTPPMSSERVVTEVDSLSAKVTNITGLSGVTRSG

SEQ ID NO: 152090 - protein, 202 aa, Glycine max
  Coding DNA Sequence Number=SeqID_60405
  Homolog annotation: Hit_ID=A5BSR3; Match level="QueryCoverage=41%, HitCoverage=25%, E-value=3e-09, Identity=44%"; Hit description =Putative uncharacterized protein
AEFEILEAFDSRTKKKILQIFGERWRQFKSDLTRKWILAADKDGADDIACEKYGISKDKWAQFCQTRRDPLWKSGSTEGIIDPPSPIRRHVKWKMARTKKTGQMTSEATKEIADRIIIHDSLDEQASQGSFVPHGHQDILTAAIGRLEHPDRVRVVGAGVTIKQYFGSASRTSRSSSSMPPEDLEQLTQQIRDQLEESITEK

SEQ ID NO: 152091 - protein, 57 aa, Glycine max
  Coding DNA Sequence Number=SeqID_60406
STLEDPTQQREVRVMIAGQDVAEQQHHPYLSQGGHVGAHDLHPSPGSGPGKILTRYA

SEQ ID NO: 152092 - protein, 57 aa, Glycine max
  Coding DNA Sequence Number=SeqID_60407
IVINFVMQAPLELVGLGSSSSMDSFASWKINGSGMEKEEREETPLQGEDESRRSSPP

SEQ ID NO: 152093 - protein, 177 aa, Glycine max
  Coding DNA Sequence Number=SeqID_60408
  Pfam annotation: Domain name=Transposase_23; Domain location=50-118; Score=-2.5; E_value=0.0022; Accession=PF03017.5; Description =TNP1ENSPM transposase
  Subcellular localization annotation: CTP_CleavageSite=29; ConfidenceScore=5.29e-01
MASFSQLQSQIQSQAPSEPLVGPCPSGSRVSTKGSCVDPSGNNPETGDSDRVYEGSTLVHNPARLVAVGRVYEGSTLVHNTPLLSGQVKVSVDEVKDADAPVLVSTAEVFLVGQTLHTFLAWPTHLIKSLSHEVRWDVTMFGIVNPDFPLYIKHEDLSEIAHGGQCLGISVLRLWIL

SEQ ID NO: 152094 - protein, 296 aa, Glycine max
  Coding DNA Sequence Number=SeqID_60409
DVRKKAQAIQKQNTSPHVLSRAGYEYLEQKLLAEKTKKKLEETAQSGSSVDGIIDPPSLVRCHDSFEEQATQGSFVFHGRQDVLTATIGRPEHPERVTIKQYFGSAPRTSHSSSSLCPEELQQLTRQIRDQLEESISKKVTRQLMASFSQMQSQMQSQGLALPPEPLVGPSGPRVSTKGSCVDPSGNDPETGDSDRCGLYIEADPARLVALGRVYEGSTVVHNTPLLLGHVKVGVEEVTDADAPVPVPTDELCLQQNHLQSPIQRSMIRFIDDIDHPRAFLEALSGYMGCHGVRGL

SEQ ID NO: 152095 - protein, 192 aa, Glycine max
  Coding DNA Sequence Number=SeqID_60410
MHERQSIRGALKKNGEWRIALGNHYAWLQTHGWRMHERQSIHGAPNKRGEWRIALGNHYTWLQTHGWRMHERQSIHGAPKKNGEWRIALGNHYAWLQTHGWRMHERQSIHGAPNKRGEWRIALGNHYAWLQTHGWRMHERQSIHGAPNKSVGRTEWSAGFFPPKKTNMLSAKKNKSFARAPYLRETVYSCQG

SEQ ID NO: 152096 - protein, 200 aa, Glycine max
  Coding DNA Sequence Number=SeqID_60411
MDAHPCQDGVHQLALRHGEVGIMIGGQDVAEEQRHPYLGQGGHTGAHDSHSPPCSSPGKILPRPVPPLAILAFLALFQHHRISQELADSVGIERDPLTPNPGSHVTHALLCWPSIGIKFKDYSWIKLGHRSNQWCPPPAPYFLLKISILVVPELDASLPEKRPSLDGFEALLVYSAPKAVTVVLRSGTSSFGRLVLPGPL

SEQ ID NO: 152097 - protein, 174 aa, Glycine max
  Coding DNA Sequence Number=SeqID_60412
MDYGNVTPKGGDRIPKGRPLLLLNPIGRPLLLLNPVAIIKSWCKSSLRRISLFGVLLERKSQIRVVLELFPRGCSFCTYPAWEAPVELATSCMADTCHLLEESANRIGDLTMTGIGASGIGALLVCPVKQQQQKCRLGNLGAGKRHSHWRFRLAEGAGAIGASCFFFLYKLRLA

SEQ ID NO: 152098 - protein, 173 aa, Glycine max
  Coding DNA Sequence Number=SeqID_60413
MAPKKLSVKRTRRDATAEGTSAAPEFDSHRFQSAEHQQRFEAIKGWSFYIERRVQLREDEYTDFQEEIARRHWTSLVTPMAKFDPEVVLEFYANAWPTEEGVRDMRSWVRGQWIPFDADALSQILGDPLVLEEGQECEFSQRRNRADGFDEEAIAQLLCTLGKDFAWTAAGRR

SEQ ID NO: 152099 - protein, 26 aa, Glycine max
  Coding DNA Sequence Number=SeqID_60414
MSKRLQEDWTRVVEEGPRVLITSGVP

SEQ ID NO: 152100 - protein, 81 aa, Glycine max
  Coding DNA Sequence Number=SeqID_60415
  Homolog annotation: Hit_ID=A6FJQ2; Match level="QueryCoverage=46%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARLWLNLSEGGIIQGDMMVQEEIQNLNRVHNDI

SEQ ID NO: 152101 - protein, 193 aa, Glycine max
  Coding DNA Sequence Number=SeqID_60416
  Homolog annotation: Hit_ID=A5BSR3; Match level="QueryCoverage=31%, HitCoverage=19%, E-value=6e-09, Identity=51%"; Hit description =Putative uncharacterized protein
MARTKKTGEMTTEAAKEIAEKIDSFEEQATQGSFVPHGHQDVLAAAIGRPEHPGRVRAAGASQLTQQIRDQLEESITEKVTRQVMASFSQLQSQMQSQELPVPPEPLVGPGPFGPRVSTKGSCVDPSGNDPEMGDSDRCGLYIEADPAHLVAMGRVYEGSALVHNTPLLSGQVKVSVEEVTDADAQVPVPTDE

SEQ ID NO: 152102 - protein, 135 aa, Glycine max
  Coding DNA Sequence Number=SeqID_60417
MAPTRHPLDPEKALITGLCQSYEVPVTPIKGDAHQAAGAPPPPRQADPAGPLGVERYLQHLVRQQVANHRGQGQGSAPFVCPTPEQFGAEVAWPRNWPDVQVGEEPTGSPGEADESHMDEDMTDLLGFLGGSGST

SEQ ID NO: 152103 - protein, 123 aa, Glycine max
  Coding DNA Sequence Number=SeqID_60418
  Homolog annotation: Hit_ID=A2Q4P8; Match level="QueryCoverage=38%, HitCoverage=20%, E-value=2e-11, Identity=68%"; Hit description=IMP dehydrogenase/GMP reductase, related
  Pfam annotation: Domain name=DUF1723; Domain location=1-44; Score =42.6; E_value=1.4e-09; Accession=PF08330.1; Description=Protein of unknown function (DUF1723)
ISAFVERWHKETSSFHLPIGELTITLDDVASLLHLPIIGVFNSFEPLHVDEAVLMLVELLEVSEYDEMSPRACRWLTTKAYSKGFPASTYRTRINALTIPDVCWMPYGEHRGVRAFDLISCFQ

SEQ ID NO: 152104 - protein, 111 aa, Glycine max
  Coding DNA Sequence Number=SeqID_60419
  Homolog annotation: Hit_ID=A2Q246; Match level="QueryCoverage=100%, HitCoverage=63%, E-value=2e-47, Identity=66%"; Hit description=CENP -B protein
MTSKIQPCDVGIIRAFKMHYRRRFYRKILEASDVARNLDESTFDEETQDLETMINQCGYHNKMDIDNLMNYPGENEACSEVQSLEDIVGTIIENNAEDDGEDDTVSLEPVT

SEQ ID NO: 152105 - protein, 89 aa, Glycine max
  Coding DNA Sequence Number=SeqID_60420
MSPPPLGVEAMSSKVILMMSKNQELSKGSSKDSRFKNNQYQDSRLKIQESREGSIKISIKMFFNTLSSTRSFHKIITKEFYSLVIDYQK

SEQ ID NO: 152106 - protein, 142 aa, Glycine max
  Coding DNA Sequence Number=SeqID_60421
  Homolog annotation: Hit_ID=A6FJQ2; Match level="QueryCoverage=26%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARCWIYEHFPSVHRCVVDDGYAEASPRACRWLTGKAQMTGIKGAPYRARIDALTVTDVCWGTELEFVIMVIAVSCVKLLSAHNSTQHTSRKHKV

SEQ ID NO: 152107 - protein, 157 aa, Glycine max
  Coding DNA Sequence Number=SeqID_60422
MATMMEAMMSMKKIMEVNVAAVAATSAVAGVDPIPPSGLNQIIHPTSDMVGQGGKEFGSTGAPHYVRIQNKHAFLPYGLPFNYTPPNVVHTPNENVNNSTPILIDSQQTQSNHAHVSQPMGETHEIPYHNLADFEPRLRYATKGKAVAGVLLVGLYD

SEQ ID NO: 152108 - protein, 61 aa, Glycine max
  Coding DNA Sequence Number=SeqID_60423
TALGFCGKGKCYNARGIYLSSRHNIEIPNGENARNWVANVVLKFHDDPTVNESKIVIFLRQ

SEQ ID NO: 152109 - protein, 63 aa, Glycine max
  Coding DNA Sequence Number=SeqID_60424
MSVSTGSASISWGRFRAEVAWPGDWPEAQAREAPAGSPDDAEEARMDEEMTNLLGFLGGSGAT

SEQ ID NO: 152110 - protein, 209 aa, Glycine max
  Coding DNA Sequence Number=SeqID_60425
ESESISDYFKSMFVEINEAATGNGDDSSIGVVNQLKRNGEDVDEVKTMTIDNSWLLTRHRMFLEKFKMRKIKQKEATEQYYNSTTRFATKIVDVDEDMEEKEDGRNPQVTRGRGRGNLMCRGMDKSQIKCFNLKFKKAEKESGTLLLACQNMNYGGEFQKKQVVPRHRHNNTCARVKAFRETRTGQLNMVRSMLKSKKMPKEFWAEAVA

SEQ ID NO: 152111 - protein, 90 aa, Glycine max
  Coding DNA Sequence Number=SeqID_60426
MVIDQSLFHDLTKLPSDGVPFEGTLNDDWKFDFSARDARQLVCTNNADMTGRLLAGSLAFESRILHYLIVRILLPRSSNLAQGVNLTGHT

SEQ ID NO: 152112 - protein, 94 aa, Glycine max
  Coding DNA Sequence Number=SeqID_60427
  Homolog annotation: Hit_ID=A5C922; Match level="QueryCoverage=76%, HitCoverage=28%, E-value=3e-08, Identity=37%"; Hit description =Putative uncharacterized protein
MAALDFTYESLCIQYLDEGVPYVLKIGLIHLLPKFHGLAVAKDWLYYLAPRSIFSWDDLKRVFLEKFFPASRTTAIRKDISGIRKLSGESLYEY

SEQ ID NO: 152113 - protein, 63 aa, Glycine max
  Coding DNA Sequence Number=SeqID_60428
MTINSWGSGLDGGGRTNSARQSIHGAPDSMAINSWGSRLDGGGRTNSTWQSIRGAPDSMVEDA

SEQ ID NO: 152114 - protein, 182 aa, Glycine max
  Coding DNA Sequence Number=SeqID_60429
MVIPKFKVPDFGKYKGTTRSKNHLKIKKIEVDPKRGKFDHPTRTTEKTGANKEGEDEGETHAVTTIPVRPSFPPTQQYLYSANNKLSPYPPPSYPQSEKACRIHPQFQCPMLTCIPYLLDNSMVAITLAKVHQPPFLREYDSNATCACHGEAPGRSIEHGRALKRKVQGLIDAGWLKFEENC

SEQ ID NO: 152115 - protein, 71 aa, Glycine max
  Coding DNA Sequence Number=SeqID_60430
MVIPKFKVPDFGKYKGTTRSKNHLKMYCRKMGAYAKDEKLLKHDATTKSVQKGGTNLSKNTPKDGETWQLK

SEQ ID NO: 152116 - protein, 108 aa, Glycine max
  Coding DNA Sequence Number=SeqID_60431
MMRIMKLAKYRLKAQSGEGRRPKWRRDKTSEWRRMKAQTYQGNPCGVYPDLSSFTGSGVYPDLSSLTGSGVYTDLSSFIGSGVYPDLSSFTGSGVIQIFVTCIKRSAP

SEQ ID NO: 152117 - protein, 91 aa, Glycine max
  Coding DNA Sequence Number=SeqID_60432
  Subcellular localization annotation: CTP_CleavageSite=32; ConfidenceScore=5.05e-01
MMQTLSAPMTYRKRKAPSTPTQARFDRSRFTSQEALERYTDIVVPHKLLTERNVVVYYTEFDEFKVELKRRHWDEELNDFVDGNIDVAIVK

SEQ ID NO: 152118 - protein, 71 aa, Glycine max
  Coding DNA Sequence Number=SeqID_60433
MTDVWGANTFPVRKYNSRAFHLKRYAINSWGSGLDGGGCINSATQSIHGAPDLMMEDARTTLGNQFVGLRT

SEQ ID NO: 152119 - protein, 85 aa, Glycine max
  Coding DNA Sequence Number=SeqID_60434
MGLVLLSQPTLLRASEARLTGRSSKGGKCAESPPTFICGKRRKNRRKPVIKNILDSGVVFTFEEGRQKRGSCSYVPCIEEEIRPM

SEQ ID NO: 152120 - protein, 136 aa, Glycine max
  Coding DNA Sequence Number=SeqID_60435
MAPKKLSTKRSRRDTAAEGSSATPEFDSHRFRSVEHQQRLKAIKGWLFLRERRTSLVTPMPKFDPEIVLEFYANAWPTEEGVRDMHSWVRGQWIPFDADALSQFLDDPLVLEEGQQCEFSQRRNRAEALSQNPNLP

SEQ ID NO: 152121 - protein, 155 aa, Glycine max
  Coding DNA Sequence Number=SeqID_60436
MHFKSNLKRKWALAVDQDGVDDIVCEKYGISKEKWAQFCQTRRDPSWEDVRKKAQAIQKQNIAPHILSRGGYEYLEQKLLVEKTKKKLEVAAQSGSVDGIIDPPSPVRRHMKWKMVRTKKTGEMMTEAAKEIAEKIDSFEEQASQGSFVPHGRQD

SEQ ID NO: 152122 - protein, 51 aa, Glycine max
  Coding DNA Sequence Number=SeqID_60437
MVEINQGTDASGARVTTDRSLPLPGAKQAENVAAGQPSILCVRNFFYYCLF

SEQ ID NO: 152123 - protein, 115 aa, Glycine max
  Coding DNA Sequence Number=SeqID_60438
MRDPLLFITLLCCLAKHFTPSLAWPTHLVKSLSQQVAVSPPKPPPKPDLEVDDPLYLMTLTISELFLRPYQVRWDATVFRVVNPDFPLYIKHEDLSKIAHGGQCLSISVLQLWIL

SEQ ID NO: 152124 - protein, 66 aa, Glycine max
  Coding DNA Sequence Number=SeqID_60439
MCIHLKVERCENFPGRPKWTRMNAQIDKRTTFPLPRTAGQTLTYIMTSRSTSLEPKSQLTINLDPG

SEQ ID NO: 152125 - protein, 235 aa, Glycine max
  Coding DNA Sequence Number=SeqID_60440
  Homolog annotation: Hit_ID=UPI0000ECA21E; Match level="QueryCoverage =24%, HitCoverage=15%, E-value=2e-27, Identity=96%"; Hit description =UPI0000ECA21E related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSPLAAATGNRISRARYVGRATEFLKWWPNY

SEQ ID NO: 152126 - protein, 67 aa, Glycine max
  Coding DNA Sequence Number=SeqID_60441
HAAGIMTGVIKLHVINNGALKSVEDDKDGGIGVEDAPVASGRGVLCAAAEVDEPLRLLDDSAIWCSY

SEQ ID NO: 152127 - protein, 226 aa, Glycine max
  Coding DNA Sequence Number=SeqID_60442
  Gene Ontology: Mol. function=beta-lactamase activity; Biological process=beta-lactam antibiotic catabolic process
  Homolog annotation: Hit_ID=P62593; Match level="QueryCoverage=20%, HitCoverage=16%, E-value=7e-18, Identity=100%"; Hit description=Beta- lactamase TEM precursor
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPGAGERGSRGIIAALGPDGKPSRIVVIYTTGSQATMDERNRQIAEIGHHFKNSVAPPTYLALLILLPVAAASGDKSCLTGATLPEGRKADRYPVSGRVGTGERTRELPGGNAWYLYSPVGFATSDLSVDFCDA

SEQ ID NO: 152128 - protein, 91 aa, Glycine max
  Coding DNA Sequence Number=SeqID_60443
MEECKSVSTPMNQKEKFSKEEGVDNIDEGYLWELDWMSNMQQSGEVNLIYCKYKDQLADMFTKSLPINKLELKELEFAVPKARRSVEDILL

SEQ ID NO: 152129 - protein, 101 aa, Glycine max
  Coding DNA Sequence Number=SeqID_60444
  Homolog annotation: Hit_ID=A5AT22; Match level="QueryCoverage=45%, HitCoverage=12%, E-value=3e-10, Identity=50%"; Hit description =Putative uncharacterized protein
LLSLWLRITKVEVEGYSLSSTLRLAIRESCEASCMLKYAGDIALSVGKMLGRYQSNPGIDHWRAAEIETQTFLGCVDIRRSTSGYIFMMAGGMLFGHGGAC

SEQ ID NO: 152130 - protein, 120 aa, Glycine max
  Coding DNA Sequence Number=SeqID_60445
PQQQCPSPYYPHQQWAYPPYPNQYQQWSSPPWQPWATPPCPYPTARNPKEQPGILGPKPSHQAHVANAAPTSSYAPTDIQAAMHTLSLSTPDDQWYMDTGATSHMTANGGFSDRNTVNEM

SEQ ID NO: 152131 - protein, 199 aa, Glycine max
  Coding DNA Sequence Number=SeqID_60446
  Gene Ontology: Mol. function=phosphoinositide phospholipase C activity; Biological process=intracellular signaling cascade
  Homolog annotation: Hit_ID=Q2HTA0; Match level="QueryCoverage=87%, HitCoverage=27%, E-value=1e-23, Identity=37%"; Hit description=IMP dehydrogenase/GMP reductase, related
  Pfam annotation: Domain name=DUF1723; Domain location=98-147; Score =62.9; E_value=1.1e-15; Accession=PF08330.1; Description=Protein of unknown function (DUF1723)
MEAPATVEDIPADILVDAGAKAVEDQPQGFPGGPSDPSVLTAYADHVACSVWTGEECPELKLSSHGRKVHSLGRPVPAIEGLIAGTGLSPLIACSVDTGDRGLLSAFVERWHRETSSFHLPVGELTITLDDVSYLLHLPVIGDLHAFEPLHVDDAVQMLVDLLMMSPESARAETVQCRGPYVRLQWVRDIYLRRCQAGH

SEQ ID NO: 152132 - protein, 86 aa, Glycine max
  Coding DNA Sequence Number=SeqID_60447
MTSRDKIWSFGTLVSSRGGGPDDTRRYLTVICTLVSSRGGGPDDTQRYLTVICTLVSSRGGGPDDTRRYLTVIRINFLLLSVRQNA

SEQ ID NO: 152133 - protein, 161 aa, Glycine max
  Coding DNA Sequence Number=SeqID_60448
  Homolog annotation: Hit_ID=Q6WAY6; Match level="QueryCoverage=58%, HitCoverage=15%, E-value=5e-08, Identity=37%"; Hit description =Putative uncharacterized protein
MGTNQNGKRFYQVKVKGLDVTSLKELGRLMGPLQRQAFRKVYGKILDLTVAEVFTEAVEMFHVAAVVGDSAKELDRIKQIRNGVVGLPRKYLEDKARDMASQEKWGPFADVLALLIYGVVLFPNVDGLVDLAAIDAFLAYHHSKESPVVAILADLFDTFDR

SEQ ID NO: 152134 - protein, 208 aa, Glycine max
  Coding DNA Sequence Number=SeqID_60449
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=93%, E-value=4e-66, Identity=100%"; Hit description =Apocytochrome f precursor
  Pfam annotation: Domain name=Apocytochr_F_C; Domain location=97-208; Score=181.6; E_value=2e-51; Accession=PF01333.10; Description =Apocytochrome F, C-terminal
MIYIIIRAPISNAYPIFAQQGYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGPELLVSEGESIKLDQPLTSNPNVGGFGQGDAEIVLQDPLRVQGLLFFFASIILAQIFLVLKKKQFEKVQLSEMNF

SEQ ID NO: 152135 - protein, 118 aa, Glycine max
  Coding DNA Sequence Number=SeqID_60450
MAGAGDNGGVYHQLDGFQCLLLDAMTRQMQRLLKPNNEEFYRRIEGLEHQMNPNVGRPYSGNRRVNDGSNRIKRQDRSEGVKLNVSSFKGRSDPDAYVDWEMKIQHAFSYNDYPEKQK

SEQ ID NO: 152136 - protein, 97 aa, Glycine max
  Coding DNA Sequence Number=SeqID_60451
MTIYEETLGSTKREENHSKCINLAQREANKSPTHRILVGNQRERTTLGHGQGLTFSPWVKVYGKLGFWLKACSTAAHDICQGLVQFKDKKECPTLFP

SEQ ID NO: 152137 - protein, 76 aa, Glycine max
  Coding DNA Sequence Number=SeqID_60452
MTRGNSSDLQPFDPEIDRTFHRLVRHHLVPFEHPKHSVIGDFEHSENMAHPPPCEDSHKHLKEFHIVCSTMKPPDV

SEQ ID NO: 152138 - protein, 133 aa, Glycine max
  Coding DNA Sequence Number=SeqID_60453
MEPIASLAQYYDQPLRCFIFGDFQLSPMVEEFEEILGCPLGGRKPYLFSGFYPSLARISKKGPNLGAGIRPPKASRKWGGRNTEKIFGAIDVFLAYHNHKESPVVAILAMYDTFDRGCERSGARIVCCAPTLG

SEQ ID NO: 152139 - protein, 103 aa, Glycine max
  Coding DNA Sequence Number=SeqID_60454
MGLRIRLDDGGCMNNARQSIRRASDSMVEDASLGNQFVGLRTQWWRMHVWQSIHGAPHKMVEDAQKALGSQFVRLQIRFDDGGWTNSARKSIRGAPDSMVEDA

SEQ ID NO: 152140 - protein, 153 aa, Glycine max
  Coding DNA Sequence Number=SeqID_60455
MINIQNLIYGYGGFHQHTLLPRWTHCFSLKKAYAALISWNICLFAKACLHFSGENTETFSSLTSYPELRRSEFLIGGYVGARASLLSTTPLFVTMTQKLVACGDTLRLSAPRHSVTPSVIDEQRPVWSFAPFPEMSTSSGRDFFKSHKLSRTT

SEQ ID NO: 152141 - protein, 52 aa, Glycine max
  Coding DNA Sequence Number=SeqID_60456
VDNSGAFAPTYPPLERKSDLRSSFVCVNQVILFYLKDDHFKALDLKNDPFYL

SEQ ID NO: 152142 - protein, 227 aa, Glycine max
  Coding DNA Sequence Number=SeqID_60457
MQRQIMVILHTSSFGHRRVRWHAATNIVFCAFCHPEAAGPMTCGDKLWSFRTLRHSDTVMSNGMQRLTLSSAPFVIQRRHSRVRWHAETNVVFCAFYHPEAAGPMTCRNHLVLHFLLLSSRGDGPDDMRRQIMVIPTLLLSGDSLSEWCFARTKLVSYLYFPFISNKRQVKRGNCHTLISSGDHPLLGCDPRLTTLRYMAPIVRQFVKLRDMPEIKRKHCCTIRKVP

SEQ ID NO: 152143 - protein, 286 aa, Glycine max
  Coding DNA Sequence Number=SeqID_60458
  Pfam annotation: Domain name=Transposase_23; Domain location=114-184; Score=1.5; E_value=0.00081; Accession=PF03017.5; Description =TNP1ENSPM transposase
MTTEAAKEIDEKMYSFEEQASQGSFVPHGRQNVLTAAIGRPEHPGRACATGAAADPANQGPARGVDHRKSDSTTHGTVQLDAIPVSVPDAILGTCTASGASGWSLRSSRNDLETGDAERCGLYIEANPARLVSLGRLYEGSTIVHNTPLLPSQVKVGVEEVKDPDAPAPVPTDEVSLVGQAIHSFLAWPTHLVKPLSQQAVVSPIKPPQKSDPKVDDPLYLMALTIPELFLRPYQVTWDATVFVVFNPNFSLYITHEDLSEITHGGQCLSIPVLQLWILLVILDYF

SEQ ID NO: 152144 - protein, 63 aa, Glycine max
  Coding DNA Sequence Number=SeqID_60459
MAYTDNHSGISARQHDSKVSMTDLNDQILSLRANLPFGGRATRDSRDACSTKGIRAESPPTFI

SEQ ID NO: 152145 - protein, 229 aa, Glycine max
  Coding DNA Sequence Number=SeqID_60460
MASLGGYHEWLKVRISRFKIGSPKDEEVQALKSELGKAKLAKEKFKLAATHVRKECAGLREENAITARALEREAKRARKEEYGRNKFRGALWGSNNELKLRREERDQSRAHSMVLKEELIACSRSKRSLSQRLCETETNMLAIIAKYEEELGLATAHEHRIADEYAQVYAEKEARGRVIDSLHQEATMWMERFALTLNGSQELPRLLAKAKAMADTYSTPEEIHGLLGY

SEQ ID NO: 152146 - protein, 46 aa, Glycine max
  Coding DNA Sequence Number=SeqID_60461
TYQGNPCGVYPDLSSFGGSGVYPDLSSFTGSGVIQTFVACIKRSAP

SEQ ID NO: 152147 - protein, 335 aa, Glycine max
  Coding DNA Sequence Number=SeqID_60462
  Subcellular localization annotation: CTP_CleavageSite=38; ConfidenceScore=5.06e-01
RPARPHLQRTTHPRLERTTCPHHQRAVRPHLRRTTRPRLERATRPRLGYLVTLTLRGLNVLALRGLHVLTIRGLHALTSRGLQVLTLRGLHVLTIRGLHALTSRGLHVLALRGLLALALGTSYPHLQRTTCPHLRLHALAIRGLHVLTFVGLHALTFRGLHILANRGLHALTFRGLHVLANRGLHALNLRGLHALTFRGLYILALRGLHALTFRGLRVLIFRTSSFLLTVPGPPPDIGGWPTVRAQPEREAITQLLCIPGQDFTRAAAKRRGSHPQDTQWTRKSPTGPWGFQLWLRVSVGPIGDRARKTPSGSEEVQQGLVMFQALITGLCQFYG

SEQ ID NO: 152148 - protein, 110 aa, Glycine max
  Coding DNA Sequence Number=SeqID_60463
ENSDCFMHSEAEALDHTKKIDTSHQSVSLENETRDSTMLKMGDSAKVVIKQDMKGREHKYGFNNNEREKPEKKRVVDDETGDKHQLDEVLRRQIETKTDASIRENVAVTY

SEQ ID NO: 152149 - protein, 91 aa, Glycine max
  Coding DNA Sequence Number=SeqID_60464
MENCTKQSVRMAPNSWAGGCLNENAIHGAPKKGMNERSKLVGGGYMNENAIHGDSKKGREWRIALSNHYAWLQTRGRRMHERIRNSWGSEK

SEQ ID NO: 152150 - protein, 78 aa, Glycine max
  Coding DNA Sequence Number=SeqID_60465
  Homolog annotation: Hit_ID=B0HC01; Match level="QueryCoverage=44%, HitCoverage=74%, E-value=3e-12, Identity=100%"; Hit description =Putative uncharacterized protein
MRKRHASPKGEKPDRYPGAGAYGKTPATRPFYGSWPFAGLLLTCSFLRYPLILWITVLPPLSELIPLAAAERPSAASQ

SEQ ID NO: 152151 - protein, 109 aa, Glycine max
  Coding DNA Sequence Number=SeqID_60466
ARPNSQKKSPVESPTIATCPLAGERGRGSRVRFPKEERCAESPPTFICGKRQKNRRKPVKMKILSSGVVFTLEEGISISHVDKSRAFAPTYPPSKRKSDLRSSFLCVNQ

SEQ ID NO: 152152 - protein, 56 aa, Glycine max
  Coding DNA Sequence Number=SeqID_60467
MEKVMIKHLHKIKWPNSLTTILSGVANCRNLPFGGRATRDSRDASSKKGIHAESPP

SEQ ID NO: 152153 - protein, 227 aa, Glycine max
  Coding DNA Sequence Number=SeqID_60468
  Gene Ontology: Mol. function=transcription factor activity; Cellular component=intracellular; Biological process=regulation of transcription, DNA-dependent
  Homolog annotation: Hit_ID=A4WDS1; Match level="QueryCoverage=100%, HitCoverage=67%, E-value=1e-102, Identity=82%"; Hit description =Transcriptional regulator, LacI family
  Pfam annotation: Domain name=Peripla_BP_1; Domain location=3-216; Score=-25.3; E_value=0.00037; Accession=PF00532.12; Description =Periplasmic binding proteins and sugar
MTEEKGRQLILADGKHSADEEREAIQYLLDMRCDAVIIYPRFLSVEEMDEIVEKCEQPIMVLNRRLRKNSSHCVWSDHKASSQDAVAQLIAKGHREIAFITGSLDSPTGVERLSGYKDALAQHGLPLREGLIAQGKWNPASGAAAVAELLARGERFTALVASNDDMAIGAMKQLHDSGVATPEAVSVIGFDDVAIAPYIVPSLSSVRIPVTEMIKETISRLIFMLDG

SEQ ID NO: 152154 - protein, 99 aa, Glycine max
  Coding DNA Sequence Number=SeqID_60469
MDEMDIRVRHPLTNACLLIQLSPECGCKPLVYLLKRPALLSVDFQDCSIRDYSSCTLVGVPDTLPLCSGILYNKRPTVSNPFSEIRRREEEVSRKRGRL

SEQ ID NO: 152155 - protein, 52 aa, Glycine max
  Coding DNA Sequence Number=SeqID_60470
MGSSQKPSLKKRFYQVKIKSLEDFPASAKRVEEFEEIPGMPTGRKEAISFPL

SEQ ID NO: 152156 - protein, 275 aa, Glycine max
  Coding DNA Sequence Number=SeqID_60471
MVERPGSTSGPSLGRKGDDYHDGRHLAKGSSIMSPPQVPMLGESEQLGQKGRRGIPMPSLRRPHGSSPRRPLMVPISTRNITRASQLMPGNLPIQYPYSLRCPPPSRGRPPKLRLQPRLIWLAMPTLAPVQRDEELSPEANSRIHPTPNDVRRPLVVPHRQPFGRNNSREDLPTPFPKVDRPNVKTNPLANHGGGAVNTIESDRPCRSKPLKDVATPRRFIFEALQKGGVIPHGGHEEDSCLLHPGELHNMETCLAVEELLQRMIDQGRLEVGDE

SEQ ID NO: 152157 - protein, 111 aa, Glycine max
  Coding DNA Sequence Number=SeqID_60472
  Subcellular localization annotation: CTP_CleavageSite=45; ConfidenceScore=5.45e-01
MNLLPSVVHVSSTIESGAPRIHCLAMFANSPFSTFIRRPMNSLPNAVHVSSTIESGAPRIDCLALFANSPFSNLIRRPMNSLPSAVHVSSVIKHGASEKKEEGVETRVVIT

SEQ ID NO: 152158 - protein, 122 aa, Glycine max
  Coding DNA Sequence Number=SeqID_60473
  Homolog annotation: Hit_ID=A5C7Z4; Match level="QueryCoverage=63%, HitCoverage=28%, E-value=2e-07, Identity=35%"; Hit description =Putative uncharacterized protein
MYKTTITHIGLHCSGHWQMVVILPKENLVVWFCSLHNRPDNYLKGIINSALKGLDDTPQPKSKAGARWIVVKCNRKKGSTECDYYVMHWMSTIFLGSFRNNWETYFNDVRPLEAKRLKAFHI

SEQ ID NO: 152159 - protein, 130 aa, Glycine max
  Coding DNA Sequence Number=SeqID_60474
EPARTLQRTVEWILPTPTPYRLVEPVQVIEVTSSEEDPEEDLEELPPEPAVDALDFLEGDEDPLLEVDSPEEVVSASEADSTEDSGPREMAISGGSSSYGSEDDVRGEESSEEVYPHEEGDLLMVRRLLG

SEQ ID NO: 152160 - protein, 231 aa, Glycine max
  Coding DNA Sequence Number=SeqID_60475
MKDKRDEEEKLEKQKKKKDSKALSSKAKGKEKEEKDSSKKIVKKENHFATKGDIKRALILKQSFYLLLSRETSLTTAIPLRLEFIPQVKELLDEGLVRKSLNPCALLVPKIGIIRHQIPMIGGMMNVLSGETLFCKITHAPNIFMICVHRNSLGSDQGLPMDPKRIKVIPKWPTPPTPLIELVRNYILSWEDDQERGAEERIHEFQEPLDLRSNPFQGGGNDAILPPKGIG

SEQ ID NO: 152161 - protein, 108 aa, Glycine max
  Coding DNA Sequence Number=SeqID_60476
MISRLSQEQFKNQEKFDFKIQEKMNSRFKRRNQEDFTREGTSFVVQVEGTSTWVVVTENKRGYISCGSVLVEGTSTRLFKENKGGCRNVPFCGRARARLAGALSKGGK

SEQ ID NO: 152162 - protein, 57 aa, Glycine max
  Coding DNA Sequence Number=SeqID_60477
MTLVTACYWALSLTDSKMRPFRSLGRKRMTSPGKIANETFSQSQSKDDDISGEVQMM

SEQ ID NO: 152163 - protein, 227 aa, Glycine max
  Coding DNA Sequence Number=SeqID_60478
GHLLKIDADNLNAFLETAVGHPGKILKKDLTTLAQVWSVLSYSNLAPTSHTSDLIVERARLIFGLVSHMDMNIGALISGQMTSTAQSNTSRLGFPALITALCRSRGVVSDSLTFERLSPVINLAYIRKNCWNPKALTISIRGVRRVRARPAELPSTFAAPTPASMSVVAPLGSIPSVEQFKEMVVWSRNQPSLHKEDKGPTAQVPQNMEDEFSEATIPEPFTAGEEA

SEQ ID NO: 152164 - protein, 164 aa, Glycine max
  Coding DNA Sequence Number=SeqID_60479
MTSSKRARTDDIPSSSNLAHPTTAMEPDVQHSHTVIPMLQSLFRGQLMIMYNPQELAHNRPIISMEHFLEKVAWPEAQLPLEKSHELVPPEPTPTRTKPIPAEPQPPVVDPPLSPELEILSPPPAPAPPLIIVSDESSDEAATPPDSPSCNIDDGADFSDWMNC

SEQ ID NO: 152165 - protein, 213 aa, Glycine max
  Coding DNA Sequence Number=SeqID_60480
  Gene Ontology: Mol. function=aspartic-type endopeptidase activity; Cellular component=small subunit processome; Biological process=DNA integration
  Homolog annotation: Hit_ID=A5AUC6; Match level="QueryCoverage=64%, HitCoverage=7%, E-value=2e-20, Identity=47%"; Hit description =Putative uncharacterized protein
MALPKERIGILLRLLGHYYFMPMYMSDIGVLISLLLEPSNVFSLDIPNYKKVTDVTLLFTIVYISADVTFFEEKPYFSPSMVESNTLQEVFPIPYLGPSPSLQESESTVDSTIDIPNNPPLEQTQRSPIVYQPRPRILVVELEGNERPVESCPSPTDNPTMDLPEENLDLLIALRKDTRSTRNPYPIYNFLSYHRLSYLYHSFVSSLSFGFSS

SEQ ID NO: 152166 - protein, 15 aa, Glycine max
  Coding DNA Sequence Number=SeqID_60481
LSSLVTDAWGANIFP

SEQ ID NO: 152167 - protein, 155 aa, Glycine max
  Coding DNA Sequence Number=SeqID_60482
MAPKKLSTKRSRRDVAAEGSNAAPKFDSHCFRSAEHLQRFEAIKGWLFHRVRRVQLGEDEYTDFQEEIARRHWTSLLTPMAKFDPEVVLEFYANAWPIEEGVRDMRSWVRGQWIPFDADTLSQFLGDPLVLEEGQQCEFSQRRNRTDGFDEEAIA

SEQ ID NO: 152168 - protein, 291 aa, Glycine max
  Coding DNA Sequence Number=SeqID_60483
  Pfam annotation: Domain name=Transposase_23; Domain location=62-126; Score=-8.8; E_value=0.011; Accession=PF03017.5; Description =TNP1ENSPM transposase
MTNALKEAIKKELSNKGSQEALQIQPDIQQLGARVSTQGSNAVTNAQASQEHDADAIPLMGLFVQRNDGTQRLVAMGKIMEGDSIIHTVAYADDVVRVSVETVIDPEAEVPYATSEIQYVKQAVNTFVAWPTHLVKAVLDEHPQRIPHNEDAHVPKPANVDADDPLRELMKYSFHIYDKPLEISFDGSFLGIVDASTSIFITYSYVIEIIAGDKSLNISVIQLWLMYMHEWSQIFSQGFIRSECEQYLERWLKESDREVYIGPYFHHVMTKLKKTLSPKTKAVAPKWIEVK

SEQ ID NO: 152169 - protein, 50 aa, Glycine max
  Coding DNA Sequence Number=SeqID_60484
MTKARQKGVRKVNEMKIKGKEGEACHRARPGELGCAFWRNFLEGPSGPAF

SEQ ID NO: 152170 - protein, 120 aa, Glycine max
  Coding DNA Sequence Number=SeqID_60485
  Gene Ontology: Mol. function=structural constituent of ribosome; Cellular component=ribonucleoprotein complex; Biological process =translation
  Homolog annotation: Hit_ID=P21434; Match level="QueryCoverage=98%, HitCoverage=49%, E-value=7e-59, Identity=85%"; Hit description =Chloroplast 50S ribosomal protein L2
  Pfam annotation: Domain name=Ribosomal_L2; Domain location=27-103; Score=146.0; E_value=1e-40; Accession=PF00181.14; Description =Ribosomal Proteins L2, RNA binding domain
MAIHLYKTSTPSTRNGAVDSQHRCGKGRNARGIITAGHRGGGHKRLYRKIDFRRNEKNIYGRIVTIEYDPNRNAYICLIHYGDGEKKYILHPRGAIIGDTIVSGTEVPIKMGNALPLSAV

SEQ ID NO: 152171 - protein, 279 aa, Glycine max
  Coding DNA Sequence Number=SeqID_60486
  Homolog annotation: Hit_ID=A7UQU7; Match level="QueryCoverage=55%, HitCoverage=26%, E-value=2e-20, Identity=36%"; Hit description=IMP dehydrogenase/GMP reductase, putative
MYDQLDEACRTTTRQLAGYLTLFQCWIYEHFPSVHQCVTDDTYQETSPRASRWLTSKAHMKGITGAPYRARCDGLTVTDVSWLPYTEHRGVRAFQEISSFQGQLRWGPMIVAVRPERVVRQFGYIQSIPPPPVSARLSQEQIDDRWMEFADHLLPAGQPCLVPGQVSADYIEWFFRISHPFMTPTQAADQQRDAPAADPEDYIQPPSPQVPVAFDPPPYVDDYEGYEAIAQRLERVLNLRIVTAGTELYDIMQDCLTIARGRPSADGTIRARQRRRTDH

SEQ ID NO: 152172 - protein, 48 aa, Glycine max
  Coding DNA Sequence Number=SeqID_60487
MHMFDQNTCLLPLPNWYYLFLYRSGLTGKRTGSPNVPVFYAEDKNIKH

SEQ ID NO: 152173 - protein, 384 aa, Glycine max
  Coding DNA Sequence Number=SeqID_60488
  Gene Ontology: Mol. function=oxidoreductase activity; Cellular component=cytoplasm; Biological process=metabolic process
  Homolog annotation: Hit_ID=A3XIJ4; Match level="QueryCoverage=99%, HitCoverage=99%, E-value=1e-134, Identity=60%"; Hit description =Putative uncharacterized protein
  Pfam annotation: Domain name=DAO; Domain location=6-381; Score=166.4; E_value=7.3e-47; Accession=PF01266.15; Description=FAD dependent oxidoreductase
MTTKFDLIVVGGGILGTFHAYHALKRNLKVALVEKNAQPQGATVRNFGQVVPSGMDLKWQNFGRESLAIYNELQSQTDLTIRKNGSVYLASSEEELKLINELYDINRKNGYESVLLSKNDCMKKFDGLRSDYCKGGLFFPEELSIDSGEMIVKLHKLLQEKLDLKIYNNTTVIETYEDNNQCVAQTSDGQQLQAAKIIICGGHEFKTLYPNVFNESDLVVTKLQMLQTKAQGIYSLQGNILTGLSIRRYESFQECPSFQEIKALETPDSFEKRYGVHILFKQALDGSIILGDSHEYASAKDSDALGYDLNMEIDEFMISEAKKIIDLPTYEIQRRWFGIYSQCKTKDIFEHNPSPNIHIITGIGGKGMTASGGFSKFNIDKIYA

SEQ ID NO: 152174 - protein, 127 aa, Glycine max
  Coding DNA Sequence Number=SeqID_60489
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPAIVDRERAKGSYSLGPYLFSKLLAEIPLEQHFH

SEQ ID NO: 152175 - protein, 61 aa, Glycine max
  Coding DNA Sequence Number=SeqID_60490
MKGQGSSRCGVSTENNGGLWWLMVVVGDGERAWNVGNGFGRKKGEEMAFFLSYMDYKAQNA

SEQ ID NO: 152176 - protein, 133 aa, Glycine max
  Coding DNA Sequence Number=SeqID_60491
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVPGRRCTMMVFFAPK

SEQ ID NO: 152177 - protein, 73 aa, Glycine max
  Coding DNA Sequence Number=SeqID_60492
  Homolog annotation: Hit_ID=A2ZJK6; Match level="QueryCoverage=67%, HitCoverage=18%, E-value=1e-07, Identity=48%"; Hit description =Putative uncharacterized protein
MAKGKSIDIQSPPPFYKICGKHAKYFKSKAQMCIRQKAPLQVNGWSEISKDDVDEMWRHMKERSLTNKANRSK

SEQ ID NO: 152178 - protein, 127 aa, Glycine max
  Coding DNA Sequence Number=SeqID_60493
MTSRDKIWSFCTLVSSRAVGPDDTRRYLTVIHTLVSSRVAGPDDTRKYLTVIRTLVSSRAGGPDDTQRYLTVIRTLVSSRGGGPDDTRRYLTVIRTLLSSRGGGPDDKQRQNLVILHPCVIQRWRAR

SEQ ID NO: 152179 - protein, 281 aa, Glycine max
  Coding DNA Sequence Number=SeqID_60494
MSPFLVRDFGAQNFKAIQRIHKAWETPLRKDQELRGIRNGIIGCYHEWLKVHIRGLDWLAKLKVVSEESFEAPEEDEEVQALKSEVGKAKLAKEKFKLAATHIQKECVGLREENATTTRALEQETKRARKEEYGRNKFRGALWGSNSELKLRREERDQSRAHSMVLKEELVACSRSKRSLSQRLCETETNMLAIIAKYQEELGLATAHEHRVADEYAQVYAEKKARGRVIDSLHQEETMWMDRFALTLNGSQELPRLLAKAKAMADTYSAPEEIHGLLGYC

SEQ ID NO: 152180 - protein, 25 aa, Glycine max
  Coding DNA Sequence Number=SeqID_60495
MALSFTEAGTGKSEELKYARDIATL

SEQ ID NO: 152181 - protein, 141 aa, Glycine max
  Coding DNA Sequence Number=SeqID_60496
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMKIQRIGETILLQGFPFPQRAKAQLGIL

SEQ ID NO: 152182 - protein, 166 aa, Glycine max
  Coding DNA Sequence Number=SeqID_60497
  Pfam annotation: Domain name=Transposase_23; Domain location=26-94; Score=-11.0; E_value=0.019; Accession=PF03017.5; Description =TNP1ENSPM transposase
AEVGPSGAHVSTKESCVALSGNDPETGDSDKCGLYIEENSSRLVALGRLYEGSTAVHNIPLLHDQVKVGVEEVKDAETLIPVPTDEVMWDATMFGVFNQNFSLYIKHEDLSEIAHGGQCLSISVIQLWISPDNYLKGIINSALKGLDDTLQPKSKAAARWIVVGIL

SEQ ID NO: 152183 - protein, 163 aa, Glycine max
  Coding DNA Sequence Number=SeqID_60498
  Homolog annotation: Hit_ID=UPI00016621D1; Match level="QueryCoverage =87%, HitCoverage=39%, E-value=3e-15, Identity=38%"; Hit description =UPI00016621D1 related cluster
MIGPLDESISCFFIRVDPWVHALAFRGLHVLTFRGLHVLTFRELHVLTFRGLHVLTFRGLHVFTFRGLDVLTFRGLHTLTFGGLYVLPLRGIHALAFKGLHALTFRGLHVLPFRGLPALTFRGLHVLAFKGLYAFAIRGLHGLTFRGLHVLTFRGLHALAFRG

SEQ ID NO: 152184 - protein, 60 aa, Glycine max
  Coding DNA Sequence Number=SeqID_60499
MLNGMPPGLLHDKHTLRSSKLACDTGIWGMVFVDNWVVGKEKGCYWLSNDILGLVGNLAV

SEQ ID NO: 152185 - protein, 183 aa, Glycine max
  Coding DNA Sequence Number=SeqID_60500
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPETLNRMQAWHWPSFYNVVTGKTLALPNLIALQHIPLSPAGVIAKRPAPIALPNSCAA

SEQ ID NO: 152186 - protein, 153 aa, Glycine max
  Coding DNA Sequence Number=SeqID_60501
  Homolog annotation: Hit_ID=UPI0000ECBAF8; Match level="QueryCoverage =26%, HitCoverage=48%, E-value=1e-16, Identity=100%"; Hit description= UPI0000ECBAF8 related cluster
KRKSAQYANRLSPRVGRFINAAGTTGFPTGKRAVSATQLMDEAELVKEIVKCVWMRLNHAHQVNSKGLVGVGKRIVHVESLLQLEAADVRIIGIWGIGGIGMQAWHWPSFYNVVTGKTLALPNLIALQHIPLSPAGVIAKRPAPIALPNSCAA

SEQ ID NO: 152187 - protein, 93 aa, Glycine max
  Coding DNA Sequence Number=SeqID_60502
  Subcellular localization annotation: CTP_CleavageSite=67; ConfidenceScore=5.17e-01
MASSGVYVAMCPRPFHLGFAQTTPRVNDFLLLCPGLLIVMQRKIVTSLISRKNRREKAPFHRLAAERAMPASSTRNASNQPKRDSCTQSKQPG

SEQ ID NO: 152188 - protein, 71 aa, Glycine max
  Coding DNA Sequence Number=SeqID_60503
MMTFKNDFKIESRTLQGSRGNLISRIKNQCVLMQSYPARALGRRLQVDWARDPRECPRVLMSLRVDFEPMG

SEQ ID NO: 152189 - protein, 108 aa, Glycine max
  Coding DNA Sequence Number=SeqID_60504
MEAMKEQMATMMKAMMSMKKIMEANAVAVTATSVVAKLNPTPPSGLNQMNHPTSDMVGKDLGSTSGLHYVQFQNKHAFPPNGLPSNYTPPNVAYTLGEDVNNSISHTH

SEQ ID NO: 152190 - protein, 107 aa, Glycine max
  Coding DNA Sequence Number=SeqID_60505
  Gene Ontology: Mol. function=helicase activity; Biological process =viral genome replication
  Homolog annotation: Hit_ID=Q9C925; Match level="QueryCoverage=97%, HitCoverage=10%, E-value=2e-30, Identity=57%"; Hit description =Putative uncharacterized protein F14G24.23
  Pfam annotation: Domain name=DUF889; Domain location=13-107; Score= -44.1; E_value=1.7e-08; Accession=PF05970.5; Description=Eukaryotic protein of unknown function (DUF889)
MHNDKPFGGKVIVFGGDFCQILPVVPRGSRSDIMHTSLNASYIWDHCQVFKLTKNMRLQNNVVDTSSHDLQQFSDWLLDVGDGKPNDGYGEITIPDEFLIKDFNDPI

SEQ ID NO: 152191 - protein, 231 aa, Glycine max
  Coding DNA Sequence Number=SeqID_60506
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=99%, HitCoverage=43%, E-value=4e-39, Identity=56%"; Hit description=DNA polymerase
MVVNPGIPVSRRERIDTYFSEDYSSRIFPTFEERSCQMLKSFIFRVAAITRQNRSAKTIYFHNLGRFDGIFLLKHLALYHPNYTVTPLMRDNRLYEVAVYSKKRLLFTFRDSLHLLPGKLDDLAKNLCPELGSKGSISYEDEFSMPGGTPVWHTDLEYMTLDNMFGFIEAYVECPKSIKKPFLPYRDNKDGTLIFPTGTFVGVYYSEELKYARDIRLHYNTNLWIPLRGDG

SEQ ID NO: 152192 - protein, 64 aa, Glycine max
  Coding DNA Sequence Number=SeqID_60507
MEKNEETTMEEKLLCSDYHLMEACLWGFYGGWIFELQWGPLMVIFHHGDAPEDKGKEVTGGAIH

SEQ ID NO: 152193 - protein, 52 aa, Glycine max
  Coding DNA Sequence Number=SeqID_60508
MLATGNQLLPSGNRLPESKTLDGPGGKVESMAAKKDGLAKVVANLEVARLKE

SEQ ID NO: 152194 - protein, 253 aa, Glycine max
  Coding DNA Sequence Number=SeqID_60509
MKEFYANLYDPEDKSPKHVRVRGHLIKFDEDTLNTFLMTSIIVEEGESLCAYSRFALLRPDPQELAAKLCIPRRGFKLNVDGQPMMILRKNMTTLAQTWSVLSFSNLIPTSHTSDVTLDRARLIYGIIMKMDMNVGYLISHQISLTAQHDTSKLGFPALTTALCRARRVQSDSRSLESLSPIFNLAYIKKNCWNLDDPTVTFRGPKKARGKRSEAPSTAPSEAPAPFSSTLPPSSSIDILVIPPAPSQIPLPV

SEQ ID NO: 152195 - protein, 88 aa, Glycine max
  Coding DNA Sequence Number=SeqID_60510
APVSLALARPRRARCDSDDKKLKDQSKNKSSESRIIQEFKIRITKNSRTQEESLETRIKIQGSRSQESRSRFKTQDSRMKRRLNQDKY

SEQ ID NO: 152196 - protein, 147 aa, Glycine max
  Coding DNA Sequence Number=SeqID_60511
  Homolog annotation: Hit_ID=Q6WAY4; Match level="QueryCoverage=88%, HitCoverage=23%, E-value=4e-16, Identity=36%"; Hit description =Putative uncharacterized protein
MVEVSTEAIASLAQYYDQPLRCFTFGDFQLSPMVEEFEEILGCPLGGRRPYLFSGFYPSLARISKIVQISVQELDHRKQVENGVVGISRKYLEAKARILASKGEWAPFIDILALLIFGGVLFPNVDELVDLAPIDAFLAYHNHKGSP

SEQ ID NO: 152197 - protein, 170 aa, Glycine max
  Coding DNA Sequence Number=SeqID_60512
DASSTFIAWPRHLVKPITDDSNHNARLPVGRLGEAEVAVEPDPPVEVPWEATQFGLPDVGAKFFITHADLTEIISGDKCLNISILQLWTIFMNNCGRSKVDQSLYGLLEPQSIHNAKDRREQCQEYIQTWVKESQRQLYLGAYLHQKKPDINIKATINRFYSNIQMMVCG

SEQ ID NO: 152198 - protein, 88 aa, Glycine max
  Coding DNA Sequence Number=SeqID_60513
  Homolog annotation: Hit_ID=A9BXK9; Match level="QueryCoverage=78%, HitCoverage=62%, E-value=1e-09, Identity=52%"; Hit description =Putative uncharacterized protein
  Subcellular localization annotation: CTP_CleavageSite=38; ConfidenceScore=5.17e-01
MSKIASPLIRVSALRTLKFAFFTIAISTCYAANSQESSAANKKEVNSTSRAEVMADLALWRRAGVDRYEVLSTSNIFAFGMVRNSRKN

SEQ ID NO: 152199 - protein, 75 aa, Glycine max
  Coding DNA Sequence Number=SeqID_60514
MYGVACQCYDSTSDSPQISASPYQLDFTLYASGSYNAQWNAPGLLHDKHTLRSSRILRKMEVVFVIGSAVDRLCG

SEQ ID NO: 152200 - protein, 174 aa, Glycine max
  Coding DNA Sequence Number=SeqID_60515
  Homolog annotation: Hit_ID=A5BKT6; Match level="QueryCoverage=63%, HitCoverage=14%, E-value=8e-11, Identity=31%"; Hit description =Putative uncharacterized protein
MTSSNPLFPKGNSIHRQPIFNGEAIDLNIWEAIELGPHIPTIRDVSTITTTQKPRDQWTEEDRRKIQYDLKAKNIITSALGIDEYFRVSNYTNAKDMWDTLQLAHEGTTNEHEMELQRLNQNEENEKKKRSIALKASSSIQEENEEEDSDDEEDFSFFVKKFQKFIKKRRIDRR

SEQ ID NO: 152201 - protein, 122 aa, Glycine max
  Coding DNA Sequence Number=SeqID_60516
  Homolog annotation: Hit_ID=UPI00006A17C9; Match level="QueryCoverage =47%, HitCoverage=48%, E-value=8e-07, Identity=43%"; Hit description =UPI00006A17C9 related cluster
ILLSSNVIYVRVVMLVRMIRTRLFAVATVGAPPISGEGAAHGRNRVKGNYCPLKVRTRSTSKVRACSPFKARTCSPLEVRACSPLKARTCSPLKVRACSPLLVRTCSPPKARTCSPHNGEGN

SEQ ID NO: 152202 - protein, 82 aa, Glycine max
  Coding DNA Sequence Number=SeqID_60517
MGKAEEVQEKVKADMETMKEKMATMMKAMMSMKKIMEANAVTIAATSIVAKVNPMPPSGLNQMNHPTLEMVGKDSGSRDGPP

SEQ ID NO: 152203 - protein, 244 aa, Glycine max
  Coding DNA Sequence Number=SeqID_60518
MVPGITGDKPLPNPVASRCHGLLIRSRRLASSMGARLRVEMIEPSPVQLYRLIVAIIADAFRQRANLADTGVVGPEVAQRHFQRAAVDLRHGEAQFVIFTARQRPAQRLFGIGVAAQRLRHRQLVQHDACATVAGLKDMLQIGNQAVGDVDRRAGQIAQRLPLQHPRLRPQMAGDQIIARRRFRHRQTILQDRQPGGAVAQRSGHIDPVADARAAAGQRPTGRDQPLDGKRHAQRPARGIAADQ

SEQ ID NO: 152204 - protein, 225 aa, Glycine max
  Coding DNA Sequence Number=SeqID_60519
  Subcellular localization annotation: CTP_CleavageSite=25; ConfidenceScore=5.03e-01
GGPLGTSTLTFGGLHVLPSRGLHVLAFRGLHVLVLRGLHALTFRGLHVLAFRGLRVLIFSVLHIHTLREFKFPFNRSIPGPPPDPGGGPIMRAQLEEEAIVQPLCILGQDFTRAATKRRVRTNMTTLTQIWMMLLLSNILPNDCNADLPLWKYQLDLSHKTPSGPGEVQQGPRVSSSDYEPFSDYGPLLTVAPSKFIRPPINRAFIKKFCAPRQAQGETPQQPRD

SEQ ID NO: 152205 - protein, 141 aa, Glycine max
  Coding DNA Sequence Number=SeqID_60520
HSGITPNKVANAAELSNDVPKQDPLRELIKTLVDIYDKPVEFVWDLTEFGIPNVNSSLFLTYIDVSEITSGDKWLNIAILQLWTMYMNEWSNGLGYQSVYGFLEPQSIHNAKDRRGQCEEYIEKWLKESQRQLYIGAYLNE

SEQ ID NO: 152206 - protein, 173 aa, Glycine max
  Coding DNA Sequence Number=SeqID_60521
MASRDQVWSFCTHDTRRYLTVIRPPLPFRHSRVRWQAETKFGHSAHMIRGDTLRLSAPLCHSDTVVFDGKQRPSLIPYGYPPPPFAIQTQSCSMASRDQVWSFCTHDTRRYLTVIRPPLPFRHIRVRWQAETKFGHSAHMIRGDTLRLSAPLCYSDAVVFDGQQRPSVVILLT

SEQ ID NO: 152207 - protein, 51 aa, Glycine max
  Coding DNA Sequence Number=SeqID_60522
DVLAAAIGRLEHPECVRAAGAGVTIKQYFGSAPWTSRSASSLPPDELQQLT

SEQ ID NO: 152208 - protein, 125 aa, Glycine max
  Coding DNA Sequence Number=SeqID_60523
  Gene Ontology: Mol. function=S-adenosylmethionine-dependent methyltransferase activity; Biological process=rRNA processing
  Homolog annotation: Hit_ID=Q8XCL9; Match level="QueryCoverage=75%, HitCoverage=62%, E-value=6e-19, Identity=80%"; Hit description =Ribosomal RNA small subunit methyltransferase F (EC 2.1.1.-) (rRNA (cytosine-C(5)-)-methyltransferase rsmF)
MKGREAAAVAAAAQMLLACNGQSIFVYGNAIKKSGCIPQELEALIGRVRFSRIGFVIAETHNKGYRWQHEAEASSMLPVAALFADGEMPERVMDVAAAPGSKTTQIAARMGNHGAILANEFSASR

SEQ ID NO: 152209 - protein, 176 aa, Glycine max
  Coding DNA Sequence Number=SeqID_60524
  Gene Ontology: Mol. function=helicase activity; Biological process =viral genome replication
  Homolog annotation: Hit_ID=Q6AUV2; Match level="QueryCoverage=99%, HitCoverage=11%, E-value=2e-39, Identity=44%"; Hit description =Putative uncharacterized protein OSJNBa0091B22.10
MFHPQTVLDSNDYLIYRRRNDGRTISKNGVIIDNRYIVPYNAKLPRKYQAHINIEWCNQNTSIKYLFKYINKGYDRVTVVVVYDANGALENPITQNDEIKEYVDYRYISPCEATWRIFGFPIHARKPVVERLHFHLPGQHSVLYEDDDDIDDILSKPSISDSKFLAWMNSNKCFSE

SEQ ID NO: 152210 - protein, 190 aa, Glycine max
  Coding DNA Sequence Number=SeqID_60525
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLKNGKNALHVVTAKYNSLIRETCRASCINESANARGEAVCVLGALPLPRSLTRCARSFGCGERYQLTQRRSFAPSWAVCTNPPFRPTVAPYPVTIVLSPT

SEQ ID NO: 152211 - protein, 147 aa, Glycine max
  Coding DNA Sequence Number=SeqID_60526
MAPRKLASKRSRKDKAVEGTSSAPEYDGHCFRSAEHQQRFEAIKGWSFLRERCVQLRDDEYTDFQDEIVRRRWASLFTPMAKFDPDVVLEFYANAWPIEEGVRDMRSWVRGQWIPFDADALSQFLGYPLVLEEGQECEYGQRRNQAD

SEQ ID NO: 152212 - protein, 76 aa, Glycine max
  Coding DNA Sequence Number=SeqID_60527
MAEEHQHRVTLEDYSSSSVPQFFTREAKRWLHSFKGNSLKTWEEVVEKFLKKYFPESKTAEGKASISSFHQFPDES

SEQ ID NO: 152213 - protein, 108 aa, Glycine max
  Coding DNA Sequence Number=SeqID_60528
MASFFFRALKFGSLLLHRYWHPPLTSFVRFFHHPDEGPSARRTFFNACGRGSWILKQKKEFFHGNLWKKGEKVLPRVPAEERSQGSSIGSRGRTLSSASISNCPSNMR

SEQ ID NO: 152214 - protein, 104 aa, Glycine max
  Coding DNA Sequence Number=SeqID_60529
MRAASPAASRVNYKSSPEGLHVLALRGLHVLTIRGLHALTSRGLHVLALRGLHALTLGTSYPHRQRTTRPRLERTTRPHHQRAARPYLQRTTCPCLERATRPHL

SEQ ID NO: 152215 - protein, 270 aa, Glycine max
  Coding DNA Sequence Number=SeqID_60530
  Homolog annotation: Hit_ID=A5B5V0; Match level="QueryCoverage=71%, HitCoverage=42%, E-value=3e-09, Identity=24%"; Hit description =Putative uncharacterized protein
MDFFSDESFECIQAFQNSNLIPFMSLKLPVYSELVKAFYSNLEIQESTLISEVYGIKMVIDQSLFYDLTQLSSKGVPFEGTLDDDWIFDFSVHDACRLVCTNKADMTGRLLAGSLALESQILHYLIVHILLPRSSNLAQVSEEDLIVMWAFHTGRQIDWAHLVQYRMHKALRLNAPLPYPHLVTLFLQHFNIPLDSEPYVPIKRSFLIGACCGCLLWFDGLQTYVGERFDSLERQVDTRFEEMNSRIAKVEEDVTIIRDYFDLPPLPPSV

SEQ ID NO: 152216 - protein, 213 aa, Glycine max
  Coding DNA Sequence Number=SeqID_60531
  Gene Ontology: Mol. function=aspartic-type endopeptidase activity; Cellular component=small subunit processome; Biological process=DNA integration
  Homolog annotation: Hit_ID=A7PG51; Match level="QueryCoverage=76%, HitCoverage=29%, E-value=2e-24, Identity=37%"; Hit description =Chromosome chr6 scaffold_15, whole genome shotgun sequence
SDAVPNDRELNGKAGYQLCAVLWQSVEPDVLEILRSFKTCSSFWKKAQEIFANDIQSLFDATQKVAALKQTSHDMIAHVGKARAAVEELKRFLAAKSLEEVNRKLDKFYMVLILRSLHSDFDHVRDQILAGDQVPSMDSLITRLLRVPQALKEENLAESVETSAMAASRGRGGVAQVAQTEKSEPKFSDTEYQEYLKLKSEKSSSQASSSSVP

SEQ ID NO: 152217 - protein, 235 aa, Glycine max
  Coding DNA Sequence Number=SeqID_60532
  Homolog annotation: Hit_ID=Q2HTA0; Match level="QueryCoverage=76%, HitCoverage=27%, E-value=3e-20, Identity=35%"; Hit description=IMP dehydrogenase/GMP reductase, related
  Pfam annotation: Domain name=DUF1723; Domain location=158-207; Score =55.3; E_value=2.2e-13; Accession=PF08330.1; Description=Protein of unknown function (DUF1723)
MVRTRGLSRALGAGRGRGISEDAHEADVPRRRRPTASARRQRVRLREDITERHEDVPQLHEDMTGAADAVQTEGVATDGSLGSPAADEGFPGGPHDPSILTDFAEHVAHSIWSGQERSDLKLVSHGRKVDKIGRPAPEIEGLIVGTGLSLLIRCSVITTDLGLIAAFVERWHRETNMFHLPVGELTIMLDDVASLLHLPITGTLHTFEPLVTSDAISLLTELLKVSHEEATFETQ

SEQ ID NO: 152218 - protein, 103 aa, Glycine max
  Coding DNA Sequence Number=SeqID_60533
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=98%, E-value=2e-10, Identity=35%"; Hit description =UPI00006A17C9 related cluster
  Subcellular localization annotation: CTP_CleavageSite=91; ConfidenceScore=5.49e-01
VRACSPLKARTYSPLEVRACSPLVVRTCSPFKVRACNPLMVRTCSPLKARTCSPLNGEEVRACSPLMVRTCSPLKVRACSPLMVRTCSPLKARTCSPLNGEGN

SEQ ID NO: 152219 - protein, 319 aa, Glycine max
  Coding DNA Sequence Number=SeqID_60534
  Homolog annotation: Hit_ID=Q84VH5; Match level="QueryCoverage=100%, HitCoverage=51%, E-value=1e-115, Identity=66%"; Hit description =Envelope-like protein
MATSPKETSAPGSPSAPSNQERPEFNIQPIQMIPGQAPGVKISENPSIATSPREVDLEMDKKIRSIVSSILKDASVPDAGEDVPTSSTPNYSLHPVKRIIRGRRSSHRGDPCTKGTRTCTKGTRTAPGDLIDLEEVESDEEPIANRLAPGIAERLQSRKGKTPIKRSGRIKTMAQKKSTPITPTSSRRSKVTIPSKKRKEISSSDSDDDVELDVSTSKKAKKSGKKVPGNVPDAPLDNISFHSIGNVEKWKYVYQRRLAVERELGRDALDCKETMDLIKAAGLLKTVTKLGDCYESLVREFIVNISSDITNRKSDEYQK

SEQ ID NO: 152220 - protein, 245 aa, Glycine max
  Coding DNA Sequence Number=SeqID_60535
ACINNDPALAIRQLGYPMRGAPIEESLSPFLVRDFGTQSFKIIQRVHKAWESPLRKDKELRGIHNGIIGGYHEWLKVHTRGLDWLSKLKIINEENFEALEEDEEVRALKTELGKAILAKEKFKLVATDVRKECAELREENAATARALEQETKRARRDKFRGALSKRNLSQRLCETEANMLSIVSKYEEELNLATTHEHKVANEYAQVYAEKEARGRVINSLHQEATMWMDRFALTLNGSQDFPDC

SEQ ID NO: 152221 - protein, 184 aa, Glycine max
  Coding DNA Sequence Number=SeqID_60536
  Homolog annotation: Hit_ID=Q84VH5; Match level="QueryCoverage=76%, HitCoverage=24%, E-value=2e-58, Identity=72%"; Hit description =Envelope-like protein
KLSVKYAILHRIGAANWVPTNHTSTVATESFAVKLPIAFPTVLCGIMLSQHPNILNYIDSVMKRESPLSLHYKLFEGTHVPDIVSTSGKAAASGAVSKDALIAELKDTCKVLEATIKATTEKKMELERLIKRLSESGIDDGEAAEEEEAAEQEEEEAEEEEEETDDEDAAEDTESDDDDSEATP

SEQ ID NO: 152222 - protein, 67 aa, Glycine max
  Coding DNA Sequence Number=SeqID_60537
  Homolog annotation: Hit_ID=A5BEJ0; Match level="QueryCoverage=64%, HitCoverage=3%, E-value=4e-09, Identity=60%"; Hit description =Putative uncharacterized protein
MFKCKWVDSNIDVRTDDIGFTLVDLKKLGYHNDPFIMAEQARQGKTIGVNEEDNDSYMDTYVSPLTT

SEQ ID NO: 152223 - protein, 118 aa, Glycine max
  Coding DNA Sequence Number=SeqID_60538
MGNFMCLPHGLGDMCMISLGLLALNGYGSGVIDILIGSVRHIGWRIVERQAIWPDGGIGFTLAIVLVAAIGFHYLPHAHRGHHRGHLLFHGLHVGLHLLLYLLYFTHYSRSSTSSVRA

SEQ ID NO: 152224 - protein, 218 aa, Glycine max
  Coding DNA Sequence Number=SeqID_60539
  Subcellular localization annotation: CTP_CleavageSite=41; ConfidenceScore=5.52e-01
MAEPSKKRKGSSSTATAAAHRRHDPSGAPTAPIPPSLSSPRSSTLFSSDDQRLRYLSQFSSRIILDPKYLDVEFFNDETFDCYQVFQNSGLVDFMSLKLPYYPELVKVFYCNLKIQDGIIMYEVHGTSMIIDQSLFFSLTHLPSQGAPFEGTIVDDWKFDYLSHDARRMVCNDQAEMTGRLLAGILLPRSSNLAQASEEDLILMWAFLTGRQIDWAHL

SEQ ID NO: 152225 - protein, 121 aa, Glycine max
  Coding DNA Sequence Number=SeqID_60540
  Pfam annotation: Domain name=G-patch; Domain location=1-42; Score =19.6; E_value=0.00081; Accession=PF01585.14; Description=G-patch domain
MVARIMLRHGYEPGIGLGKDSLGNADVVDIRGNPYNYGLGYEPGKPGRRNAPSRLRADRAWPGHVSQCFTSVGIMFEEEVAAIGEESPQDPQSFMRPCHPDSQVGNWRVISQSEVYIADSM

SEQ ID NO: 152226 - protein, 217 aa, Glycine max
  Coding DNA Sequence Number=SeqID_60541
MGEGADGFDEEAIAQLLSTPGQDFARTATGGGNVLSSDNNSNLPMPKCPLVYAILARMSVHVAQLIADAIYLFAGMPPTRHPLDSDKSNRALGFPALITGLCQSFGVPVTPSKVIRSLITRAFIEKYCMPRQVQDDAPQAADVSLPPHQADPARSLGMERYLQQLVRQQAANHRGQPEELPDAHAGEAPARSPADAEEARMDEEMTDLLGFLGGSGA

SEQ ID NO: 152227 - protein, 107 aa, Glycine max
  Coding DNA Sequence Number=SeqID_60542
MCYDKVLRRLVLLNFVNGETKDISVRKLEVDFQRVKTLSLRVNGLTCLWLTKGADNHKVCPRATGPLGHDSRNETFLRSRSVVADIFGKGADDHIGLYVSTGSLASG

SEQ ID NO: 152228 - protein, 226 aa, Glycine max
  Coding DNA Sequence Number=SeqID_60543
  Gene Ontology: Mol. function=electron carrier activity; Cellular component=integral to membrane; Biological process=cell redox homeostasis
  Homolog annotation: Hit_ID=A6EAN9; Match level="QueryCoverage=99%, HitCoverage=58%, E-value=5e-48, Identity=41%"; Hit description =Thioredoxin family protein
  Pfam annotation: Domain name=AhpC-TSA; Domain location=110-225; Score= 94.6; E_value=3.1e-25; Accession=PF00578.12; Description=AhpCTSA family
  Pfam annotation: Domain name=GSHPx; Domain location=116-186; Score= -27.1; E_value=0.0001; Accession=PF00255.10; Description=Glutathione peroxidase
  Pfam annotation: Domain name=Redoxin; Domain location=109-217; Score =20.4; E_value=0.00013; Accession=PF08534.1; Description=Redoxin
  Pfam annotation: Domain name=Thioredoxin; Domain location=117-217; Score=-32.0; E_value=0.078; Accession=PF00085.11; Description =Thioredoxin
  Pfam module annotation: Pfam domain module=AhpC-TSA::GSHPx::Redoxin::T hioredoxin; Domain location=110-225::116-186::109-217::117-217
MLKPIYDQYEVLNNEYKAKSLADQQDPKYIKSLEDRANAIQQQTIDAKLDYVAKNPKSYMALMAFNSTLPPEFDALKAEKIFATLDPSLQNSILGKDLAKRIALVKKTSEGVEAQDFTQPDVDGKPVKLSDYRGKYVLIDFWASWCAPCRRENPNLVKSYTKYQKQGFEILGVSMDKAADKAKWLKAIQDDGLTWKQVGDLKGWENEAGLMYDVKAIPMNFLVDPN

SEQ ID NO: 152229 - protein, 57 aa, Glycine max
  Coding DNA Sequence Number=SeqID_60544
MVFHLRLVMSFKTKKGKHRLKGAIKEINSRWAHLQEVSTRFKPRLLCKHSMGAKHIE

SEQ ID NO: 152230 - protein, 157 aa, Glycine max
  Coding DNA Sequence Number=SeqID_60545
MVAGNTTIEEPREQWSEEERKLFQYNLKAKNIIKSVLVMDEYFRISNSKTFPNEDLINKVLRCLSREWQPKEHEMELMRLNQHEENDKKKKGIALKASSSTQERSNKEDSIEIDEDDDLSLFVKRFNKFLRVRGNQRKGQKIHPLLQNVMNAINLDI

SEQ ID NO: 152231 - protein, 40 aa, Glycine max
  Coding DNA Sequence Number=SeqID_60546
MFPHGKISIKGGRSLEYEEPQDLRSNPFHDGGDDAILPPK

SEQ ID NO: 152232 - protein, 90 aa, Glycine max
  Coding DNA Sequence Number=SeqID_60547
  Subcellular localization annotation: CTP_CleavageSite=48; ConfidenceScore=5.06e-01
MKDSGIRMSLKTVQWSRQLPQPTLRREGDARAHGCVFHRRKMRGVATNANKRKSSEKSERCGLRTLSVKGSGVVFTHGEGISTPRVRHKG

SEQ ID NO: 152233 - protein, 113 aa, Glycine max
  Coding DNA Sequence Number=SeqID_60548
MRGYLMVTHTFRQPGVLQHALLRARLTGAFSKGGKCAESPPTFICGKRWKNRRKPVKKKIPSSGVVFTFEEGISTSHVDKSGAFAPTYPPSKRKSDLCSSFLRVNQAILFTWK

SEQ ID NO: 152234 - protein, 97 aa, Glycine max
  Coding DNA Sequence Number=SeqID_60549
MVICTLSEDVGIFWWRLFQVSQVIQNYVEAAGPMTHRDKIWSFCTLVSSRGGGPDDTRRYLTVIRTLLSSRGGGPDDTQRQNLVILHPCVIQRRRAR

SEQ ID NO: 152235 - protein, 103 aa, Glycine max
  Coding DNA Sequence Number=SeqID_60550
MGLRIRFDDGGCTNSTRKSIRRAANSMDARIALGFQFVGLRTQWWKIHVWQSIHGAPNKMVEDARKALGNHFMGLRIRFDDGGCTNSARKSIRGAPDSMVEDA

SEQ ID NO: 152236 - protein, 88 aa, Glycine max
  Coding DNA Sequence Number=SeqID_60551
  Homolog annotation: Hit_ID=Q2HW89; Match level="QueryCoverage=31%, HitCoverage=2%, E-value=7e-07, Identity=85%"; Hit description =Integrase, catalytic region; Ribonuclease H
MLNPTKCTFGVKSGRLLGFIISQKGIEVDEWRRKIERRCHFKEKIGLEEAHHHRRPWIRAWRKKEMNEGRGKEEHKILCSKRVLKSEV

SEQ ID NO: 152237 - protein, 128 aa, Glycine max
  Coding DNA Sequence Number=SeqID_60552
MNNMIIVQHTEIKASFKTSTHEVRHVFKVTLIQETTWHGIKLSRYVVGSIPLDTIHMFWRRLSFLGQGLSEPNVTITEEMKAISKRFEELDVCGKVTLKTKLREIVYPDVNSICAPSEKVKTKGAQKK

SEQ ID NO: 152238 - protein, 143 aa, Glycine max
  Coding DNA Sequence Number=SeqID_60553
MSRNFTNWLTMGAKYLEVVKQGSHPNNGWSPDQIRQVAWPKAQLPLVRPNEAASPEPTPIQVNSEPVNPQSPVVNLPSSPELEAVPPSPPLIVIADASSDEAVAPPNSPAAEIADPTISPIGGIADLSDLSSREVVALTDSPV

SEQ ID NO: 152239 - protein, 161 aa, Glycine max
  Coding DNA Sequence Number=SeqID_60554
  Homolog annotation: Hit_ID=B0HC01; Match level="QueryCoverage=21%, HitCoverage=72%, E-value=1e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINETAMTMITNSSSVPMLLLVEILACDTGVCNLCNGGVKFVRDNDRNK

SEQ ID NO: 152240 - protein, 86 aa, Glycine max
  Coding DNA Sequence Number=SeqID_60555
MTDLFGIDFNTPNSASSYLATLQQFDAPHSFGEQGQSSSAATTNIENTNIEQQHHRDVGEPLILERRNPRRNRRPPPYGTGHRLGH

SEQ ID NO: 152241 - protein, 134 aa, Glycine max
  Coding DNA Sequence Number=SeqID_60556
MRGAPTEESLSPLLVRDLGAQSLKVIQRVHKAWRSPLRKDKELRGIRNGVIGDWLSKLKVIDEENFEAPEEDEEVRALKLELGKARLAKEKFKSAATHIRKECTELQEENAATVRALEQETKRARKEEHGREKF

SEQ ID NO: 152242 - protein, 135 aa, Glycine max
  Coding DNA Sequence Number=SeqID_60557
  Homolog annotation: Hit_ID=A3A7P3; Match level="QueryCoverage=59%, HitCoverage=28%, E-value=3e-08, Identity=33%"; Hit description =Putative uncharacterized protein
MVEEDALSLDNIECGVCAEYTDAGVYGRRNSGSNKEAFEMGERRLHLSWTHSERPVMEQYNELLRILGQFTQHDLKMDESIAVSSIIDKLPSSWKDFKHTLKHKKEELTLVQLGSHFMIEESLRAQEIDKVNDKI

SEQ ID NO: 152243 - protein, 109 aa, Glycine max
  Coding DNA Sequence Number=SeqID_60558
MENCTKQSLRIGSKLVGGGRMNENAIHGAPKKGNRMENCTKQITTHGSKLVGGGCMNENAIHGAPKQGKRWRIALSNHYGWLQTRGWRMHERKRNSRGSEKGLENLELH

SEQ ID NO: 152244 - protein, 102 aa, Glycine max
  Coding DNA Sequence Number=SeqID_60559
MEHADLGIPRSCSSACHQTLGTRKETKLPTDQSNICFLDEKQCVYRGRRHFVSKRPFRGNTRSNKDRRKSLKVYQSHTVCGEKVASAQDFGWQSKGEGHFGS

SEQ ID NO: 152245 - protein, 162 aa, Glycine max
  Coding DNA Sequence Number=SeqID_60560
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPHNSGMQAWHWPSFYNVVTGKTLALPNLIALQHIPLSPAGVIAKRPAPIALPNSCAA

SEQ ID NO: 152246 - protein, 30 aa, Glycine max
  Coding DNA Sequence Number=SeqID_60561
MGSPPASTPPPPFPPPTSDDSASTSAMKRT

SEQ ID NO: 152247 - protein, 36 aa, Glycine max
  Coding DNA Sequence Number=SeqID_60562
HLNTRDGLSLCGSDFVKDFTKIVEISRISGLLEYWT

SEQ ID NO: 152248 - protein, 381 aa, Glycine max
  Coding DNA Sequence Number=SeqID_60563
  Gene Ontology: Mol. function=symporter activity; Cellular component =integral to membrane; Biological process=auxin mediated signaling pathway
  Homolog annotation: Hit_ID=A3RID2; Match level="QueryCoverage=94%, HitCoverage=97%, E-value=1e-147, Identity=78%"; Hit description =Auxin influx transport protein
  Pfam annotation: Domain name=Aa_trans; Domain location=51-379; Score =129.4; E_value=1e-35; Accession=PF01490.9; Description=Transmembrane amino acid transporter protein
METMLPQNQAEEAIVTTSLNETESEVGMREEEKELQQQDHSMFNIKSFLWHGGSVWDAWFSCASNQVAQVLLTLPYSFSQLGMLSGILLQIFYGILGSWTAYLISVLYMEYRTRKEKENVSFKNHVIQWFEVLDGLLGPYWKAVGLAFNCTFLLFGSVIQLIACASNIYYINDHLDKRTWTYIFGACCATSVFIPSFHNYRIWSFLGLGMTTYTAWYLAIAALIHGQGDKCCREIMHAMWKPQKFKYIYLLATLYVFTLTIPSAAAVYWAFGDELLNHSNAFSLLPKNRFRDAAVILMLIHQNAAEKPPFFMPSWTAMYVFNAFIVVWVLVVGFGFGGWASMTNFVKQIDTFGLFAKCYQCKPPTPPPMAAAPPPHAHHHH

SEQ ID NO: 152249 - protein, 290 aa, Glycine max
  Coding DNA Sequence Number=SeqID_60564
  Gene Ontology: Mol. function=protein dimerization activity
  Homolog annotation: Hit_ID=A5AX25; Match level="QueryCoverage=99%, HitCoverage=50%, E-value=4e-41, Identity=32%"; Hit description =Putative uncharacterized protein
  Pfam annotation: Domain name=DUF659; Domain location=133-271; Score =40.8; E_value=1.2e-10; Accession=PF04937.6; Description=Protein of unknown function (DUF 659)
SGNIASCKKTPSDVVEELKRYMANKKSGTTYSSIGSGNVPNIRYFEFYEPIGCDESEDEFEDSCNATVLATKTKCETKKGPMDRFCKNPENAINQRKMEMLRQRNIRESMDKNKVLKNMVANIGQCGPHLPIPSYHDIRVSLLKKEVEYTENLMKGHTKHWVKYGCTIMFDSVDGSNFVKTDEKFFELLDAIVEEVGEENIVQVVTNNESNYVLAGKEAVKVVLMPSFWNSVVYTLKVMGPLVKVLRLVDDERKPSMGYIYEAMDKAKEIINKSFNNHESKYKDVFAIID

SEQ ID NO: 152250 - protein, 101 aa, Glycine max
  Coding DNA Sequence Number=SeqID_60565
MDEDDDNDARNDLVFNDDDALNWATVYETLGVGDPRMYTRWKQKAVQENDEDLEFEDIELESKEEEIMINFEEFDGEEGEEDAPLPYDNNEEDYVGIEEDD

SEQ ID NO: 152251 - protein, 72 aa, Glycine max
  Coding DNA Sequence Number=SeqID_60566
  Gene Ontology: Mol. function=heat shock protein binding; Cellular component=integral to membrane
  Homolog annotation: Hit_ID=Q337D7; Match level="QueryCoverage=88%, HitCoverage=11%, E-value=9e-17, Identity=70%"; Hit description =Chaperone protein dnaJ 13, putative, expressed
MKDIATENFQQIYKAYEILSDLNKRQIYDIYSMEGLTSGLELGPKHNGVEEIKAELRGSALREQYKPGVGLL

SEQ ID NO: 152252 - protein, 126 aa, Glycine max
  Coding DNA Sequence Number=SeqID_60567
MTKDYGITKSIVIHNKHQTKEPMIMLEREREKEILEREDLVLENLRGEELDLEVGGDGEAAIEGVGLLELDEQIDGERDLQIWDQKECLKCLNFQSVLKRIHNYQVFSDGNEFWKETSESEIQCMQ

SEQ ID NO: 152253 - protein, 478 aa, Glycine max
  Coding DNA Sequence Number=SeqID_60568
MSVIALQRQVKLASLENSCKLVVQACGNDDFPFLRDSSNSPPFFFMYRCLFEVFGLILPLTAFQCVLLEHLNMASAKLHPNSIAIVRAFEILCPFFNIQPSVLDNFFKVLTTNAMANVHVMYVAFVYATLRTCGSMNRVEGMKSSQFDFNLVKGLVIHLVGNPCALWTFSPDGLRSMFDFPLVESLVNQSRRRLLDLLSFSSMVIRRKVSVTSSRLKVLSCNLVMGCLDLRDSPLMVMRSKYDFHLIEELGKRKGSTRVNLGFVEPWTEDVLALGFVKPDSPRANLGFCKLFGGSTKELSDLGFGRHALACMPLVVGGSTRDIAPTRIALVARERFPGCCEPSFELITIKDGTVASRLFQASGFVLRFLDDSLEVFDLLIVDQLEDFLAPISLTSFRPAMSASYSAWLFKALKLIFRDCSRVELMASSTTKRYMNRGALITIMYSAFQSLSMTQSLSEQRTLSTKKYGQVWIVKAHLA

SEQ ID NO: 152254 - protein, 423 aa, Glycine max
  Coding DNA Sequence Number=SeqID_60569
  Gene Ontology: Mol. function=protein serine/threonine kinase activity; Cellular component=integral to membrane; Biological process=protein amino acid phosphorylation
  Homolog annotation: Hit_ID=A5BC93; Match level="QueryCoverage=43%, HitCoverage=32%, E-value=1e-41, Identity=52%"; Hit description =Putative uncharacterized protein
MVSFSWTEFMVVQNLVPGMFYKVSKGWHKFAGMGVPISGGNDGNRVLEAVKTVIVKMNFNDEDKNCRVGSCGGYLAPEYALLGQLTKKADVYSFGILMLEIISGKSSSIAAFEEDYLVLVEWGGTCIQFRIRGEILATHYSLASILSFGLFWLAWKLKGENRLLDLVDSELSEYDESVVYRFLIVALFCTQSAAQHRPSMKQVLEMLSKEVHLNEKALTEPGIYRWHSTGKKCGSLNETSSSQAINSSRSLGCFRQRLLAKIHGLSVVIIECSTTPWSSDGCGVVRAVGLYCTPKRWAKVKKESMDRGGHTCTTIRGTNVSFNVQGFPVGSRLKVARGGYKRRVKCDFPEYMSRHGWVGMGSEVEMVVVGATEVTVGDCHNPSMWGPTSRVRAEFHEPYGTTIIYVLPDTKYNNTLQRFSLVG

SEQ ID NO: 152255 - protein, 147 aa, Glycine max
  Coding DNA Sequence Number=SeqID_60570
  Gene Ontology: Mol. function=protein serine/threonine kinase activity; Cellular component=integral to membrane; Biological process=protein amino acid phosphorylation
  Homolog annotation: Hit_ID=Q7XB99; Match level="QueryCoverage=50%, HitCoverage=8%, E-value=1e-09, Identity=41%"; Hit description =Transmembrane protein kinase
MKLLCKHYLTSIIVLEGNELTGGALQPMHDLNQGLQLLAEIGNLANLTLIALEGNELTGGVPDALGYFDVSHNALSGTLPVEVSKLRNLGELVLSENNFAGKTDYNRKAIAQQLTKLAKSPPQAGSGCSLVPAWNKGPEKQMEIELW

SEQ ID NO: 152256 - protein, 581 aa, Glycine max
  Coding DNA Sequence Number=SeqID_60571
  Gene Ontology: Mol. function=double-stranded RNA binding; Cellular component=intracellular
  Homolog annotation: Hit_ID=A7PP34; Match level="QueryCoverage=91%, HitCoverage=62%, E-value=1e-162, Identity=56%"; Hit description =Chromosome chr8 scaffold_23, whole genome shotgun sequence
  Pfam annotation: Domain name=dsrm; Domain location=377-440; Score =55.0; E_value=2.5e-13; Accession=PF00035.16; Description=Double -stranded RNA binding motif
MAERDYALEIWRLLDPGAHLIGSKQVLNRVICVKSGSRKSLLNVFQDGVCHPKMAMVIDDRSKVWEDKDQPRVHVVPAFTPYYAPQAETANAVPVLCVARNVACNVRGCFFKEFDESLLQRIAEIFFEDDIGLLPLPPDVSNYLMSEDVPNGNANAPISEGINGAEVERRLSQPDDKFSVDLVTRPMTNSVEFRHETSQPTAEPGLLGPPVKHDGNSVDRDYDMRKGLLGMRHGPDIRGQISAEPPLISRPPNQTSPSLIQPFGGGLVEDDIASRTQTNSWPSASFKESNVIKFDKHQAQQKPFSHSVIGSSPNVLPPQASQVKTEEATSVSDLQRHIAPSKSQLSSEDGISQNHATSNSKDFQNEAGKVNFLPSLSIQVLQEIGRRCNSKVEFKTILSTSKDLQFSVEVLFTGEKIGVGMARTRKDAQQQAAENALRSLAEIISKHGSREKYVAHVEPQCRAVDKDFDKLSLGRDNGFLWDVVNLESSELQPEDGVPRENASEALDAETRSSTPNAINQQMDKRVSSPRSFKKQDLPLVQQLENWPSEFWERHIIVLYAKGFDVICSCNISAVAVVDMLR

SEQ ID NO: 152257 - protein, 94 aa, Glycine max
  Coding DNA Sequence Number=SeqID_60572
MKRAVEEEPVVEKKAPLKMACKTINEEEEPRQRGKESLCSFVFSCHVVWRRKENGFEFRKRGEEEKQMDFVAVLITLLTVIQTFYVVLNYHRPN

SEQ ID NO: 152258 - protein, 219 aa, Glycine max
  Coding DNA Sequence Number=SeqID_60573
  Gene Ontology: Mol. function=serine-type peptidase activity; Cellular component=integral to membrane; Biological process=proteolysis
  Homolog annotation: Hit_ID=A7PP39; Match level="QueryCoverage=72%, HitCoverage=93%, E-value=6e-51, Identity=59%"; Hit description =Chromosome chr8 scaffold_23, whole genome shotgun sequence
  Pfam annotation: Domain name=Peptidase_S24; Domain location=33-115; Score=37.5; E_value=4.7e-08; Accession=PF00717.14; Description =Peptidase family S24
  Subcellular localization annotation: CTP_CleavageSite=16; ConfidenceScore=5.07e-01
MGTSSFLWNCTKKFITAGIVTVTVTDHFVTVIPVRGGSMSPTFNPKAGSHMGDVFDDYVLVEKFCLRNYKFSHGDVVVFRSPLNHKETHVKRIAALPGEWFGTHHNNDVIQIPLGHCWVEGDNTASSLDSNSFGPIPLALIRGRVTHVVWPPQRIGAVKMERIVTYLFVDWVASVNLESLKCWLHSKQGNLKKDAGPNVIPAFSSSCPDVTMMSSNGDY

SEQ ID NO: 152259 - protein, 98 aa, Glycine max
  Coding DNA Sequence Number=SeqID_60574
MEWFFRISHTFMIPTQAGDQSRDALAADPEDYIQPPSPQVPVTFDPPPHVRLERVLNLRIVTAGTKLYDIRQDCLTIARGGPSADGTVRARQRRRTDH

SEQ ID NO: 152260 - protein, 172 aa, Glycine max
  Coding DNA Sequence Number=SeqID_60575
MAYGRSYLQMRCFQENFSTSLAVIFYNGLASIHLAKGSSDCEDFQEECMAHLKTLGIVYTSWHFSQGVVNPLLNSSPSRMTWVIHNFLSDYGGSLEHLLDDSLEVPDLLGTGQLREQVCSGVALPGNVLHFETFKIVNKSSCNVIVLEKHCFLGIVYVGNLSLDKLGVRVAP

SEQ ID NO: 152261 - protein, 70 aa, Glycine max
  Coding DNA Sequence Number=SeqID_60576
MGGGDGRRRREVAGWCGLRQMMNESIDFVHELLNSEEEEVTRAPMLALPKLRGTSNLLRRRRRHREEEAS

SEQ ID NO: 152262 - protein, 165 aa, Glycine max
  Coding DNA Sequence Number=SeqID_60577
MKPWKPRYEAVRTIKKRALRKHGAGGGEAAIELVVHVVGPLDLELVGLNGRVITADYDYMWGPKRARLFGKTGIIKKSKLIKENRTNYGSRIRKTERKTWLSNSKSSSSNKGVSGAGVKDAEEGEIKIRELEGEEFGNDSGAEEGGEGLEEVKVRVKVKERIWRK

SEQ ID NO: 152263 - protein, 161 aa, Glycine max
  Coding DNA Sequence Number=SeqID_60578
  Gene Ontology: Mol. function=protein serine/threonine kinase activity; Cellular component=membrane; Biological process=two -component signal transduction system (phosphorelay)
  Homolog annotation: Hit_ID=A7Q2R5; Match level="QueryCoverage=70%, HitCoverage=84%, E-value=2e-23, Identity=43%"; Hit description =Chromosome chr1 scaffold_46, whole genome shotgun sequence
  Pfam annotation: Domain name=PAS_3; Domain location=46-139; Score =2.9; E_value=0.052; Accession=PF08447.2; Description=PAS fold
  Subcellular localization annotation: CTP_CleavageSite=62; ConfidenceScore=5.23e-01
MWHDDISVIIKELNKDGTRSSNSSNVSSLPSNSFTITDPSIPGHPIVFANPSFLKLTGYSLREVLGWPAAIFSGPLTSQKFVIEIHEIVREEGNAQVILLNYHIDDMPFWMLFCVSPVFSSDGGAVVHFVVVQVPLQKKEGSGVRDFGFGFGPIRALCCST

SEQ ID NO: 152264 - protein, 53 aa, Glycine max
  Coding DNA Sequence Number=SeqID_60579
MRIIFPSVPIGFGSDLVPRPAVGVFPSSGENNRIKVHLSQSEWRTGSDGDSSY

SEQ ID NO: 152265 - protein, 44 aa, Glycine max
  Coding DNA Sequence Number=SeqID_60580
MLGTLRPQFVLFGSSIVQYSYYEGWGATLSHLYARKRMIDIDFD

SEQ ID NO: 152266 - protein, 256 aa, Glycine max
  Coding DNA Sequence Number=SeqID_60581
  Gene Ontology: Mol. function=hydrolase activity, acting on ester bonds; Biological process=lipid metabolic process
  Homolog annotation: Hit_ID=Q9AYM5; Match level="QueryCoverage=99%, HitCoverage=99%, E-value=1e-130, Identity=86%"; Hit description =CPRD49 protein
  Pfam annotation: Domain name=Lipase_GDSL; Domain location=9-201; Score=158.5; E_value=1.9e-44; Accession=PF00657.13; Description=GDSL- like LipaseAcylhydrolase
MVGPMRPKIVLFGSSIVQMSFDNGGWGAILANLYSRKADIILRGYSGWNSRQALDVLDEVFSKDAHVQPSLVIVYFGGNDSVHPHPSGLGPHVPLQEYVANMRKIANHLKSLSDHIRIIFLTSPPINEEQIRKKLSATQSGRTNESCGEYADALMELCDEMNIKAINLWSAIQTRDDWLDVSFTDGVHLSAEGSKVVVKEILKVLREVDWKPSLHWMSMPTEYAEDSPYYPPNPDGTTTINVSYCISRKWLQWDDL

SEQ ID NO: 152267 - protein, 158 aa, Glycine max
  Coding DNA Sequence Number=SeqID_60582
MASRKRKTTTSRPREPYDTTRFIFEGAWERYDQNVHSQSILSERRAILYISEYDEFRWELERRSWHKALTRQPDGHIDVTLVKEFYANLYDPEDKSPRQVRVQRKLIKFDAKSLNTFLETPVVLEPGEHYTTYTRSALEAPKEGPYHFSANLECPILF

SEQ ID NO: 152268 - protein, 57 aa, Glycine max
  Coding DNA Sequence Number=SeqID_60583
MREEYCTQSYPCICKEAVSGFEPMTNKSPRHNFTAAPGLALNDEFLNITCCGSNWIC

SEQ ID NO: 152269 - protein, 60 aa, Glycine max
  Coding DNA Sequence Number=SeqID_60584
MVENLRVITHGNVTEAPWLGFSSRNKIGEELATQLAQASKVASSRSNNLLEEESGRPKWA

SEQ ID NO: 152270 - protein, 278 aa, Glycine max
  Coding DNA Sequence Number=SeqID_60585
LHALTSRGLHVLALRGLPALTLGLHILANRGLHALTFRGPHVLTLRGLHALTLGLHILATRGLHALTSRGLHVLALRGLPALTLEGYTPSPWVLVTLTVERTTRPRLERTTRPRLERTTRPHHQRAACPHLQRTTCPRLERATRPHLGYSLPSPLRGLHVLALRGLHVLTFRGYTGLHVLAIIGLHSLAFERRHVLNFRGLHALAFRGLRVLTFRTSSFLLTVPGPPPDIGGGPTVRAQLEREAITLLLCILGQDFTRAAAKRRVRIMRTNMTTLTQI

SEQ ID NO: 152271 - protein, 214 aa, Glycine max
  Coding DNA Sequence Number=SeqID_60586
  Subcellular localization annotation: CTP_CleavageSite=28; ConfidenceScore=5.03e-01
TLVATPRVFLSWNTHPASLASPSRQRVGCDTRVCGLCSSAYHHTDLCPSMQQPGAIEQPEAYAANIYNRPPQPQQQNQPQHNKYDLSRNRYNPGWRNHPNLRWSSSQQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKNAVPFH

SEQ ID NO: 152272 - protein, 118 aa, Glycine max
  Coding DNA Sequence Number=SeqID_60587
  Subcellular localization annotation: CTP_CleavageSite=46; ConfidenceScore=5.12e-01
MVKVGTSYVPINVSFSPKVGPGLPAVPPVQLLTGWCVTAKAPPDISAGKCSGHAARNHHTRRAYCADTGRVPFPIQAAQLLGRAIGAGLFANTPAGERGICGKAIKLGNARVFPVTTL

SEQ ID NO: 152273 - protein, 60 aa, Glycine max
  Coding DNA Sequence Number=SeqID_60588
MGEGQEVLNVRTKTPFAKRLLLAKHIIVHVLSHEFQALSAQPCLAPLMVAELNHLRQYAR

SEQ ID NO: 152274 - protein, 31 aa, Glycine max
  Coding DNA Sequence Number=SeqID_60589
ELAKCAYRAKRVHLLGMNIHLPDELPVAKRG

SEQ ID NO: 152275 - protein, 114 aa, Glycine max
  Coding DNA Sequence Number=SeqID_60590
DLEAATIPKEEPLSSEASSSFPIAEHSHLDPSEDYIMAEEPRRVTLEDYSSSNIPQFFTSIAEPEVQAQTITYPPSLIQLIQNNLFHGLPNEDPYAHLATYIEICNTIRLAGVP

SEQ ID NO: 152276 - protein, 407 aa, Glycine max
  Coding DNA Sequence Number=SeqID_60591
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=42%, E-value=0.0, Identity=88%"; Hit description=DNA -directed RNA polymerase subunit beta
  Pfam annotation: Domain name=RNA_pol_Rpb2_6; Domain location=1-316; Score=482.0; E_value=7.3e-142; Accession=PF00562.19; Description=RNA polymerase Rpb2, domain 6
  Pfam annotation: Domain name=RNA_pol_Rpb2_7; Domain location=318-395; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-316::318-395
MHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 152277 - protein, 91 aa, Glycine max
  Coding DNA Sequence Number=SeqID_60592
MKTRQRLVPQKPYTGAMRGTVHEPQVNIGADQKFSPIDVFNKKGGGGRPKDFNGLIKHQTTPLPSLQNGQMTKSNRTTLRGSSRRDLQKIG

SEQ ID NO: 152278 - protein, 89 aa, Glycine max
  Coding DNA Sequence Number=SeqID_60593
MQRRSFAGDLIPIDLEINATCRRRNQERIRKFLQDLEAEAIPEEEPQSFEASSSFPIAEHSHLDPSEDYIMAEEPRRVTLEDYSSSNVP

SEQ ID NO: 152279 - protein, 121 aa, Glycine max
  Coding DNA Sequence Number=SeqID_60594
MHALLGSFNSGNWSDSKALDSTGLSCCAITRDWVIFSYQTPIYRNSLPDNRSSLRVRYSVLTVLYYLCDLVYLSVSNIALSLARDLSKLISRLVHCFDSRSLPYSFFTLSARKPHLAMDTR

SEQ ID NO: 152280 - protein, 99 aa, Glycine max
  Coding DNA Sequence Number=SeqID_60595
MRLKLPFGKVIEVSSPREEYEESPSMAISLKGEEYDELQGRQYGHRLKPGMRNSKIVPEIRRKNSRPKQAWILKDELKAFDFGEIVSQQYGSETGLAAI

SEQ ID NO: 152281 - protein, 164 aa, Glycine max
  Coding DNA Sequence Number=SeqID_60596
MSSPSEGYTPSPSKDYTSSPSEDYTSLPLEGCTPSPSEDYRGVRVLTLRGLHVLTFKGLHDLTFRGLHVLTFRGLHALTYRGLHVLTFRGLHALPSKGYTPSPSKDYTSSPSEDYIPCLQRATVCALQRTTCPLPLRVHAFTFKGLHVLALRTTRPHFRDLPPG

SEQ ID NO: 152282 - protein, 31 aa, Glycine max
  Coding DNA Sequence Number=SeqID_60597
MGLKSTLSKVRSENPFPWHLPMKEHGSSPTQ

SEQ ID NO: 152283 - protein, 114 aa, Glycine max
  Coding DNA Sequence Number=SeqID_60598
  Homolog annotation: Hit_ID=A7ZNX4; Match level="QueryCoverage=42%, HitCoverage=71%, E-value=2e-08, Identity=58%"; Hit description =Putative uncharacterized protein
MVSLTCVASAWALAFGRADQRAVVQDTRDGSHRNARLTGDVTNGDHIHHPSKDCSNSQTPPVFSKVAILAVRERGLREEAHTHENAYIRFVNDCDPDRYLDVFFNDIPEARAVN

SEQ ID NO: 152284 - protein, 200 aa, Glycine max
  Coding DNA Sequence Number=SeqID_60599
GWWVYARIVDVENLLCTIARPPPSTTCDGVVPGDMSRGSGDLGDVRRAPGSQQIKGKQDHKARRLVVAGQLLENEVRKLGKPLVIDYQGIVMTAQLIRDRVEMECLEGAWETLEGNTRCRFRGTIRFTATSFVTSSEEDPEEDLEELPPEPAVDALDFLEGDEDPLLEVDSPEEVMSASEADSTEDSGPREMAISGGSSS

SEQ ID NO: 152285 - protein, 75 aa, Glycine max
  Coding DNA Sequence Number=SeqID_60600
MTCKVPYPYGKKTSIVTKFVKFRNVTEKESPKKQIATRPTWAFQDVPPEGGCFWWKQPGSPGRAGWQAPPLFSYK

SEQ ID NO: 152286 - protein, 154 aa, Glycine max
  Coding DNA Sequence Number=SeqID_60601
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MPLAIQVHHAVCDGFHVGRMLNELQQYCDEWQGGAPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152287 - protein, 62 aa, Glycine max
  Coding DNA Sequence Number=SeqID_60602
MDAYPCQDGIHQLTLRQGEVGVMIVGQDVAEQQRHPHLSQGGHVGAHDLHPSPGRGPGKILT

SEQ ID NO: 152288 - protein, 150 aa, Glycine max
  Coding DNA Sequence Number=SeqID_60603
GLHVLALRGLHVLTIIGLHALTSRGLHVLALRRLHALTLGTSYPHRQRTLYTSSPSEGCTPSPREDYITACPRLVGLHALTLGYPQEDYTPSPLERLRVLIFRIAPTKTPSGPEEVQQGPGVSSSGIAPARHPVDPKKSNRVLELSSSNY

SEQ ID NO: 152289 - protein, 246 aa, Glycine max
  Coding DNA Sequence Number=SeqID_60604
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152290 - protein, 50 aa, Glycine max
  Coding DNA Sequence Number=SeqID_60605
MAHDYVGVLDNFKETNIPTDLEQHMHFLSENNASTGDQESSADEINPSLP

SEQ ID NO: 152291 - protein, 116 aa, Glycine max
  Coding DNA Sequence Number=SeqID_60606
  Homolog annotation: Hit_ID=Q2HW90; Match level="QueryCoverage=78%, HitCoverage=18%, E-value=1e-09, Identity=37%"; Hit description =Putative uncharacterized protein
MGTNQIGYQVKIKGLDVTSLKELGRLMGSLQMQAFRKAYGKILDLTIAEVFTEAVVSLTQYYDQPLRCFMFGDFQIVPTVEEFEEILGCPPGGRKPYLFSGFLPSLSKIAAVVRDS

SEQ ID NO: 152292 - protein, 201 aa, Glycine max
  Coding DNA Sequence Number=SeqID_60607
MDVLSFRGLHTLPFREIHVLAFRGLYVLPFRGTTRPRHQRVACLLNLQRTTLSSPSEDYTGLDVLTFKRATHPPLKYYTSSPSEDYRPRHFQRVALILVLIMRGLHALAFRGLHASPLEDYTSSLLENHTSSPSEGCTALAFRGLHVLTFRGLHVLPFQGLHVLAFRGMAILTFRGLHTLTFREILSSPSEDFTSSPSENH

SEQ ID NO: 152293 - protein, 143 aa, Glycine max
  Coding DNA Sequence Number=SeqID_60608
MKEIKREKHVSYNSHDSCKSLSEELSDYYRGRHRSHTKHQSQRREKDRRPQEVNISLPYFHRKDNVEVYLDWEMKRENFHWLSLASKGMPSIDGLLLLGKEEFMRILQQSIGMILRVPLGKGTFPTTMIGNLWTSSKGLDNEV

SEQ ID NO: 152294 - protein, 205 aa, Glycine max
  Coding DNA Sequence Number=SeqID_60609
  Gene Ontology: Mol. function=intramolecular transferase activity, phosphotransferases; Cellular component=plasma membrane; Biological process=carbohydrate metabolic process
  Homolog annotation: Hit_ID=Q0AEK2; Match level="QueryCoverage=100%, HitCoverage=43%, E-value=2e-70, Identity=60%"; Hit description =Phosphomannomutase
  Pfam annotation: Domain name=PGM_PMM_III; Domain location=1-111; Score=97.2; E_value=5.3e-26; Accession=PF02880.7; Description =Phosphoglucomutasephosphomannomutase, alphabetaalpha domain III
  Pfam annotation: Domain name=PGM_PMM_IV; Domain location=116-199; Score=51.2; E_value=3.7e-12; Accession=PF00408.11; Description =Phosphoglucomutasephosphomannomutase
  Pfam module annotation: Pfam domain module=PGM_PMM_III::PGM_PMM_IV; Domain location=1-111::116-199
MLFVEDVLMQQPGSHVVFDVKSTRHLSPWIRKHGGKPVIWKTGHSLMKAKIKETGAAVGGELSGHLFFNDTKAGKPRWFGFDDGLYSAARLLEIVSRSPNASAVLEALPDSVNTPELQIAMQEGEPDAFITTLQHAAQFPDAIEIITVDGLRVEYTDGFGLIRASNTTPVLTLRFEAETASALARIQQAFRQVLGNTRPDLKIPF

SEQ ID NO: 152295 - protein, 86 aa, Glycine max
  Coding DNA Sequence Number=SeqID_60610
MKVKVILWMNALLEPKLLNPRKTMNFWQPSPITSLESPSDSFCGKRLSFEVQKVAVGLSVYPPLSAASACLAQRRIWKSINIKATC

SEQ ID NO: 152296 - protein, 67 aa, Glycine max
  Coding DNA Sequence Number=SeqID_60611
MGIEIHKTQCGPPWVHRMNRKAWFEGRWLPPSSPRRARLLPPEATAFWRNLLEGPSGPGCYLHPHFY

SEQ ID NO: 152297 - protein, 125 aa, Glycine max
  Coding DNA Sequence Number=SeqID_60612
MHKALRLNAPLPFPHLVTLLLQHFNIPLDSEPYVLIKRSFLIGTSVIASFGYQKEHDGSWVKKGARHILDRFDGLQTVVGERFDSLELQVDMRFNEMESRITKVEEDVSYIRSSFDLPPLPPPSS

SEQ ID NO: 152298 - protein, 111 aa, Glycine max
  Coding DNA Sequence Number=SeqID_60613
MGKAEEVQDKMKADMEAMKEQMATMMEAMMSMKKIMEANAIAVAATSAVAKVNPMPPSDLNQMNHPTLVMVGKDLGSMGGPHDVKIQNEHTFPAIWLASQLTPPNVTYTSQ

SEQ ID NO: 152299 - protein, 81 aa, Glycine max
  Coding DNA Sequence Number=SeqID_60614
MYDSTKFPFECKCVHNEMAPRKLASKRSRKDKAAEGTSSAPEYDSHRFRSAKHQQCFEAIKGWSFLRERRVQLRDDEHTDF

SEQ ID NO: 152300 - protein, 92 aa, Glycine max
  Coding DNA Sequence Number=SeqID_60615
MVSKWVFQRKRKNIQWWFQSQKRCKDKLKIPRNKLKITVTSKKTAKVTLGFVLYRNRETNLEDSALIEGFLSVWGFNGEQRRFMMATGGCGW

SEQ ID NO: 152301 - protein, 125 aa, Glycine max
  Coding DNA Sequence Number=SeqID_60616
  Subcellular localization annotation: CTP_CleavageSite=18; ConfidenceScore=5.31e-01
MATPPASPPPPLPPPPVDASTSPSTPPGAERPVVNVNPATGKADGPHKKKLRTYLGIVARDKVDVTYETWKEAEFEILEASDTDKDGVDDIVYEKYDISKEKWAQFCQTRKDPSWEDVRKKAQTI

SEQ ID NO: 152302 - protein, 77 aa, Glycine max
  Coding DNA Sequence Number=SeqID_60617
MGRKILEQVITGSLWKAIAASICHWSHRTQSFERSSLHSHGDRLFHQVGRSGFLYQCHEECGGQIHKEGTDLSIRTP

SEQ ID NO: 152303 - protein, 208 aa, Glycine max
  Coding DNA Sequence Number=SeqID_60618
  Gene Ontology: Mol. function=protein kinase activity; Biological process=protein amino acid phosphorylation
  Homolog annotation: Hit_ID=Q0CHE9; Match level="QueryCoverage=97%, HitCoverage=89%, E-value=4e-74, Identity=65%"; Hit description =Putative uncharacterized protein
MALTLSQSTQNVSKPVNNGILSRYSTLLAVKILKHFRPCHGNVLMLTDKLCVKYGRRVHLSEASTLRFISRHTSIPGPKVLCSFTHHGLTYIVLERIKGDIIGSGWVHQNEESKAKLLSQLAKMVAEMRELQPPADIVVASVDGGPLFDCRVPGRSLHFGPFNTVQDFHRHLRMGMEFDPGLDPQIQDLINQQSKTWPSVFTHGDLSS

SEQ ID NO: 152304 - protein, 88 aa, Glycine max
  Coding DNA Sequence Number=SeqID_60619
MEKEERDETPLQGKKGVKDKCFTQFGVLLSPIALKVVGPLLLDSNSSRYGTNPPFQFPIWQLTSKETKREAITKDQKKNEMKAKPIEF

SEQ ID NO: 152305 - protein, 81 aa, Glycine max
  Coding DNA Sequence Number=SeqID_60620
MEFPHMNATIVLRSEPVIPHPQNLSGHGMSIGMCRNLLFDGGAKRPKQWAKASVSKGENERSHHQFLFEENTRKNQKDKAL

SEQ ID NO: 152306 - protein, 152 aa, Glycine max
  Coding DNA Sequence Number=SeqID_60621
  Subcellular localization annotation: CTP_CleavageSite=78; ConfidenceScore=5.34e-01
MVKVGTSYVPFSPRALGLPVCVPPVGPSPGLHQAYSISVTSGLGKGPRWQVSGNSHALRVTTTPAALMRRYRETRPIAAFKRRNWREGDRRLLRITQGAKGRSVKAIICWVTVPGCFPVTKLVEEKKATASEYVDTTHIGRIVTPPSVCGTL

SEQ ID NO: 152307 - protein, 266 aa, Glycine max
  Coding DNA Sequence Number=SeqID_60622
  Gene Ontology: Mol. function=sequence-specific DNA binding; Cellular component=intracellular; Biological process=regulation of transcription, DNA-dependent
  Homolog annotation: Hit_ID=Q5PCC8; Match level="QueryCoverage=100%, HitCoverage=93%, E-value=6e-65, Identity=52%"; Hit description =Hypothetical araC-family transcriptional regulator
  Pfam annotation: Domain name=HTH_AraC; Domain location=184-228; Score= 15.8; E_value=0.039; Accession=PF00165.14; Description=Bacterial regulatory helix-turn-helix proteins, araC family
MDPLSQLLLLHNPQGSIDKNCVLSGEWQLPHSAGHLCAVRWHTVTGGPVMLDMPVTAGVELTAGSVIFLPQNAAHRIYQRHTQPTQLVCGLLELPASAHAFLTALPEVLMLAPDPTSSDGRWLAAVLPFITQSADALPTAGDAALRSQQIGSLFTLAVRHGLSTHAAHPGLLSVALHPRLGPLITQLCAAPERPWTVEAMAQQVFMSRASFALLFRQLSATTPLAVLTALRLQLAAQRLARETAPLINIALAVGYASESSFHKAFV

SEQ ID NO: 152308 - protein, 189 aa, Glycine max
  Coding DNA Sequence Number=SeqID_60623
MGEVEEIQEKMKADMEAIKEKMATMMEAMMSVKKIMEANAVAIAATSVVAKEVRAAPMMCKFKTSTPSRHMACLQTIHHPMWCTFPMRMSITPLPYPLKASNPKLIMHMSLKPWKETHEIPHHNLDDFEPWLGYTTEGQAVGGIPLRNPLEGPQYHPQLHLLHSTAVKNPHDYGRNGTVGSSRGNAQGH

SEQ ID NO: 152309 - protein, 362 aa, Glycine max
  Coding DNA Sequence Number=SeqID_60624
  Homolog annotation: Hit_ID=Q6WAY6; Match level="QueryCoverage=87%, HitCoverage=57%, E-value=2e-40, Identity=34%"; Hit description =Putative uncharacterized protein
MGTNQTSKRFYQVKVKGLDTTSIKELGRLMEPLQMQAFRKTYEKILDLTIAEVSIEANASLTQYYDQPLRCFTFGDFQLVPTIEEFEEILGCPLGGRKPYLFSGCLPSLSRIATVVKDSARGLDHVKQTRNGIAGLPRKYLEDKARDMASQGDWVPFMDVLALLIFGVVLFPNVDGLVDLAAIDAFLAYHHRKESPVVAVLADLFDIFDRRCEKSSAQIICCLPALCVWLVSHLFQQDARHPCRTINWFPRWKEGKEGVLFSCKGYPNIPLIGTRGCINYNPALAIRQLGYPMRGAPMEESMSPFLVRDFGAQNFKAIQRIHKAWETPLRKDQELRGIRNGIIGGYHECLKVHIRGLDGSPS

SEQ ID NO: 152310 - protein, 139 aa, Glycine max
  Coding DNA Sequence Number=SeqID_60625
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=73%, E-value=1e-24, Identity=67%"; Hit description=LacZ protein
MKHFTDTLISANIIVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152311 - protein, 111 aa, Glycine max
  Coding DNA Sequence Number=SeqID_60626
MHMPNKNANHVVPVTFEGQQPRPIGSAREEPREHAQGDFNPYSPFTTEGPAFNAMPRPNIVGAPQPRPLQPLHFSVGGPPPAVERREKLDLIEKRLRVVKGFGDYPFTDMA

SEQ ID NO: 152312 - protein, 79 aa, Glycine max
  Coding DNA Sequence Number=SeqID_60627
VTGCTICGEAHETGQCIPTEENTQEIHYMGNQQQQGYTQGGFLGFQQGPYNQQGQWRTPWQPVQQRPEWAFKQAHPTRA

SEQ ID NO: 152313 - protein, 153 aa, Glycine max
  Coding DNA Sequence Number=SeqID_60628
  Subcellular localization annotation: CTP_CleavageSite=90; ConfidenceScore=5.50e-01
MWGCLMVSCTFRQPGANDPVDVHRLTSSSAPFVVLTREVRVTLWLPAPFVNQGQTSLLTRRDTRTFRQPGANEPVETQRLTSSSTPFAIQGQRVRCYSRCPETFNPDDARDSSLLGRDDRVQWRREVSWLSNFVAFETLKFVDAFDAFSFLSE

SEQ ID NO: 152314 - protein, 340 aa, Glycine max
  Coding DNA Sequence Number=SeqID_60629
  Gene Ontology: Mol. function=transferase activity, transferring nitrogenous groups; Cellular component=cytosol; Biological process =amino acid biosynthetic process
  Homolog annotation: Hit_ID=A8GC78; Match level="QueryCoverage=71%, HitCoverage=66%, E-value=1e-123, Identity=91%"; Hit description =Histidinol-phosphate aminotransferase
  Pfam annotation: Domain name=Aminotran_1_2; Domain location=1-277; Score=116.9; E_value=6.1e-32; Accession=PF00155.12; Description =Aminotransferase class I and II
RYAAYAGVKKEQVLVSRGADEGIELLIRAFCEPGKDAILFCPPTYGMYAVSAETFGVERRTVAAKEDWQLDLPAIADSMDNVKLIYVCSPNNPTGNLIDPDSLRNLLELAKGKAIVAVDEAYIEFCPQASVAGWLSDYPHLAILRTLSKAFALAGLRCGFTLANEDLIALLLKVIAPYPLSTPVADIASQALSEEGIRTMRQRVTDIAATRSWLQQQLEKCACVEQVFASDSNYLLARFTASRHYLTRPKQTARVVRLPTHHHRHPRRMSTRGGRLVRPARRQPDSPGANVSQKILFIDRDGTLIAEPPEDFQVDRLDKLALEPDVIPSLLALQQAGYQL

SEQ ID NO: 152315 - protein, 129 aa, Glycine max
  Coding DNA Sequence Number=SeqID_60630
LVATDVRKECARLREENAATARALERETKRARKEEHGRDKFRGALWGSNNELKLGREEIDQSRAHSMVLKEELAACLRSKTSLSPHLCETETNMLAIISKYQEELNLTTAHKHKVADEYARVYAEKEAR

SEQ ID NO: 152316 - protein, 73 aa, Glycine max
  Coding DNA Sequence Number=SeqID_60631
IAPARHPVDPKKSNKVLGFPALITGLCHFYGVPVDPSKFIRPLLIGLSSRSTAPSGRRRARHHSSIRMAGSGQ

SEQ ID NO: 152317 - protein, 131 aa, Glycine max
  Coding DNA Sequence Number=SeqID_60632
  Subcellular localization annotation: CTP_CleavageSite=80; ConfidenceScore=5.22e-01
MHVAQLISDAIHYLQGSRPQDTQWTQRSPTRPWGFQLWLRASVSPTGCPSPPTRSCHRDIGKYLLSRSLRPQTSAGRDTTAAWGWPVAGNRRTAATSKAPQLIYKSWSVAYDPWSTSRRLSPKPKDTPSCS

SEQ ID NO: 152318 - protein, 111 aa, Glycine max
  Coding DNA Sequence Number=SeqID_60633
  Subcellular localization annotation: CTP_CleavageSite=18; ConfidenceScore=5.34e-01
MVILRPLSFKSSKSSDKRAETNYGHSAPLSFMSSESSGGRRQIMVIPHTFSPSRGDRVRWRAETNYGHSAPFHPGPIVSDGAQRQIMVILRLVSTKRNKFGSIKMMLVVRC

SEQ ID NO: 152319 - protein, 109 aa, Glycine max
  Coding DNA Sequence Number=SeqID_60634
  Homolog annotation: Hit_ID=A0ST23; Match level="QueryCoverage=22%, HitCoverage=51%, E-value=3e-07, Identity=100%"; Hit description =Putative reverse transcriptase
GKPVVPAALMNRPTRGERRFAYWALAECILGYYVGTDEGVSEVLHVAGEKRLHRKILNRQVRGPAAKPFFPRLLPPDKASQKSDGSNQCWEKPEQDYKDTRRFPPGGSL

SEQ ID NO: 152320 - protein, 79 aa, Glycine max
  Coding DNA Sequence Number=SeqID_60635
ADEEVEVAEADISIDCDNKEAEVREGKDSVGHGGGLAHASLARGDKGDARGGARELGLVDFGWEEEECGVGGGGGARKK

SEQ ID NO: 152321 - protein, 117 aa, Glycine max
  Coding DNA Sequence Number=SeqID_60636
  Homolog annotation: Hit_ID=P93251; Match level="QueryCoverage=41%, HitCoverage=37%, E-value=3e-08, Identity=72%"; Hit description =Putative uncharacterized protein
  Pfam annotation: Domain name=RVT_2; Domain location=11-117; Score= -195.1; E_value=0.092; Accession=PF07727.5; Description=Reverse transcriptase (RNA-dependent DNA pol
MALNKARLVATPRTLQSRMEGIDYEETYAPVARLEAIRMLLANASIMNFKLNIKWMLKVLFYEWLNSRSIHLENLQISLKGIEGARGRMNILGLQIKANNDLQESGKFQEDHPLQHS

SEQ ID NO: 152322 - protein, 169 aa, Glycine max
  Coding DNA Sequence Number=SeqID_60637
  Subcellular localization annotation: CTP_CleavageSite=67; ConfidenceScore=5.28e-01
MGKDRTHKTPSGPGKVQQGPGVSSPGYGPLSVLQGARTPPARSRHHRDCARKTPSGPEEGQQCLGVASSKYGSLSVQGSACCPQQGHQAPYQSSFHLEVLRLQAGAGRNTTAALGWPVAGNRHTATTSRVHLSSSAKRLERCLQHMADQRATKSKAKGKQSTRSVTDKS

SEQ ID NO: 152323 - protein, 64 aa, Glycine max
  Coding DNA Sequence Number=SeqID_60638
MNVLSGASLFCKITRTPNIFMVCVHRDPLGVEGRSPEYEEPRDLRSNPFQGGGNDAILSRKGIG

SEQ ID NO: 152324 - protein, 145 aa, Glycine max
  Coding DNA Sequence Number=SeqID_60639
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=2e-24, Identity=55%"; Hit description =Putative uncharacterized protein
  Subcellular localization annotation: CTP_CleavageSite=39; ConfidenceScore=5.39e-01
MTMITPSSKLTLTKGNKSCKGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152325 - protein, 95 aa, Glycine max
  Coding DNA Sequence Number=SeqID_60640
  Pfam annotation: Domain name=zf-CCHC; Domain location=23-40; Score =23.1; E_value=0.00048; Accession=PF00098.14; Description=Zinc knuckle
MYFLKSVTGNRLPLRFQEDSPTLRCYKCNQLGHIKANFPSKEQWPEKNEKKSHEERRSKKAYIAWDDNDSSDGLEKEIYLLSKDYESDENISQED

SEQ ID NO: 152326 - protein, 108 aa, Glycine max
  Coding DNA Sequence Number=SeqID_60641
MASSSSSNHYDVAFGPLEDDLLWMQKSHISQHIWNGANQRTLKIRRATPLYNHREAPPEEIIPLLQVSGLYPIAVEGNQQGLERFARAWILRFIEGVMFVDKVAKGCQ

SEQ ID NO: 152327 - protein, 148 aa, Glycine max
  Coding DNA Sequence Number=SeqID_60642
IELVDEEEAQIGADRSSATSNKSEIYKEEARNATQKHKPKRVESVNANAEAFAEALEHTKKRDTGHQSVSLENKTGDSTVLKIGDSAKVVIKQDMKGRKHKYGYNNNKREKTEKKRVVDDETGNKHELYEVLRIPSKTKYRCLNQRKM

SEQ ID NO: 152328 - protein, 91 aa, Glycine max
  Coding DNA Sequence Number=SeqID_60643
MSHTSKDVEVLDSWLPPFPDFIQCGWSPSSKYDSVVDIACCVHGSMYQQEFFGRSEQPLSRYQSSLADALSEVCNKTDLVFWTFTSSSVVV

SEQ ID NO: 152329 - protein, 64 aa, Glycine max
  Coding DNA Sequence Number=SeqID_60644
VHCEGCQGMTQDLGAIAEDLERVINLRMVTEGTDLHDIMTRCLRRARGDTANESLRPRQRRRID

SEQ ID NO: 152330 - protein, 126 aa, Glycine max
  Coding DNA Sequence Number=SeqID_60645
  Subcellular localization annotation: CTP_CleavageSite=36; ConfidenceScore=5.44e-01
MHYPPTSLEPRGGLPALFANSPFSTFIRSPMNLLPSAFHASSTHEPGAPRNYFLALFANSPFTTFIRNPMNLLPSAVHASSTNESGAPRIYCLALFANSPFSTFIRSPGNLLPSAVCQFSILKFDP

SEQ ID NO: 152331 - protein, 88 aa, Glycine max
  Coding DNA Sequence Number=SeqID_60646
MNKDGTNSQTNVVKSVEDEDVVFLAINNEVAKTKWVMDFAASKHICIDREMFDTLKTDGEFDHFKLGNGKKMKFGIGSVRMKLHDGVV

SEQ ID NO: 152332 - protein, 103 aa, Glycine max
  Coding DNA Sequence Number=SeqID_60647
  Homolog annotation: Hit_ID=A5ZQM3; Match level="QueryCoverage=63%, HitCoverage=92%, E-value=2e-19, Identity=53%"; Hit description =Putative uncharacterized protein
GKEGLLLGGPEPSVRYHSGRARILTLCQDIRAEGQSQAEGSLTARPTRRAGTKVGLSDPTVPSGRAVAQRIKGWAVRPLKRYVSWVQNVVRQFGPYPVWALEH

SEQ ID NO: 152333 - protein, 173 aa, Glycine max
  Coding DNA Sequence Number=SeqID_60648
MALKKLSTKRSRRDAAAEGSSATPEFDSHHFRSAEHQQHFEAIKGWSFHRERHVQLREDGYTDFQEEIARRHWTSLVTSMAKFDPEIVLEFYANAWPTEEGVRDMRSWVRGQWIPFDANALSQFLGDPLVLEEGQQCEFGQRRNKADGFDEEAIAHLLCTPGQDFARTAAGRR

SEQ ID NO: 152334 - protein, 80 aa, Glycine max
  Coding DNA Sequence Number=SeqID_60649
MAVRLFPAADHPNAAVVFRPAPVWGAVLLDESSISRGPDALAGGLIEARNQSWKPQGPVGLFRVHWGEIGTAVAGQNVAK

SEQ ID NO: 152335 - protein, 37 aa, Glycine max
  Coding DNA Sequence Number=SeqID_60650
MVDLRRRIPKPPTLGEGMLGSMKINNPPQEADTLVRF

SEQ ID NO: 152336 - protein, 112 aa, Glycine max
  Coding DNA Sequence Number=SeqID_60651
MGTTTGEELATQLAQASMVASSRSILLLEEELEGPTFEEVTKTHGLRKIPPFDFRHITEFSRITSNQHDNTKKVIKGFPQTQRIKVILEWPTPPSIREIWGFLDLTNFYKRG

SEQ ID NO: 152337 - protein, 167 aa, Glycine max
  Coding DNA Sequence Number=SeqID_60652
LIADAIYLFAGMAPTRHPLDPDKCNRALGFPALITGLCQSFGVPVAPSKAADVPPPHQAGPAGSFDTEQYLRHLVRQQAANHRAHVQTHDCLYQMSLSLQSQGFTSFPCPTPDQFRAEVAWPGDWPEARAGEAPTEAPVEAPDEADETREDEEMTDLLDFLGGSGAT

SEQ ID NO: 152338 - protein, 129 aa, Glycine max
  Coding DNA Sequence Number=SeqID_60653
  Gene Ontology: Mol. function=tyrosine-based site-specific recombinase activity; Cellular component=cytoplasm; Biological process =transposition, DNA-mediated
  Homolog annotation: Hit_ID=Q329Y7; Match level="QueryCoverage=100%, HitCoverage=43%, E-value=2e-59, Identity=86%"; Hit description =Tyrosine recombinase xerC
  Pfam annotation: Domain name=Phage_integrase; Domain location=1-116; Score=87.7; E_value=3.7e-23; Accession=PF00589.13; Description=Phage integrase family
MGKGSKERRLPIGRNAVAWIEHWLDLRGLFGGDDDALFLSKLGKRISARNVQKRFAEWGIKQGLNSHVHPHKLRHSFATHMLESSGDLRGVQELLGHANLSTTQIYTHLDFQHLASVYDAAHPRAKRGK

SEQ ID NO: 152339 - protein, 203 aa, Glycine max
  Coding DNA Sequence Number=SeqID_60654
  Gene Ontology: Mol. function=phosphoglycolate phosphatase activity; Biological process=metabolic process
  Homolog annotation: Hit_ID=A6TGJ5; Match level="QueryCoverage=97%, HitCoverage=83%, E-value=5e-94, Identity=84%"; Hit description =Putative enzyme with a phophatase-like domain
  Pfam annotation: Domain name=Hydrolase; Domain location=18-179; Score= 27.2; E_value=6.2e-05; Accession=PF00702.17; Description=haloacid dehalogenase-like hydrolase
MQESLTFVRNYHPALSQFDAHALNQLRQTLLSSEPEIYHDVTVWRHRALELGMRNAGLSAAEAKAGADAAMENFAHWRSRVDVPQETHDTLAKLAQKWPLVAITNGNAQPELFGLNDYFRFVLRAGPDGRSKPFADMYHLAAERLDLPLGQILHVGDDLTTDVAGAIRCGMQACWIKPQDASLMKTADSRLLPHIEISVGSSR

SEQ ID NO: 152340 - protein, 113 aa, Glycine max
  Coding DNA Sequence Number=SeqID_60655
VWRLPGTLWIQISPTGPGISLADHRTLPAANHRAHVQTHDCLYQMSLSMQSQGFASFSCPTPDQFRAEVAWPGDWPEAQAGEAPPEAPGGGEEAHEDEEMADLLDFLGGSGDT

SEQ ID NO: 152341 - protein, 149 aa, Glycine max
  Coding DNA Sequence Number=SeqID_60656
  Gene Ontology: Mol. function=cytochrome-c oxidase activity; Cellular component=mitochondrial inner membrane; Biological process=electron transport
  Homolog annotation: Hit_ID=P92514; Match level="QueryCoverage=86%, HitCoverage=56%, E-value=3e-63, Identity=82%"; Hit description =Cytochrome c oxidase subunit 3
  Pfam annotation: Domain name=COX3; Domain location=1-130; Score =137.0; E_value=5.2e-38; Accession=PF00510.9; Description=Cytochrome c oxidase subunit III
IGGIWPPLGIWVLDPREIPFLNTPILLSSGAAVTWAHHAILAGKEKRAVYALVATVSLALVFTGFQGMEYYQAPFTISDSTLFLIICGIRQYLGHLTKEHHVGFEAAAWYWHFVDVVRLFLFVSIYWWGDGSGTQRKEAFKGCALNPIP

SEQ ID NO: 152342 - protein, 322 aa, Glycine max
  Coding DNA Sequence Number=SeqID_60657
  Gene Ontology: Mol. function=RNA-directed DNA polymerase activity; Biological process=regulation of transcription, DNA-dependent
  Homolog annotation: Hit_ID=A7NWH9; Match level="QueryCoverage=43%, HitCoverage=12%, E-value=5e-14, Identity=35%"; Hit description =Chromosome chr5 scaffold_2, whole genome shotgun sequence
MFVSSYFHKAFKIVETDASDIGYGGILKQRVHGQDHNTSRAPQIHYLTTLPVNSYRKVVMPPKASRISLRGGRSTGKGARLALPEPTIKKSSTSSGSSTQAGSSTQKTNLEGSSTQIASIKPEPSTQESPKPATAKQTSADYAWPIETLQALQDMGLTKFPKIIKKSWADIASESDDESESNLQTMIQNASMTKTATNTKGKLPLAKAQTPTTKQTNNYIYKNKLLTVLQMEPKFWDKNPFKATAKAFPPGFHYKPTTILKTRTFYELILVDSNSVSIKHFKDPKDQTLNTHSTIQILKVLQPRHFGSDLNKGMRFSVPFDP

SEQ ID NO: 152343 - protein, 252 aa, Glycine max
  Coding DNA Sequence Number=SeqID_60658
ELSGPCLAKLPMASKKRKSIGARPTAQYDTRWFHLLDAWNRYTDNVLGRNILPERKVDIYHTEFEDFKTELERRNLHKRLTNLADRTIDLALVEDVNLYSSEGPSPKQARVRGHQVKIDADSLNTFLETPEGFILNAEGHPERILRKDLTTLAQSNLAPTSHTSDLTVDRARLIFGLVSCMDMNIGALISGQMTSIAQSNSSRLGFPTLITALCRARGVVSDSLTFERLSLVINLAYIRKNCWNPDDLTVSI

SEQ ID NO: 152344 - protein, 96 aa, Glycine max
  Coding DNA Sequence Number=SeqID_60659
MSVSACYQAFHLTDSKKNVYTDNHSGISVRQRDSNVSFLSYRQQKKVYTDNHSGISARQRDSNVSMTDLVCAEDDVNLRVSTGLSAAIDEGCRRRR

SEQ ID NO: 152345 - protein, 96 aa, Glycine max
  Coding DNA Sequence Number=SeqID_60660
MGKRRKLNIIQNDGQSQAKEQSIESSTEVNQNNNSILEENAQFEEEQHIQEDSHVQSHTSLESASESSTKDKKRTRGYTHMLDVWDLPDGEFILVE

SEQ ID NO: 152346 - protein, 77 aa, Glycine max
  Coding DNA Sequence Number=SeqID_60661
ACSKIDPSNVDCNNTTHPECQSLSVIADHDPVAGLPLTPKKRMSSDEVDDELGSLQIFPAQLSSNKLTRHSHKSQFS

SEQ ID NO: 152347 - protein, 129 aa, Glycine max
  Coding DNA Sequence Number=SeqID_60662
MGGCAILLQSWAWYLMSFIAPRVPRSETTYPLAKRWSGGRLEYRVTLHGDLGQVLNKHIWKFHILSHCTPSPVHQTFGQTGESVSATSHECMTNLFGVDLNTPNSAASYLASLQQFDAPHSFGAQGQSS

SEQ ID NO: 152348 - protein, 57 aa, Glycine max
  Coding DNA Sequence Number=SeqID_60663
MEVKLGRIDGDPVLRGTRIWATWEYVSSVGGGQQGMVGLCAHCGCGKLVVHHRSTAT

SEQ ID NO: 152349 - protein, 70 aa, Glycine max
  Coding DNA Sequence Number=SeqID_60664
MFSRLDFQPFFNVLRSFFIVLQSSTDKNNLTKYFVHKELRRSDFLNTIEEYVGVRETPSSTAKDKKYKKE

SEQ ID NO: 152350 - protein, 108 aa, Glycine max
  Coding DNA Sequence Number=SeqID_60665
MHETSGFSSPRDNIEHRNVVRSPTGNLVPLDLETEATLRRNRAERRRKLLQDRTVASILEEEAQSSDSTSSDSLSSRESAIYLPEASVMADEDQQRVTLEDYSSSSVP

SEQ ID NO: 152351 - protein, 79 aa, Glycine max
  Coding DNA Sequence Number=SeqID_60666
MNIEEIIHVTPFDESNALVKKEYACHIGIFEQVYHGQDSKGKGKGSNEQILQKEAKSNNELPKEWKAPQKIKYPLDSIF

SEQ ID NO: 152352 - protein, 69 aa, Glycine max
  Coding DNA Sequence Number=SeqID_60667
  Homolog annotation: Hit_ID=A0PAV3; Match level="QueryCoverage=55%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSANDGVKRPPPPPIVNDTASIL

SEQ ID NO: 152353 - protein, 127 aa, Glycine max
  Coding DNA Sequence Number=SeqID_60668
MASLTSVILESLLVYFTHAEKHGVEVVSMLIILVCKLSMCHILISSGDHLLLGCDPRLTTSSYLAPIVRQSVKFRDMPEVKRKWGANSNQAHLGLPGSSPKGGAFWRKQPSSHGRAGCQAYPSFSYK

SEQ ID NO: 152354 - protein, 71 aa, Glycine max
  Coding DNA Sequence Number=SeqID_60669
MCTCAIFGSQNALSMHEMAPRKLASKRSRKDKAAEGTSSAPEYDSHRFRSVVHQQRFEAIKGWSFLRERRV

SEQ ID NO: 152355 - protein, 288 aa, Glycine max
  Coding DNA Sequence Number=SeqID_60670
  Gene Ontology: Mol. function=chloramphenicol O-acetyltransferase activity; Biological process=response to antibiotic
  Homolog annotation: Hit_ID=P62577; Match level="QueryCoverage=76%, HitCoverage=100%, E-value=1e-131, Identity=100%"; Hit description =Chloramphenicol acetyltransferase
  Pfam annotation: Domain name=CAT; Domain location=11-214; Score =528.7; E_value=6.6e-156; Accession=PF00302.9; Description =Chloramphenicol acetyltransferase
AKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGAHQNLSFQFSLKPAHDFKTNSSKSNYQWLLPVVLLHVFPVQLGANCLPGTECQAWNETNAAITAE

SEQ ID NO: 152356 - protein, 88 aa, Glycine max
  Coding DNA Sequence Number=SeqID_60671
MVKVGTYYVTINVSFSKKVGPGLHGINRVTRIYIFCEVIFRHSCSSCSATDGVGASHSPFRLRNCWEGQSVRASSLLRQLAKGGCGAR

SEQ ID NO: 152357 - protein, 105 aa, Glycine max
  Coding DNA Sequence Number=SeqID_60672
  Subcellular localization annotation: CTP_CleavageSite=35; ConfidenceScore=5.24e-01
MQGLTQSSAPFVPPGTTKSVTCGNFEVARDSRRPRGAKLVSYTDFRDLCLMTCDHLWSLSDQSWSPVTLVNREETKLVSYTDFRGLLLDDKRPFFGPCKVLGTHH

SEQ ID NO: 152358 - protein, 84 aa, Glycine max
  Coding DNA Sequence Number=SeqID_60673
MAINSWGFRLNGGGCMNGNQFMGLRVRFDAQGNQFVGLRIIFDGGGCMNGNEFMGLRIRFDGGGCTNSARQSTCGAPDSMVEDA

SEQ ID NO: 152359 - protein, 479 aa, Glycine max
  Coding DNA Sequence Number=SeqID_60674
  Gene Ontology: Mol. function=binding; Cellular component =extrachromosomal circular DNA; Biological process=cell adhesion
  Homolog annotation: Hit_ID=A7MMJ3; Match level="QueryCoverage=90%, HitCoverage=91%, E-value=1e-151, Identity=60%"; Hit description =Putative uncharacterized protein
MLPLVLTRKIFAAVAFGAPVLAAVAPAQAFTDNSDVSATPFADPARFQKIADELPALGYQDDTSAFSKKLAGIAKSIGEASQNSDSDTTLGQQAGIWAFNHFRDEVATRVADEGQSLLSPYGQAQIDLNVDMEGNFSGSGASLLTPWADRYNYLTFSQLGVHQTDDGLVGNAGLGQRWVAGSWLLGYNGFVDRLFDSGLQRASLGTEAWSDYLRLSANYYTPLSGWRNRNPFQQQRLARGYDVTTQGYLPFYRQLGVSVSWQQYLGNNVDLFNSGNSYHNPSALTLGVSYTPVPLVTVSASHKTSNEGESQDQLGLRLNYRFGVALSQQLNPDNVAAARSLRGSRYDLVTRSNTPVLEFRQRKTLSVFLATPPWQLNAGESLPLKLQIRSAHPISKVSWQGDTQALSLTPGADPNDPQGWSIIMPAWDASPEANNSYRLSVTLEDSKQNRVTSNWITLQVQPPVMLEQGGENRFDLLAP

SEQ ID NO: 152360 - protein, 66 aa, Glycine max
  Coding DNA Sequence Number=SeqID_60675
  Subcellular localization annotation: CTP_CleavageSite=30; ConfidenceScore=5.06e-01
MAKGCGMTKFCLRMSHDLRVSADNRKVSPQATSSWVMTTKGGVVDKSEALAPTYPPMRNSDLRSSG

SEQ ID NO: 152361 - protein, 54 aa, Glycine max
  Coding DNA Sequence Number=SeqID_60676
MLTSLGKVEVTTLVTAWRLRVPTDSQVTIAKVGAVDKSEAFAPTYPQFVMRNSD

SEQ ID NO: 152362 - protein, 110 aa, Glycine max
  Coding DNA Sequence Number=SeqID_60677
  Subcellular localization annotation: CTP_CleavageSite=49; ConfidenceScore=5.31e-01
MWGANTFPVRKYNSRTFHLKVRRSRLFRFFRHFPQINVGGDSARIPFVQHASRESRVALPPKGRLRQCLPKVFGKFTEAPETIFQKRGGVFRLVASSLSNPTSKMFRKGL

SEQ ID NO: 152363 - protein, 208 aa, Glycine max
  Coding DNA Sequence Number=SeqID_60678
MGEVEEVQEQMESDTEALKEKMATMMEAMMIIKEILEVSVAYRTRAKARVMGKVEEVQEQMKADMEAMKEQMATMMEAMMSMKKIMEANAVTVVATSVVAEVNPMPLSGLNQMNHPTSDMVGKDLGSTGSPYYAQIQNKHAFPPYGLPPNYTTPNVAYIPNEDVNNSTPILIESRQPDHAHVSQPMGETHEMPHHNLADFEPCLGYAT

SEQ ID NO: 152364 - protein, 120 aa, Glycine max
  Coding DNA Sequence Number=SeqID_60679
MSSIVCRDCARKTPSGPEEGQQCLGVASSKYGSLSVQGSACCPQQGHQAPYQSSFHLEVLRLQAGAGRNTTAAWGWPAAGNRRTAITSRVHLSSSTKSRTHLVAHDPGDLTSTPPRKLGR

SEQ ID NO: 152365 - protein, 155 aa, Glycine max
  Coding DNA Sequence Number=SeqID_60680
  Homolog annotation: Hit_ID=UPI00006A2D9E; Match level="QueryCoverage =96%, HitCoverage=81%, E-value=8e-15, Identity=16%"; Hit description =UPI00006A2D9E related cluster
PIALRRLHALTFIGLHVLAFRGLHVLTLRGLHTLAFRGLHALTFRELKVLTFREQHFLAFRGPHALVFRGLHVLAFRGLHALTFRRLHGLAFRGLHMLTIRGLHVLAFRGLHALALGEPHVLAFRGLHALAFRGLHAPTIRELHVLAFRGLHILT

SEQ ID NO: 152366 - protein, 203 aa, Glycine max
  Coding DNA Sequence Number=SeqID_60681
MGSVLIPTVNKPTEGPCRLLKNVRWGISLPLDVVSKKVTNSPDPRIRKLHLCHMHFFMHSSIPPMRYRSFDLHQLLSHFKVLPSQGQKPRYHQHQGIRAVDGTPPNASLPQTYGKILELTIAENCNCGQGFSKRFGQHKTDLERHSGPTTEVPRRQGEGYGQSRRLGPVYGCVSFAYFWGRPLSKRGWFGGPSSNRRFPCLPP

SEQ ID NO: 152367 - protein, 197 aa, Glycine max
  Coding DNA Sequence Number=SeqID_60682
MTCGDKLWSFRTPFAIQIQSCPMARRDKLWSFCALLSSGGGGPDDMRRQIMVILHTPFAIQTQSCPMARRDKLWSFCALLSSGGGGPDDMRRQIMVIPHTLLPFRHSCVRWHAETNYGHYAPFCHPEAADPMTCGDKLWSFCTPFCHSDTFVSNGTQRQIMVILCPSSIAADKPVDTRRFTSSSVLTRSVNRGRQAR

SEQ ID NO: 152368 - protein, 98 aa, Glycine max
  Coding DNA Sequence Number=SeqID_60683
  Homolog annotation: Hit_ID=O52175; Match level="QueryCoverage=83%, HitCoverage=94%, E-value=6e-23, Identity=68%"; Hit description =Salmonella berta plasmid pBERT, complete plasmid sequence
MAYERGGDFLEDARKILNREVRGPRQSRFSIGSTPLTSITKSDAQISGGETRQDYKDTRRIPLAAPSCALLFLPFSLPVSFRCYGRVCLIPRLTLSSG

SEQ ID NO: 152369 - protein, 123 aa, Glycine max; identical to SEQ ID NO: 102630
  Coding DNA Sequence Number=SeqID_60684

SEQ ID NO: 152370 - protein, 125 aa, Glycine max
  Coding DNA Sequence Number=SeqID_60685
MAGYTPTSFTDLDFASKKIEVDLKRGKFNHPAWTNEKTGANKEGEDEGETHAMTAIPPIEFSPIPVSYADLLPYLLDNSMVSITLAKVHQPPFLREYDSNATCACHGEAPGRSIEHCRDLKRKVQ

SEQ ID NO: 152371 - protein, 232 aa, Glycine max
  Coding DNA Sequence Number=SeqID_60686
  Gene Ontology: Mol. function=chloramphenicol O-acetyltransferase activity; Biological process=response to antibiotic
  Homolog annotation: Hit_ID=P62577; Match level="QueryCoverage=75%, HitCoverage=79%, E-value=3e-99, Identity=97%"; Hit description =Chloramphenicol acetyltransferase
  Pfam annotation: Domain name=CAT; Domain location=6-180; Score=344.7; E_value=1.6e-100; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPRFHHGQILYARRQGADAAGDSVVLLHVFPGWTQDDSYRIRRSGRTERGVRAYSPAWSELPTRN

SEQ ID NO: 152372 - protein, 375 aa, Glycine max
  Coding DNA Sequence Number=SeqID_60687
  Gene Ontology: Cellular component=viral envelope
  Homolog annotation: Hit_ID=Q84VH5; Match level="QueryCoverage=84%, HitCoverage=51%, E-value=1e-162, Identity=84%"; Hit description =Envelope-like protein
MAQKKSTPITPTTSRRSKVAIPSKKRKEISSSDSDDDVELDVPDIKRAKTSGKKVPGNVPDAPLDNISFHSIGNVERWKFVYQRRLALERELGRDALDCKEIMDLIKAAGLLKIVTKLGDCYESLVREFIVNIPSDITNRKSDEYQKEITAKQVQHWPKKGKLSAGKLSVKYAILHRIGAANWVPTNHTSTVATGLGKFLYAVGTKSKFNFGNYIFDQTVKHSESFAVKLPIAFPTVLCGIMLSQHPNILNYTDSVMKKESPLSLHYKLFEGTHVPDIVSTSGKAAASGAVTKDTLIAELKDTCKVLEATIKANTEKKMELERLIKRLSESGIDDGEAAEEEEEAAEEEEEAAEAEEDAAEDTDSDDDDDSEATP

SEQ ID NO: 152373 - protein, 128 aa, Glycine max
  Coding DNA Sequence Number=SeqID_60688
  Homolog annotation: Hit_ID=A5ATK3; Match level="QueryCoverage=85%, HitCoverage=30%, E-value=3e-12, Identity=33%"; Hit description =Putative uncharacterized protein
MRPLLGKWGWELATNQNHFWPRIVMSKYGGWNALIHGRNSTAFSKWWKDLKSIFQQQHTNRLFYNLCWKLGNGAKIRFWKDKWREDDLTLQEKYPTLYQVSYQQDSSISLMGILVDNKWEWRMQWRRN

SEQ ID NO: 152374 - protein, 261 aa, Glycine max
  Coding DNA Sequence Number=SeqID_60689
  Homolog annotation: Hit_ID=Q2HW90; Match level="QueryCoverage=70%, HitCoverage=36%, E-value=3e-21, Identity=32%"; Hit description =Putative uncharacterized protein
MVEVSTEAIASLTQYYDQPLRCFTFGDFQLSPMVEEFEEILGCPLGGRKPYLFSGFYPSLARISKIFQILAKELDHQKQVENGVVGIPRKCLEAKARILAGRNEWAPFIDVLALLIFGGVLFSNVDGLVDLAAIDAFLAYHNHKESPVVAMLADLYDTFDRGCEKSSARIVCCALALYVWLVSHLFLQEGRPVYPLQGHRSCVEKGKANWDQLLASMEGRLLIGSLARRKEESGLYLHAKDIQMFPGWEHGVVLIIIPSSP

SEQ ID NO: 152375 - protein, 154 aa, Glycine max
  Coding DNA Sequence Number=SeqID_60690
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=9e-25, Identity=51%"; Hit description =Putative uncharacterized protein
  Subcellular localization annotation: CTP_CleavageSite=48; ConfidenceScore=5.42e-01
MTMITPSSKLTLTKGNKSWYRAPPRGPVGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152376 - protein, 43 aa, Glycine max
  Coding DNA Sequence Number=SeqID_60691
MKGRVNLGLNYWPQYQDAQNEEDLCAQFENGLRLEIQQAVSYM

SEQ ID NO: 152377 - protein, 268 aa, Glycine max
  Coding DNA Sequence Number=SeqID_60692
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNLDYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 152378 - protein, 105 aa, Glycine max
  Coding DNA Sequence Number=SeqID_60693
  Subcellular localization annotation: CTP_CleavageSite=46; ConfidenceScore=5.09e-01
MSLPSAVHVSSTFEFGAMLHDCLSVDLQVQSSILHFFRSPMNVMPSAVHVSSTFEFGAMLHDLPKCGPSSAILHSPPFSEPHECHCLALFMCPPPSSLELCFMIA

SEQ ID NO: 152379 - protein, 269 aa, Glycine max
  Coding DNA Sequence Number=SeqID_60694
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGTTLNARVNSSEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152380 - protein, 139 aa, Glycine max
  Coding DNA Sequence Number=SeqID_60695
PEDISAVNCRCPAVQNHRSRRPERNANSWVPLNIREGQMSGSNQCAGSKLVGGGRMNKNAIHGEAGMKTQFMGLRKRFENGELHEAIITHGSKLVGGGHMNENAIHGCRNLPFGGRATRDSRDACSTKGIRAESPPTFI

SEQ ID NO: 152381 - protein, 70 aa, Glycine max
  Coding DNA Sequence Number=SeqID_60696
MGHFLQHEVPLIELARAYLLVECVLYPSLIQTPMAHGGCRNLPFGGRATRDSRDACSMKGIRAESPPTFI

SEQ ID NO: 152382 - protein, 180 aa, Glycine max
  Coding DNA Sequence Number=SeqID_60697
  Homolog annotation: Hit_ID=Q2HW90; Match level="QueryCoverage=88%, HitCoverage=29%, E-value=2e-19, Identity=37%"; Hit description =Putative uncharacterized protein
MDQVQRQAFPLLVFGILLFPNVDGLVDLVAIDSFLAYHHSKESSTVAVLANAYDMFDQRCEKSSARIVYCTPVLYVWLLSHIFRHESRPVCPLQGHRMCAEKGKPNWEELLVGMVGASVNWFPQWKEGGVGVLCSCEGFLNVPLMGTRGCINYNPILAIRQLGYPMRGAPSKEGIASFIA

SEQ ID NO: 152383 - protein, 151 aa, Glycine max
  Coding DNA Sequence Number=SeqID_60698
  Homolog annotation: Hit_ID=Q6UUU1; Match level="QueryCoverage=39%, HitCoverage=40%, E-value=1e-18, Identity=78%"; Hit description =Putative uncharacterized protein
MAHVYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 152384 - protein, 160 aa, Glycine max
  Coding DNA Sequence Number=SeqID_60699
HPLDPDKSNRALGFPALITGLCQSFGVPVTPSKRQIQGDAPQAADASPPHQAGPAGLFDTEQYLRHLVRQQAANHRAHVQTHDCLYQMSLSLQSQGFTSFPCPTPDQFRAEVAWPRDWPEAQAGEAPAGAPAEAPNEADGAREDEEMTDLLDFLGGSGAT

SEQ ID NO: 152385 - protein, 195 aa, Glycine max
  Coding DNA Sequence Number=SeqID_60700
LKELGRLMGPLQRQAFRKVYGKILDLTAVEVFTEAVVSLAQYYDQPLRCFTFRDFQMQDCSCGQGFGKRVGSYEANSKRRSRPTKSLKVLQRVHKAWRSLLRKDKELRGIRNRIIGGYHEWLRVHTRGLDWLSKLKVMNEENFEAPEEDEEVQALKLELGKERLAKEKFKSAGTSRDVPKIKRKQAYAIRENSVI

SEQ ID NO: 152386 - protein, 143 aa, Glycine max
  Coding DNA Sequence Number=SeqID_60701
MKEKEIITMIVDTLSVFYYEKMEAWENEENKEGGTHAVNVVPTWPNFPPAQQCQHSANISSSHYPPPYQPRTLNHPQRPPLNHPIPNTTLNTNQNTNQGRNFLVKKPVEFTPIPMSYANLLPYLLNNAMVAITPAKVRQPPFF

SEQ ID NO: 152387 - protein, 38 aa, Glycine max
  Coding DNA Sequence Number=SeqID_60702
MWTVTGEDLATQLAQVSKVASSRSNRLLEEESGRPKWT

SEQ ID NO: 152388 - protein, 81 aa, Glycine max
  Coding DNA Sequence Number=SeqID_60703
MDRMRKDNEESLRRIHGSSEALSVRIENIKKRREDKSSNSSHGEDEAYEEDVGGRRNERYRERRNHRRYEGRKREEWIDGV

SEQ ID NO: 152389 - protein, 38 aa, Glycine max
  Coding DNA Sequence Number=SeqID_60704
MWTTTGEMVAAQLAQASSARPGEPGCFLQKQQPSGGTF

SEQ ID NO: 152390 - protein, 143 aa, Glycine max
  Coding DNA Sequence Number=SeqID_60705
  Subcellular localization annotation: CTP_CleavageSite=56; ConfidenceScore=5.37e-01
MATNYQDNMFVHAHFLIFEYDKGVSSATTTFFETNLSNATTLVLSSSSTTSILVSYAMTSASVSNIVSTVAMPLYSNADVIASMRGWRAFLHFNPCPCWGRTFVSRRPSDVAPCGACGPWIFFINGVICFLKFNCSKMEKEER

SEQ ID NO: 152391 - protein, 113 aa, Glycine max
  Coding DNA Sequence Number=SeqID_60706
MSGIRPILFPYKNSRAVLWRYAPPGGKKEEATDISSLSAKVTNITGLSDITRSGRVFAPPGLPMQPTNAKGKAKVTEGQNVKAIPASDEDVPAKEFIEGREGRNKKEVSLEEA

SEQ ID NO: 152392 - protein, 91 aa, Glycine max
  Coding DNA Sequence Number=SeqID_60707
MGCYNGQCLSISVIQLWILHLTETTMRAGNSDVYGFLEPQSIQRSRQSQFDSESYIKSWMQSSKCNVYLGGYLNGGHWQMVVILPKENLVV

SEQ ID NO: 152393 - protein, 206 aa, Glycine max
  Coding DNA Sequence Number=SeqID_60708
VDSRGSPRAGSPRRYLTVIRTLLSSRGGGPDDKQRPKTKFGHSAPMIRGDTLRLSAPFCHPEAAGPMTSRDQVWSFCTHDTRRYLTVIRTLLSSRGGGPDDKQRPKTKFGHSAPMIRGDTLRLSAPFCHPEAAGPMTSRDQVWSFCTHDTRRYLMVIRTLLSSRGGGPDDKQRPKTKFGHSAPMIRGDTLRLFAPFCHPEAAGPMT

SEQ ID NO: 152394 - protein, 61 aa, Glycine max
  Coding DNA Sequence Number=SeqID_60709
  Gene Ontology: Mol. function=nucleic acid binding
  Homolog annotation: Hit_ID=A5AYU6; Match level="QueryCoverage=85%, HitCoverage=9%, E-value=8e-13, Identity=59%"; Hit description =Putative uncharacterized protein
MTKSHENNKEESVRKKWYINSGCSKHMTGDASKFTTISHKKSGHVTYGDNNKGKIIGVGKI

SEQ ID NO: 152395 - protein, 134 aa, Glycine max
  Coding DNA Sequence Number=SeqID_60710
  Homolog annotation: Hit_ID=A5BZK9; Match level="QueryCoverage=86%, HitCoverage=80%, E-value=3e-14, Identity=40%"; Hit description =Putative uncharacterized protein
GDKKDLGEDCAAKQKDWSTRLDDALWAHRTAYKAPIGMSPYRAGEETYEKSKFYKEKTKKFHDSLIAKKDFVVGLKVLLYKFRLKLMSVEIKSESTDKSFKVNGHRLKPFLTNPSLVDVVVEETSLLHPTSLPP

SEQ ID NO: 152396 - protein, 74 aa, Glycine max
  Coding DNA Sequence Number=SeqID_60711
GVISIVLVDCRDLVGNLRILLGCILAFVDFPCLGSSSSMDSFASWKMNDSGMEKEEREETPLQGEDESRGSSPP

SEQ ID NO: 152397 - protein, 85 aa, Glycine max
  Coding DNA Sequence Number=SeqID_60712
  Homolog annotation: Hit_ID=A5AY93; Match level="QueryCoverage=96%, HitCoverage=16%, E-value=1e-07, Identity=36%"; Hit description =Putative uncharacterized protein
MNIEESIHVSFDESNVISPRKDVLDDVSDFLEEIHTHERGSQRKRDESNEDSQDYETPATNDLPKEWKASRNHPLDNIIGDISKG

SEQ ID NO: 152398 - protein, 359 aa, Glycine max
  Coding DNA Sequence Number=SeqID_60713
  Gene Ontology: Mol. function=transcription factor activity; Biological process=regulation of transcription, DNA-dependent
  Homolog annotation: Hit_ID=A6X5Z9; Match level="QueryCoverage=31%, HitCoverage=39%, E-value=3e-56, Identity=99%"; Hit description=RNA polymerase, sigma-24 subunit, ECF subfamily
VDKQRGLELAQAFFNASRSGDMNALGAMLAADVNLQADGGGKRPAFPKPVFGFEEVMKTHEKLAGYFRGNQSTLLRAVFINGLPGIITREADGEIQTTALDIEDGKIVGIYVHVFVPKPVSTFWRHALPDQVAAGACRADADQHGWQHGKARRSEDRDCECDQVGRLVGHEIGRDDRNQNTAGSCFHHRRRALAERAVAQQHIAADPREIGDTCHQNDGCNKTGQGTRGDIPGAGNGEIGQRGHHKADQPRARGRKTFPHARQQNQKHCRKCHVETIRAQVSHHRPEGGTQRGEAQRRIDAFRLATFGIGKAERPAFIAHQKQARKSLALGQMADEGGQSRAHQQMAAVDQKGDRKGIL

SEQ ID NO: 152399 - protein, 156 aa, Glycine max
  Coding DNA Sequence Number=SeqID_60714
  Homolog annotation: Hit_ID=Q6UUU1; Match level="QueryCoverage=38%, HitCoverage=40%, E-value=9e-19, Identity=78%"; Hit description =Putative uncharacterized protein
MQLARQVDGIDKLDVLVTALLQASYLGQRVGSSENLRKTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152400 - protein, 218 aa, Glycine max
  Coding DNA Sequence Number=SeqID_60715
  Gene Ontology: Mol. function=motor activity; Cellular component=cell projection
  Homolog annotation: Hit_ID=UPI00006A2D9E; Match level="QueryCoverage =96%, HitCoverage=91%, E-value=9e-18, Identity=15%"; Hit description =UPI00006A2D9E related cluster
GLHVLAFRGKNALAFRGLHILAFRGLHVLAFRGLHVLAFRGLHALAVRGLHVLAFRGLHVLTFRGLHVLAFRGLHALAFRGLHVLAFGGQHFLAFRGLHALAFGEPHVLAIRGLHVLAFKGLHALAYKRLHVVTFRGLHVLAFRGQHALAFRRLHILAFRGLHVLAFRGLHALAIRGLHVLAFRGLRALAFVGIHALTSEDYTSSPLEGYTPSTSEDY

SEQ ID NO: 152401 - protein, 56 aa, Glycine max
  Coding DNA Sequence Number=SeqID_60716
  Subcellular localization annotation: CTP_CleavageSite=39; ConfidenceScore=5.05e-01
FPVAGSTWTTGLSAPGGLVAKDRSRVALRVRLKVDGVCDATTRGGGGKPGGVAMGL

SEQ ID NO: 152402 - protein, 136 aa, Glycine max
  Coding DNA Sequence Number=SeqID_60717
MEGLVDLAVIDAFLAFHHGKESPVVAILAMYDTFDRGGEKSGARIVCCALALYVWLTVRDDEVKASEESDEVQALKTELERARVVEEKFKSIAIKVYDELRDVNMATAEALERGTKKARKEEHDQSKVLRGFIGQQ

SEQ ID NO: 152403 - protein, 59 aa, Glycine max
  Coding DNA Sequence Number=SeqID_60718
MAYHAPMFPTWESGGMVENLVGLEDCLFYCGHLLFDTIPALANLAVLFRDWDNVGHPLR

SEQ ID NO: 152404 - protein, 103 aa, Glycine max
  Coding DNA Sequence Number=SeqID_60719
MVSSTHEFGAMGSDCLVQFSILNLFSEPHELRFRSCVLHPRVWSNGPKNCVFVHVSSTHEFGAMRSDCLVQLSILNPFSEPHEFAFSFMCPPPTSLEPCVVIA

SEQ ID NO: 152405 - protein, 133 aa, Glycine max
  Coding DNA Sequence Number=SeqID_60720
GGPLGTSTLTLRGLHALVIRGLHVLAFRGLHVLAFRGLDVLTFRGLYYAFAIRGLHDLTFKGLHVLTFRGLDVLALRGLDVLVVRGLDVLAFKGLHIHPCRGLHVLTFRGLHVLAFRGPHTLSFSGLDALTFK

SEQ ID NO: 152406 - protein, 154 aa, Glycine max
  Coding DNA Sequence Number=SeqID_60721
  Homolog annotation: Hit_ID=A5AYU6; Match level="QueryCoverage=65%, HitCoverage=18%, E-value=3e-10, Identity=35%"; Hit description =Putative uncharacterized protein
GTSFVVQVEGTSTWVVVTENKRGYISCGSVQVEGTSTWLFKENKGGYIPCGSLLVKDFTRLKSNLKDRRNKSNLKSFQDHDEDQANLCLMTKSHENNKEESVRKKQYIDSGCSKHITGDVPKFTTISPKKSGHVTYGDNNISKISKKVTSKSSL

SEQ ID NO: 152407 - protein, 111 aa, Glycine max
  Coding DNA Sequence Number=SeqID_60722
RHSGCATVGKAIVRAFSLLRQLRRRMCCKAIKLGIRSPQDERTPSPHPQRDNLALMTEVLFELRGLRTYVGECFDSLDNCFAGMDIRLIQLEEDVGYIRQSFDLPPPPPPS

SEQ ID NO: 152408 - protein, 177 aa, Glycine max
  Coding DNA Sequence Number=SeqID_60723
  Homolog annotation: Hit_ID=A5C995; Match level="QueryCoverage=63%, HitCoverage=7%, E-value=2e-13, Identity=38%"; Hit description =Putative uncharacterized protein
MTRGNPSDLQPFDPEIDWTFHRLVRHHFIPFEHPEHFVTGESVHYVIGDFEHPDFEHYNIEHSDFEHSENMAQPLPRERTLREMAAPDFTYESLCIQYPDEDVPYILKTGLIHLLPKFHGLAGEDPHKHLKEFHIVCSTMKPPDVQEDHIFLKAFPHSLEGVAKDWLYYLAPRSITS

SEQ ID NO: 152409 - protein, 64 aa, Glycine max
  Coding DNA Sequence Number=SeqID_60724
MANNIINNRDSGELTLRTPHAKRHLLHALSELLFALSALTPDHWLYGPAKRVTCVLSPINSMSI

SEQ ID NO: 152410 - protein, 37 aa, Glycine max
  Coding DNA Sequence Number=SeqID_60725
MVNELFDRMTEKGLSFTTANWRCCGSALIISLKPQSQ

SEQ ID NO: 152411 - protein, 110 aa, Glycine max
  Coding DNA Sequence Number=SeqID_60726
  Homolog annotation: Hit_ID=A0PAV3; Match level="QueryCoverage=34%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFWLSNCWEGRSVRASSLLRQLAKGGCAARRLSWVTPGFSQSRRCKTTASEL

SEQ ID NO: 152412 - protein, 89 aa, Glycine max
  Coding DNA Sequence Number=SeqID_60727
MFPSGVANCRNLSFGGRATRDSRNFTDCALTLPFNFQHVTELHGLCYNAFLLASGMSRNFTNWLMMGAKYLEVVKRGSHPNNGWSPERN

SEQ ID NO: 152413 - protein, 148 aa, Glycine max [sequence omitted]

SEQ ID NO: 152414 - protein, 179 aa, Glycine max
  Coding DNA Sequence Number=SeqID_60729
  Pfam annotation: Domain name=zf-CCHC; Domain location=35-52; Score =20.9; E_value=0.0011; Accession=PF00098.14; Description=Zinc knuckle
QGILGVRPSKPKDDKGKTIEKQPLKASMQEKTSSTKCFKCLGRGHITSQCPTKKTMIMRGQDIYSIQDEATSPSSSKSEEAKGEESSEEIYPQEEGQSLMVKEECKETLVSIATSLRLEFIPQVNELLDEGLVRKRLNPCALLVPKIGGVMNVLGGATLFCKITRAPNIFTICVHRDSL

SEQ ID NO: 152415 - protein, 171 aa, Glycine max
  Coding DNA Sequence Number=SeqID_60730
  Homolog annotation: Hit_ID=Q6WAY6; Match level="QueryCoverage=49%, HitCoverage=18%, E-value=1e-07, Identity=41%"; Hit description =Putative uncharacterized protein
WTLAAIDAFLACHHGKEIPVVAILAMHDTFNQRREKSGARIVCCTPALYVWLVSHPFFSKKVGSSIRYKEGRIGILSSCEGFPNVPLMGTRGCINYNPDRELRGSSNGIIGGYHKWLRVRTQGLDWLPNLKTVRDDEVKASEESDEVQALKAELERARVVEEKFKSIAIKV

SEQ ID NO: 152416 - protein, 176 aa, Glycine max
  Coding DNA Sequence Number=SeqID_60731
  Gene Ontology: Biological process=transposition, DNA-mediated
  Homolog annotation: Hit_ID=Q1J7G7; Match level="QueryCoverage=23%, HitCoverage=71%, E-value=7e-12, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLAKPFANQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 152417 - protein, 239 aa, Glycine max
  Coding DNA Sequence Number=SeqID_60732
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSINPYFIFFLSFITHQEAEGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152418 - protein, 149 aa, Glycine max
  Coding DNA Sequence Number=SeqID_60733
  Gene Ontology: Mol. function=transcription repressor activity; Biological process=regulation of transcription, DNA-dependent
  Homolog annotation: Hit_ID=Q57SE9; Match level="QueryCoverage=100%, HitCoverage=100%, E-value=8e-76, Identity=94%"; Hit description =Transcriptional repressor nrdR
  Pfam annotation: Domain name=ATP-cone; Domain location=49-139; Score =120.7; E_value=4.2e-33; Accession=PF03477.7; Description=ATP cone domain
MHCPFCFAVDTKVIDSRLVGEGSSVRRRRQCLVCNERFTTFEVAELVMPRVVKSNDVREPFNEDKLRSGMLKALEKRPVSADDVEMAVNHIKTHLRGTGEREVASKMIGNLVMEQLKKLDKVAYIRFASVYRSFEDIKEFGEEIARLQD

SEQ ID NO: 152419 - protein, 75 aa, Glycine max
  Coding DNA Sequence Number=SeqID_60734
MRKGPLKEGGTEAIDSVGTRRTCLKIYFILDTKNEVTLSKNGNRNEEKEGILKKAQPNSGAKRESGAKRATKCRR

SEQ ID NO: 152420 - protein, 182 aa, Glycine max
  Coding DNA Sequence Number=SeqID_60735
  Homolog annotation: Hit_ID=A5B0A4; Match level="QueryCoverage=76%, HitCoverage=9%, E-value=4e-16, Identity=31%"; Hit description =Putative uncharacterized protein
MGRWIWAFASGQQQLWVRVLISKYGGWPEFQYDTDKRGFSHWWRDLRKIFHQSDHNIFKHQLTWKVGCGETIKFWTDKWLGEDYTLGQKYNKLFLISRQQNSLISNMGDFNHDSWEWNLRWRRNLFDHESDLAALPIYLLSFFKIPKKVVHKVITTAVEFKLNLDKYLMKRPATLSQLTSQN

SEQ ID NO: 152421 - protein, 122 aa, Glycine max
  Coding DNA Sequence Number=SeqID_60736
SFGVPVTPSKVIRPPITRAFIEKYCTQRQAQGDAPQAADAPPPHQAGPAESFDTEQYLRHLVPCPTPDLFRAKVAWPGDWPEARAREVPAEAPAEATDEADEAREDEEMTDLLDFLGGSGAT

SEQ ID NO: 152422 - protein, 147 aa, Glycine max
  Coding DNA Sequence Number=SeqID_60737
MVGYAPSSFADLVFTGERIETGLKRGKFDNPALTNEKTGANEEGENEGETHAVTTIPIRPSFPPTQQCHYSANNNPSPYPSPSYPQRPSLNQPQSPPTTQPMLNTTFSTNQNTNQEINFAAKKPVGFTPKFWCHMLTCSHIYLIMQW

SEQ ID NO: 152423 - protein, 287 aa, Glycine max
  Coding DNA Sequence Number=SeqID_60738
  Homolog annotation: Hit_ID=Q6WAY6; Match level="QueryCoverage=76%, HitCoverage=35%, E-value=5e-28, Identity=36%"; Hit description =Putative uncharacterized protein
MGTNQTGKRFYQVKVKSLDTTSIKELGRLMEPLQMQAFRKTYGKILELTIAEDSARGLDRIKQTRNGIAGLPRRYLEDKARGMANQGDWVPFMDVLALLIFGVVLFPIIDGLVDLAAIDAFLAYHHSKESPVVAVLADLFDTFDRRCKKSSARIICCLPALCVWLVSHLFQQDTRHPCPLQSHRSCTEKRRIDWDQLLAEVGGRTINWFPRWKEGKEGVLFSCGGYPNIPLIGTRGCINYNPALAIRQLGYPMRGAPMEESMSPFLVRNFGVQNFKAIQRIHKAWET

SEQ ID NO: 152424 - protein, 65 aa, Glycine max
  Coding DNA Sequence Number=SeqID_60739
MMPNFYMLGSRVENWIFRYVYGTCDAILPRKGPITRTMSKRLQEDWARAAEEGPRVLMNLRDSIL

SEQ ID NO: 152425 - protein, 122 aa, Glycine max
  Coding DNA Sequence Number=SeqID_60740
SSEPLGCARNSPPPIGDQPGSPKVFPTRYLAPFVAQYVKFRNMPEIKRKHCYTIREIPPTWAFQDVPPEGGCFWRKQPGSPGRAGKSKPRHFRNISVGDFAKIFNRSSSFVFHSSSFFDLQP

SEQ ID NO: 152426 - protein, 49 aa, Glycine max
  Coding DNA Sequence Number=SeqID_60741
MQEQLEGLGSSSSMDPFASWKMNGSRMEKEEREETPLQGEDESRRSSPP

SEQ ID NO: 152427 - protein, 311 aa, Glycine max
  Coding DNA Sequence Number=SeqID_60742
  Gene Ontology: Mol. function=magnesium ion binding; Cellular component=cytoplasm; Biological process=Mo-molybdopterin cofactor biosynthetic process
  Homolog annotation: Hit_ID=A6T6S5; Match level="QueryCoverage=100%, HitCoverage=75%, E-value=1e-140, Identity=80%"; Hit description =Molybdopterin biosynthesis protein
  Pfam annotation: Domain name=MoCF_biosynth; Domain location=181-311; Score=147.9; E_value=2.7e-41; Accession=PF00994.15; Description =Probable molybdopterin binding domain
  Pfam annotation: Domain name=MoeA_N; Domain location=7-168; Score =284.7; E_value=1.9e-82; Accession=PF03453.8; Description=MoeA N -terminal region (domain I and II)
  Pfam module annotation: Pfam domain module=MoCF_biosynth::MoeA_N; Domain location=181-311::7-168
MDFTAGLMSLETALTQMLDRVSPLHDVETLPLVRCFGRIAARDIVSPLNVPGFDNSAMDGYAVRLADLRAGQALPVAGKAFAGQPFNGEWPARTCVRIMTGAPVPEGCDAVVMQEETEQSDAGVRFIAPVKAGQNIRRRGEDIANGAVVFPAGTRLTVAELPVLASLGIADVEVVRKVRVAVFSTGDELQLPGQPLGDGQIYDTNRLAVHLMLEQLGCEVINLGIIPDDPAKLRDAFIAADQQADVVISSGGVSVGEADYTKTILEELGEIGFWKLAIKPGKPFAFGKLSNSWFCGLPGNPVSATLTFYQL

SEQ ID NO: 152428 - protein, 143 aa, Glycine max
  Coding DNA Sequence Number=SeqID_60743
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=75%, E-value=9e-25, Identity=66%"; Hit description=LacZ protein
MKGEIPRELNNMEALTELLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152429 - protein, 97 aa, Glycine max
  Coding DNA Sequence Number=SeqID_60744
VDSRGSPIPELFLRPYQVRWDATVFGVVNPDFPLYIKHEDFSEIAHGGQCLSISVLQLWILHLTETCMRAGNSDIYGFLEPQSIQKIQMMKKTSHSL

SEQ ID NO: 152430 - protein, 303 aa, Glycine max
  Coding DNA Sequence Number=SeqID_60745
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPGSGGGGAPGGPPGPAGAGRLLVRGLRHHACRGRLVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152431 - protein, 261 aa, Glycine max
  Coding DNA Sequence Number=SeqID_60746
KVEIHHTELDEFKAEVERRNFHKCLTNLVDGSIDLALVKDFYANLYSFEDYPPKKSRVRGHLVKIDVGSINTFFETPVVLAEGETLPAYSRYYRLPTNYREIEGHPGKILKKDLTTLARVWSVLSYYNLAATSHTSDLTVDRARLIFGLVSCMDMNIGALISGQMTSIPQSNTSRLGFPALITALCRARGVVSDSLTFERLRLVINLSYIRKNYWNPEDLTISIRGVMRARARLAELPSTSAAQTPTSTSAAPSVPAQTDS

SEQ ID NO: 152432 - protein, 79 aa, Glycine max
  Coding DNA Sequence Number=SeqID_60747
MTEARQKGVRKVNETRINVHKTNEDHHGMLRNLTNRATMLPFEFRHVTELHELPNNGCQVPQNGQMKVACHQAKVPGRN

SEQ ID NO: 152433 - protein, 121 aa, Glycine max
  Coding DNA Sequence Number=SeqID_60748
  Gene Ontology: Mol. function=chitin binding; Cellular component =extracellular region; Biological process=chitin metabolic process
  Homolog annotation: Hit_ID=UPI000069F178; Match level="QueryCoverage =98%, HitCoverage=49%, E-value=5e-10, Identity=33%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=22; ConfidenceScore=5.12e-01
MARTCSPLKVRTCSPLNVRTCSPTKVKAHDPLTARTCSPLKLKVHDPLKARTRSPLKVKARTYSPLEVRACSPLVVRTCSPLKARTCSPLTVRVRACSPLMVRTCSPLKARTCSPLNGEGN

SEQ ID NO: 152434 - protein, 103 aa, Glycine max
  Coding DNA Sequence Number=SeqID_60749
PGKMTHRGLKKKHDRMTPIEHFPIAVSDEDMTKSKGKDPLEGLGGPMTRARARKAKEALQQVLSILFEYKPKFQGEKSKVGPIGNLGISLLGDQMVADLLAVG

SEQ ID NO: 152435 - protein, 117 aa, Glycine max
  Coding DNA Sequence Number=SeqID_60750
  Pfam annotation: Domain name=Transposase_23; Domain location=37-106; Score=-9.6; E_value=0.013; Accession=PF03017.5; Description =TNP1ENSPM transposase
MQSQGLALPPEPLVGPSGPRVSTKESCVDPSGNDPETGDSERCGLYIEANPTHLVALGKVYEGSTVVHNTPLLHVQVKVGVEEVKDPNAPVPVPTDEVSLMGCVSGKTTSKAGSGGR

SEQ ID NO: 152436 - protein, 109 aa, Glycine max
  Coding DNA Sequence Number=SeqID_60751
KIGGEACHPARPSEQGCFLQKQQPSGGIFWRAVASGGIFWRAQVGLVALEKQIVVKDATEKKKEEVTDVTSQESEKPIMVEEKEINDQEKEIEVEKEKENEEKEKVEKK

SEQ ID NO: 152437 - protein, 346 aa, Glycine max
  Coding DNA Sequence Number=SeqID_60752
  Gene Ontology: Mol. function=motor activity; Cellular component=cell projection
  Homolog annotation: Hit_ID=UPI00016621D1; Match level="QueryCoverage =98%, HitCoverage=42%, E-value=5e-19, Identity=32%"; Hit description =UPI00016621D1 related cluster
GGPLGTSTLTLRGLHILALRGLHTLAVRGLYVLTSRGIHVLAFRGLHILAFRGLHVLTFRGLHALAFRGLHALTIIGLHVLTFRGLHVLAIRGLYVLTSRGLHVLAFRGLYVLAFRGLHVLTFRGLHTLTFRGLHILTIRGLYVLTFRGPHVLTLVGYTGLHALTFRGLHVLTFRGLHVLASRGLDVLALRGLHVLAFRGLRALTFKGLHVLAFRGLRALAFKGLHVLAFRGLHALTFRGLHPLAFRGLHVFPFRGLHVLAFRGLHAFAFRGPHALAVRGLHVLAFRGLHVLTFRGLHVLAFRGLHALAFIGLHALAIIRLHVLPFRGLHVLAFRGLHVLAIIRLH

SEQ ID NO: 152438 - protein, 257 aa, Glycine max
  Coding DNA Sequence Number=SeqID_60753
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLAGKMIFKASIRACHTIHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152439 - protein, 224 aa, Glycine max
  Coding DNA Sequence Number=SeqID_60754
MAPRKVASKRSRKDKAAEGTSSGPEYDSHRFRSAEHQQRFEAIKGWSFLRERRVQLRDDEYTDFQEEIIRRRWASLVTPMAKFDPDIVLEFYANAWPTEEGVRDMRSWVRGQWIPFDADAIGQLLGYPLVLEEGQECEYDHRRNRSDGFDEEAIAQLLCIPGQDFARTAAGRRVRIMRTNMTTLTQIWMTLLLSNIQPSDHNSNLPLPKCQLVYGTYQAPSGPG

SEQ ID NO: 152440 - protein, 313 aa, Glycine max
  Coding DNA Sequence Number=SeqID_60755
MASKKRKSIGTRPTYQYDTRRFHSFEAWTRYTNNVLGRHILPKRKVEIYHTELDEFKAELETCNFHKCLTNLVDISIDLVLVKEFYANLYSPKGPSPKQVRVRGHVVKIDVDNLNTFLETPVVLAEGETLPAYSRYCRPPWEDSQVWSVLSYSNLAPTSHTPDLTVDRARLIFGLVSHMDMNVEALISGQITSMTQSNSSRLGFPALITALCKSRGVASDSLVFERLSPVINLAYIRKNCWNPDDLTVTIRGARRVRTRPAKALSTSTAPPPARTLAVPSASAPMVAAPDSIPSVEQFNEWVAWPGTQSSLHR

SEQ ID NO: 152441 - protein, 156 aa, Glycine max
  Coding DNA Sequence Number=SeqID_60756
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKHFTDTLISANIVYDWVWWLTPVIPALWEAKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152442 - protein, 146 aa, Glycine max
  Coding DNA Sequence Number=SeqID_60757
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=9e-25, Identity=54%"; Hit description =Putative uncharacterized protein
  Subcellular localization annotation: CTP_CleavageSite=40; ConfidenceScore=5.36e-01
MTMITPSSKLTLTKGNKSWHQGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152443 - protein, 349 aa, Glycine max
  Coding DNA Sequence Number=SeqID_60758
  Gene Ontology: Mol. function=L-lactate dehydrogenase activity; Cellular component=cytoplasm; Biological process=metabolic process
  Homolog annotation: Hit_ID=Q7VSM5; Match level="QueryCoverage=100%, HitCoverage=99%, E-value=1e-167, Identity=81%"; Hit description =Putative L-lactate dehydrogenase
  Pfam annotation: Domain name=Ldh_2; Domain location=1-338; Score =222.9; E_value=7.3e-64; Accession=PF02615.5; Description=MalateL -lactate dehydrogenase
MKISIAQANEYGRRVLMAQGVPEDIARDVAEHLVESDRVGYTSHGLSILTNYRRVLAEGLAQADGRPELLNDRGAMLAYDGHNGLGQYVGKVVIEQAIERTQAHGQCILTLRRSHHLGRMGHYGEMVAAKGLILLAFTNVINRAPTVAPFGGARACLTTNPLCFAGPLPGGRPPFIVDMATSSIAVNKARVLAAKGEQAPPGSLIDAQGNPTTDPGALFTDPPGALLPFGGHKGYAMGLVAELLAGVLSGGGTIQPEHPRNGVATNNMFALLLDPQVDFNTDWRSMEVGAFIDYLHACPPQPGVDGVQYPGEYEARNRELNADSLEFSPPIWEGLKKLAADVGVADALP

SEQ ID NO: 152444 - protein, 335 aa, Glycine max
  Coding DNA Sequence Number=SeqID_60759
  Gene Ontology: Mol. function=transferase activity, transferring glycosyl groups; Cellular component=transcription factor TFIID complex; Biological process=queuosine biosynthetic process
  Homolog annotation: Hit_ID=Q5PFT6; Match level="QueryCoverage=63%, HitCoverage=56%, E-value=1e-120, Identity=97%"; Hit description =Queuine tRNA-ribosyltransferase
  Pfam annotation: Domain name=TGT; Domain location=1-203; Score=424.8; E_value=1.2e-124; Accession=PF01702.9; Description=Queuine tRNA -ribosyltransferase
  Pfam annotation: Domain name=YajC; Domain location=215-301; Score =136.9; E_value=5.8e-38; Accession=PF02699.6; Description=Preprotein translocase subunit
  Pfam module annotation: Pfam domain module=TGT::YajC; Domain location= 1-203::215-301
MSLRWAKRSRDRFDGLGNKNALFGIIQGSVYEDLRDISVKGLVEIGFDGYAVGGLAVGEPKEDMHRILEHVCPQIPADKPRYLMGVGKPEDLVEGVRRGIDMFDCVMPTRNARNGHLFVTDGVVKIRNAKHKSDTSPLDAECDCYTCRNYSRAYLHHLDRCNEILGARLNTIHNLRYYQRLMAGLRKAIEEGKLESFVTDFYQRQGRSVPPLNGSPMSLILMLVVFGLIFYFMILRPQQKRTKEHKNLMNSIAKGDEVLTNGGLVGRVTKVAENGYIAIALNDTTEVGTAVLNRYPLWKYVMLVVVIIVGLIYALPNLYGEDPAVQITGARGVAA

SEQ ID NO: 152445 - protein, 278 aa, Glycine max
  Coding DNA Sequence Number=SeqID_60760
MRYFHVLSDPRVTIAELRLFRGFGRKTLTSPGRVCPHATGPLGLTTELRLFYGLGRKTLKSPGKVQMTMLVSTCYQTLESNSRNETFSRSRLEDADISRKGADDHVGLCVLSRPLSLTVERDFFAVSLKDLTSLGKVNETFSRSGRPDISGKGADETLVSPCCRTLESDGRNETFSRSREDADISGKGADDDSLRATGPLGLTVEMRLFRGLGRKMLTSSGKVDYVSLCMSIRLGVSERRDADNRKVTIAKGGVVDKSGAFASTYPQFMMRNSDLRSS

SEQ ID NO: 152446 - protein, 451 aa, Glycine max
  Coding DNA Sequence Number=SeqID_60761
  Gene Ontology: Mol. function=zinc ion binding; Biological process =apoptosis
  Homolog annotation: Hit_ID=A5BXI2; Match level="QueryCoverage=50%, HitCoverage=27%, E-value=4e-34, Identity=30%"; Hit description =Putative uncharacterized protein
  Pfam annotation: Domain name=SWIM; Domain location=380-412; Score =29.4; E_value=1.3e-05; Accession=PF04434.8; Description=SWIM zinc finger
SGKYVALQICDDEDVEIMIESFQQQQQMSVLELSIEKDVVGGSMFHSANSITSCGHNLSHNESEPPRNISNLHDDEDDGGDYLVSNSHVEESLDEDDSVDGISDTDDEVTDMIQQVKIVHPTKGVQGIQNSFWNDALHYNNINWSHPVKEDICGLEMPSTFNVGQELYVGMETVKMRAILSKKNDSWKVTQWGGPHTCLNTSMTQDHEKLDSDLIATCIVEAFKYCKPIIQVDDGTHLYGKYRGNLLMATSQDGNGGVLPLAFFVVEALGWQPPHGYHVHCVRHIASNFNRKFNNAKQKEMFEKLAITTWIDRISKEKWSMAYDKEGRRYGHMTTDNSVELRKNQEQACSYIVRVYDIHSIRFEVEETFNPITQHGRQKWAVNLNDHYCQCGKYSALHYPCSHIIAACAEIPPSNDAWTLIPDPTTICAKGQPKSTRIRNEMDWLEPSEHR

SEQ ID NO: 152447 - protein, 277 aa, Glycine max
  Coding DNA Sequence Number=SeqID_60762
MAPKKLPAKRARRTATREGSTTAPPIDIEFDGHNFRNAINQFLGHPLILEEGQQCEYIERISQFSGFDEETIGQLLCSPGHDFARSAAGKRVRIMHISMTTMTQIWMTFLLSNILLSDHNSDLTLPKCQLVYNIMMHISVHVAQLILNSIHQFVGISPPKHPVDPEKSNRVLGFPALIIGLCQFYGVPVTLTKLIQPPINRSFIKKYCMPRQVQQPGQEQQQQPIAGAPLPPPYQPSSLELQMHTYMRHLAYQQAANARGQMQLNDNFYHYTLHQHR

SEQ ID NO: 152448 - protein, 118 aa, Glycine max
  Coding DNA Sequence Number=SeqID_60763
MDKSLKVEEDEWREKERRSTKFHVSNEISGPNLGPWAQKSIPRFMRTLGPSSAALAQSSWSLLLMSLVTGPFLERIASYMLLKYYYIHIHEKAFGLPLIENIKRLNQTHVSNKVLKAQ

SEQ ID NO: 152449 - protein, 96 aa, Glycine max
  Coding DNA Sequence Number=SeqID_60764
  Subcellular localization annotation: CTP_CleavageSite=25; ConfidenceScore=5.25e-01
MKTDFKIRMLRCMFASRHCSNVPFCGRARRGSRVRFPKEERCAESSLSYPNFVRGLLFYDIQPLIGRFEILGTLWCTICEVPRRAENQKEAGLRDP

SEQ ID NO: 152450 - protein, 190 aa, Glycine max
  Coding DNA Sequence Number=SeqID_60765
MASPPLHGLAALLLYPPSPSTTVYGHLQIHTRPDLELKILTQDLTLKLLLGSFLMLLETKEPKKFIGIPLHAWSEEFFTQIGSFYGEFLHSNEETKIKESLEDCSNCLLCKGKSTAMVSNSDASKDNLHLDGFEKDDLGAGDGRRIAMVNVYSPCSLAGKRKLWGDLVMTKRGFGMTLWCIGGDFNIVAN

SEQ ID NO: 152451 - protein, 150 aa, Glycine max
  Coding DNA Sequence Number=SeqID_60766
MRGVAINVYSRKTSEKPERCGLRTLIVKGSKLYLLAGKVNKSEAFAPTYPLLKRKSDLRSSRKSASPHQLDFAPCALRSYNAQWNAPGLLHDKHTLRSSRILRKWRLRKPSRGFVVDLGMAFVDSWVMGKEKVCYWLSNDIVGLVGNLVV

SEQ ID NO: 152452 - protein, 211 aa, Glycine max
  Coding DNA Sequence Number=SeqID_60767
  Homolog annotation: Hit_ID=Q9FKS9; Match level="QueryCoverage=35%, HitCoverage=17%, E-value=6e-15, Identity=51%"; Hit description=WD -repeat protein-like
MLFVVREIILPSVRELRPLGIVRCKPSKFCKLGTVSRGEIPYISDKIPRFNHSGCLLINNIREILLIKYQLTSFKVIDTSIAQARNGKDIQGIPWEMLNISRERYKLTRLEQYRNFEDILTSGDVVGKNKNLFHKCFDVQNFTSFFPYRGPKSASKWRRVAITMNSSIIEEWLSLLSQPTLRREGDARLKGPSSNKRNAQESPPTFIRGKC

SEQ ID NO: 152453 - protein, 66 aa, Glycine max
  Coding DNA Sequence Number=SeqID_60768
MADGRKPKFRHKNMADGIAENGKRHEHCVPMSFRTTFLKAVHLVICFPEHKVQDHHRIQTQTANWE

SEQ ID NO: 152454 - protein, 39 aa, Glycine max
  Coding DNA Sequence Number=SeqID_60769
MEKDASHEDSTTITFRRHVSPLRGGVPMRNYYEIDVSLC

SEQ ID NO: 152455 - protein, 96 aa, Glycine max
  Coding DNA Sequence Number=SeqID_60770
MTRGNPSDLQPFDPKIDRTFHRLVGHHLVPFEHPEHYSFEHSENMTQPPLCERTLREMVVPDFTYESLCIQYPDEDVPYVLKTGLIHLFPKFHGLA

SEQ ID NO: 152456 - protein, 25 aa, Glycine max
  Coding DNA Sequence Number=SeqID_60771
MGLSSSFFRNLLKEASQGGELSYEK

SEQ ID NO: 152457 - protein, 118 aa, Glycine max
  Coding DNA Sequence Number=SeqID_60772
  Homolog annotation: Hit_ID=A5C686; Match level="QueryCoverage=100%, HitCoverage=14%, E-value=2e-10, Identity=36%"; Hit description =Putative uncharacterized protein
MENANFIEEVEFGREENIRNVVFEEELWIDSDQVLIPIIAQHTTLVIEDNVDDIVLEQDNNEVLPQIPIEQPQQPTKVSLRRSIRDENSNTKKWMDAMKNEMKFMQDNDALDLIELLE

SEQ ID NO: 152458 - protein, 60 aa, Glycine max
  Coding DNA Sequence Number=SeqID_60773
MIASGVNVMQAPLELVGLGSSSSMDSFASWKMNGSGMEKGREREETPLQGEDESRRSSPP

SEQ ID NO: 152459 - protein, 196 aa, Glycine max
  Coding DNA Sequence Number=SeqID_60774
MEAMKEQMTTMMEAMRSMRKMMEFNTATVITTCTATKVDPTHPSGINQASRLVLNMVGQGGEALGSMGDPHFVQVPQPMGETPEVPRDHTLANFEPHLRYATEGQAFGGIPQPNTLGGPKYRPQPQPLHFAVGRVPPTMVERGNFYHIEERLRAIAGGGDYAFADMEELFQVPEIVILPKFKVSNFDKYKGTTGIL

SEQ ID NO: 152460 - protein, 58 aa, Glycine max
  Coding DNA Sequence Number=SeqID_60775
MLRRYMEKKMKKQQWKRSLWGFYGGWIFELQWGPLMVIFHHGDEAEDKGKEVRGGAIH

SEQ ID NO: 152461 - protein, 561 aa, Glycine max
  Coding DNA Sequence Number=SeqID_60776
  Gene Ontology: Mol. function=protein binding; Cellular component =cytosol; Biological process=translation
  Homolog annotation: Hit_ID=A7QLU9; Match level="QueryCoverage=79%, HitCoverage=94%, E-value=0.0, Identity=67%"; Hit description =Chromosome chr18 scaffold_122, whole genome shotgun sequence
  Pfam annotation: Domain name=N2227; Domain location=261-515; Score =498.5; E_value=8.3e-147; Accession=PF07942.3; Description=N2227-like protein
MTPATANPRPERLNLAVYGGGAVCPTSLGDKPSSGRNLRCGRSVHRLRRVMDEAEEEQQRRRLKLEEALEIQSLRRIISAYLNYPDAAEEDVRRYERSYRKLPPSHKALLSHYSRKFQRLRWCISMNTHFIFGMLQAFEPPLDMSQDVDFSEDPHPESTQKDHLVSEGISACSCESVPVRITCSVSDQHRCVEGGNHTCISQAQMHSNEEVDIESCHQSNTGSHSPSMIHPKETSEYCGSPIADSNGNVPVTSSQQQWLDPSLKLNVPLVDVDKVRCIIRNIVRDWAAEGKNERDQCYSPILDELNMLFPNRSKDSPPACLVPGAGLGRLALEISCLGFISQGNEFSYYMMICSSFILNHNCNSLSDSDQLRPVSIPDMHPASAGITEGFSMCGGDFVEVYSDSSQVGAWDAVVTCFFIDTAHNIVEYIEIISKILKEGGVWINLGPLLYHFADMYGQDDEMSIELSLEDVKRVALHYGFELEKERTIETTYTANSRSMMQNRYFSAFWTMRKKSAAVQQQKVFILEVHLARLEAKFDICGRSQEAVTIEFVTSDQLSPSV

SEQ ID NO: 152462 - protein, 78 aa, Glycine max
  Coding DNA Sequence Number=SeqID_60777
MAAATPNETDVDVHHVRHAVDGFVEIADKLERLLNLRILTEGTKAYTVAGEILGITRNYIGQPTVGHRSRHMQRTDSH

SEQ ID NO: 152463 - protein, 36 aa, Glycine max
  Coding DNA Sequence Number=SeqID_60778
MFCGKMRESVVARCETENEFVWRLWSVLYGGGSVTE

SEQ ID NO: 152464 - protein, 104 aa, Glycine max
  Coding DNA Sequence Number=SeqID_60779
MEKRLKPPLILSSCDSFFSLHEYYLANPNGKSPTVNETGIIVLSRQLWVSAGKENATMRVYFYYLRHDIEIPNGRNSRNWVVNVVLKFHNDPTVNESEIVVFLR

SEQ ID NO: 152465 - protein, 117 aa, Glycine max
  Coding DNA Sequence Number=SeqID_60780
MAEPSKKRKGSSSRSQRHSEAQDIPILSSISSSSLFSSEEQCALDDDWKFDFFVHDARRLVCTNQTDMTGRLLAGSLALESRILHYLIVRILLPRSSNLAQVSEEDLIVMWAFHTNR

SEQ ID NO: 152466 - protein, 34 aa, Glycine max
  Coding DNA Sequence Number=SeqID_60781
MAVVGTIGNSDVRVGTKESMERRSSGMSSQRARF

SEQ ID NO: 152467 - protein, 216 aa, Glycine max
  Coding DNA Sequence Number=SeqID_60782
MIKRNNYDLVGVSSKKIASGFGNEVYKNGTRGWKYECFEVERDNDSYDSIDDESNENSSETESFPAPRYQTFDITRLTDSTLFLGVVSPELSGPPFMYYVVPLVKSLVNNECTENGRQPDEDQTVMAPDAVSYFQDMQRRINAIARTVKQLNESLKPKNEENIQASKHVTQPDQARPSIPVTEIEVLPKDIMVDQMLELWETADKDATIGKQAEKT

SEQ ID NO: 152468 - protein, 73 aa, Glycine max
  Coding DNA Sequence Number=SeqID_60783
  Pfam annotation: Domain name=RALF; Domain location=15-73; Score=18.1; E_value=0.00027; Accession=PF05498.2; Description=Rapid ALkalinization Factor (RALF)
MAMPKGMLVLLVSTLLVCSLLGQHAEARPVQIDYGVIRRDTIVGCSKRHPANCKLPRANPWRRGCEDETRCRH

SEQ ID NO: 152469 - protein, 63 aa, Glycine max
  Coding DNA Sequence Number=SeqID_60784
MGCSSKIYPEVHENPQAFFNNSSPILLEPLAHGSGNWSLPREDCIIRDEFIAIEVRMNMYKDP

SEQ ID NO: 152470 - protein, 67 aa, Glycine max
  Coding DNA Sequence Number=SeqID_60785
MDPKSTLRLMRTLGPCLASLVQSSWSLLSNALGGNWIGGLMPSVEEFESRSKGPTTLRAIGLRSTPN

SEQ ID NO: 152471 - protein, 521 aa, Glycine max
  Coding DNA Sequence Number=SeqID_60786
  Gene Ontology: Mol. function=phosphoprotein phosphatase activity
  Homolog annotation: Hit_ID=A7UQU7; Match level="QueryCoverage=61%, HitCoverage=62%, E-value=4e-36, Identity=31%"; Hit description=IMP dehydrogenase/GMP reductase, putative
  Pfam annotation: Domain name=DUF1723; Domain location=130-179; Score =54.2; E_value=4.6e-13; Accession=PF08330.1; Description=Protein of unknown function (DUF1723)
MTGAVDAADAKGVATDGSEGSPAADGSEGVAIDGSEGSPTADGREGVATDGSEGSPVVDEEFPGGPRDPSILTGFAKHLTHSIWSGKERPELKVVSHCRKVYKFGRPALEIESMIAATGLSPLIRCSVITTNPGLIFSFVERWHGKTSTFHLPVGELTITLDDVSSVLHLPITDALHTFEPLVTFDAVMLLTELLKALCSVVLAPGGVPEQVSGQTLDCSSPRVSPPLGGFSWGLAALVHLYDHLNEASQTPTWQMSCYMTLSQCWIYEHFLMVHQCVVDDAYAEASPRASRWLTSKAHMRGIKGAPYQARIEALTVMDVCWMPYAEHRGVKGFDLVSSYTGQLRWGQIEALVYVRLERVLRQFGYIQTVPPPPIRDSLMGLDIDGRWLHFSDHLVPAGEICVVPGQVALDYMDWFFRISHPFVTPIEDGAELRHLPTPHDEEFVEPPIPEVPVASDLPTHSMVDCQGCQAIAEDLEQVINLRMVTEGIELYDIMARCLRITRGDDVADGSLRLRQRWCIE

SEQ ID NO: 152472 - protein, 379 aa, Glycine max
  Coding DNA Sequence Number=SeqID_60787
MASRKRKATASRPMEPYDTTRFISKEYDEFRRELKRWSWHKALTRKLDGHIDVALVKEFYANLYDPKDKSPRQVRVRGKLIKFDAQSLNTFLENLVILELGEQYTTHTRFCYSRPNPQEGTLEAVEEGPYHPCPDMECVIILQPCPTSHTSDFNMDRARLVYGLVMKMDMDLGSLISGQISQMAQSNSSRLGFPALITALCVARGVIFDSLTFESLSPAINLVYIRKNCWNSDDPMITFLGTCKARAWGPSDTSTPAPYAPTPPPAPPAPTLATLSIHDLAQHRLIMSMEAFMAQVAWSGVQPSPLGGGEAPTAQEPQPKVEPEASPEAEATPEVTPAATPLVEIIEDEDGAKDTDYAADMVAVQSTWDPWPTTAQETP

SEQ ID NO: 152473 - protein, 56 aa, Glycine max
  Coding DNA Sequence Number=SeqID_60788
MKILSSGVVFTFEEGISTSHVDKSGAFAPTYPPSKRKSDLRSSSFKHESSDSFTRK

SEQ ID NO: 152474 - protein, 70 aa, Glycine max
  Coding DNA Sequence Number=SeqID_60789
MVQLTNPRSSPRFSTKSVLRCHEAYHGSKIYPKAHENPRAFSCIFGPVFLESPSHGSNDGSPPWKDCIIN

SEQ ID NO: 152475 - protein, 25 aa, Glycine max
  Coding DNA Sequence Number=SeqID_60790
MSKRLQEDWARADQAYRYRRPRGGA

SEQ ID NO: 152476 - protein, 119 aa, Glycine max
  Coding DNA Sequence Number=SeqID_60791
MRGYRMVIRTFRQPGANEPVDAQRLASSFAPFVIQGQRVRWQAEIPYGHPHLSSIEANEFDGFYSRRPETFKPDDAQDSSPLGGGRSSSMAWGNVMVVPLYRFQDTEVLLTLLMPFLSF

SEQ ID NO: 152477 - protein, 59 aa, Glycine max
  Coding DNA Sequence Number=SeqID_60792
MKLDLVDLSNIDECIHLKVFDQQGRPSGKEFIHWLTDEEKDSAHVHVLINCAEVKSYLE

SEQ ID NO: 152478 - protein, 106 aa, Glycine max
  Coding DNA Sequence Number=SeqID_60793
MAKLGMSSSIGMLATTDDGDGVDVGTKDGPRASRWDGDGQTSVEGGNGVGVTSEDLTGIDRTNGDGINDGRLSLGSTYSIPPIKSSNLEIFSTSMTSLTCDISSTW

SEQ ID NO: 152479 - protein, 204 aa, Glycine max
  Coding DNA Sequence Number=SeqID_60794
  Gene Ontology: Cellular component=integral to membrane
  Homolog annotation: Hit_ID=A7QU43; Match level="QueryCoverage=40%, HitCoverage=32%, E-value=3e-25, Identity=67%"; Hit description =Chromosome chr2 scaffold_176, whole genome shotgun sequence
  Pfam annotation: Domain name=MtN3_slv; Domain location=57-166; Score =66.3; E_value=1e-16; Accession=PF03083.7; Description=MtN3saliva family
MEERISGAVLSSAIPSHIDELHGMDPLWPPHGAPSQLAGDHLCHPLLALLRPYQEAQGLPLALLRTRLHRRSNLRHIHSHPFRQEALCRRRNHLHALQCCHKLVITTKSVEYMPFFLSLASFGNGVSWTTYALIPFDPFIAIPNGIGTTFSVAQLILYATYYKSTKKQIAARNAKEVNLSEVVVGNSTVQDPNNNKISAAPNGL

SEQ ID NO: 152480 - protein, 98 aa, Glycine max
  Coding DNA Sequence Number=SeqID_60795
MRFRVISDVAQCRACRPWIFFINEVLCFLKINGSGMKKEERNPYKSTAPRVPLYPKGVRIYSLLPLDDQNILIMFALLKSLSPSTITLEDHVAPRLYG

SEQ ID NO: 152481 - protein, 136 aa, Glycine max
  Coding DNA Sequence Number=SeqID_60796
IKRCLMNPPMLVPPVPKRPLILYITVLDESMGMRDELIFAREDVLCLGVGSSPFEAVYAELHYLVGVQNGSRQVHLRKACSHWKDSSVAEFPNEDIMTLFEEDVEDEDRDKWIVWFEGASSALGHGIGAILVSLDK

SEQ ID NO: 152482 - protein, 140 aa, Glycine max
  Coding DNA Sequence Number=SeqID_60797
MAPKKLLTKRARKATAEEGSSAALQVEIEFDGHHFRSEEHQHRFEAIKGWSFLKERRVQLREKEYTELQFNANAWPTEEGVMDKRSWVRGQWIPYDEDAINQFLGHPLVLEEGQRCEHTERSQVSSFDEEAIGQLMCSLG

SEQ ID NO: 152483 - protein, 86 aa, Glycine max
  Coding DNA Sequence Number=SeqID_60798
MAELRGGNLKKRHRIEVAWRVAYGGRHSHGGHGGIGLTRPNPTRYCNAKAQRGEPTRHSTEHSSTTSSDNTAPSSNERQPHDTAPA

SEQ ID NO: 152484 - protein, 45 aa, Glycine max
  Coding DNA Sequence Number=SeqID_60799
MEGVSCYVLNFNMGVHLDYILVARCLLPLTIAQFQNSLAIAYLKK

SEQ ID NO: 152485 - protein, 188 aa, Glycine max
  Coding DNA Sequence Number=SeqID_60800
  Homolog annotation: Hit_ID=Q0ZCD0; Match level="QueryCoverage=97%, HitCoverage=16%, E-value=1e-07, Identity=23%"; Hit description =Integrase
MERSMIDAASGGALGDMTPAEARNLIEKMISNSQQLSARNDAIVLRGVHEVATNSCSSTENKKLEGKLDALVNLVTQIAMNQKSASAPIARVCGLCSSANHHTNLCPSLQQSGVNEQPEAYAANIYKRPPQQQNQQQRNNYDLSSNRYNLGWRNHPNLRWASPPQQQQPDPPFQKAGGPSKPYVPPPI

SEQ ID NO: 152486 - protein, 30 aa, Glycine max
  Coding DNA Sequence Number=SeqID_60801
PRRFRNASDTFLWVISRRFSAVLRRSSVFN

SEQ ID NO: 152487 - protein, 238 aa, Glycine max
  Coding DNA Sequence Number=SeqID_60802
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGDLVELDLEIEATCRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152488 - protein, 112 aa, Glycine max
  Coding DNA Sequence Number=SeqID_60803
  Subcellular localization annotation: CTP_CleavageSite=45; ConfidenceScore=5.62e-01
MTTDSPPSLCPHGPRPNSLKTVPSGVVNCRNLSFGGRATWGSRVRLPGEEGARSRHQRLFEENVIKTGTCGLRTLSMKGSGVVFMHGEGCFPRSYVSSIAMRKSDLRSSFEN

SEQ ID NO: 152489 - protein, 236 aa, Glycine max
  Coding DNA Sequence Number=SeqID_60804
MAPRKLASKRSRKDKAAEGTSSAPEYDSHRFRSVVHQQRFEAIKGWSFLRERRVQLRTTKEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTK

SEQ ID NO: 152490 - protein, 79 aa, Glycine max
  Coding DNA Sequence Number=SeqID_60805
MARSVSASCPYSWDLYGRELKGFLVIIPKVVISLLMVSRAYPSAGRRRVTRGCVFQERNTRGVVTNVYLRKKSEKPEKT

SEQ ID NO: 152491 - protein, 173 aa, Glycine max
  Coding DNA Sequence Number=SeqID_60806
  Homolog annotation: Hit_ID=A5BEV8; Match level="QueryCoverage=90%, HitCoverage=21%, E-value=1e-10, Identity=28%"; Hit description =Putative uncharacterized protein
VDHLRYLGNNLSSCGCVMRSTHGIPCAYQGLCETKVTIKEEIEIAYPDHNSMCPPPSKYVDAFHYVQSSNSPMKRSASCSQPPQPTRIIPMLDQFVSFFQGFIRDVVNVKADGNCGYRSIAALLGMGEDSWPLVRNELIKELGRWSHEYMNLFGGTERFEQLKLSLLVDGFSK

SEQ ID NO: 152492 - protein, 85 aa, Glycine max
  Coding DNA Sequence Number=SeqID_60807
MGAQVAVQGQQRDGDGQNWERGNNQDVGAQRCPGKYRHLEHGHARGTHLDNGHEEVDTGQGGTDTGELKRPDPVVNANARTVLNS

SEQ ID NO: 152493 - protein, 70 aa, Glycine max
  Coding DNA Sequence Number=SeqID_60808
MCCKAIKLGNARGEWEFHRGGGRSRISGSPGLQDFKKKKEGVEMRVVITERAERTKSVSYLCFPLISDER

SEQ ID NO: 152494 - protein, 166 aa, Glycine max
  Coding DNA Sequence Number=SeqID_60809
  Gene Ontology: Mol. function=RNA binding; Cellular component =cytoplasm; Biological process=thiamin biosynthetic process
  Homolog annotation: Hit_ID=P55913; Match level="QueryCoverage=100%, HitCoverage=34%, E-value=2e-71, Identity=83%"; Hit description =Thiamine biosynthesis protein thiI
  Pfam annotation: Domain name=ThiI; Domain location=1-110; Score=99.2; E_value=1.3e-26; Accession=PF02568.5; Description=Thiamine biosynthesis protein (ThiI)
MGVILKRMMVRAASKVAERYGVQALVTGEALGQVSSQTLTNLRLIDNVSDTLILRPLISHDKEHIIDLAREIGTEDFARTMPEYCGVISKSPTVKAVKAKIEAEEENFDFSILEKVVAEASNIDIREIAQQTEQDVIEVETVSGFGANDAILDIRSIDEQDDKPLQ

SEQ ID NO: 152495 - protein, 60 aa, Glycine max
  Coding DNA Sequence Number=SeqID_60810
  Subcellular localization annotation: CTP_CleavageSite=22; ConfidenceScore=5.01e-01
MGAYFMPILVLKFKLKISVKTSAKTRGNWKGGLVPSLEEFESRSKGPTTLRAIGLRSTPN

SEQ ID NO: 152496 - protein, 214 aa, Glycine max
  Coding DNA Sequence Number=SeqID_60811
LALQVEVIDEEDFEAPEEDEEVRALKLELGKARLAKEKFKSADTHIRKECTELQEENAATAKAREQETKRARKEEYAREKFRGALWGSNNELKLRREERDRSRVHGMILKEELVACARSKRSLAQHLEATEQSMLAIIGQYKEELNQSMAHEQKLVEDFAQVYAEKEARGRVIDALHQEATIWMDRFALTLNGSQDLPRLLAKAKAMAEEFHHN

SEQ ID NO: 152497 - protein, 30 aa, Glycine max
  Coding DNA Sequence Number=SeqID_60812
MGHATLLPFSCNSCPNMRSPSARYNIGDSK

SEQ ID NO: 152498 - protein, 124 aa, Glycine max
  Coding DNA Sequence Number=SeqID_60813
  Homolog annotation: Hit_ID=Q5QJQ3; Match level="QueryCoverage=61%, HitCoverage=89%, E-value=2e-27, Identity=58%"; Hit description =Putative uncharacterized protein
MAYERGGDFLEDARKILNREVRGPRQNRFSLRSAPLTSITKSDAQISGGETRQDYKDTRRFPLEAPSQFAPSWTVCTNPPFSPTAAPYPVTIVLSPTRKDMQKHHWQQPLVIDLEELVLKSCAG

SEQ ID NO: 152499 - protein, 80 aa, Glycine max
  Coding DNA Sequence Number=SeqID_60814
GLHPGTFIGLQRALAGLHALASRGLHVLGLPGPARPTLEGARPCLYRATCPHLRRDGYTKPLGPSEKAPQCPGFSLVQRL

SEQ ID NO: 152500 - protein, 96 aa, Glycine max
  Coding DNA Sequence Number=SeqID_60815
MTPPKEISIVIRHHGQIADNPIPGLMYSYTFISAQLHDNDDLRGMLETIVQNLELNYIELYVVTKLIHHHNHRLYNYNYRLHNYNYRLHNNYCTTT

SEQ ID NO: 152501 - protein, 80 aa, Glycine max
  Coding DNA Sequence Number=SeqID_60816
MAQPPPRERPLREMAAPNFTYESLCIQYPDEDVPYFHGLASEDSHKHLKEFHIACSTMKPPDVQEDHIFLKVFPHSSELN

SEQ ID NO: 152502 - protein, 66 aa, Glycine max
  Coding DNA Sequence Number=SeqID_60817
  Gene Ontology: Biological process=transposition, DNA-mediated
  Homolog annotation: Hit_ID=Q1J7G7; Match level="QueryCoverage=45%, HitCoverage=42%, E-value=2e-10, Identity=100%"; Hit description =Transposase
AAWYQQGHQDLFILRSDLPSQWLLFLSAVPPVQLLTGWCVTAKAPPDISAGKCSGHAARNHHTRRA

SEQ ID NO: 152503 - protein, 152 aa, Glycine max
  Coding DNA Sequence Number=SeqID_60818
MRYRSFDLHQLLSHFSKHGNKSNRQEVLPSQGQKPRYHQHQGIRAVDGTPPNASLPQDLRKDLRVDHSRGIRAVDWVPFKDVLALLIFGVVLFPNVDGLIDLAAIDAFLAYHHSKESPVVAVLADLFDTFDRRCEKSSARIICCYPPLCVWL

SEQ ID NO: 152504 - protein, 47 aa, Glycine max
  Coding DNA Sequence Number=SeqID_60819
KNLVGRLGVHDRTCLTKVKSDLQKHSNRMTPKAYTPKSPSGPLPPDS

SEQ ID NO: 152505 - protein, 103 aa, Glycine max
  Coding DNA Sequence Number=SeqID_60820
  Homolog annotation: Hit_ID=A0PAV3; Match level="QueryCoverage=36%, HitCoverage=17%, E-value=5e-07, Identity=76%"; Hit description =Restriction endonuclease
MVKVGTSYVPINVSFSPKVGPGLPGINRDTRIYLFCEVSVRHQRHAAYNSTQHTAGSIMRRSGASLRQFRLTLTAHWEGCDRCGPHLRYYASSGNGGCAARLH

SEQ ID NO: 152506 - protein, 92 aa, Glycine max
  Coding DNA Sequence Number=SeqID_60821
CCNSSRGSEEELRDVHGADPKYCLMVTPAPATQTRPSLALVGSTWNTGLSAPGGLVDKDRRREAFRVRFTADGEADAFEGRGGGGRGGGGEA

SEQ ID NO: 152507 - protein, 108 aa, Glycine max
  Coding DNA Sequence Number=SeqID_60822
MQIDIFFVVAPNLQVVVIIKKGENVNHEDFDDIKKNLLEKGGDVNHASFDGVEKKSHVCHHQKGGECEYSLKTKSCLKTKCFQDMQGSGNRLPGSVIDYQKTGLRNSC

SEQ ID NO: 152508 - protein, 123 aa, Glycine max
  Coding DNA Sequence Number=SeqID_60823
  Subcellular localization annotation: CTP_CleavageSite=40; ConfidenceScore=5.00e-01
MPSVCRTHLDGQTIPISVPGPGPMCLTNFKAGDVSCTPVLAKRVRNRHQVQQISRSCDNPPPGLTSGLINVSEPILIVHMLPCECCLGSGLFGRHFQQLRKQESGLLRRKSVETVQGASDGQM

SEQ ID NO: 152509 - protein, 65 aa, Glycine max
  Coding DNA Sequence Number=SeqID_60824
  Subcellular localization annotation: CTP_CleavageSite=17; ConfidenceScore=5.17e-01
PQWSRQLSQRALHGRARARLMGALSKGGKMRGVATNVDKSGTFAPTYPPSKRKSDLRSSFSCVNQ

SEQ ID NO: 152510 - protein, 76 aa, Glycine max
  Coding DNA Sequence Number=SeqID_60825
MEIEETKQGLWLPLNYRVDTRASLAYDTEIWGESYRLFATKFLFGFVVDLGMAFVDNWVVGKEKLHPIRRHYTDTA

SEQ ID NO: 152511 - protein, 144 aa, Glycine max
  Coding DNA Sequence Number=SeqID_60826
  Homolog annotation: Hit_ID=A6BLN7; Match level="QueryCoverage=73%, HitCoverage=20%, E-value=1e-07, Identity=34%"; Hit description =Putative transposase
MAPFTCACGKYNKEVVLRYRIEVMINHRDESTKFLLWDRECTELIGQLADAVNRLKIEDGDVDLNASPEALDKLLGYVLAFKIKVQPKFRNSVVLKCSTDSSLINVVMDILVDVETSSKINIPAFDSNHSTEHESTSLIMTLIF

SEQ ID NO: 152512 - protein, 61 aa, Glycine max
  Coding DNA Sequence Number=SeqID_60827
  Subcellular localization annotation: CTP_CleavageSite=30; ConfidenceScore=5.41e-01
MRPVRLKGALKPGDPSHTLKQFPSQGSLPRQSSRSNPRIHNTTELGSELYNTHDSSTNRES

SEQ ID NO: 152513 - protein, 48 aa, Glycine max
  Coding DNA Sequence Number=SeqID_60828
MSRNFTDCLTMALGNQFMGLRIRFDGGGCTNNARQSIRGAPDSMVEDA

SEQ ID NO: 152514 - protein, 73 aa, Glycine max
  Coding DNA Sequence Number=SeqID_60829
  Subcellular localization annotation: CTP_CleavageSite=45; ConfidenceScore=5.56e-01
MACPLACVPKDPSCTSTNICSASLASTHRSSTTSWFLLYRIFPLRKKPVSNFTTFFCRYQRPLAGIPYPRCIV

SEQ ID NO: 152515 - protein, 69 aa, Glycine max
  Coding DNA Sequence Number=SeqID_60830
MLANECEREDAGCRCNCLWCFDDDHNDMMQLMQMGFSRLNSRQYFKITSHNIKMITSILGREFLIELAK

SEQ ID NO: 152516 - protein, 74 aa, Glycine max
  Coding DNA Sequence Number=SeqID_60831
ASPLSLPFLHSAAIHLPKKAKESIDEEDPRPTSSNGACIRMYPPLFSLNNLVDVPSTRTDPQEMYPLLFSVTPK

SEQ ID NO: 152517 - protein, 194 aa, Glycine max
  Coding DNA Sequence Number=SeqID_60832
MHALLGSFNSGNWSDSKVLDSTGLSFCTITRNRDSFYTCSYSHLSLHTRHLFAEIAYQITQVPREFDTRFLPFYTTCAIRCTCRKSNKFLAPLSGNFFLFGKSPIGNLVPLDLEIEATLQRNRAERRRKLLQDRTVASILEEETRFSDLLSPDLPSSRESATQLPEVITMAEEHDQRITLEEFSTTIFHQHCTS

SEQ ID NO: 152518 - protein, 106 aa, Glycine max
  Coding DNA Sequence Number=SeqID_60833
MSSLLEDYTSSPSEDCMSSLSEDHTSSPSEDYIPSEDYTSSPSEKCMSSLSEDYTSSPSEDYTSSPSKGCTPSPSEDYTSSTSEDYTSSPSEGYALLPLVGSISAP

SEQ ID NO: 152519 - protein, 121 aa, Glycine max
  Coding DNA Sequence Number=SeqID_60834
MKYFPESKTVEGKAAISSFHQFPDESLIETLERFRELMNLDVISLMKSKLHMRLIIWGISLEAISIQVDFQDFRTTSSINNKDSGKITLVTNSTEIRVVHLQGHNSRCQVSMTEPRSWKRL

SEQ ID NO: 152520 - protein, 104 aa, Glycine max
  Coding DNA Sequence Number=SeqID_60835
MIESFQQQQMSVLELYVEKDVAGGSMFHAANFVMSCGRNVSHHESELSRNISNLHDDDDDDDYLASNSYVEESFDEDDSDDGISDTDNEVTDIVEPVSIVHPTE

SEQ ID NO: 152521 - protein, 201 aa, Glycine max
  Coding DNA Sequence Number=SeqID_60836
MQQSEAIEHPEAYAANIYNRPPQPQQQNQPQQNNYDLSNNRYNPGWRNHPNLRWSSPSQQQQQQQPYFQNVAGPSRPYVPPPIQQQQQPQKQQTVEAPPQPSLEELVRQMTMQNMQFQQETRTSIQSLTNQMGQLATKLNQQQSQNFDRLPSQSIQNPKNVSAITLRSGKQCQEPQPTTSSSSANEPTQPHSTPKKDDDKI

SEQ ID NO: 152522 - protein, 77 aa, Glycine max
  Coding DNA Sequence Number=SeqID_60837
MRGSEHPATTGYATEADDVGHLGRQGVNFGCNSFSKSGRGMLPRNGLIALIFKRRQLGRCAGVHGHGAGPFPSETYY

SEQ ID NO: 152523 - protein, 261 aa, Glycine max
  Coding DNA Sequence Number=SeqID_60838
  Gene Ontology: Mol. function=metalloendopeptidase activity; Cellular component=cell outer membrane; Biological process=cell wall catabolic process
  Homolog annotation: Hit_ID=A1JRZ5; Match level="QueryCoverage=64%, HitCoverage=68%, E-value=1e-69, Identity=73%"; Hit description =Putative lipoprotein precursor
  Pfam annotation: Domain name=LysM; Domain location=112-155; Score =58.3; E_value=2.7e-14; Accession=PF01476.11; Description=LysM domain
  Pfam annotation: Domain name=Peptidase_M23; Domain location=205-261; Score=17.8; E_value=2.6e-06; Accession=PF01551.13; Description =Peptidase family M23
  Pfam module annotation: Pfam domain module=LysM::Peptidase_M23; Domain location=112-155::205-261
MPTTMLSAAPEAKGLTRHSIPPASSRKAMIKRVTVRGFLTDPAQMLHCAADAYQNRNDDWGQDLSTGSKLAGWRRVAVCLALGLLLAGCSGKNTYNRDYDKLPKGSYSGKTYTVKRGDTLYYIAWITDSEVSELARINKIRPPYSLEVGQKLRLSGSAPAKTAATRRKKSSSAAIVKQTPPPGASRCWRWPTSGRIVQAYSNSDGGNKGIDIAGKRGQPIYASAKGKVVYVGNQLRGYGNLIMIKHGEDFITAYAHNDTTL

SEQ ID NO: 152524 - protein, 76 aa, Glycine max
  Coding DNA Sequence Number=SeqID_60839
MALKKLSAKISRRDAVAEGTSAVPEFDSHRFRSAEHQQRFEAIKGWLFHREIRVQLRDDEYTEFQEEIARQHWTSL

SEQ ID NO: 152525 - protein, 72 aa, Glycine max
  Coding DNA Sequence Number=SeqID_60840
RIPDVVAHLAAIGQRAFAAAVFQAGDARCDAGEVGRLEADRAREQPVAGGPALQAVVERKQGRGHERFPVGG

SEQ ID NO: 152526 - protein, 102 aa, Glycine max
  Coding DNA Sequence Number=SeqID_60841
  Gene Ontology: Mol. function=nucleic acid binding
  Homolog annotation: Hit_ID=A5AYU6; Match level="QueryCoverage=81%, HitCoverage=15%, E-value=2e-15, Identity=44%"; Hit description =Putative uncharacterized protein
MEKSEKKNFNEKKAKRAYITWDDNDMDSYENSKNEVVSLSLMAKIYENNEEVSLKKRWYIDSECSKHMMGDASKFTHISPKKSGHVTYGDNNKGRILGVGKI

SEQ ID NO: 152527 - protein, 113 aa, Glycine max
  Coding DNA Sequence Number=SeqID_60842
MADRSSSSFTANTEKNPKEECKAVMTRSKMAIHLAPKPALEPDSDFVELEEINEEAKNDKEEETPIKEKEKEKEKEKEKKLKNEKQKQKVIDFEMRRGKSEASTEKEEGYYSK

SEQ ID NO: 152528 - protein, 117 aa, Glycine max
  Coding DNA Sequence Number=SeqID_60843
MAEKTKKKLEEVAQSGSTEGINNPPSTIRRHVKWKMAHTKKTRQITSEAAKEIAEKIASQGLFVPHRRQDVLTTAIGRPEHPGRMRAAGAGVTIKQYFGSAPRSSRSSSSIPPEELE

SEQ ID NO: 152529 - protein, 121 aa, Glycine max
  Coding DNA Sequence Number=SeqID_60844
MPTTETLGRSTTCQFPNWKSGRHGCTQFEWSWGASSCIMGADVSSIGACRPRIFLINGFLCFLEDEWQRNGERKRERRRHFKEKMSLEEAHHHRRPWIRAWRKKEMNEGRGREEHEILCSK

SEQ ID NO: 152530 - protein, 148 aa, Glycine max
  Coding DNA Sequence Number=SeqID_60845
MYQLPNVKDSNDKPVMATPFKTKDVNEEVTSKDIKSLMEQANYTNKYLQVLGESISREKVSEKAKQKIRELRKHKSLTEGIGDKNSELLSKIDSLLKVIPKTPQPSKESSKMRTRNTSKLINVINDDSDQNLEQTTEEGSVSGKDINP

SEQ ID NO: 152531 - protein, 26 aa, Glycine max
  Coding DNA Sequence Number=SeqID_60846
MVVNDNRYFFIWSHGWFLREREQEGW

SEQ ID NO: 152532 - protein, 75 aa, Glycine max
  Coding DNA Sequence Number=SeqID_60847
MAEINQGKMMTAHDWSHIILALTRRYIGTDASRVRVTTDRSLPLPGAKQAENVAARQPSILCVRSFFYYLFVLNE

SEQ ID NO: 152533 - protein, 114 aa, Glycine max
  Coding DNA Sequence Number=SeqID_60848
MESGDMWGYRMVTRTFRQPRANEPVDAQRLTSSSVPFVIQGQRVKWQTEIPYGHLHLSSTEGNEFDSFYSRRPETFKPDDALDSSLLGGDDQVRWRREVSWLSHFIAFKTLKFC

SEQ ID NO: 152534 - protein, 80 aa, Glycine max
  Coding DNA Sequence Number=SeqID_60849
MKRIRIWGSHGHVAPHATGLLGHGKESMLMKFSHNHEILDVSISFPNDHLEETLGPTKIEENHSKCINLTQCEVTSQGIL

SEQ ID NO: 152535 - protein, 100 aa, Glycine max
  Coding DNA Sequence Number=SeqID_60850
MSKGQPPIFNADSPAVLHSCGDKLIPFIHNHCEACLLRNHLDWTHVQPPIFNADSLAVLHSCGDKLVPFILNHCEACLLRNHLDWTHPLAIRNGVDDSSL

SEQ ID NO: 152536 - protein, 53 aa, Glycine max
  Coding DNA Sequence Number=SeqID_60851
METTNKGHLINNPNNWKLEVGSSYWKLKVKNGSWKLEVEVTGSWKLEMKVIGS

SEQ ID NO: 152537 - protein, 140 aa, Glycine max
  Coding DNA Sequence Number=SeqID_60852
  Homolog annotation: Hit_ID=Q5NRP4; Match level="QueryCoverage=57%, HitCoverage=4%, E-value=2e-07, Identity=36%"; Hit description =Putative gag-pol polyprotein, identical
  Pfam annotation: Domain name=zf-CCHC; Domain location=90-107; Score =8.2; E_value=0.09; Accession=PF00098.14; Description=Zinc knuckle
MKEDIGHILDLTPIGEKRKESLKRLTLTSDTSMGRTMKSTSKSYGSHSYPKKDQGQGILGVTPSKPKDDKGKTIEKQPLKASMQEKTSSMKCFKFLGRGHITSQCPTKKTMIMRGQDNYSSQDEATTSPSSRESEEAKGK

SEQ ID NO: 152538 - protein, 112 aa, Glycine max
  Coding DNA Sequence Number=SeqID_60853
  Subcellular localization annotation: CTP_CleavageSite=53; ConfidenceScore=5.30e-01
LPSLVTDAWGANTFPVRKYNSRTFHLKFVDHAPASHASPSRRRVASHGGASVNATEEDGPSRAKSLGEVATSRRFIYQSMQVACMVSRGGGERDKCLFSPRGSRTTWKPVPR

SEQ ID NO: 152539 - protein, 201 aa, Glycine max
  Coding DNA Sequence Number=SeqID_60854
  Gene Ontology: Mol. function=receptor activity; Cellular component =outer membrane-bounded periplasmic space; Biological process=amino acid transport
  Homolog annotation: Hit_ID=A1WSJ1; Match level="QueryCoverage=98%, HitCoverage=49%, E-value=3e-85, Identity=81%"; Hit description =Extracellular ligand-binding receptor precursor
MSAYNRRRFLQHSGSMVLLGATSGMAALPRAAFAQDATVKLGLLHSLSGTIAIAEASLVDAEKLAIEEINAAGGVMGRKIEPVVEDGASENAVFAEKARKLLDRDKVAAIVGCYTSASRKALLPVLARSKGLLYYPTYYEGQEQDARVFYPSQEATQSVIAAVEWMAREKGKTFFLVGSDYIYPRTCNKIAKPAITHMGAK

SEQ ID NO: 152540 - protein, 55 aa, Glycine max
  Coding DNA Sequence Number=SeqID_60855
MPLVAWIAVEAKLHDDDKGDDKKLKDQSKNNSSESRTIQEFKIRIKKNSRLKKKV

SEQ ID NO: 152541 - protein, 107 aa, Glycine max
  Coding DNA Sequence Number=SeqID_60856
  Pfam annotation: Domain name=Ins_element1; Domain location=35-100; Score=-9.6; E_value=0.001; Accession=PF03811.4; Description =Insertion element protein
  Subcellular localization annotation: CTP_CleavageSite=92; ConfidenceScore=5.61e-01
MVKVGTFYVPINVSFSPKVGPGLPGINRDTRSAPVASVSISSPSRSATDGVVRNGKSTAGHQRWQAAQLLGRAIGAGLFAITPAGERGMCCKAIKLGNARVFPVTTL

SEQ ID NO: 152542 - protein, 204 aa, Glycine max
  Coding DNA Sequence Number=SeqID_60857
MTGRLLDGSLAFESRILHYLIVCILLPRSSNLAQVFEEDLIVMWAFHKGRQIDWAHLVRYRMHKALRLNAPLPYPHLATLFLQHFNIPLDSESYVPIKRSFLIGTAVIASFRYRKEYDGSWVKKGAQPIDEERHLHGGEDSSLLQKILDRFDGIQTFVGERFDTLELQVDMRFNEMESRITNIEEDVSYIRTSFDLPPPPPPSS

SEQ ID NO: 152543 - protein, 140 aa, Glycine max
  Coding DNA Sequence Number=SeqID_60858
WDATVFGVFNPDFPLYIKHKDLSEIAHGGQVKAIHTFLAWPTHLAAVSPAKPPQKPDPEVDDLLYLMTLTIPELFLRPYQVTWDATVFGVFNPDFPLYIKHEDLSEIAHASHLNMSASGEFLYVWIPRATVHSEVWAIAI

SEQ ID NO: 152544 - protein, 93 aa, Glycine max
  Coding DNA Sequence Number=SeqID_60859
MEREIITMIVDTLLVFYYEKMVGYTPSSFADLVFAGKFNHPALINKKPEENGENKKKGGTHVVTVVHIWPNFPPAQQCHYSANISPSHYPPPY

SEQ ID NO: 152545 - protein, 134 aa, Glycine max
  Coding DNA Sequence Number=SeqID_60860
  Pfam annotation: Domain name=zf-CCHC; Domain location=48-65; Score =26.7; E_value=8.8e-05; Accession=PF00098.14; Description=Zinc knuckle
  Subcellular localization annotation: CTP_CleavageSite=27; ConfidenceScore=5.28e-01
MTRKRKELLLKHHPQFKKKIQKFLKVRGNQRRPNFKSKRRTETSSSTLKCFECNQPGHLRVDCPIFKKKMEKSEKKNLSEKKLKKTYITWDENDMESSEDSENEEINLCLMAKSYESDEEKRTWHINLLLQEKL

SEQ ID NO: 152546 - protein, 105 aa, Glycine max
  Coding DNA Sequence Number=SeqID_60861
MGPVLPDSQRPFLQKLLAEKNKKKLEEAAQSGSVDGIINPPSPVRHHDPFEEQATQGSFIPHGRQDVLTTTIGRPEHPGRVRAARAKVTIKQYFRSADRGRARIN

SEQ ID NO: 152547 - protein, 79 aa, Glycine max
  Coding DNA Sequence Number=SeqID_60862
MDFRKVSSRFSKGIIFASNFNGPEPFHQLDSFAPYASEPNAQERPGALPTAKCNAFSRLWAKWRLMNPKGLWKHQLNYN

SEQ ID NO: 152548 - protein, 246 aa, Glycine max
  Coding DNA Sequence Number=SeqID_60863
MGTNQIGKRFYQVKIKGLDVTTLKEQGRLMGPPQRQAFRKVYGKILDLITAEVFTEAVVSLTQYYDRAVEMLHDALLGEENCIFVVRVGLPSLSKIATVVERFGERVGSYEKLETAIVGLLRKYLVGIGKARAYGESRGVPHEKESPMEESLSPFLVRDFGAQSLKIVQRVHKAWKSPLRKDKELRGICNGIIGDWLSKLKIINEENFEAPEEDEEVQALKSELGKARLAKEKFKSAATNIRKECA

SEQ ID NO: 152549 - protein, 153 aa, Glycine max
  Coding DNA Sequence Number=SeqID_60864
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=3e-24, Identity=54%"; Hit description =Putative uncharacterized protein
  Subcellular localization annotation: CTP_CleavageSite=47; ConfidenceScore=5.47e-01
MTMITPSSKLTLTKGNKSWYRAPPRVLFRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 152550 - protein, 82 aa, Glycine max
  Coding DNA Sequence Number=SeqID_60865
IIPFEEHIVAVGTTSNNRFSKRKALDEVESPTVATYPSAGGRRVTRRMRVPRKEYARSRHQRLFEENVGKTGKDAIYELLSE

SEQ ID NO: 152551 - protein, 146 aa, Glycine max
  Coding DNA Sequence Number=SeqID_60866
VKHRGRESCNLFIFHQFPDESLSEALDRWAKTTNQANVRCFSKGKNKAEAPEEATELIKNMSASDHAILHDRVHQPTKKNLLQVVSSVVRLMKQANVFPLKKTLKKFTIWEINKDKDILKEDFQASSRVLITIKDSGDHTLAINSS

SEQ ID NO: 152552 - protein, 154 aa, Glycine max
  Coding DNA Sequence Number=SeqID_60867
  Homolog annotation: Hit_ID=A7UQS9; Match level="QueryCoverage=72%, HitCoverage=49%, E-value=6e-08, Identity=33%"; Hit description =Putative uncharacterized protein
  Subcellular localization annotation: CTP_CleavageSite=73; ConfidenceScore=5.25e-01
MGNQQRQGYTQGGFSGFQQGPYNQQGQWRTHPGNQFNKDQSGPSNRPIQQRPNIFQRNTKLEETLTQFMQVTMSNHKSTESALKNLEVQMGQLAKQIADKSSNSFVANTKQNPKEECKAIMTRSKRFVEAKDEDSVVHKKNTADKKGTDGKKNE

SEQ ID NO: 152553 - protein, 76 aa, Glycine max
  Coding DNA Sequence Number=SeqID_60868
MYKDNWTQPWPMGSEIYPEVHENPRAFFRSSSPILLEPLAHGSSDWSLPREDCIRIHCSSDENSVEDEMDGGIGVS

SEQ ID NO: 152554 - protein, 72 aa, Glycine max
  Coding DNA Sequence Number=SeqID_60869
  Subcellular localization annotation: CTP_CleavageSite=13; ConfidenceScore=5.01e-01
MGKCQFRPKQNVRCARTKKPSRPGAISRPMSVMRIMKLAKYRLKAQVEKDEGPSGEGQSPRVEKDEGPSGEG

SEQ ID NO: 152555 - protein, 106 aa, Glycine max
  Coding DNA Sequence Number=SeqID_60870
  Subcellular localization annotation: CTP_CleavageSite=82; ConfidenceScore=5.26e-01
MASVVLQGARSPWQGSRPQDTQWTRRSPTGSWSFQALITGLYQFYGVLVAPSKIIRPPTNRVFIKKYCVPRQLQGETPQQPRDGRQWTIDAPPSPLEFTSAHPQKG

SEQ ID NO: 152556 - protein, 148 aa, Glycine max
  Coding DNA Sequence Number=SeqID_60871
  Subcellular localization annotation: CTP_CleavageSite=80; ConfidenceScore=5.22e-01
MVKVGTSYVPINVSFSPKVGEACRAEPPAPSGFRANHTGTLPGSSLFDIRRPRGGQRRRCSGVHGSISCPSCSATEIGVVSASNSHTSIPSRKHQRGKCSGAKTLTRTLTPLNAALQGASLSSRETCGNCNEANARGSSAGLFAIRWR

SEQ ID NO: 152557 - protein, 257 aa, Glycine max
  Coding DNA Sequence Number=SeqID_60872
  Gene Ontology: Mol. function=DNA topoisomerase (ATP-hydrolyzing) activity; Cellular component=chromosome; Biological process=DNA unwinding during replication
  Homolog annotation: Hit_ID=P0AFI3; Match level="QueryCoverage=100%, HitCoverage=34%, E-value=1e-141, Identity=96%"; Hit description=DNA topoisomerase 4 subunit A
  Pfam annotation: Domain name=DNA_topoisoIV; Domain location=26-257; Score=217.5; E_value=3.2e-62; Accession=PF00521.11; Description=DNA gyrasetopoisomerase IV, subunit A
MAERLALHEFTENAYLNYSMYVIMDRALPFIGDGLKPVQRRIVYAMSELGLNASAKFKKSARTVGDVLGKYHPHGDSACYEAMVLMAQPFSYRYPLVDGQGNWGAPDDPKSFAAMRYTESRLSKYAELLLSELGQGTVDWVPNFDGTLQEPKMLPARLPNILLNGTTGIAVGMATDIPPHNLREVAQAAITLLEKPKTTLDELLDIVQGPDYPTEAEIITPRAEIRKIYQNGRGSVRMRAVWTKEDGAVVISALPHQ

SEQ ID NO: 152558 - protein, 134 aa, Glycine max
  Coding DNA Sequence Number=SeqID_60873
  Subcellular localization annotation: CTP_CleavageSite=72; ConfidenceScore=5.24e-01
MAPTTLPRLLRVMVPPEQLSPITMRTFASSTPRCHKIRTRFSSFIQDKNPRYPRNSRDMIKIISRVLGRKFQVETTKDLAKGFNLKCFFKSFTCQTCKRFLQDSEILKRVAWGLDIGTRVLAFMVENFKEDEEG

SEQ ID NO: 152559 - protein, 85 aa, Glycine max
  Coding DNA Sequence Number=SeqID_60874
MAEPSKKRKGTSSRSQRHSGEGVPFEGALIDEWKFDFSVHDARRLVCTNQADMTGRLLAGSLAFESRILHYLIIRILLPRSSNLA

SEQ ID NO: 152560 - protein, 109 aa, Glycine max
  Coding DNA Sequence Number=SeqID_60875
MAPPDSILLVEQFNEMVAWPGNQPSLHREDKGPTAQVPAATPERSIEATSEPSTPVVNLPSPQPAADPSTPLLQMPEDPTTPVLAVDTSPPTTPVLQLTDEEDDQTQDT

SEQ ID NO: 152561 - protein, 186 aa, Glycine max
  Coding DNA Sequence Number=SeqID_60876
  Homolog annotation: Hit_ID=Q6WAY6; Match level="QueryCoverage=97%, HitCoverage=29%, E-value=1e-23, Identity=37%"; Hit description =Putative uncharacterized protein
KDEWASFIDILALLIFGGVLFPNVDGLVDLAAIDAFLAYHNHKESPVVAMLANLYDTFDRRCEKSSTRIVCCTPALYVWLVSHLFRQEVRHACPLESHRSCTEKGGANWDQLLASKEGASVNWFPRWKEGRTGVLISCGGFPNVPLMGARGCISYNPVLAIRQLGYLMTGAPLEEELAPAISRGFS

SEQ ID NO: 152562 - protein, 73 aa, Glycine max
  Coding DNA Sequence Number=SeqID_60877
FTRAWILRFIGGVLFVDKSSSKVSLREMCSATDYKIKSIGGMCILIQMWAWERCTTLAPNRTPPVIENKTLGH

SEQ ID NO: 152563 - protein, 118 aa, Glycine max
  Coding DNA Sequence Number=SeqID_60878
MACSVLNCAQLMGSSYSSSNLSCLPYLRSGMIHFLEARWGIGFTLATALVAATITALASIIFFMLIMASIIVAICSFMASMSAFIFSCTSSASAHYSSSSTSSATIRSFQVWTRKVPS

SEQ ID NO: 152564 - protein, 273 aa, Glycine max
  Coding DNA Sequence Number=SeqID_60879
  Gene Ontology: Mol. function=nucleotide binding; Cellular component =intrinsic to membrane; Biological process=defense response
  Homolog annotation: Hit_ID=A2Q3B4; Match level="QueryCoverage=100%, HitCoverage=57%, E-value=2e-83, Identity=55%"; Hit description =Disease resistance protein; Calcium-binding EF-hand
  Pfam annotation: Domain name=NB-ARC; Domain location=1-141; Score= -121.1; E_value=0.015; Accession=PF00931.13; Description=NB-ARC domain
MMGTVTSHKLQSLSPENSLSLFVKWAFKEGEEEKHPHFVNIGKEIVNKCKGVPLAVRTLGSLLFSKFEANEWEYVRDNEIWNLPQKKDDILAVLKLSYDFLPSYLRQCFALFSLYPKDYEFRSVEVARLWEALGVLAPPRKNETPEDVVKQYLDELLSRSFLQDFIDGGTICQFKIHDLVHDLALFVAEDECLLLNSHIQNIPENIWHLSFAEYNFLENSFTSKSVAVRTIMFSNGAEVANVEALLNTCVSKFKFLRVLDLRDSTCKTLPRSI

SEQ ID NO: 152565 - protein, 63 aa, Glycine max
  Coding DNA Sequence Number=SeqID_60880
MSQYISVIVVDSVCKRGIPISMDSSSHSPFRGLGNHNLSLKRTLADGGHPAQGTPSCLVLFIA

SEQ ID NO: 152566 - protein, 150 aa, Glycine max
  Coding DNA Sequence Number=SeqID_60881
MWMDRFALTLNGSQELPRLLAKAKAMADTYSAPEEIHGLLGYWKNTITKRATRHPYRTRSKSRTVGDQEETQEQMKADMSALKEQMASMMEAMLGMRQLMEKNAATAAAVSSAAEADPTLLATAHHPPSNIVGRGRDTLGHDGNPHLGYN

SEQ ID NO: 152567 - protein, 373 aa, Glycine max
  Coding DNA Sequence Number=SeqID_60882
  Gene Ontology: Mol. function=transporter activity; Cellular component= integral to membrane; Biological process=transport
  Homolog annotation: Hit_ID=Q5PJW8; Match level="QueryCoverage=100%, HitCoverage=35%, E-value=1e-170, Identity=81%"; Hit description=RND family, multidrug transport protein, acriflavin resistance protein F
  Pfam annotation: Domain name=ACR_tran; Domain location=1-373; Score= -182.1; E_value=0.026; Accession=PF00873.10; Description=AcrBAcrDAcrF family
MANFFIQRPVFAWVLAIILMIAGGLAILKLPVAQYPTIAPPAVAISATYPGADAQTVQDTVTQVIEQNMNGIDNLMYMSSTSDSAGNVTITLTFESGTDPDIAQVQVQNKLQLAMPLLPQEVKQQGIGVEKSSSSFLLVAGFVSDNKHLTQDDISDYVASNVKDAISRTSGVGDVQLFGAQYAMRIWLDSNAMNKYQLTPLDIINQLKTQNDQIAAGQLGGTPSIPGQQLNASIIAQTRLKSPEEFGRVTLKVNQDGSMVHLKDVARIELGGENYNMVTKINGQAATGLGIKLATGANALNTAAAIKSKLAQLQQFFPQGLKVFYPYDTTPFVKISIHEVVKTLFEAIILVFLVMYLFLQNLRATLIPTIAVP

SEQ ID NO: 152568 - protein, 269 aa, Glycine max
  Coding DNA Sequence Number=SeqID_60883
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMAGKVTHRFYVLDTKLMAATLNKIHKDMLVICISGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152569 - protein, 31 aa, Glycine max
  Coding DNA Sequence Number=SeqID_60884
MKSLRGKEIALVKVQWGTDEEVGIVGARYAG

SEQ ID NO: 152570 - protein, 79 aa, Glycine max
  Coding DNA Sequence Number=SeqID_60885
PLGPSRIFLQKAVASGGSNLARLGELGGNHLPYFAINRGGSEEEKAEALPNHFRNVFREEFREGFDRSSTFFIRSSIFN

SEQ ID NO: 152571 - protein, 79 aa, Glycine max
  Coding DNA Sequence Number=SeqID_60886
MFCKNAPTIWDQHRLKGVLKSGDPQGLHSEESVRGLNINSSPLKGLNINSLPKKGLNVNSSPLKGLSINSSPLKGHIVV

SEQ ID NO: 152572 - protein, 153 aa, Glycine max
  Coding DNA Sequence Number=SeqID_60887
MLNIQNLICGYEKISSADSPSPIDTLFFVRKAYVDLISWKFYLFTKARSHFSEENTGTISSLTSYPELRRSEFLIGGYVGARASLLSTTPPFVAMTQELVTRGDTLQLSAPRRSVTPSVIDEQRPMWSSAPFPEMSASSGGDFFKSHKLSRTT

SEQ ID NO: 152573 - protein, 147 aa, Glycine max
  Coding DNA Sequence Number=SeqID_60888
DVPLGRSHLRAWRSGFLLPRCLPASSSSASAENVLELGHDIAVKGSLWAMKNELVFPQHHRTIAGLHKYQCDDPEKDIDTSGSDTQQMFVACDTFHGHAPPFVGNILPLQQCPFFCLSPEFQYLTEACETVVQEIDALMRDHVTLAQ

SEQ ID NO: 152574 - protein, 105 aa, Glycine max
  Coding DNA Sequence Number=SeqID_60889
AEFEIPEASNSRTKKKILQTVGECWRQFKSDLTRKWALAADKDGVDDIVCEKYGISNEKWTQFCQTRKDSLWELMGEKTKKRLEEAAQSGSTEGVIDPPLPLDAT

SEQ ID NO: 152575 - protein, 89 aa, Glycine max
  Coding DNA Sequence Number=SeqID_60890
  Subcellular localization annotation: CTP_CleavageSite=36; ConfidenceScore=5.35e-01
VTLRVTTTPAALIAPLQGASHSPFRLRNCREGRSVRASLLLRQLAKGGCAARRLSWGELELHRGGGRSRTSGSPGLQEFDPFSPFFGAP

SEQ ID NO: 152576 - protein, 190 aa, Glycine max
  Coding DNA Sequence Number=SeqID_60891
  Homolog annotation: Hit_ID=Q2AA09; Match level="QueryCoverage=83%, HitCoverage=50%, E-value=5e-07, Identity=28%"; Hit description =Retrotransposon gag protein
MERSMIDAASGGALGDMTPAEARNLIEKMASNSQQFSARNDAIVIRGVHEVATNPSASFETKKLEGKLDALVNLVTQLALNQKSVPVARVCGLCSSTDHHTDLCPSMQQPGAIKQPEAYAANIYNRPPLPQQHNQPQQNNYDLSSNRYNPGWRNHPNLRWSSPQQQQQPAPSFQNAAGPSRPYIPPPIQQ

SEQ ID NO: 152577 - protein, 195 aa, Glycine max
  Coding DNA Sequence Number=SeqID_60892
  Homolog annotation: Hit_ID=UPI00006A2D9E; Match level="QueryCoverage =60%, HitCoverage=73%, E-value=2e-08, Identity=15%"; Hit description =UPI00006A2D9E related cluster
VDPWVLVPIFFRGLHVLTIRGLHVLTFREPHALAFRGLHVFNFRGLQVLVVKGSYTFTFVGLHALTFRGLHVLAFRGLHVLAIRDYMSPIFKGRHALTFRGLHVLAIIGLHSLAFKRRHVLNFRGLHTLAFRGPRVLIFRASSFLLSVPGSPPDIGGDRAHKTPSGPEEVQQGPWVSNSGYGPLSILQGARSPSE

SEQ ID NO: 152578 - protein, 72 aa, Glycine max
  Coding DNA Sequence Number=SeqID_60893
MEKIGGKQSNSRSMKEREWKIFRPDKFSARSFSTGDIPPRMNKEEKTETPSFLSKNTTLEKILLIRDRTCDL

SEQ ID NO: 152579 - protein, 146 aa, Glycine max
  Coding DNA Sequence Number=SeqID_60894
MWCTCRKPNKIFASLSGNFFLFGKSPTGNLVPLDLEIEATLRRNRAERRWKILQDRTVASILEEETHFSDLLSPDSPSSREFATQLPEVITMAEEHNQRITLEDYSSSSVPQFFTRIARPEVQANNINYPTFLNSFNTGELISRIT

SEQ ID NO: 152580 - protein, 114 aa, Glycine max
  Coding DNA Sequence Number=SeqID_60895
MKREKHVSYSSHDSCKSLSEELSDYYRGSHSSHTKHHSQRREKDKRPQEVNISLPYFHGKDNVEAYLDWEMKVEQLFACHHISEERKDPLAFKGMPSIGGLPLLGNEGFMGILQ

SEQ ID NO: 152581 - protein, 194 aa, Glycine max
  Coding DNA Sequence Number=SeqID_60896
  Gene Ontology: Mol. function=racemase and epimerase activity, acting on amino acids and derivatives; Biological process=amino acid metabolic process
  Homolog annotation: Hit_ID=A5KUC2; Match level="QueryCoverage=99%, HitCoverage=83%, E-value=7e-66, Identity=63%"; Hit description =Aspartate racemase
  Pfam annotation: Domain name=Asp_Glu_race; Domain location=1-194; Score=124.6; E_value=3e-34; Accession=PF01177.13; Description =AspGluHydantoin racemase
MIGLIGGMSWESTALYYRIINEQVKQQLGGLHSARSLMYSVDFQQIEKLQVAGEWQQAGEILAEAGRSLEKGGADFIVLCTNTMHKVADQITAATRIPLLHIADATAQRIRQAGVKRVGLLATAFTMEQEFYKGRLEQQYDIEVLVPDATGRKTVHDIIYQELCLGVIREESRAQYRDIIAQLVAQGAEAIILG

SEQ ID NO: 152582 - protein, 65 aa, Glycine max
  Coding DNA Sequence Number=SeqID_60897
  Subcellular localization annotation: CTP_CleavageSite=26; ConfidenceScore=5.28e-01
TYQGSPCGVCPDLSSFTGSGVYPDLSSFTRSGVYPDLSSFTGSGVYPDLSSFTGSGVIQIFIACI

SEQ ID NO: 152583 - protein, 153 aa, Glycine max
  Coding DNA Sequence Number=SeqID_60898
  Homolog annotation: Hit_ID=Q6WAY4; Match level="QueryCoverage=81%, HitCoverage=22%, E-value=2e-09, Identity=34%"; Hit description =Putative uncharacterized protein
MGANQNSKRFYQVKVKGLDVTSLKELGRLMGPLQRQAFRKVYGKILDLTIAEVFMEAIVSLTQYYDQSLRCFTLGDFQMVPTIEEFEEILGCPLEGEKTVSFLRFLPSLSKIAAVIGDSAKELDRMKQIPERRMGLPQKYLMQAGIWRAREWG

SEQ ID NO: 152584 - protein, 125 aa, Glycine max
  Coding DNA Sequence Number=SeqID_60899
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=41%, HitCoverage=50%, E-value=4e-24, Identity=100%"; Hit description=LacZ protein
MPILLCPPMVCLVHVLSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 152585 - protein, 236 aa, Glycine max
  Coding DNA Sequence Number=SeqID_60900
  Homolog annotation: Hit_ID=A5C169; Match level="QueryCoverage=72%, HitCoverage=14%, E-value=9e-09, Identity=27%"; Hit description =Putative uncharacterized protein
DGVPFEGTLNDDWKFDFSAHDARQLVCSNHADMTGRLLAGSLAFESRILHYLIVRILLPRSSNLAQVSVEDLVIMWAFHTGRQLDWAHLVRYRMHKALRLNAPLPYPHLVTLFLRHFQIPLDSEPYVPIKRSFLIGAAAIASFGYRKEHDGSWVKKGAQPADDEGNLPVEDNSSLLRRLLDKFDGLQTFVGDKFDAMELQVDMRFDAMELRITKVKEDVSFIRTCFDPPPPPPSSS

SEQ ID NO: 152586 - protein, 288 aa, Glycine max
  Coding DNA Sequence Number=SeqID_60901
  Gene Ontology: Mol. function=transferase activity, transferring glycosyl groups; Biological process=lipopolysaccharide biosynthetic process
  Homolog annotation: Hit_ID=Q1H3A1; Match level="QueryCoverage=99%, HitCoverage=83%, E-value=1e-107, Identity=68%"; Hit description =Lipopolysaccharide heptosyltransferase II
  Pfam annotation: Domain name=Glyco_transf_9; Domain location=56-288; Score=236.9; E_value=4.5e-68; Accession=PF01075.8; Description =Glycosyltransferase family 9 (heptosyltransferase)
MVLAQSLFKQLKIEQPDCQITVAAPAWTLPLLERMPEVSHAIALPFKHGDLALRERFKLGRELAKQGFTQAILLTNSLKSAILPWAARIPVRTGFKGEMRYGLVNDMRPLDKSSLKQTVQRFIALGLPRHATLPESLPQPSLLANAADAHSLLRKFDLPSRGMVLGLCPGAEYGEAKRWPTEYYAEVANAALSQGWQVWLFGSEKDQPVTANIQQQTQQRCVNLAGKTKLGEAIDLMSLCHTVISNDSGLMHVAAALDKKLIAIYGSSDPKHTPPMHPQAVIEYLGLT

SEQ ID NO: 152587 - protein, 269 aa, Glycine max
  Coding DNA Sequence Number=SeqID_60902
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLTDFQAGLDVNGVYADRFKSASSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152588 - protein, 72 aa, Glycine max
  Coding DNA Sequence Number=SeqID_60903
  Subcellular localization annotation: CTP_CleavageSite=54; ConfidenceScore=5.66e-01
MVKVGTSYVPINVSFSPKVGRAVGFPVSTGSTRNCSFILSSCSATDGVVIRVIRQKHTSRKHQRKCSRARCA

SEQ ID NO: 152589 - protein, 272 aa, Glycine max
  Coding DNA Sequence Number=SeqID_60904
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFLTADYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152590 - protein, 101 aa, Glycine max
  Coding DNA Sequence Number=SeqID_60905
MIGPLDESISYFFIRVNPWVHALAFRGLHVLTFRGLHVLTFRGLHVLTFRGLHVLAVRGLHVLAVRGLHVLAVRGLHVLAFRGLHVLTFRGLHVLTFRGLH

SEQ ID NO: 152591 - protein, 122 aa, Glycine max
  Coding DNA Sequence Number=SeqID_60906
MKREKHASYSSHNSCKRLSEELRDYYEGRHRSHLRPHSHRREKEKESLKRLTLTSHTSMGRKIGHITSQCPTTKTMIMRGQEIYSAKMRLLLHLPLVKVKKQKGKNLLKKSTPEEEGQPLMV

SEQ ID NO: 152592 - protein, 63 aa, Glycine max
  Coding DNA Sequence Number=SeqID_60907
  Subcellular localization annotation: CTP_CleavageSite=30; ConfidenceScore=5.20e-01
MSMKNLVRRQGLHDKPNHTLVSQVTLTRFKGALKSGVFTPKTYTPKSPSGPLSPDSGPTQKTF

SEQ ID NO: 152593 - protein, 179 aa, Glycine max
  Coding DNA Sequence Number=SeqID_60908
  Homolog annotation: Hit_ID=Q6WAY4; Match level="QueryCoverage=67%, HitCoverage=21%, E-value=8e-11, Identity=31%"; Hit description =Putative uncharacterized protein
MGSSQKPSLKKRFYQVKIKSLEVTSLRKLGQLMGQLQRQAFHKACGKIWDLARVEVSMEPIASLSQYYDQPLRCFTFEDFQLVPTVKEFEEILGCPLGGRKPYLFSGFYPSTTRVAKVVKISAQELDRKEGRIRILSSCEGCPMRGVPSDESITPFIARDFSDHNARVLQGVRKAWDAA

SEQ ID NO: 152594 - protein, 135 aa, Glycine max
  Coding DNA Sequence Number=SeqID_60909
  Gene Ontology: Mol. function=hydrolase activity; Cellular component =integral to membrane
  Homolog annotation: Hit_ID=A8AN33; Match level="QueryCoverage=100%, HitCoverage=99%, E-value=2e-48, Identity=71%"; Hit description =Putative uncharacterized protein
  Pfam annotation: Domain name=LrgA; Domain location=18-127; Score =107.8; E_value=3.4e-29; Accession=PF03788.5; Description=LrgA family
MAFAPARVAPFVMQRLQVPVQVLLYAGLFVCAEYLVNWLHLPLPANLVGMLMLLMLIVCRVIPLNWVRAGARWLLAEMLLFFVPAVVAVVNYAQLLMIDGWRIFLVIGLSTTMVLGATAWVVDKVYRYEVSRFER

SEQ ID NO: 152595 - protein, 216 aa, Glycine max
  Coding DNA Sequence Number=SeqID_60910
MGDQEETQEQMKADMSALKEQMASMMEAMLGMRQLMEKNVATATAVSSAAEADPTLLATAHHPPSNIVGRGRNTLGHDGNPHLGYNRVAYPYGLPPNYSPPVLQDDAGHIASPVLEREPPQQPDEVHEDPQDYARRDVEFYPPIPEGPAPSTLPQPNITTQPIVLSMEGPPPATEERRKLDLLEERLRAVEGFGDYPFADMTDLCLVPDVVSPRSS

SEQ ID NO: 152596 - protein, 142 aa, Glycine max
  Coding DNA Sequence Number=SeqID_60911
MVISPGVTCPAQGRRVYRFPGRDSSPAVGITGHPHGQVRSRHSPRILCQCLAYRGGRARYEVLVKGQWIPFDADAIGQLLGYPLVLEEGQECEYGQRRNRSDGFDEEAIAQLLCIPGQDFARTAAGRRVRIMRTNMTTLTQI

SEQ ID NO: 152597 - protein, 303 aa, Glycine max
  Coding DNA Sequence Number=SeqID_60912
  Homolog annotation: Hit_ID=Q6WAY4; Match level="QueryCoverage=58%, HitCoverage=36%, E-value=2e-14, Identity=29%"; Hit description =Putative uncharacterized protein
MGSSQKPSLKKRFYQVKIKSLEVTSLRKLGQLMGQLQRQAFHKAYGKIWDLARVEVSMEPIASLSQYYDQPLRCFTFEDFQLVPTVKEFEEILGCPLGGRKPYLFSGFYPSTTRVAKVVKISAQELDRVKQNRNGVVGVPRKFVLFPNMEGLVDLAAIDAFLAFHHGKESPVVAILAMYDTFDWGCEKSGARIEGRIRILSSCEGCPMRGVPSDESITPFIARGFSDHNARDRELRGSSNGIIGGYHKWLRVRTQGLDWLPNLKTVRDDEVKASKESDEVQALKAELERAWVVEEKFKSIAIK

SEQ ID NO: 152598 - protein, 114 aa, Glycine max
  Coding DNA Sequence Number=SeqID_60913
MHETQCGPPRVHRMNRKAWFEKIGGEACHPARPSEQGCFLQKQQPSGGIFWRAVASGGIFWRAQVGLVALEKQIVVKDATEKKKEEVTDVTSQESEKPIMVEEKEINDQEKEIE

SEQ ID NO: 152599 - protein, 48 aa, Glycine max
  Coding DNA Sequence Number=SeqID_60914
MWTTTGEVVAAQLAQASQVASSRSNNLLEESSGGPKWAWLLFAPPFFY

SEQ ID NO: 152600 - protein, 75 aa, Glycine max
  Coding DNA Sequence Number=SeqID_60915
MEDEPSEATIPKPFVVGEEAAFCTSGGPTFTSAYNRPILEIPEDPTTLVLTLDTSPPTTPILHLTDEEDVQTQDT

SEQ ID NO: 152601 - protein, 58 aa, Glycine max
  Coding DNA Sequence Number=SeqID_60916
MSGCGEYQLDGAQIFLLDAFNAQMQRLLRENNEELYERTKRLENRERHEDERRGGNGA

SEQ ID NO: 152602 - protein, 229 aa, Glycine max
  Coding DNA Sequence Number=SeqID_60917
  Homolog annotation: Hit_ID=A4W9M1; Match level="QueryCoverage=63%, HitCoverage=50%, E-value=3e-77, Identity=92%"; Hit description =Putative uncharacterized protein precursor
  Pfam annotation: Domain name=DUF481; Domain location=1-145; Score =144.1; E_value=3.9e-40; Accession=PF04338.3; Description=Protein of unknown function, DUF481
MTDYDYLFGQASWLTDRYNGYRQRDVFTAGYGRQFLNGPVHSFRFEFGPGVRYDEYTDGDTKTQPLGYASGTYAWQMTDNTKFTQGVSVFGADDTTLNSETALNVAINEHFGLKVAYNVTWNSSPPETAPDHTDRRTTVSLGYKILSNRADTCPFTGSIRLCQRRVGLRTSGIVRRESTINLSLKGCSISQPFYWIRSWYAPLGLKICSRVAQHFRNASTGNWPPANSC

SEQ ID NO: 152603 - protein, 256 aa, Glycine max
  Coding DNA Sequence Number=SeqID_60918
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLDSTFNFERLDILRDSIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152604 - protein, 103 aa, Glycine max
  Coding DNA Sequence Number=SeqID_60919
MSLHVLYLYAFSGFPPTDFPSAVSLVTIFQRNELGFEALVLTLVSNLALICDHLSPSARGRIILSYLLGWGPNMNRRNQPKVHRDGCKWGRGHNRLIVAPSPR

SEQ ID NO: 152605 - protein, 191 aa, Glycine max
  Coding DNA Sequence Number=SeqID_60920
  Subcellular localization annotation: CTP_CleavageSite=14; ConfidenceScore=5.16e-01
MVKVGTSYVPINVSFSPKVGPGLPGINRDMPSVPPVQLLTGNGVIRSQFGTQAYQPEASALASVKPGVPNDADATTHTPRLIALALQGCPLSHVGKPSGAKGRMCCILAITMLGTLMPGCSQSRSAFMWQEKKAAPVRQSEYVNTGLTIGPRIPRSELATARSSTAASAQNYGLSPTGAEFLDYGWVLFMP

SEQ ID NO: 152606 - protein, 126 aa, Glycine max
  Coding DNA Sequence Number=SeqID_60921
  Subcellular localization annotation: CTP_CleavageSite=29; ConfidenceScore=5.51e-01
SSAPFVPPGTTKSFTCGNFMVTRDSRQPRGAKLVSYTGFRGPLLDDMRPFFGPCEERQVTVTRDSRQPRGAKLVSYTGFRGPLLDDMRPFFGPCEGQLSYPNFVRGPLLDNVRPFFGLREVLGTHH

SEQ ID NO: 152607 - protein, 289 aa, Glycine max
  Coding DNA Sequence Number=SeqID_60922
  Homolog annotation: Hit_ID=Q2HW90; Match level="QueryCoverage=74%, HitCoverage=41%, E-value=6e-22, Identity=33%"; Hit description =Putative uncharacterized protein
MANQEEWVPFADILAFLIFGVVLFPNLDGLVDLAAIDAFLAYHHSKESTVVAVLVDLFDTFDRRCEKNSARIICCLPALCVWLVLHLFQQDIRHSCSLQSYRSCVEKRRVDWDQCLAGIGGSTINWFPRWKEGKEGVLFSCGDYPNVPLIGMRGCINYNPTLAIRQLGYPMRGAPTEESLSPFLMRDFGAQSFKIVQRVHKAWKSPLRKDKELRGIRNGIIGGYHEWLKVHTRGLDWLSMLKIINEENFEALEEDEEIQALKSELAKERLAKEKFKSAATNIRKECAEL

SEQ ID NO: 152608 - protein, 94 aa, Glycine max
  Coding DNA Sequence Number=SeqID_60923
MVFHLRLVVSFKTRKGKQGSKGLSKELIQGKSIWLEAFKNKIASIISKYACELGSINKNQAKAIVQNRTSVIKAKKEIGKEELPKSWWRKSRVE

SEQ ID NO: 152609 - protein, 62 aa, Glycine max
  Coding DNA Sequence Number=SeqID_60924
LHYVVARGPQVYPSNLPNNWYQSRWFKMASEQGKYRRWPWLYSWMIKTSARGGDYYVEETHT

SEQ ID NO: 152610 - protein, 152 aa, Glycine max
  Coding DNA Sequence Number=SeqID_60925
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
  Subcellular localization annotation: CTP_CleavageSite=44; ConfidenceScore=5.41e-01
MTMITPSSKLTLTKGNKSWYRAPPRGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRAVAFAVTHHPVSS

SEQ ID NO: 152611 - protein, 101 aa, Glycine max
  Coding DNA Sequence Number=SeqID_60926
MIMIVDILPVFYYEKMVGYTPSSFTDLVFASKKIEVGLKRGKFNHPAWTNEKTGANEEGEDEGETHAMTAIPVRPSFPPTQQCHYPTLLLTYHPFIHQGHP

SEQ ID NO: 152612 - protein, 92 aa, Glycine max
  Coding DNA Sequence Number=SeqID_60927
MVVLCVILKFEWVMIFTHGMTLNKLSTKRARKATVGEGSGAAPQGGDEDMTKSKGKDPLEGLGGPMTRARARKAKEALQQVLSILFEYKPKF

SEQ ID NO: 152613 - protein, 69 aa, Glycine max
  Coding DNA Sequence Number=SeqID_60928
  Homolog annotation: Hit_ID=A5BIJ0; Match level="QueryCoverage=72%, HitCoverage=2%, E-value=6e-08, Identity=52%"; Hit description =Putative uncharacterized protein
MGLGGVLMQNGKVVAYASRQLKTSLLGLTKICLIKEEVKKKFDVGFLAVARYLEWVADIVSVPKKDGKL

SEQ ID NO: 152614 - protein, 97 aa, Glycine max
  Coding DNA Sequence Number=SeqID_60929
MTLLLCNVLPSDRNADLPLRKYQLGSWLLDTQWTRRNPTGPWGFQLWECPLPPTSSSGPLLTGLSSRSSAPPGRRKAKHHNSLGRAGSGQQTHRHHL

SEQ ID NO: 152615 - protein, 75 aa, Glycine max
  Coding DNA Sequence Number=SeqID_60930
MKNGKERTKTFTDLLTETSRKGYGSTSAWIFFTEIIFLSKFERERSAKGAEPISTSLLPLFIENWGRSLPPSSPK

SEQ ID NO: 152616 - protein, 114 aa, Glycine max
  Coding DNA Sequence Number=SeqID_60931
  Subcellular localization annotation: CTP_CleavageSite=74; ConfidenceScore=5.37e-01
MLVRMIRTRLFAAARVKSCPGMHSSCVIASLSGCARTVGPPPISGGGPGTVRMWSTLKMRTRSPLKVRACNPLKARMYSPLEVRECSPLLARTCSPLNVRACSPLLARTCIPLK

SEQ ID NO: 152617 - protein, 286 aa, Glycine max
  Coding DNA Sequence Number=SeqID_60932
  Homolog annotation: Hit_ID=Q6WAY6; Match level="QueryCoverage=50%, HitCoverage=23%, E-value=3e-13, Identity=33%"; Hit description =Putative uncharacterized protein
MFDTFDRRCEKNSARIVCCLPALCVWLVSHLFQQDTRHPCPLQSYRSCAEKGRVDWDQHLAGIGGNAINWFPRWKEGKEGVLFSCGDYPNVLLIGTRGCINYNPALAIRQLGYPMRGAPTEGSLSPFLVKDLGAQGLKVIQRIHKAWRSPLRKDKELRGIHNGVIGGYHGWLRIHTRGLDWLSKLKVINEENFEAPEEDEEVRALKLELGKARLAKEKFKSAATHIRKECTELQEENAATARALEQETKRAHKEDMVERNSEEHCGVATMSSSSEERREIGHGCMA

SEQ ID NO: 152618 - protein, 81 aa, Glycine max
  Coding DNA Sequence Number=SeqID_60933
DSFEEQATQGSFVPHGRQDVLTAAIGRLEHPGRVRVAGAGFTIKQYFGLAPRTSRNSSSLPPEELQQLTQQIRDQLEESIT

SEQ ID NO: 152619 - protein, 306 aa, Glycine max
  Coding DNA Sequence Number=SeqID_60934
  Gene Ontology: Mol. function=nucleoside-triphosphatase activity; Cellular component=intracellular; Biological process=transport
  Homolog annotation: Hit_ID=Q1GZG3; Match level="QueryCoverage=100%, HitCoverage=88%, E-value=1e-149, Identity=86%"; Hit description =Twitching motility protein
  Pfam annotation: Domain name=AAA; Domain location=84-265; Score= -40.7; E_value=0.076; Accession=PF00004.20; Description=ATPase family associated with various cellular activities (AAA)
  Pfam annotation: Domain name=GSPII_E; Domain location=1-231; Score =59.5; E_value=1.2e-14; Accession=PF00437.11; Description=Type IIIV secretion system protein
  Pfam annotation: Domain name=SRP54; Domain location=81-216; Score= -128.4; E_value=0.072; Accession=PF00448.13; Description=SRP54-type protein, GTPase domain
  Pfam module annotation: Pfam domain module=AAA::GSPII_E::SRP54; Domain location=84-265::1-231::81-216
MEHAEVHRMLYDIMNDSQRKVYEETLECDFSFEIPDLARFRVNAFNQQRGAGAVFRTIPSKVLTLDELNAPKVFKDIADTPRGIVLVTGPTGSGKSTTLAAMIDYINETQMSHVLTVEDPIEFVHTSKKSLINQREVGPHTQSFENALRSALREDPDVILVGEMRDLETIRLALTAAETGHLVFGTLHTSSAAKTIDRVVDVFPAAEKEMVRSMLSESLRAVISQTLCKTKDEQGRVAAHEIMMGTPAIRNLIRENKIAQMYSAIQTGQSMGMQTLDQNLQDLVKRNVISAAEARTKAANRDTIIG

SEQ ID NO: 152620 - protein, 152 aa, Glycine max
  Coding DNA Sequence Number=SeqID_60935
MRPDPQELAAKLCIPGRGFELNAYGQPLKILRKNMTTLAQTWSVLSFSNLILTSHTSDVTLDRAKLIYGIIMKMDMNVGYLISHQISPTAQHDTSILGFPTLIIALCKTKEVQSDLKSLESLSPTINLAYIKNNCWNLDDPIVTFRGPRKAR

SEQ ID NO: 152621 - protein, 107 aa, Glycine max
  Coding DNA Sequence Number=SeqID_60936
MDSGRFQVSVPGNSYPIYTAPTLNLGGLFKNCQGCGSLWVDTEAILLKFQRVYHINACPYSLRAYSARMECPRAPPRYAHVAFESYPQKNGGLREPSRGYGYHCIIK

SEQ ID NO: 152622 - protein, 26 aa, Glycine max
  Coding DNA Sequence Number=SeqID_60937
MKKNCLKFKSWMDKKGYGKPKEASGK

SEQ ID NO: 152623 - protein, 236 aa, Glycine max
  Coding DNA Sequence Number=SeqID_60938
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLYFAIYMRVQGILIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152624 - protein, 52 aa, Glycine max
  Coding DNA Sequence Number=SeqID_60939
MMGDASKFTHISPKKSRHVTYGDKNKGRILGVGKIDQKQNHDQCFLSKDDDP

SEQ ID NO: 152625 - protein, 266 aa, Glycine max
  Coding DNA Sequence Number=SeqID_60940
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFQTNTHKPQSRSYTAPSLITARLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152626 - protein, 160 aa, Glycine max
  Coding DNA Sequence Number=SeqID_60941
MEGLVDLVAIDAFLTFHHGKESPVVAILAMYDMFDRGCEKSGARIDSIFMRRMSHERSAIRRKHHAFHRMSNGIIGGYHKWLRVRTQGLDWLPNLKTVRDDEVKASEESDEVQALKAELERAWVVEEKFKAAIVSSNSEEVKGIITGQRHDLEGRAKGLP

SEQ ID NO: 152627 - protein, 85 aa, Glycine max
  Coding DNA Sequence Number=SeqID_60942
MTHQDFQVQAIGLFAQATCASEFGLPRPFNQRLLILHVGGGAVKQRGQPFPCVQESPTTRDPRSLNPFSEIRRREEEISLKRDGL

SEQ ID NO: 152628 - protein, 135 aa, Glycine max
  Coding DNA Sequence Number=SeqID_60943
  Subcellular localization annotation: CTP_CleavageSite=42; ConfidenceScore=5.55e-01
MVKVGTSYVPINVSFSPKVGPGLPASFNTAPGRARISCLFAKCSSGVSGFYQLSLPVQLLTGNWLSAQFGKSIPAGTSALASVKPGGVQSRMRSVAKKAAPVRQHEYVNTGLTIPGEFLAHELATARSFMRRRKA

SEQ ID NO: 152629 - protein, 122 aa, Glycine max
  Coding DNA Sequence Number=SeqID_60944
  Subcellular localization annotation: CTP_CleavageSite=29; ConfidenceScore=5.07e-01
MVKVGTSYVPINVSFSPKVGPGLPGIAYSAQYRAPRLFPPVQLLTGNWSLNRQKHTDRNISAGKCKAGVPKTLTLTHHSPCVALHCAAIPVGRVAIRCIHELRNCCAKGDRCGPLAYYASWR

SEQ ID NO: 152630 - protein, 113 aa, Glycine max
  Coding DNA Sequence Number=SeqID_60945
  Subcellular localization annotation: CTP_CleavageSite=76; ConfidenceScore=5.00e-01
MDLTTLAQVWSFLSYSNLAPTSRTFDLTVDRARLIFGLVFHLDMNIGVLVSGQMTSIAQSNTSRLGFPALITTLCRARGVVSNLAYIRKNYWNPDDLIVSIRGARRARTRQAN

SEQ ID NO: 152631 - protein, 45 aa, Glycine max
  Coding DNA Sequence Number=SeqID_60946
MEKRANEKRREQVKKKRANKEKESKVNAVKFPRTPEMDLDECTNG

SEQ ID NO: 152632 - protein, 162 aa, Glycine max
  Coding DNA Sequence Number=SeqID_60947
  Subcellular localization annotation: CTP_CleavageSite=58; ConfidenceScore=5.06e-01
MDPKKSHRALGFPTLVTGLCQSYRVPVPPARSCHRDIGIAPTKTPSGPREVQQGFGVSSSGIVPARHPVDPKKSNRVLELSSSNYGSIKGIRPLTNRAFIKKYCIPRQAQGETPQQPGGWPATGNRCTAITSRVHLSSSTKEARALLTTHGRPTGGQVRSQR

SEQ ID NO: 152633 - protein, 28 aa, Glycine max
  Coding DNA Sequence Number=SeqID_60948
MARRLQEDWARDVGEGPRVLMSLRGSIV

SEQ ID NO: 152634 - protein, 138 aa, Glycine max
  Coding DNA Sequence Number=SeqID_60949
MEAMKEQMATMMEAMMSMKKIMEANAVIVAATSAVAKVNPMLPSGLKKMNHPTSNMAHISQTMGETHEIPHHNLADFEPCLGYATEGQAVGGIPLQNTLEGPQCHPQPQPSHSTAVKNPHAMAEMGKRKGLGPLKEVR

SEQ ID NO: 152635 - protein, 69 aa, Glycine max
  Coding DNA Sequence Number=SeqID_60950
MSPVHLLRVCVTLTTVLGTQDCKAPKSFGSLAYDVEAMSSKVILMIPKNQELSKFQRFKNQVSRIKIQE

SEQ ID NO: 152636 - protein, 137 aa, Glycine max
  Coding DNA Sequence Number=SeqID_60951
  Gene Ontology: Mol. function=chlorophyll binding; Cellular component =integral to membrane; Biological process=photosynthetic electron transport
  Homolog annotation: Hit_ID=Q2MI75; Match level="QueryCoverage=86%, HitCoverage=33%, E-value=1e-44, Identity=56%"; Hit description =Photosystem II P680 chlorophyll A apoprotein
  Pfam annotation: Domain name=PSII; Domain location=1-137; Score= -161.8; E_value=0.00053; Accession=PF00421.10; Description =Photosystem II protein
MHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGLLSLLGLCGWFSNNPY

SEQ ID NO: 152637 - protein, 93 aa, Glycine max
  Coding DNA Sequence Number=SeqID_60952
MQSAHLTWFPELGKRAALSGNAINRRVLYTCPLMLPARYAFAELRGYHPDFIAEQEEQLIETRYATEHLKLTLTTLGNQKFGHPRGRTCKQSN

SEQ ID NO: 152638 - protein, 132 aa, Glycine max
  Coding DNA Sequence Number=SeqID_60953
MTPSTEDVKKAMQGLFVVLQLSMWGWFHTFFSKKVGPSICYKVTARASKRKTNWDQLLASMEGRLLMVPSLEGRKNQDCIFMRRLDWLPSLKTVRDDEVKASEESDEVQALKEELERARVVEEKFKSIAIKV

SEQ ID NO: 152639 - protein, 143 aa, Glycine max
  Coding DNA Sequence Number=SeqID_60954
MQFGDYIAPVGQLCAVPGHCSPDYMDWFYMISHPFMSSMQPGDPLRVPPVQQHEEFVEPDMYQQPMAATTPNEADIDEHHLRHVVDDFVAIADRLDMLLNLRILTKGTKAYTVVEECVGITRRYIGQLTIRHISRRRRRMNGH

SEQ ID NO: 152640 - protein, 62 aa, Glycine max
  Coding DNA Sequence Number=SeqID_60955
MTAAFAIQVPTVRERADRCQGLFAIKNRHAAKGEMCCKFAIKLGNAGVSITAYYVVKLMTGQ

SEQ ID NO: 152641 - protein, 145 aa, Glycine max
  Coding DNA Sequence Number=SeqID_60956
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MDNFFAPVFTMGKYYTQGDKVLMPLAIQVTGLEERRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGGGYAQRDRYTCQR

SEQ ID NO: 152642 - protein, 184 aa, Glycine max
  Coding DNA Sequence Number=SeqID_60957
  Homolog annotation: Hit_ID=UPI0000ECBAF8; Match level="QueryCoverage =23%, HitCoverage=50%, E-value=2e-17, Identity=100%"; Hit description= UPI0000ECBAF8 related cluster
MVTVGTSYVLINVSCSPKVGPGLPSINCDTRIYLFCEHRRTSALASVAVTLRVTTTPAALNAPLQGASHSPFRLRNCWEGRSVRAYSLLRQLAKGGCAARRLSWIEFLQPGGSTSSRAAATAGGAPIRPIVSRITIHWPSFYNVVTGKTLALPNLIALQHIPLSPAGVIAKRPAPIALPNSCAA

SEQ ID NO: 152643 - protein, 47 aa, Glycine max
  Coding DNA Sequence Number=SeqID_60958
MSCTGSLSTPLHLTKCITSVHLLSEKARAKPKFTNRPELKAGAGLRA

SEQ ID NO: 152644 - protein, 67 aa, Glycine max
  Coding DNA Sequence Number=SeqID_60959
MIRQSSKLTPHYTNNKLASPDALPEKYLEVTEDQASIASNQNSIPPIGVPVVELGTTFGTNETLIGT

SEQ ID NO: 152645 - protein, 88 aa, Glycine max
  Coding DNA Sequence Number=SeqID_60960
MTDPGLISRLCFFVRAQPKLCCSRHWHTYQGNSCGVYPDLSSFTGSGVYPDLSSFIGSGVYSDLSSFIGSGVYLDLSSFTGSGVIQTL

SEQ ID NO: 152646 - protein, 172 aa, Glycine max
  Coding DNA Sequence Number=SeqID_60961
  Homolog annotation: Hit_ID=UPI00006A17C9; Match level="QueryCoverage =64%, HitCoverage=58%, E-value=2e-07, Identity=30%"; Hit description =UPI00006A17C9 related cluster
MAARLLPAAGHPQAAVHPVGLIEARNQSWKPQGPVGLFRVHWGEIGIAIAGQNARVKSCPGMHSSCVIASLSGCARTVGPPPISGGGPGTVWMSSTLKMRTRSPLKVRACSPLKARRCSPLEMRACSPLLARTCSPFKVRACSPLTVRACNPLMVRTCSPLKARTCSPLNSE

SEQ ID NO: 152647 - protein, 47 aa, Glycine max
  Coding DNA Sequence Number=SeqID_60962
MEKKMKNKELKSMAAEWRRKKYDWRRQFKEKMSQEQAHHHRNPWIRA

SEQ ID NO: 152648 - protein, 108 aa, Glycine max
  Coding DNA Sequence Number=SeqID_60963
MAYTHIPDSTSDSPQISASPYQLDFTLYASGSYNAQWNAPGLLHDKHTLRLSRILRKMEVEEPWLGLWLPLNYRVDMGSNLAYDNGIWGEPYRLFAAKFLFVGVFGLC

SEQ ID NO: 152649 - protein, 284 aa, Glycine max
  Coding DNA Sequence Number=SeqID_60964
  Gene Ontology: Mol. function=transferase activity, transferring glycosyl groups; Biological process=metabolic process
  Homolog annotation: Hit_ID=A8AIY1; Match level="QueryCoverage=98%, HitCoverage=87%, E-value=6e-86, Identity=58%"; Hit description =Putative uncharacterized protein
  Pfam annotation: Domain name=Glycos_trans_3N; Domain location=1-40; Score=-5.5; E_value=0.051; Accession=PF02885.8; Description=Glycosyl transferase family, helical bundle domain
MLADEVPDLELGGVLIALRIKGEGEAEMRGFYHAMQQRMMRLQAPAQRPMPIVIPSYNGARRQGNLTSLLALLLVKLGFPVLLHGVSDDPTRVTSEAVLAALDIAPVTSAQQAQAKLDAGELAFITIDDLCAPMAKQLALRWRMGVRNSAHTLAKLATPFAERAALRLASVSHPEYVPRVGKFFQDIDAPAILLNGTEGEVYANPQRCPAINYIRGAGAEAEVWVERQPEVALALAESKSAQDTAAWIRQVLAGERAVPQALRLQLACCLVATGEAATMADAET

SEQ ID NO: 152650 - protein, 151 aa, Glycine max
  Coding DNA Sequence Number=SeqID_60965
  Homolog annotation: Hit_ID=Q6UUU1; Match level="QueryCoverage=39%, HitCoverage=40%, E-value=1e-18, Identity=78%"; Hit description =Putative uncharacterized protein
EFDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPGGSSCALCSCLSVTGVIPLYA

SEQ ID NO: 152651 - protein, 42 aa, Glycine max
  Coding DNA Sequence Number=SeqID_60966
VHETLFDPSKRFLTILVLADGNLRLASRYGVPASQGWPSPFR

SEQ ID NO: 152652 - protein, 49 aa, Glycine max
  Coding DNA Sequence Number=SeqID_60967
MAITQATGLQMRTRLKMKGWKESLFSARATHKGCESPLYSRVFLNLSRT

SEQ ID NO: 152653 - protein, 67 aa, Glycine max
  Coding DNA Sequence Number=SeqID_60968
ETEQKAPYQDDELVGLQEVLEVDPDVINESLADVDGGGEKIDVDLLKQLDLVEPNEDKCMLSENDIE

SEQ ID NO: 152654 - protein, 78 aa, Glycine max
  Coding DNA Sequence Number=SeqID_60969
MQSSKHDVYLGASLNGALKGLDDVPQPKSKAPPRWIVVKCNRQKGSTECGYYVMHWMSTIILGSYRNNWKAYYLRVRA

SEQ ID NO: 152655 - protein, 271 aa, Glycine max
  Coding DNA Sequence Number=SeqID_60970
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISLRICEGVDVGCRCDSEARLGAFFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152656 - protein, 189 aa, Glycine max
  Coding DNA Sequence Number=SeqID_60971
  Gene Ontology: Mol. function=oxidoreductase activity; Cellular component=mitochondrial matrix; Biological process=metabolic process
  Homolog annotation: Hit_ID=A8GEH1; Match level="QueryCoverage=100%, HitCoverage=37%, E-value=3e-98, Identity=90%"; Hit description =Aldehyde dehydrogenase
  Pfam annotation: Domain name=Aldedh; Domain location=1-177; Score= -128.7; E_value=1.5e-08; Accession=PF00171.13; Description=Aldehyde dehydrogenase family
MEKVLARIATIRQGDPFDTDTMLGAQASQEQYDKILSYIDIAKNEGGNILAGGKRTQHGDELQNGFYLQPTLITGNNSMRFFREEIFGPVIGVTTFKDEAEALALANDTEFGLGAGLWTRDINRAYRMGRAIKAGRVWTNCYHLYPAHAAFGGYKNSGIGRETHKAALSHYQQVKNLLVSYDAKPLGLF

SEQ ID NO: 152657 - protein, 238 aa, Glycine max
  Coding DNA Sequence Number=SeqID_60972
MVILHTFSPFKHSRVRWHPETNAVFCAFCHPEATGPMTCGEKLWSFHTHFRHSDIVVSDGTQRLNFVVFCSLLSSRGGGLDDMRRQIMVIPHTFCHSDTVASDGTQRLNVVFCAFCHPEAAGPMTCGDKLLSFHTPFRHSDTVVSDGTQRQIMVFCAFFHPEAVGPIHAETNYGHSAHLFAIQTQSCPMVTQRQINVSFCALLSSRGGRPDDMRRQIMVIPAHLFTIQTQSCPMARRD

SEQ ID NO: 152658 - protein, 160 aa, Glycine max
  Coding DNA Sequence Number=SeqID_60973
MVGYAPSSFADLVFAGKRIEAGLKRGKFDHPTLISEKARANEEGLHVLAIRGLHVLAIRGLHVLTFRGLHVLIFRGLHILTFRGLHVLAFRGLHALSFRGLCALAIGGLHVPVFRGLHALTFRGLHVLAIRGLHALTFKGLLMCHHFLLFSKPFLHHFNY

SEQ ID NO: 152659 - protein, 113 aa, Glycine max
  Coding DNA Sequence Number=SeqID_60974
MYIKYGPKYIMKHSQQNMLSNETKTPTLIPKTIPKLQNSLRICELQNKERETKLKKAIKGINSREHQQESSQGYCASNQWGKTHQMIMMMDGSNSHNGKLITFKLSFQNYHDM

SEQ ID NO: 152660 - protein, 238 aa, Glycine max
  Coding DNA Sequence Number=SeqID_60975
  Gene Ontology: Mol. function=protein kinase activity; Cellular component=ubiquitin ligase complex; Biological process=protein amino acid phosphorylation
  Homolog annotation: Hit_ID=A5YJW4; Match level="QueryCoverage=90%, HitCoverage=38%, E-value=1e-81, Identity=64%"; Hit description=LYK8
MLQNCIDERNLLKGQKKPPRTSQSILEANELSATSVIFYFTPISVPLKTEPPVGIQRAATPPEDSPSPPPPPAPVEDGDSDSFKKLVIVGIVVGVTIPTTHSWSVSSEGVRYAIESLSVFKFEELQKATAFFGEENKIKGSVYRASFKGDYAAVKVLKGGVSGEINLLKRINHFNSIRLSGFCVYKGDTYLLYELAENDSLEDWLHSVNKKYENSVPLSWVQRVHIAHDVADALNYLQ

SEQ ID NO: 152661 - protein, 71 aa, Glycine max
  Coding DNA Sequence Number=SeqID_60976
VRSYQQYCTGPHQISAVKRAWARVVLGWVTSREVPVARSHYCIGSHQNSAVKRAWARVVLGWVTSSEVLVA

SEQ ID NO: 152662 - protein, 287 aa, Glycine max
  Coding DNA Sequence Number=SeqID_60977
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILVLAISLLSISIPTSTITKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152663 - protein, 132 aa, Glycine max
  Coding DNA Sequence Number=SeqID_60978
  Subcellular localization annotation: CTP_CleavageSite=46; ConfidenceScore=5.11e-01
MVKVGTSYVPINVSFSPKVGPGLPEATGTLVKNRDLTYCCEVSSVTAGVLSELTTTPAALIACRYRAARFPFEPFGANCINEWQRAGDRVRAFAYWAAGERVYTGINVGTDEAVSEVLHVAGVKKATASQNM

SEQ ID NO: 152664 - protein, 89 aa, Glycine max
  Coding DNA Sequence Number=SeqID_60979
MNELNHCYQKRKEHALRCPYRTRARARVMGEVEEVQKHMKADTEALKEKMSTMMKAMMSIQEIMEVNAAVIAAINTIAEVDLTLPPPIW

SEQ ID NO: 152665 - protein, 196 aa, Glycine max
  Coding DNA Sequence Number=SeqID_60980
  Homolog annotation: Hit_ID=A0PAV3; Match level="QueryCoverage=33%, HitCoverage=31%, E-value=6e-07, Identity=52%"; Hit description =Restriction endonuclease
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDGLHGQRTVMMSRCMGANSASRRFCCANAMPWAAMAACSTSTSALKSSLSIPSTSRGGPVPAFVPFSEG

SEQ ID NO: 152666 - protein, 72 aa, Glycine max
  Coding DNA Sequence Number=SeqID_60981
  Homolog annotation: Hit_ID=A5BD12; Match level="QueryCoverage=81%, HitCoverage=7%, E-value=3e-08, Identity=46%"; Hit description =Putative uncharacterized protein
MFKKLGYTPCKHTFDRNFDKFCELSPLIKAWIGKISKEKWTMAYDKEGRRYGHMTTNLSECVNKVFKGCLPL

SEQ ID NO: 152667 - protein, 110 aa, Glycine max
  Coding DNA Sequence Number=SeqID_60982
MFLKEYYLANPNGGSVPNLISNNISKLHENPTVNETEISHLNDEIKISNGENARNWAANVVLKFHDDPTVNESEIVVFLRQVRWLSGKRKDFGRREKKRNCETEEAEESI

SEQ ID NO: 152668 - protein, 97 aa, Glycine max
  Coding DNA Sequence Number=SeqID_60983
VIGCTICGGAHEFGHCIPCEEQTQEVSYMGNQQRQGNNQGGFSGFLQGSYNQQGKWRSHRGNQFNKDQGGPSNRPPQQGPNIFQRTTKLEETLAQFI

SEQ ID NO: 152669 - protein, 699 aa, Glycine max
  Coding DNA Sequence Number=SeqID_60984
  Gene Ontology: Mol. function=GTPase activator activity; Cellular component=cytoplasm; Biological process=regulation of GTPase activity
  Homolog annotation: Hit_ID=A7P0N2; Match level="QueryCoverage=99%, HitCoverage=99%, E-value=0.0, Identity=56%"; Hit description =Chromosome chr19 scaffold_4, whole genome shotgun sequence
MEAHASSFVSKARTAFHSAAAKAERVLMDFKIDLDSDKQFHDEFGRQRGDESARSEKFLDELKHIKWRPPHIGTKQDWQDRINNMRKGRKEVEVTDKVGDVSMASAPFYDENMYILNVKNDLDAKASEAIPSVEGLTAATKYPIPPSSVLKQLAIAIESGRQTNSMKDFVASSRGSSPAREKAGLSLSSVKALVLREKEDKLTSEFSSDEKVVYLINSLFDQEGEFLKRNSDPEETFISSLPRDIHGAPLESLVVKLAEVIGNFKTLREMSLFWSRVVDELRKHWSEEKHLPGIPPDDIPDLKSCLLYQQFQVINCCISRKKRHIIATESLDTMVMEANSNALESANYTGKIPTGPLLYARLRTGELVLRLGADCPSGDLTLLETGEPAYSPVTQEGPLLTEDLIKETEEFVLRTGSVGAGCSQLLSDMQAFKAANPGCILEDFVRWYSPPDWSESEGSTEDRDSSYGGESMSTRGQLSLRMQKEGNLWRELWETSKPVPAVKQAPLYDEDLAVEDILDAFEDIQPSELFGQLFVSLLSFGFAIAETMLYGDLDLSKLFNDCKEYIVTTCQSDRFNEKIDELVQMYETVEKMLLNPDEALKMKHMEESTMTTDESKRRFSTGEPKHRFKRLSHIFGGKDKLLTRPVCKNEVNDEETQIRHSFSSFFDSKSSLFSKKPPKPGNLYPAEQPLSLESDRTVI

SEQ ID NO: 152670 - protein, 354 aa, Glycine max
  Coding DNA Sequence Number=SeqID_60985
  Gene Ontology: Mol. function=hydrolase activity, acting on ester bonds; Cellular component=cellulose and pectin-containing cell wall; Biological process=lipid metabolic process
  Homolog annotation: Hit_ID=A7P0N6; Match level="QueryCoverage=77%, HitCoverage=76%, E-value=6e-83, Identity=56%"; Hit description =Chromosome chr19 scaffold_4, whole genome shotgun sequence
  Pfam annotation: Domain name=Lipase_GDSL; Domain location=93-352; Score=104.4; E_value=3.4e-28; Accession=PF00657.13; Description=GDSL- like LipaseAcylhydrolase
MKNDVIEGQQRVVVEDWLTVKEQWESGETPVPEEDIEMIRAKLGELDGKFVPKPIVVMTEKDYDRDPEILKQLHPFKVFVLCSALKAQKAPAVYVFGDSLVDVGNNNYLSLSIEKAILPHYGIDFPTKKPTGRFSNGKNAADLIAENLGLPTSPPYLSLVSKVHNNNKKNVSFLGGVNFASGGAGIFNASDKGFRQSIPLPKQVDYYSQVHEQLIQQIGASTLGKHLSKSIFIVVIGGNDIFGYFDSKDLQKKNTPQQYVDSMASTLKVQLQRLYNNGAKKFEIAGVGAIGCCPAYRVKNKTECVSEANDLSVKYNEALQSMLKEWQLENKDISYSYFDTYAAIQDLVHNPASY

SEQ ID NO: 152671 - protein, 20 aa, Glycine max
  Coding DNA Sequence Number=SeqID_60986
MENDKYKGFGGRLKHNWTRY

SEQ ID NO: 152672 - protein, 521 aa, Glycine max
  Coding DNA Sequence Number=SeqID_60987
  Gene Ontology: Mol. function=DNA binding; Cellular component=nucleus; Biological process=regulation of transcription
  Homolog annotation: Hit_ID=A1XI89; Match level="QueryCoverage=17%, HitCoverage=32%, E-value=7e-29, Identity=53%"; Hit description=MYB1
  Pfam annotation: Domain name=Myb_DNA-binding; Domain location=199 -244; Score=44.2; E_value=4.6e-10; Accession=PF00249.22; Description =Myb-like DNA-binding domain
MTPTMSFRPTSNIVDCACRLGGGAMREHDDVGGRSELWLDEKFKESEEMVGWGGIKSLRRSGRGRFRRKKRLERGRCRNHWLLELFGTANLATTPPLFAAIVRPPPVAASTTTVINYFLVTTRLMEGMAISDDASNGENGFLAMFGGDESGGGGSGGVGSGGDQGGGNVEDVALKKGPWTTAEDVILMDYVAKWPNLKKGAFSPEEEKLIVDLHAQFGNKWARMAALLPGRTNNEIKNYWNTGIKRRQRQGLPLYSDEHDQHNRSTTPTPPTTPFPCLTPTGSNPDIATSFELFNQNQQQHHQQQQQYQYQQQQQYQQHPLSPTASHHSPLSSPLQHRQPFTSSSPHNFLDHSPLPLSSSYSPSPLSFTFQRPAPMLSTPLRFKRYCASPSYNNNNNNNNLSDPPLTTQFPHLDGFRFPVSSGFSQFFQPSLLDSDRGVSSSSSSLAFQPKLELPLSQYYKPSQEQDIKLDIEFNDPSFQSSSSGLMGDLLFEAQAMASGKNSKKRGYLSLNEGNNVFNAC

SEQ ID NO: 152673 - protein, 128 aa, Glycine max
  Coding DNA Sequence Number=SeqID_60988
  Homolog annotation: Hit_ID=A7P0R1; Match level="QueryCoverage=37%, HitCoverage=61%, E-value=4e-08, Identity=68%"; Hit description =Chromosome chr19 scaffold_4, whole genome shotgun sequence
MGNCLKNQSPTKYDGGSDDDNDDWDFLTGEEGSFVTTKAATAAKTVTEVKIKITKKQLEELLSKVDVRELRVEQVLSQLMNHSSGGFQSFQRPWRPALQSIPEVVLVVIECMMELMMMKKRIGLLGQS

SEQ ID NO: 152674 - protein, 108 aa, Glycine max
  Coding DNA Sequence Number=SeqID_60989
MDSSKASELAMDFPQYRRSQLSSNTYHALIHLLSHISAYNASIQPLNIPVLLISGTNAIDVVAGFAVNAIATAPCCGGAWAFRVSVVWVFGSPCKVALMWRMCLKLPK

SEQ ID NO: 152675 - protein, 558 aa, Glycine max
  Coding DNA Sequence Number=SeqID_60990
  Gene Ontology: Mol. function=serine-type peptidase activity; Biological process=proteolysis
  Homolog annotation: Hit_ID=A7NTQ5; Match level="QueryCoverage=81%, HitCoverage=66%, E-value=0.0, Identity=71%"; Hit description =Chromosome chr18 scaffold_1, whole genome shotgun sequence
  Subcellular localization annotation: CTP_CleavageSite=42; ConfidenceScore=5.84e-01
MATLAIAVLTLTTRFSSSSSPYYSNFFFTRSFNHFTTNNCKRAMASSAATTIPSLSERITAPYGSWKSPITTDVVSGASKRLGGTAVDGRGRLIWLESRPAESGRGVLVVEPENPGGEAVDITPKEFGVRTVAQEYGGGAFTVSGDVVFFANYKDQRLYKQSISSLDVPPIPLTPDYGGPVVSYADGILDVRFNRFISVREDRCESSQNPTTTIVSIALGSKDAQEPQVLVGGSDFYAFPRLDPKSERMAWIQWSHPNMPWDKSELWVGYISENGEIYKRVCVAGNNPSLVESPTEPKWSSDGELFFITDRENGFWNLHKWIESENKVLPVYSLEAEFARPLWIFGMNSYEFLQSHTRKNLIACSYRQQGKSYLGIIDDVKGSKLTVLDIPFTDIDNITSSNNYLFVEGASAVHPSSVAKVTLDNDKSKAVDFNIIWSSSPDSLKYSSYFSKPELIEFPTEVPGQNAYAYFYPPTNPDFQASEEEKPPLLLKSHGKSGVGTTRSNPPHMAAVDALEVDLITLFGSIHLYQDRSMCAFLLKVQEIADVLVSVGSLISPQ

SEQ ID NO: 152676 - protein, 88 aa, Glycine max
  Coding DNA Sequence Number=SeqID_60991
MRKRTSEPHKQNHRHRGTKQRVRDDLGCGQEVLWTLDMVKKSSGHSGFCSSFGHGLERMQNLCEVEEHAAMPAKQTTVILSMDEHAQA

SEQ ID NO: 152677 - protein, 60 aa, Glycine max
  Coding DNA Sequence Number=SeqID_60992
  Homolog annotation: Hit_ID=A7P899; Match level="QueryCoverage=100%, HitCoverage=15%, E-value=2e-08, Identity=44%"; Hit description =Chromosome chr3 scaffold_8, whole genome shotgun sequence
MALFRVLPCLSDGLVLYFVPIVVFMVFARFNGKIVVKNLKSGYDSMVEDQVYVSGTIANW

SEQ ID NO: 152678 - protein, 623 aa, Glycine max
  Coding DNA Sequence Number=SeqID_60993
  Gene Ontology: Cellular component=plasma membrane
  Homolog annotation: Hit_ID=A7Q647; Match level="QueryCoverage=94%, HitCoverage=54%, E-value=1e-41, Identity=37%"; Hit description =Chromosome undetermined scaffold_55, whole genome shotgun sequence
  Pfam annotation: Domain name=DUF594; Domain location=532-591; Score =88.6; E_value=2.1e-23; Accession=PF04578.4; Description=Protein of unknown function, DUF594
GPCFTRGGLGGFVYDQKRGSNPFDVKVTYTLLYGAVALDLVSAFMLIFSDHSFALIYPHISKKISDSDGGKETSKLASILSCFLKLKRPKWREQKLKEPKWLQNKSYKILCRFMLVRRWSESISGFNLVSYCLHKRKLRLVDNKVIEYIGFKEPLEQWLCEKKQPLLQKLWIFIFTELERKSSDADDVETIQRICSSRGEWVLQEGELPRKDLNKLMSYVERNEVTFDQCLILWHIATDLLFYADKDEEDERKKKQHDDAKKNDALDLKKGPISGDGQNHNENDDAQDLEKGIIDKRQKNNEIAPDDHVKKESSEGQKKNEIAPDDVNKGSAEGKKKNENAGHKDDLVKNDFGDVDELRDFSKLLSDYLLYLVIMQPNMMSAVRGIAQIRFQDTCAEATNFFSKRQMMAEGERKMEAQGKKRKRDEEKALQKSNTMRLPPDQRIALQAKDMCKTLYDGFIGFFKKVFNSISCRRNFFQVKEENGTEKSDEQEACMRLREVCVDHEPSAVKGDRSKSLLFDACKLASVIDGLRLEEPDKWKKADKWKMIAQVWVELLSYAAANCIPITHVQQLSKGGEFLSLVWLLMTHLGLAKQFQIKEGHARAKLIVGEEEQIEQNLAKTKQ

SEQ ID NO: 152679 - protein, 238 aa, Glycine max
  Coding DNA Sequence Number=SeqID_60994
  Gene Ontology: Mol. function=RNA polymerase II transcription factor activity; Cellular component=cytoplasm; Biological process=protein transport
  Homolog annotation: Hit_ID=A7P0T6; Match level="QueryCoverage=99%, HitCoverage=98%, E-value=1e-113, Identity=83%"; Hit description =Chromosome chr19 scaffold_4, whole genome shotgun sequence
  Pfam annotation: Domain name=EAP30; Domain location=5-212; Score =249.1; E_value=9.8e-72; Accession=PF04157.7; Description=EAP30
MRRRPGIGGLQTHAAARDQFRLLGENVAKIRTDLMKEQLATFRSQLEDFARKHKNDIRKNPSFRSQFHEMCAKVGVDPLASNKGFWSELLGLGDFYYELAHNGGLIDLHELCSLLRQRRKSDREVVSEDDCLRAIKKLKVLGSGFEVISVGKKKLVRSVPTELNKDHNEILELAQAQGFVTVDEVERRLSWSSGRAIDALDTLLDEGLAMIDDGHRDGRRRYWFPCVSPISSSIGVDS

SEQ ID NO: 152680 - protein, 251 aa, Glycine max
  Coding DNA Sequence Number=SeqID_60995
  Homolog annotation: Hit_ID=A7P0T9; Match level="QueryCoverage=97%, HitCoverage=47%, E-value=3e-56, Identity=46%"; Hit description =Chromosome chr19 scaffold_4, whole genome shotgun sequence
MDAFVNSGSEVEHEAFLATWLSMIGFSSKGLVSTLVFPIAVHLARGNPIALGPAVLASIYKDLTLLKNSIVGMTKQLVLGDKLELEVTLQSPFYLVQIWVWERFKNLQPQPRLINHEDPMMFRWHKVKALKIDNVRLALESAMEHFCWRPYVQYADLDKEPTGLLVSFATCLRVSLLVGIQSTIKKYLPHRVAMQFGMDQDVPSCLPRFDGTKDFAWKNYCRPISDRSLYFPARLFEGDITTRYAKCGSDL

SEQ ID NO: 152681 - protein, 304 aa, Glycine max
  Coding DNA Sequence Number=SeqID_60996
  Gene Ontology: Mol. function=sequence-specific DNA binding; Cellular component=nucleus; Biological process=regulation of transcription, DNA-dependent
  Homolog annotation: Hit_ID=A3RI55; Match level="QueryCoverage=75%, HitCoverage=47%, E-value=5e-13, Identity=27%"; Hit description=WRKY protein
MALPSTVATVMAWGGLGVWLKVTQSSPTMSFNGKRLVVDEIDFFAEKKKKKKSEVDDQMVHHQMELPNTSLDLLITNSTSTSNRSNMEEELSEAKDNTRNKEMNAENQRLRELVHNLNNKYNALHKDLMKLTHKQHENEINGAIKENDKRDDMIIPRSLLDIGIATKEDPSQQHYSERKLQESKNIIDKLDSGKDSEKSMVDQHESPADHKALWGWISTEATRLSSLRDVDQASETMSMIKKARVSVRARTDSSMCSETRYVFFPWLDPLFIVAGVDLDYVLALSLRYSLNAGACIHAKFVLLA

SEQ ID NO: 152682 - protein, 159 aa, Glycine max
  Coding DNA Sequence Number=SeqID_60997
  Homolog annotation: Hit_ID=A5C2C5; Match level="QueryCoverage=99%, HitCoverage=98%, E-value=4e-40, Identity=49%"; Hit description =Putative uncharacterized protein
  Pfam annotation: Domain name=Stig1; Domain location=20-159; Score =141.6; E_value=2.3e-39; Accession=PF04885.4; Description=Stigma -specific protein, Stig1
MGFLKAIFVIAITMALSIALTMKTITHQEEAKPAFVHHDFPSSSSTPHDQKNNNVHLPSKRVSRFLAQVKNPNAADHCHKDHEVCTLVGAKNSTCCNNKCIDVGYDYHNCGACKMKCKLTDACCRGECVNTNFDKRHCGECNHRCEVGAYCVYGMCGYA

SEQ ID NO: 152683 - protein, 139 aa, Glycine max
  Coding DNA Sequence Number=SeqID_60998
MDRDTLGYSRRRGVKGSPLQPTTLRFRRCRGSRTLCELGIVDRQKEYGRVGIHIRHFTRITLWCTWCQQIEQMLRPSPSNTLDTATFLGDLCLVCNWSGLKTLIFYLGMKVSHDTQEFIMTPVRFDARGNVLNWRFELA

SEQ ID NO: 152684 - protein, 364 aa, Glycine max
  Coding DNA Sequence Number=SeqID_60999
  Homolog annotation: Hit_ID=A7P0T9; Match level="QueryCoverage=62%, HitCoverage=51%, E-value=5e-30, Identity=32%"; Hit description =Chromosome chr19 scaffold_4, whole genome shotgun sequence
  Pfam annotation: Domain name=DUF1723; Domain location=42-91; Score =57.4; E_value=5e-14; Accession=PF08330.1; Description=Protein of unknown function (DUF1723)
MDGITHMKNGAHGSIKIQHKYEDVWMKAGIDQAIKALTFQIRRNDELIIELAQRWCSKTNAFVFPWGEATIILEEMKVCWRYFVKGAPISSPLVSNAEKEIEQELIRAFRMFFKSKAKRADHNPRMKHFMSNESLVEHEAILSYRTILISVSPIAIHLARGTKLGLAIAVLASIYRDLSLLNNKIRIVATVELEVTLWAPFQLKGDNLKLILDSVRAGNGYIWRPYDNSPALQLYNENDKWSASNGYKFVHCIMCLHYVEAIKSKERDMHDHYFERSSEHLLPTSSSVKKESGGFYGPPPSFTSKINTEQEDFDEEGKVSIIQLSDSSDELDVLVRKKLEMARLCLVLYWMFFHQQVLKEQYVC

SEQ ID NO: 152685 - protein, 74 aa, Glycine max
  Coding DNA Sequence Number=SeqID_61000
MMLTSVSVYEHGTDSVIPSENLNEIESSTVELCWRRQSGLTGSRGNIQIIHMILDHNELQLAMVIFNFKMIISA

SEQ ID NO: 152686 - protein, 437 aa, Glycine max
  Coding DNA Sequence Number=SeqID_61001
  Gene Ontology: Mol. function=catalytic activity; Biological process =response to jasmonic acid stimulus
  Homolog annotation: Hit_ID=A4ZRE3; Match level="QueryCoverage=99%, HitCoverage=99%, E-value=1e-157, Identity=64%"; Hit description=VTC2- like protein
MLSIKRVPTVVSNYQKEETGEAAAAGGCGRNCLKSCCIQGFGFGSLVFYVVFCGTDARLPLYAFKRGEKVGGKELPLLGCKKHPVDFLDSLVLGEVWHCVLSFLRPVIMWEDRMQRGLFRYDVTTCETKVIPGKYGFIAQLNEGRHLKKRPTEFRVDKVLQPFDENKFNFTKVGQEEVLFQLEASNDGEAQFFPNVPIDVENSPSFVAINVSPIEYGHVLLIPQIFECLPQRIDHASFLLALQMAAEARNPYFRLGYNSLGAFATINHLHFQAYYLALPFPIEKAPTKKIAKLSGGVKISKLLNYPVRGLVFEGGHSLEGLANVVSEACICLQLNNIPYNILISDCGRQIFLLPQCYAEKQALGEVSAELLETQVNPAVWEISGHLRGSKKVTALVFQAIASVEMNVKPQLLEEVDAVSPSTQRAMVAGSHECLVLQ

SEQ ID NO: 152687 - protein, 437 aa, Glycine max
  Coding DNA Sequence Number=SeqID_61002
  Gene Ontology: Mol. function=transferase activity, transferring glycosyl groups; Cellular component=Golgi stack; Biological process =metabolic process
  Homolog annotation: Hit_ID=A7PMY6; Match level="QueryCoverage=96%, HitCoverage=52%, E-value=3e-72, Identity=35%"; Hit description =Chromosome chr14 scaffold_21, whole genome shotgun sequence
  Pfam annotation: Domain name=PPR; Domain location=117-151; Score=4.9; E_value=2; Accession=PF01535.11; Description=PPR repeat
  Pfam annotation: Domain name=PPR; Domain location=152-186; Score =12.7; E_value=0.25; Accession=PF01535.11; Description=PPR repeat
  Pfam annotation: Domain name=PPR; Domain location=222-256; Score=5.8; E_value=1.6; Accession=PF01535.11; Description=PPR repeat
  Pfam annotation: Domain name=PPR; Domain location=264-298; Score=4.8; E_value=2.1; Accession=PF01535.11; Description=PPR repeat
  Pfam annotation: Domain name=PPR; Domain location=337-371; Score =15.7; E_value=0.11; Accession=PF01535.11; Description=PPR repeat
  Pfam annotation: Domain name=PPR; Domain location=372-406; Score=4.3; E_value=2.4; Accession=PF01535.11; Description=PPR repeat
  Pfam annotation: Domain name=PPR; Domain location=39-73; Score=10.5; E_value=0.45; Accession=PF01535.11; Description=PPR repeat
  Pfam module annotation: Pfam domain module=PPR::PPR::PPR::PPR::PPR::PP R::PPR; Domain location=117-151::152-186::222-256::264-298::337 -371::372-406::39-73
MGDFRKWSSLMRLEMDFIWIDVDEYEKHITLDLEESMVPNFSSLLRKECNNGNLKNALILVEEMLCWGQELPLPESLNLVRQLCSSRSQTKSVTKLLETMPKSAHKLDPETLNLVVQAYSKKGLLLCIVGSIRKADTLFRNMLSKGLSPDDELCNILIQGHCQANDLRNVGELLGVAIRKGWVLTLTSYRNLVRLVCMKGRVQFTLSLKNLMLALCPLDWLIIYNILMFYLLSAGNSLDVNKILTEIEEKKVDLMKLGLKPSNRSLRKVISSPCDAGDLQKALELSQEMRFRGWIHDSAIQTSIVESLLLCGKHGRLDKAVHLMNTMLKKHNISISTSYDFLIHGFCAQNKLDIALNFYSETLNWNLKPIIDTVEMLVHRFCHDGKTELAEQYLVDMTHAGETLIRKMYCTVIKSYDMENNLRKASELMQAMQESGY

SEQ ID NO: 152688 - protein, 21 aa, Glycine max
  Coding DNA Sequence Number=SeqID_61003
MVIFVGEPNTPNKVVKQLANW

SEQ ID NO: 152689 - protein, 94 aa, Glycine max
  Coding DNA Sequence Number=SeqID_61004
VIEKVSPKELYSSALRGRRAGQRELRSDSCIHLNCRFLLLLTHRLRGFGRIDRTSCSQGASLELNHPGCLFSEDDSFAEGHDYVNQPQGCAEMA

SEQ ID NO: 152690 - protein, 106 aa, Glycine max
  Coding DNA Sequence Number=SeqID_61005
  Subcellular localization annotation: CTP_CleavageSite=50; ConfidenceScore=5.19e-01
MSPPPLGPHNHSQTHLKLTGQLPLPALVSVDLYTTNSLKLFGTWTFLSLELSNYAETSRKGQTAFKNMILGLNRWLCSCSFFLALSRGMLCSTDGSLSQQIGLARG

SEQ ID NO: 152691 - protein, 280 aa, Glycine max
  Coding DNA Sequence Number=SeqID_61006
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-34, Identity=30%"; Hit description= UPI00006A17C9 related cluster
  Subcellular localization annotation: CTP_CleavageSite=54; ConfidenceScore=5.46e-01
ARACNPLKVRTCSPLKVRACSPLMARTCSPLKARACSPLKVRTCSPLMVRACIPLMARACSSLKARTYSPLKVRGCSPIKVRTCSPLKVRVCSPLMVRTCSPLKARASNPLLARTCSPQKVRACSPLKARTCSPLKVRACIPLKVRACSPLKVRMCSPLMARTCSPLMARASSPLMARTCSPLKVRACSPLKARACSPLKVRACSPLMVSECSLLMARTRSPLKAKACSSLKMRTCSPRKVKTSSLLMARARIPLKVRTCSPLKVRACSPLKVRTRSPLK

SEQ ID NO: 152692 - protein, 26 aa, Glycine max
  Coding DNA Sequence Number=SeqID_61007
MSGTPQQNGVSERVSSKAVPKTPFEL

SEQ ID NO: 152693 - protein, 195 aa, Glycine max
  Coding DNA Sequence Number=SeqID_61008
  Homolog annotation: Hit_ID=UPI00006A2D9E; Match level="QueryCoverage =90%, HitCoverage=94%, E-value=5e-11, Identity=17%"; Hit description =UPI00006A2D9E related cluster
YPGLQRTTLLANRGLHALTLRGLCVLTFRGLHVLTFRGLHALAIRGMRVLTFRGLHALAIRGLHVLTFRGLHALAIRVLHVPTFVGLHALTFRGLHVLANRGLHALTFRGLHILAFRGLHVLTLRGLHVLALRGLHVLALRGLHVLTIRGLHALTSRGLHVLALRGLPALALGTTYPHLQRTTCPHLRRATCPHL

SEQ ID NO: 152694 - protein, 60 aa, Glycine max
  Coding DNA Sequence Number=SeqID_61009
MLRNFTDCTLTLSFDSRHVAELHGLPKDGCQVPRSGQAKVSLKKSWYTDSGCSKHRTGDA

SEQ ID NO: 152695 - protein, 107 aa, Glycine max
  Coding DNA Sequence Number=SeqID_61010
MVRRLLGAQASEEDLILMWAFLTGHQIYWAHLVRYRMLKALWANAPLPYPQLITLFLRHFQIPLDDEPFVQVKCSFAIGVGAVTSFGYRKDQNGQWLKKDALPPQDE

SEQ ID NO: 152696 - protein, 225 aa, Glycine max
  Coding DNA Sequence Number=SeqID_61011
YGLPPNYTPPVIHDDAGHIPPPILEGEPPRQSDEVHEDRREHAQGDIYFYSPVPVEGLAPNTLPQPNLTGEPRNPPTQPIPLSAGGPPPAVEEKRKLDLIEKRLRAVEGFGDYPFADMTNLCLVPDVIIPPKFKEAEQLGQRGRKEKPKQSLQCLHGSSRRRSPTVPTNMRNITRASQLAPGTPPTQHPYNLGHPRPSRGRPPKLRLKPRLAWPAMPTLASVPTR

SEQ ID NO: 152697 - protein, 91 aa, Glycine max
  Coding DNA Sequence Number=SeqID_61012
MGGELSNWGALRNLPQEASRRQAPPFFPINRGGGLFEIFWTPWLCMSVVLGEKMCFREENPSRGASVSDSVEIFHRSLPFFSLQPFSFLPL

SEQ ID NO: 152698 - protein, 144 aa, Glycine max
  Coding DNA Sequence Number=SeqID_61013
  Homolog annotation: Hit_ID=A5BLR1; Match level="QueryCoverage=72%, HitCoverage=13%, E-value=9e-09, Identity=34%"; Hit description =Putative uncharacterized protein
  Pfam annotation: Domain name=zf-CCHC; Domain location=94-111; Score =19.7; E_value=0.0016; Accession=PF00098.14; Description=Zinc knuckle
MTLATFFRKLHEHEMELMRLNQHEENDKKNKGIELQASSSIQEESNKEDLNEIEENDDFRFFVKGFNKFLRNKGNQRRSNFNSKKKREDSSLVPKCYECDLPGHLRFDCPIFKRRMEKSDKKNFKDKKEEKAYITWEDDDMDLS

SEQ ID NO: 152699 - protein, 103 aa, Glycine max
  Coding DNA Sequence Number=SeqID_61014
MSNHKSTELVLKNLEVQEECKAMMTRSKKFVEAEDEESVVYKEQMGEKAGAEVKENDVKDKENQEKGKIIMVQNKEMENQEKEKEGEKEIENEKNEKEEKNKI

SEQ ID NO: 152700 - protein, 38 aa, Glycine max
  Coding DNA Sequence Number=SeqID_61015
MGLSGLKEHSNPVTPKTYTPKSPSGPLPPDSGPTPKII

SEQ ID NO: 152701 - protein, 98 aa, Glycine max
  Coding DNA Sequence Number=SeqID_61016
MGVAVTMMDIPGEGNRVFLVRGNTCTWGHVTRFGTPLRLKLITMGEGIACARQGDLDTYCLVFLSESVVWTRLSYFLMNGTTLHLRVEVRCMHHVEHD

SEQ ID NO: 152702 - protein, 57 aa, Glycine max
  Coding DNA Sequence Number=SeqID_61017
VKKRLSHDVLKVTVELSSSVGLSVHPSLSVASVCLAQQKNMAEHQYEGPALSARSVH

SEQ ID NO: 152703 - protein, 142 aa, Glycine max
  Coding DNA Sequence Number=SeqID_61018
  Pfam annotation: Domain name=Transposase_23; Domain location=37-107; Score=-15.5; E_value=0.059; Accession=PF03017.5; Description =TNP1ENSPM transposase
MQSQGLALPPEPEVGPSGPRVSTKESCVAPSGNDLETGDSDKCGLYIEENPSRLVAIGRLYEGSTAVHNIPLLHGQVKVGVEEVKDAKALVLVPIDEVTLVGQTLNIFLAWLTHLVKRLSKQLCLQQNLQKARIMRSMIPCT

SEQ ID NO: 152704 - protein, 101 aa, Glycine max
  Coding DNA Sequence Number=SeqID_61019
  Subcellular localization annotation: CTP_CleavageSite=40; ConfidenceScore=5.69e-01
MPASLSAARRSTALPSSNSAFSFSRLSDSPPGVRNRQEIRGTYLTARKWNQSRLLQDSFDLSRSSLSPIPVDGRASPNLKKPPYPTLPKVEQFETPIPNLK

SEQ ID NO: 152705 - protein, 134 aa, Glycine max
  Coding DNA Sequence Number=SeqID_61020
MAKVGFRTSHIGFILGVAFVKRTRGNTCKIKDFDTQFFRSTRGLLLLLCISREEKGELSDHLFEYFYCHTLISSGDLCSMTCDHSLVLVRCLAPIIRQFVKFQDMPKNQKNIDAQSVSFRDTPEIKWKHRCIIK

SEQ ID NO: 152706 - protein, 124 aa, Glycine max
  Coding DNA Sequence Number=SeqID_61021
  Homolog annotation: Hit_ID=Q9SKF2; Match level="QueryCoverage=71%, HitCoverage=14%, E-value=2e-07, Identity=35%"; Hit description =Putative Athila retroelement ORF1 protein
MTRGNPFDLQPFDPEIDRTFHRLVRHHLVPFEHPEHYSFEHSDFEHSENMAQPPPRERTLREMVAPDFKLVHLLPKFHGLAGEDPHKHLKEFYIVCSTMKPSDVQEDHIFLKAFPHSLEGVEKD

SEQ ID NO: 152707 - protein, 199 aa, Glycine max
  Coding DNA Sequence Number=SeqID_61022
MERFERKTFHDKKAKKAYIIWDDNDMDSSEDSENEVVNLSLMVKNYESDEEVTSSNNNLPISFDELQDAFTDLHKESVKLAKLVSFSKKTISNLEKEALKLNEELENLRTEVKTLKPIDTNQSSTIKVIHDSKEASNSCKCCSKFIEEIKDLKNSLAKFTIGKNNLDIILGKQGCVSDKAELGYRPDKQQKFLWMYSKE

SEQ ID NO: 152708 - protein, 89 aa, Glycine max
  Coding DNA Sequence Number=SeqID_61023
MAPTRHPMDPDKSNRALGFPALIIGLCQSFEVPVAPTKPQHAESRLHSFSVPYSRPVQGRGRMARGLARGPSRGGTRKGSRRWRGGRHG

SEQ ID NO: 152709 - protein, 102 aa, Glycine max
  Coding DNA Sequence Number=SeqID_61024
MQSQGLALPPEPLVGPSGPRVSIKESCVDSSGNDPETGDSDMCELYIEANPARLVALGRVYEGSNVVDNTPLLSGQVKVGVEEAKDLDAPIPVPTDEVSLVG

SEQ ID NO: 152710 - protein, 157 aa, Glycine max
  Coding DNA Sequence Number=SeqID_61025
VNSKGGGGASIACYRPSPGCCGVSPCACLETQYFLMKARLLGGLMPLLEVTGLIEARNQSWKPQGPVGLFGSTRGRLALWSLGRMLLNSNIIHIHVRVVILVRMIRTRLFAAARVKSCPSMHSRCVIASLSGYARTVGRPPISGGGPGTDKRKLLAP

SEQ ID NO: 152711 - protein, 37 aa, Glycine max
  Coding DNA Sequence Number=SeqID_61026
MEHETFLATWLAEIDFSPNGLVSLLKKTIVSLADDKR

SEQ ID NO: 152712 - protein, 59 aa, Glycine max
  Coding DNA Sequence Number=SeqID_61027
MIHGTDRKEFQPTSARKEQTDRGRLGFFVRAEPRLCFGRHWHALIYSAGKTLAHLVRKM

SEQ ID NO: 152713 - protein, 43 aa, Glycine max
  Coding DNA Sequence Number=SeqID_61028
MAEPSKKRKGTSSRSQRYSETQEMPIPSSIPSASLFSSEEQRI

SEQ ID NO: 152714 - protein, 108 aa, Glycine max
  Coding DNA Sequence Number=SeqID_61029
MALERTWMPRVLLEQLNVSNKSAKTATTGLSLLWWYFRGRPAMPFRDCFMRSNPLAESLTTVAILLKEGRHPEERYGFLPPRGHPRISSNSSMVGTNWKSPNVKHLKG

SEQ ID NO: 152715 - protein, 52 aa, Glycine max
  Coding DNA Sequence Number=SeqID_61030
MPISTCGSISWDRTPSGPGEVQQGPGVSSSDYGPLSVLRSARRPQQGHQAPY

SEQ ID NO: 152716 - protein, 154 aa, Glycine max
  Coding DNA Sequence Number=SeqID_61031
MTRGNPSDLQPFDPEIDRTFHRLLRHHFIPFEHPEHSVTSEFVHSVIGDFEHPDFEHYNFEHSENKAQPPPYERTLREMVAPDFTYESLCIQYPDEDVPYVLKTGLIHLLPKFHGLAGLSNMERSMIDAASGGALGDMTPAEARNLIEKMASNS

SEQ ID NO: 152717 - protein, 166 aa, Glycine max
  Coding DNA Sequence Number=SeqID_61032
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPRPYASHGSRGLLEVGFGLLPTDSHFEAGTELEFVIMVIAVSFGKPVVPAALMNRPTRGERRFAYWALFRFLAH

SEQ ID NO: 152718 - protein, 250 aa, Glycine max
  Coding DNA Sequence Number=SeqID_61033
  Gene Ontology: Mol. function=aminopeptidase activity
  Homolog annotation: Hit_ID=A8GE73; Match level="QueryCoverage=99%, HitCoverage=70%, E-value=1e-118, Identity=83%"; Hit description =Putative uncharacterized protein
MMLLHSPEQEQILKTGTRILLAVEPPEVLARMLPTEEDKSRVLAAAAVLEKARMMTVKSPAGSDFRAPLGQYPTVTEYGYADEPGRWDHWPSGFLFTWPNEEQAEGVLVLDVGDILLPFKSYARERITLEIEKGFVTRIHGGFEAEYLRDYMRYFNDPEVYGISHIGWGLQPRAQWTAMGLHDKNDGMCMDARAFYGNFLFSTGPNTEVGGKRKTPCHMDIALRRCDIKVDDLLVVAEGEVVAPEASRAR

SEQ ID NO: 152719 - protein, 79 aa, Glycine max
  Coding DNA Sequence Number=SeqID_61034
MEEKEQKGSHSKESTLIDWPNSLTIVPSGVANCCNLPFGGRATRGLMGASSKKGKCAESPPMFIQGKRRKNRKGVVYEL

SEQ ID NO: 152720 - protein, 49 aa, Glycine max
  Coding DNA Sequence Number=SeqID_61035
NVTELYGLRNNVLSTPDMSRNFTDCLTMSVKDLEVIKRGSHPNKQMVPE

SEQ ID NO: 152721 - protein, 129 aa, Glycine max
  Coding DNA Sequence Number=SeqID_61036
  Homolog annotation: Hit_ID=O64312; Match level="QueryCoverage=89%, HitCoverage=92%, E-value=5e-20, Identity=39%"; Hit description=GpE+E'
  Pfam annotation: Domain name=Phage_E; Domain location=8-89; Score =36.7; E_value=8.4e-08; Accession=PF06158.2; Description=Phage tail protein E
  Pfam annotation: Domain name=Phage_P2_GpE; Domain location=90-128; Score=69.4; E_value=1.2e-17; Accession=PF06528.3; Description=Phage P2 GpE
  Pfam module annotation: Pfam domain module=Phage_E::Phage_P2_GpE; Domain location=8-89::90-128
MTDKTTGKAIELDTPLLRGKTEITHITVRKPQSGAMRGTRLQALMDMDVNAMMRNGPGRPAVALRRGGHFFVAEVGAVSFPDGLTVEDLVADIATVFHWPPPVMYAESLTDVQEWRHKAIQRSGAGDDE

SEQ ID NO: 152722 - protein, 132 aa, Glycine max
  Coding DNA Sequence Number=SeqID_61037
MVRLHTNFFTRIKEWCIPKNNEACGVPEVSVLTTKTLISSPSNKSYGWNINSFPIALISSSDLTYSTPETMIPETSSKIEVFKLSAETAVPMLSDEKSSLIFLLLTPPASSKLPIKLKHMLGSDEDLLFSFR

SEQ ID NO: 152723 - protein, 28 aa, Glycine max
  Coding DNA Sequence Number=SeqID_61038
MRPPPSSAEPPVIGKCEKEEGEMEVVID

SEQ ID NO: 152724 - protein, 40 aa, Glycine max
  Coding DNA Sequence Number=SeqID_61039
MWSLSMTAEWRRKKDDWRCHFKKKMSQEQAHHHRKPWTRA

SEQ ID NO: 152725 - protein, 192 aa, Glycine max
  Coding DNA Sequence Number=SeqID_61040
  Homolog annotation: Hit_ID=A5AWV0; Match level="QueryCoverage=86%, HitCoverage=11%, E-value=2e-10, Identity=24%"; Hit description =Putative uncharacterized protein
VMWDASLFRLLNSDFPLYIKHEDLSEIAHGGQCLSISVIQLWIMHLTETSMRLGNSNVYGLLEPQSIQRFGQSQFESESYMKNWMQSSKRDVYLGAYLNGAHWQMVVILSKKSLVVWFYSLHHRPDNYLKGIINSALKGVDGTPQPKSKAAVGARWIVVKCNKQKGSTKCGYYVIHWLSTIISGSFRNNGKW

SEQ ID NO: 152726 - protein, 244 aa, Glycine max
  Coding DNA Sequence Number=SeqID_61041
  Gene Ontology: Mol. function=transferase activity, transferring glycosyl groups; Cellular component=extracellular region; Biological process=enterobacterial common antigen biosynthetic process
  Homolog annotation: Hit_ID=Q5PKK7; Match level="QueryCoverage=97%, HitCoverage=97%, E-value=3e-86, Identity=65%"; Hit description =Probable UDP-N-acetyl-D-mannosaminuronic acid transferase
  Pfam annotation: Domain name=Glyco_tran_WecB; Domain location=58-229; Score=266.9; E_value=4.1e-77; Accession=PF03808.4; Description =Glycosyl transferase WecBTagACpsF family
METDHPRYTLRGIDLHAFADMASFLHFLLPDGKPRSGTLVAINAEKMLTLEEDAQLRALIAAAEIKYPDGISIVRSLRKKYPQLTVNRIAGADLWEALMEQAGRSGIPVFLIGGREQVLQETCDKLRRQWNVNIVGSQNGYFAPAEREALFARIAASGAQIVTVAQGSPRQELLMRDCREHWPHALYMGVGGTYDVFTGHVTRAPRIWQQLGLEWLYRLIRQPSRWRRQLKLLKYLRYHWRGDL

SEQ ID NO: 152727 - protein, 258 aa, Glycine max
  Coding DNA Sequence Number=SeqID_61042
  Gene Ontology: Mol. function=two-component response regulator activity; Cellular component=intracellular; Biological process=two -component signal transduction system (phosphorelay)
  Homolog annotation: Hit_ID=Q0K3J2; Match level="QueryCoverage=97%, HitCoverage=69%, E-value=4e-70, Identity=48%"; Hit description =Transcriptional regulator, LuxR-family
  Pfam annotation: Domain name=GerE; Domain location=193-250; Score =10.2; E_value=0.00067; Accession=PF00196.10; Description=Bacterial regulatory proteins, luxR family
MPEAELKQSEFFRNFLEPVDVFHILGVDINTNDGAQCRLRISRGRDDAPFVESEKHLLARFIPHLERSIKLHMQLNRIETERNLYAGAVDQMAVGTIILDDTGKVLQTNQVAERLLQEKDGIKQAMLSQKGNLASVVEAMRVKRPSGRADLGIIVRSVPLSAWSEGKQCPTVVIFISDPEQQSSAPQEIVRALFDFTPAETQLAMLLANGLTLDEASEELGISRNTSRAHLRSTFSKTGVTRQTMLVRLILRSVATLG

SEQ ID NO: 152728 - protein, 116 aa, Glycine max
  Coding DNA Sequence Number=SeqID_61043
MPLQRDECGSWIAPARHPVDPETSNRALGFPARVTGLCKSYRTPVPPSSSCHRDLGIVPAKHSVDPKKANRFYGVPVAPNKVIRSHINRAFIKKYCAPRQAHGETPHSIGMAGSGQ

SEQ ID NO: 152729 - protein, 130 aa, Glycine max
  Coding DNA Sequence Number=SeqID_61044
  Pfam annotation: Domain name=G-patch; Domain location=2-43; Score =21.0; E_value=0.00055; Accession=PF01585.14; Description=G-patch domain
MMVARVMLGNGYEPGMGLGKNNGDRTSLISTRGNRGKFGLGYKPTQVDIRKSVAGRKSGSQGSQLGRKIEEGPPCHINRSFISAGLGHEGQVVAICEDDSPNGSDLVRPCPPSFRLGNLRDKHNVTLCGF

SEQ ID NO: 152730 - protein, 162 aa, Glycine max
  Coding DNA Sequence Number=SeqID_61045
MWAFHKGLQIDWAYLVRYRMHKALQLNAPLPYPHLVTLFLQHFNIPLDSEPYVPIKRSFLIGFAVIGSFGYQKEHDGSWVKNGARPVDEEGHLHGGEDSSLLQKILDRFDGLQTFVGERFDTLELQVDMRFNEMKSRITKVEEDVSHIRTSFDLPPPLPPSS

SEQ ID NO: 152731 - protein, 133 aa, Glycine max
  Coding DNA Sequence Number=SeqID_61046
  Subcellular localization annotation: CTP_CleavageSite=74; ConfidenceScore=5.16e-01
MGNQPRPNFNAGGYFGFQHGQQYNQQQGQWRTHPGNQFNKDQSGPSNRPQQQGPSLYDRTMNLEETLAQFMQVSMSNQKSTESTIKNLEVQVGQLAKQLVDRPSSSFGANTEKNPKEECKDVMTRSKMVSMSE

SEQ ID NO: 152732 - protein, 89 aa, Glycine max
  Coding DNA Sequence Number=SeqID_61047
EDEGPTAQVPQHVEDESSEATNSEPFVIGEEAEETQLATNPSTPLLEMPKDPTTPVLAMDTSPPATPILHLIDEEDVQTQDTQDQSQEF

SEQ ID NO: 152733 - protein, 365 aa, Glycine max
  Coding DNA Sequence Number=SeqID_61048
  Homolog annotation: Hit_ID=Q652R5; Match level="QueryCoverage=51%, HitCoverage=83%, E-value=2e-21, Identity=38%"; Hit description =Putative uncharacterized protein P0603C10.50
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVI

SEQ ID NO: 152734 - protein, 135 aa, Glycine max
  Coding DNA Sequence Number=SeqID_61049
VKASEESDEVQALKAELERAWVVEEKFKAAIVSSSSEEVKGIITGQRHDLEGRAKGNMWAIIDKCKEKLNLAATHEQRLEDEYAKISAEREARERVIDSLHQEATMWTDRFALNGAKQWRTPTPPPRRSTDFSAI

SEQ ID NO: 152735 - protein, 119 aa, Glycine max
  Coding DNA Sequence Number=SeqID_61050
MGETHEMPHHNLADFEPCLGYATEGQAVSDIPLQNTLEGPQYHPQPHVLHSTTGTNPHVMAEIGKLDRLEERLRVIEVCEDYAFANLEELLDFDKYKGTTCPKNHLKMYCRKMGAYAKR

SEQ ID NO: 152736 - protein, 156 aa, Glycine max
  Coding DNA Sequence Number=SeqID_61051
MTRGNLGDLQPFDPEIDRTFHRLVRHSVYPDHSVHFEHCEHLEHSEYSIASDSEYSNFEHSTTNFCTENMAQLPPRERALRMMAAPDFTYESLCIQYPDEGVPYVLKTGLIHLLPKFHGLAGEDPHKHLKEFHIVCSTMKPPDVQEDHIFMKKRMR

SEQ ID NO: 152737 - protein, 106 aa, Glycine max
  Coding DNA Sequence Number=SeqID_61052
MEGTSTRLFKENKGGYIPCGSLLVKEFYKVEKKSQGPQVAWGLDVGTSCCRTTLSVEASFMMMNQAILMMPKAQVIDSRLQDQASRIQSKIQEKKSRSKKSRLHIV

SEQ ID NO: 152738 - protein, 149 aa, Glycine max
  Coding DNA Sequence Number=SeqID_61053
GRTMLNGTSQNFSMTSTHCVRVVSSEKWRLGNLGWGYGYCHTLISSGDHPMLGCDPRLTTSRYLAPIVRQFVKFRDMPEAKRKALLTRAFLDVPPEGGCFGRKQPSSPGRAGKSKLKRFRNVFVGDFAKIFNCSSTFFVRSLSFFGLQP

SEQ ID NO: 152739 - protein, 72 aa, Glycine max
  Coding DNA Sequence Number=SeqID_61054
MDEVRFNLETNLVLRASAKRNTPGLSRRKNPKEDELYRFAKCTASVHPLSEKGALSQKSLTCAKQSIRVLST

SEQ ID NO: 152740 - protein, 178 aa, Glycine max
  Coding DNA Sequence Number=SeqID_61055
MASRKRKNAWTRYTDNVLGRNILPERKVEIYHSEQNEFKAELERRNFHKCLTNLVDGGIDLALVKEFYAHLYSFEDHPPKKSRVRGHLVKIDGDSLNTFLETPVVLAEGETLPAYYRYYRLPTDYREIEVALCIPGRGFILNSEGHPGKILRKDLTTLAQVWSVLSYSNLAPHHTLLT

SEQ ID NO: 152741 - protein, 65 aa, Glycine max
  Coding DNA Sequence Number=SeqID_61056
MKEEKKKEKMVEDDKQQLKKKKREKKRREKARVSVLERKRNKHLHMKGEKYHILWYLLGKTKKDI

SEQ ID NO: 152742 - protein, 120 aa, Glycine max
  Coding DNA Sequence Number=SeqID_61057
MVKGECKEVSVSSKRLAKKERHFEIKTNIKEISPLRQPPYFLLCKKTLVSIATPLRLEFIPQVKKLLDEGLVCKSLNPCALLVPKIGVPMNPKRIKVIPEWPAPPSVLREGAQSIKNLRI

SEQ ID NO: 152743 - protein, 143 aa, Glycine max
  Coding DNA Sequence Number=SeqID_61058
LGNDINGSPNKSGEWRIGGQHYAITSRGYRLEGGGHMNSARKLHSWVSEKSREWRIGEQRYAITSRGSRLEALGNDINGSLNKSGEWRIGGQHYEITSRGSRLEGGGDMNSARKLHSWVSEKSREWRIGGQRYAITSHGSRLE

SEQ ID NO: 152744 - protein, 275 aa, Glycine max
  Coding DNA Sequence Number=SeqID_61059
  Gene Ontology: Mol. function=RNA-directed DNA polymerase activity; Biological process=regulation of transcription, DNA-dependent
  Homolog annotation: Hit_ID=A7NWH9; Match level="QueryCoverage=83%, HitCoverage=19%, E-value=9e-33, Identity=34%"; Hit description =Chromosome chr5 scaffold_2, whole genome shotgun sequence
SNSVFYQHFKDPKEQTLNTHSTIQILKVLQPRHFGSDLNKGKRFSVPFDPVGYTYWDYVDAWTKVFWHQNTRFKHSWLIYFKTNTIYNFPNWFLQWWDFFGPIPEIFPETVQQGFSQFKKQYNSQESRIPADLKYFSSFALSWIFSWQYRYSKTEKTNQYPSLQRHAFVKWWTQFDSSKADPEQVKLWFKSHPEFLKTADPETSVFLNQKSHLAAFLAGSTSKEVLAKNLKEVLQMLQQEEEVSSSKKEETSSAEEDEEDPFYQNEDDCFGICLD

SEQ ID NO: 152745 - protein, 121 aa, Glycine max
  Coding DNA Sequence Number=SeqID_61060
PGHPESGPPPYLSDGKIGESERATTSLDKESERSTASLVGDSGGAVASPDGESEMIIKGGDGGTTSSSGEEGGFTTRDCGSAGTGSTRAELWTSGPMVANRGVEVDDEGMSSALALFLDAI

SEQ ID NO: 152746 - protein, 100 aa, Glycine max
  Coding DNA Sequence Number=SeqID_61061
  Homolog annotation: Hit_ID=Q6WAY3; Match level="QueryCoverage=83%, HitCoverage=4%, E-value=3e-07, Identity=40%"; Hit description =Gag/pol polyprotein
MTMITNSSSVPLPIQIGPHVCQITFQVMDINLAYSYLLGHLIIVSGEEDILVSCPSSTPYVEVAEESLETAFQALEVVSNAHVESPQVQLPSSDAALGIL

SEQ ID NO: 152747 - protein, 81 aa, Glycine max
  Coding DNA Sequence Number=SeqID_61062
MYKDNWTQPWPMGSEIYPKVHENPRAFFSSSSPIFLEPLAHGSSDWSLPREDCISLNLGGLSKLSLVQQDGYEDEAWIDSV

SEQ ID NO: 152748 - protein, 417 aa, Glycine max
  Coding DNA Sequence Number=SeqID_61063
  Gene Ontology: Mol. function=transporter activity; Cellular component= cell outer membrane; Biological process=transport
  Homolog annotation: Hit_ID=A5FLE9; Match level="QueryCoverage=92%, HitCoverage=52%, E-value=1e-132, Identity=57%"; Hit description=TonB- dependent receptor, plug
  Pfam annotation: Domain name=Plug; Domain location=41-148; Score =74.6; E_value=3.1e-19; Accession=PF07715.6; Description=TonB -dependent Receptor Plug Domain
ETDSLTLNQNQRPDSISVAKKEIKTKLIDDVVVTGTIKPISRSKSPVAVEIYSQKFFQKNPTPNVFEAISMVNGVRPQLNCSVCNTGDIHINGLEGPYTMILIDGMPIVSSLSTVYGLSGIPNSLVDRIEVVKGPASSIYGSEAMGGVINIITKNALTAPKLSLDVMTSTWSEDNIDLSTKFNVGKKAASLLSLNYFNFTKRIDQNKDNFTDATLQNRISVFNKWNFQRKENRLASLALRYLYEDRFGGEMQWTKANRGGDKIYGESIYTNRVEALGVYQWPLKEQIITQFSYNYHNQDSFYGTNPYDAQQKVAFVQTYWDRKFGNHDLILGVTYKRTFYDDNTPGTSSADGLINQPMKSPILGAFIQDQWDLDSKNTILLGYRFAWKFSPNPYHTLRFNFGTGFRVVNLFTEIMQH

SEQ ID NO: 152749 - protein, 198 aa, Glycine max
  Coding DNA Sequence Number=SeqID_61064
  Gene Ontology: Mol. function=motor activity; Cellular component=cell projection
  Homolog annotation: Hit_ID=UPI00016621D1; Match level="QueryCoverage =97%, HitCoverage=40%, E-value=7e-24, Identity=35%"; Hit description =UPI00016621D1 related cluster
LHALAFRGLHVLTFRGLHVLAFRGLHVFTFRGLHVLAYRGLHILAFRGLHVLTFKRLHALAFRGLHVLAFRGLHILAFRGLHILTFKGLHILAFRGLHVLTFRGLHVLAFRGLHALAFRGLHAFAFIGLHALTFRGLHVLTFKGLHVLTFRGLHALAFIRLCVLAFRELHVLGFRGLHVLTFRGLQICTFRELKVLRP

SEQ ID NO: 152750 - protein, 223 aa, Glycine max
  Coding DNA Sequence Number=SeqID_61065
MRSWVRGQWIPFDADALSQFLGDPLVLEEGQECEFSQRRNRADGFDEEAIAQLLCTPGHPLDPDKSNKALGFPALITGLCQSFGVPVTPSKVIRPPITQAFIEKYCTPRQAQGDAPQAADAPPPPYQADPARSLGMECYLQHLVRQQAANHRGQVQIHECLYWFSLSQQGQGFAPFACPTPEQFRAEVAWPGDWPEAQAGEEPTGSPGDAEEARMAEEITDLL

SEQ ID NO: 152751 - protein, 228 aa, Glycine max
  Coding DNA Sequence Number=SeqID_61066
  Homolog annotation: Hit_ID=A5BSR3; Match level="QueryCoverage=23%, HitCoverage=16%, E-value=3e-07, Identity=52%"; Hit description =Putative uncharacterized protein
MTSEAAKEIADRIDSLDEQASQGSFIPHGRQDILTAAIGRPEHPGRVRAIGAGVTIKQYFGSASRTSRSSSSMPPEDLEQLTQQIRDQLEESITEKGLALPPEPEVGPSGPRVSTKESCVVHSGNNPGTGDSNKCGLYIEENPSRLMQEALVPVPTDEVTSVGQALNTFLAWPTHLVKCLSEQAAVSPAKSLESPDEEVDDPLYLMTLTIPQLFLKPLQVMWDATIFG

SEQ ID NO: 152752 - protein, 78 aa, Glycine max
  Coding DNA Sequence Number=SeqID_61067
MEGLVDLAAIDAFLAFHHGKESPVVAILAMYDTFDRGCEKSNARIVCCALALYVGPSIRYKVTARASKRKGELGPTLG

SEQ ID NO: 152753 - protein, 182 aa, Glycine max
  Coding DNA Sequence Number=SeqID_61068
MEEKKKKQLDEAAKSRSTYTVIDPPSSIRRHVKWKMAHTKKIGQMTYEAAKEIANKIVSHIQLIPWRSKPHRVPLSPMDVRIRCHDQAILWTGSKDLPHVFVHGSQRLRATGAKNQGLAGGGLTLPPKHEVDLSAACVSTKESCVDPSGNDPKMGDLDKCGLYVKVSVEKFTNADAYIPVPT

SEQ ID NO: 152754 - protein, 58 aa, Glycine max
  Coding DNA Sequence Number=SeqID_61069
KERVLKKAQPNTRAKRASGAKREKKAGAKRGVKLEDAESVTRAKPSYALSARSNRSIG

SEQ ID NO: 152755 - protein, 202 aa, Glycine max
  Coding DNA Sequence Number=SeqID_61070
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLRNRITNGSERINKRLNVEKIINDPVIFQRDIAQIHTKLPFLRASNRVKMRMEFLPELP

SEQ ID NO: 152756 - protein, 105 aa, Glycine max
  Coding DNA Sequence Number=SeqID_61071
MEDGQSCRMAEFIVGILIGGGTSGRYISIMTSRLFIKTWLGRQQNDLISNMGSFYQNNWRWDLKWRRHLFEHDEGVAVAFMEEISAYPIQCHLKDNLLWKADPTG

SEQ ID NO: 152757 - protein, 81 aa, Glycine max
  Coding DNA Sequence Number=SeqID_61072
  Homolog annotation: Hit_ID=UPI0000ECBAF8; Match level="QueryCoverage =50%, HitCoverage=48%, E-value=1e-16, Identity=100%"; Hit description= UPI0000ECBAF8 related cluster
MHMPNSWAPPKMLHNMQLLRKLVHHFCEGMQAWHWPSFYNVVTGKTLALPNLIALQHIPLSPAGVIAKRPAPIALPNSCAA

SEQ ID NO: 152758 - protein, 111 aa, Glycine max
  Coding DNA Sequence Number=SeqID_61073
MECLEGAWETLEGNARCRFRGTIRLTATSLVHPEEPARTLQRTVTSFEEDPEEDPEELPLQPAVDALDFLEGDDDPLPEVDSPEDVMSTSEADSTEESGPGGITTSGGSSS

SEQ ID NO: 152759 - protein, 103 aa, Glycine max
  Coding DNA Sequence Number=SeqID_61074
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=98%, E-value=6e-10, Identity=37%"; Hit description =UPI00006A17C9 related cluster
  Subcellular localization annotation: CTP_CleavageSite=22; ConfidenceScore=5.59e-01
MCSPLMVRTCSPLKARTLPKVRACSPLKARTCSPLEVRACSPLMVRTCSPLEVRTCSPLKARTCSPLEVRACSPLIVRTCSPLKARVTSTQGEGVQPSDREDV

SEQ ID NO: 152760 - protein, 67 aa, Glycine max
  Coding DNA Sequence Number=SeqID_61075
MGPTGARYSENGIHLSVISSRHNVDAVGCGGMVYTYSKCRTTLSGRCMTIDGPHRTCPKAKQLVQIL

SEQ ID NO: 152761 - protein, 72 aa, Glycine max
  Coding DNA Sequence Number=SeqID_61076
MRDLYEERFMPNYYWWTTHGEELPQFPPIVLQGSYYKSGRQRKELNPYEQMIMDHAGPSIGQYIEQQGVIET

SEQ ID NO: 152762 - protein, 189 aa, Glycine max
  Coding DNA Sequence Number=SeqID_61077
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=21%, E-value=5e-93, Identity=77%"; Hit description=DNA -directed RNA polymerase subunit beta
  Pfam annotation: Domain name=RNA_pol_Rpb2_6; Domain location=1-98; Score=-187.1; E_value=0.0035; Accession=PF00562.19; Description=RNA polymerase Rpb2, domain 6
  Pfam annotation: Domain name=RNA_pol_Rpb2_7; Domain location=100-177; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-98::100-177
MPYLQDGRPVDMVFNPLGVPSRMNVGQIFECSLGLAGGMLERHYRITPFDERYEQEASRKLVFSELYEASKQTSNPWIFEPDGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 152763 - protein, 44 aa, Glycine max
  Coding DNA Sequence Number=SeqID_61078
MKDLEFSEGTNVESYEGEGMQPYEGEGVQPYEGEGVWPSEGEDV

SEQ ID NO: 152764 - protein, 107 aa, Glycine max
  Coding DNA Sequence Number=SeqID_61079
MVEEFEEILGCPLGGRKPYLFSGFYPSLARISKIVKILTQELDRGKQVENEVVGVPRKFSEAKAKVLASQDEWAPFMDTLPVFYYEKLVGYMPSSFADLVFAGERIE

SEQ ID NO: 152765 - protein, 84 aa, Glycine max
  Coding DNA Sequence Number=SeqID_61080
  Homolog annotation: Hit_ID=A5B5H1; Match level="QueryCoverage=82%, HitCoverage=17%, E-value=9e-09, Identity=44%"; Hit description =Putative uncharacterized protein
MATVDITGLNSNDLHKPFRFEGYHFKRWQQKMMLSLTMRKVAYVLNIDIPVMPKDAEKEVKDKKTMELALWNENDYLCKNFILN

SEQ ID NO: 152766 - protein, 134 aa, Glycine max
  Coding DNA Sequence Number=SeqID_61081
  Gene Ontology: Mol. function=glutamate 5-kinase activity; Cellular component=chloroplast; Biological process=amino acid biosynthetic process
  Homolog annotation: Hit_ID=A9CG68; Match level="QueryCoverage=93%, HitCoverage=29%, E-value=2e-58, Identity=91%"; Hit description =Aspartokinase
  Pfam annotation: Domain name=AA_kinase; Domain location=1-106; Score=- 46.2; E_value=0.018; Accession=PF00696.19; Description=Amino acid kinase family
MGEGQVAVVAGFQGIGPDNRIATLGRGGSDTSAVAIAAAVKADRCDIYTDVDGVYTTDPRIEPKARRMKKIAFEEMLEMASLGAKVLQVRSVELAMVHKVRTFVRSSFEDPDAPGMGDLINPPGSRNRHRLCQG

SEQ ID NO: 152767 - protein, 63 aa, Glycine max
  Coding DNA Sequence Number=SeqID_61082
MVWFTIRRRCYSPCVNGLICPWLTKGAGNHNVTPHIMTSRVRMSKGAEDDISLSVSTGSFAPG

SEQ ID NO: 152768 - protein, 258 aa, Glycine max
  Coding DNA Sequence Number=SeqID_61083
  Homolog annotation: Hit_ID=A2Q4S5; Match level="QueryCoverage=53%, HitCoverage=21%, E-value=5e-21, Identity=40%"; Hit description=IMP dehydrogenase/GMP reductase, putative
MSVDARQVIGQLRLAHLFFTFWVALCLLTRVQPMSMFSTCEALRDLSMTKRYAWGVAALVHMYDQLNDASMSHSRQCWIYEHFPSVVDSTGEQEYDEDSPCACRWIATKKTLKSIRTPAYRERLDRLQILDVCWIPYGDHREVRDFHVRSCYSGFLRWGPVAVYYRPERVVRQFGYTQTIPSPPIDSWVSYDDIHDRWMHYEDHIVPAGEVCVVPGQCSSDYMDWFFRISHLFITLGHALDPLPHCHALQAQVIPQAP

SEQ ID NO: 152769 - protein, 224 aa, Glycine max
  Coding DNA Sequence Number=SeqID_61084
  Gene Ontology: Mol. function=protein kinase C binding; Cellular component=cell projection
  Homolog annotation: Hit_ID=Q9JKS4-3; Match level="QueryCoverage=29%, HitCoverage=11%, E-value=8e-09, Identity=47%"; Hit description =Isoform 3 of Q9JKS4
YLSPLEDYTSSPSEGYTSSPSEDCTSLPLEDYTSSPSEGCTPSPSEGYTPSPSEDYTSSPSKGYTPSPSEGYTSSPSEDYTGLHTLIFRGLYILPLRGLHVLAFGGLHALAFRELHVLAIKGLHVLAFKGLHVLTFRGLHTLIFRGLYVLPLRGLHVLAFGGLRALAFRGLHVPLFRGLHALAFRGRHVLNFRGLHAYAFRGLRIPTFSGLYIRTLREFKVICP

SEQ ID NO: 152770 - protein, 60 aa, Glycine max
  Coding DNA Sequence Number=SeqID_61085
MGVLGPSRKFLQKAVASGGSNLARLGELGGKHLPHFPINRGRGEEENCSTLLKIRAEALP

SEQ ID NO: 152771 - protein, 177 aa, Glycine max
  Coding DNA Sequence Number=SeqID_61086
DPQRPGIAEQDQAADPGREQCIDGVEALFADRSRNQPGRQQQGAEVKCAACDAMDDGHRHRNDRLVDRQVRRQRTLARYSRLCHGSVGFPDVSLRPHPADDHQQGSRVAGSPEPWFDAVRDTGNRTLRSRAGTTQENMAGPWRTALCGAFYCAFTITSKKLFHEKTNNWSHLGDTFA

SEQ ID NO: 152772 - protein, 114 aa, Glycine max
  Coding DNA Sequence Number=SeqID_61087
  Homolog annotation: Hit_ID=UPI0000ECBAF8; Match level="QueryCoverage =35%, HitCoverage=48%, E-value=1e-16, Identity=100%"; Hit description= UPI0000ECBAF8 related cluster
RKRKSAQYANRLSPRVGRFINAAGTTGFPTGKRASEEKLEESQETARDVAIVVGKHVSPLRGMQAWHWPSFYNVVTGKTLALPNLIALQHIPLSPAGVIAKRPAPIALPNSCAA

SEQ ID NO: 152773 - protein, 27 aa, Glycine max
  Coding DNA Sequence Number=SeqID_61088
MKAQVEKDEGPEAEALPRLLIVAEDTL

SEQ ID NO: 152774 - protein, 173 aa, Glycine max
  Coding DNA Sequence Number=SeqID_61089
MAPRKLASKRSRKDKAVEGTSSSPEYDSHRFRSAEHQQRFEAIKGWSFLRERRVQLRDDEYTDFQEEIVRRRWASLVTPMAKFDPDIVLEFYDNAWPTEEGVRNLRSWVRGQWILFDADAISQFLGYPLVLEEGQECEYGQRRNRSDGFDEEAIANLLCIPGQDFARTAAGRR

SEQ ID NO: 152775 - protein, 155 aa, Glycine max
  Coding DNA Sequence Number=SeqID_61090
  Subcellular localization annotation: CTP_CleavageSite=30; ConfidenceScore=5.55e-01
MASPPASPPPPPPPPSDASASPSAMKRTCKASHLQSLSTRPPGADTPVVHVDPTTGKADGPHRKKLRTYLGIVARDKVDITYENWKEVPTAQKDLIWEDIQAEFEIPEASDSSTKRSFFRLLARDGSSLNQTSRGNGPLQSIGMVWTTLSVRNMA

SEQ ID NO: 152776 - protein, 66 aa, Glycine max
  Coding DNA Sequence Number=SeqID_61091
MGEEEKKPEENKVEEKKAEEEEKKEEEKKLEESKDDKESKEEYVPLEIVQGTTFAMHGLSMISDIF

SEQ ID NO: 152777 - protein, 102 aa, Glycine max
  Coding DNA Sequence Number=SeqID_61092
MQSQGLALPPDPLVGPFGPRVSTKGSCVDPSGNDLETGIHVVHNTPLLPGLVKVSVEEVTDADALVPVPTDEVRWDATVFGVFNPNFPLYIKHEDLSKITHG

SEQ ID NO: 152778 - protein, 366 aa, Glycine max
  Coding DNA Sequence Number=SeqID_61093
  Homolog annotation: Hit_ID=Q84VI1; Match level="QueryCoverage=100%, HitCoverage=57%, E-value=1e-176, Identity=82%"; Hit description =Envelope-like protein
PEKLVPRRQQGVKIAENPSPATSPREVDTEMDKKIRSIVSSILKEASVPEADEDVPTSSTPNVSVPDVEKDVPTSSAPNAEVLSSPSKERSTEEDDQATKETPAPRAPEPAPGDLIDLEEVESDEEPIANRLAPGIAERLQNRKGKTPLKRSVRIKTMAQKKSTPITPATSRRSKMSRHLRGPRSGRKVPGNVPDAPLDNISFHSIGNVEKWKFVYQRRLALERELGRTALDCKEIMDLIKAAGLLKTVTKLGDCYEGLVREFIVNIPSDISNRKSDDYQRVFVRGKCVRFTPAVINKYLGRPTDGVIDIDVSEHQIAKEITAKRVQHWPKKGKLSAGKLSVKYAILHRIGAANWVPTNHTSTVAT

SEQ ID NO: 152779 - protein, 58 aa, Glycine max
  Coding DNA Sequence Number=SeqID_61094
MGVQIAPRPTWALQNIPPEGCCFWRKQPGSPGRAGRQAPPLFCYIKLIDTVRPSRGGP

SEQ ID NO: 152780 - protein, 84 aa, Glycine max
  Coding DNA Sequence Number=SeqID_61095
  Gene Ontology: Mol. function=nucleic acid binding
  Homolog annotation: Hit_ID=A5AYU6; Match level="QueryCoverage=84%, HitCoverage=12%, E-value=5e-14, Identity=52%"; Hit description =Putative uncharacterized protein
MSLATLFGKLQEHEIELQRLNQNEKEQANICLMTKNHESNEEEPLKKKWYIDSGCSKHMTGDASKFTIISPEKSGHVTFGDNNK

SEQ ID NO: 152781 - protein, 156 aa, Glycine max
  Coding DNA Sequence Number=SeqID_61096
MTLTIPEIFLRPYQVTWDATVFGVFNLDFPLYIKHEDLSEIAHDGQCLSISMLQLWILHLTETSMRAGNSDIYGFLEPQSIQRSGQSQFETESYIKSWMNGALKGLDNAPQPKSKAPARWTIVKCNRQKGSTECGYYVMHWMSTIILGTFRNNWEA

SEQ ID NO: 152782 - protein, 107 aa, Glycine max
  Coding DNA Sequence Number=SeqID_61097
MKERGGANSSFQIFEFGPFQNIFEAGLLLEEATQLSWAKMGCSKDPSSPWLCISAALGEKNYFREENPSRGASVTLSRRFRGRIREGFPSFFIVLHPFFVRSSFFNG

SEQ ID NO: 152783 - protein, 87 aa, Glycine max
  Coding DNA Sequence Number=SeqID_61098
DRARKTSSGPGEVNRVLGFPALITGLYQFYGVPVAPSKGETPQQPGDGRQRATDAPPPPSKPLSSSTKARALPTTRGRPAGDQVQSQ

SEQ ID NO: 152784 - protein, 156 aa, Glycine max
  Coding DNA Sequence Number=SeqID_61099
MHLGNTTTNSVWEAMNNMMALQHTQIKASFVFKVTLYKKLLGMVSRKKPFTLWMCHEEYPRFIPLETIHIFLRRLSFSDQGLCEAQVTITEEMETISKRFEQLNACGKVHLKTKLREITYPDMNSMCPPLEKVKTKGAPKKLLTKQQKSTKHDPSY

SEQ ID NO: 152785 - protein, 126 aa, Glycine max
  Coding DNA Sequence Number=SeqID_61100
MSKSCEFGMTGPLDESISCFLIRLDPWVLVPITFRGLYALTVRGLHVLAFRGLHVLTFRGLHAFAFIGLDVLKFRGLHVLAIRGLHVLAFKGLYALTFRGLHVLTFRGLHALTFRGLHPLIFRGLH

SEQ ID NO: 152786 - protein, 225 aa, Glycine max
  Coding DNA Sequence Number=SeqID_61101
  Gene Ontology: Mol. function=protein kinase C binding; Cellular component=cell projection
  Homolog annotation: Hit_ID=Q9JKS4-3; Match level="QueryCoverage=29%, HitCoverage=11%, E-value=8e-09, Identity=47%"; Hit description =Isoform 3 of Q9JKS4
MYLSPLEDYTSSPSEGYTSSPSEDCTSLPLEDYTSSPSEGCTPSPSEGYTPSPSEDYTSSPSKGYTPSPSEGYTSSPSEDYTGLHTLIFRGLYILPLRGLHVLAFGGLHALAFRELHVLAIKGLHVLAFKGLHVLTFRGLHTLIFRGLYVLPLRGLHVLAFGGLRALAFRGLHVPLFRGLHALAFRGRHVLNFRGLHAYAFRGLRIPTFSGLYIRTLREFKVICP

SEQ ID NO: 152787 - protein, 85 aa, Glycine max
  Coding DNA Sequence Number=SeqID_61102
MGLNHAHAFSKKVHQVKLKYGSNHLAKIGAKDESSYITARVMDEIEKVQEQMKADMEAMKEQMATNDGGHNKHEKDKGSRYERCC

SEQ ID NO: 152788 - protein, 126 aa, Glycine max
  Coding DNA Sequence Number=SeqID_61103
  Subcellular localization annotation: CTP_CleavageSite=27; ConfidenceScore=5.03e-01
PANLQPSAVRQFSILHFFLSPMNLLPSAVHVCSTNEFGAPRIYCLEFPMNLLPSTIHVSSTNEYRSPANLLPRAVRQFSILHFFLSPMNLLPSAVHVCSTNEFGAPRIYSLALFANSPFSTFFGAA

SEQ ID NO: 152789 - protein, 179 aa, Glycine max; identical to SEQ ID NO: 117363
  Coding DNA Sequence Number=SeqID_61104
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster

SEQ ID NO: 152790 - protein, 134 aa, Glycine max
  Coding DNA Sequence Number=SeqID_61105
MEAIKPKSILMNARTSIKNDNKADPIQLQCDILKEMGLSYKEEDSKAISGDSTGHWDFVPSVEAAGGLLCMWNNSTFVVERKEKGRPFLMLEGTCCSNNQKLIFVNVYAPCDLVGKKALWDELRQLKASNPSGM

SEQ ID NO: 152791 - protein, 122 aa, Glycine max
  Coding DNA Sequence Number=SeqID_61106
MALRQREIGVVIARQDIAEQQCHPCLGQSGHAGAHDPHPPPCSGPGEILPRCAQKLGNGFLIEPVGPVPPLADLTLLAFLKNKRVTQELVEGICVKGNPLTPHPRTHVSHSLLRGPSISIEL

SEQ ID NO: 152792 - protein, 260 aa, Glycine max
  Coding DNA Sequence Number=SeqID_61107
MPLWWEFNSWVKEPRVFHCRPMDNFLQHSPMAGLKDTNTRWKIWWIAATTSIWKLKNDIIFNNHPFVISKLVDNTIFLSWSWMRGGKRILMFLFTNGPHLWLWLLSSVCVVGLGSIEGDKEKDLPLEVILPHNSNSNIKKKSRVNVPFGQYDLKVASEEVGQRINGPTHSATKVYVRIKEVLRSNGKAQQFKEPAVDSNSISITDSMPSIQQGPIELQCALLKEMGLTYGEDANKVKGLILDMENRDDMMAAERGIKKHQ

SEQ ID NO: 152793 - protein, 30 aa, Glycine max
  Coding DNA Sequence Number=SeqID_61108
PLIELVRNYVLSWEDGVEEKSPEFQEPRHL

SEQ ID NO: 152794 - protein, 93 aa, Glycine max
  Coding DNA Sequence Number=SeqID_61109
MPISPCRCISWDRAHKTPSGPEEVQQGPGVSSSGYGPLSVLQGARPPSEGSRPQDTQWTRRSPTGPWDFQLWLRASVSPTGCPFPQQGHAIVT

SEQ ID NO: 152795 - protein, 18 aa, Glycine max
  Coding DNA Sequence Number=SeqID_61110
MQVILSIQTKLSNLKLLN

SEQ ID NO: 152796 - protein, 79 aa, Glycine max
  Coding DNA Sequence Number=SeqID_61111
MVGQGGKELGSVGGPHFVQVQNKHSFPPYGLPPNYTPPNVAHTLDENVDNSTPMQIESQQPQSDHAHVSQPMGETHEAP

SEQ ID NO: 152797 - protein, 98 aa, Glycine max
  Coding DNA Sequence Number=SeqID_61112
MENWRRALRNNFAGLQTRWWRMHEQRQAMTFMGLPPGKDIHGAPLKSGEWRIGEKRYSNNFAGLQTRWWRMHEQCQAMTFMGLRKKVENGELAKSATQ

SEQ ID NO: 152798 - protein, 151 aa, Glycine max
  Coding DNA Sequence Number=SeqID_61113
MARAGDNGGVYHQLDESQRLFLDAWTTQMQRLLNRNKEEPYKRIAKSSSFTLKPLSPREVCDDQIRMREKREQEKENSEAPQRNMKKKSDTPEEKSDTHKRESDTHERKFNYFAEVSEVRKVLPAHEPLNLQNLKMSFLRRFLMDCHLQEA

SEQ ID NO: 152799 - protein, 205 aa, Glycine max
  Coding DNA Sequence Number=SeqID_61114
  Gene Ontology: Mol. function=methyltransferase activity; Biological process=metabolic process
  Homolog annotation: Hit_ID=A5CRN4; Match level="QueryCoverage=84%, HitCoverage=48%, E-value=4e-74, Identity=72%"; Hit description =Putative methyltransferase
SPERRDDFADVARGNVETFFGATPDTWRVVVGDLVEALPAEVAPASVDRVVLDMLAPWECMDAVADALTPGGVVLCYVATATQLSRVAEYIRGTGLFTEPDASETMVRGWHVEGLAVRPDHRMVAHTGFLLTARRLAPGAVAPSVKRRASKSSYSDDDVEAWTPGAVGDREISDKNLRKRAREAEKAAEGARLAAASRESGRVTE

SEQ ID NO: 152800 - protein, 59 aa, Glycine max
  Coding DNA Sequence Number=SeqID_61115
MQNSQRDVYLGAYINGPDNCLKGIINSALKGFNNSQGSKSKVAARWIVVKYFTDSRPLE

SEQ ID NO: 152801 - protein, 208 aa, Glycine max
  Coding DNA Sequence Number=SeqID_61116
GYTPSPWVLVTLTVRGLHVLALRGLHVLTIGGLHALTFRGLHVLTLRGLHALTLGLHVLTIRGLHALTVRGLHALTFRGLHALAFRGLRVLTFRTSSFLLTVPGPPPDIGGRPTVQAQPEREAITQLLCIPGQDFTRACKETRIAPKRHPVDPEKSTGPGVSSSGYGPLSVLQGARIAPARHPVDPKKSNRVLELSSSNYGPAQGETP

SEQ ID NO: 152802 - protein, 53 aa, Glycine max
  Coding DNA Sequence Number=SeqID_61117
  Subcellular localization annotation: CTP_CleavageSite=17; ConfidenceScore=5.29e-01
MASYGVASPLPLPSPFRCQSSSKKQRNPLMKKILGLQAPMELASCGIRASSSR

SEQ ID NO: 152803 - protein, 48 aa, Glycine max
  Coding DNA Sequence Number=SeqID_61118
MKILSSGVIFTLEEGRQKQGFCSYVPSIEEKIRPTQFFLKGESHDSFT

SEQ ID NO: 152804 - protein, 221 aa, Glycine max
  Coding DNA Sequence Number=SeqID_61119
  Homolog annotation: Hit_ID=Q6UUU1; Match level="QueryCoverage=27%, HitCoverage=40%, E-value=2e-18, Identity=78%"; Hit description =Putative uncharacterized protein
SALDGEEHVGEWKDPIGKITKITFPSQEGSALGGEEHIGEWKNPIGKITKITFPSQGGSVLDVEEHIGEWRNPIGKITKITFPRSVLDGEEHIGEWRNPIGKITKITFPSQEGPLLDVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152805 - protein, 80 aa, Glycine max
  Coding DNA Sequence Number=SeqID_61120
MKGDLLEAPNLLPMKGLFVTKFESNEVGVLLSPIALKVVGPLLLDSNSSRDDTNPPFQFPIWQLTNKETKTSNNQRPKKK

SEQ ID NO: 152806 - protein, 89 aa, Glycine max
  Coding DNA Sequence Number=SeqID_61121
MTQKLVARGNTLRLSAPRHSVTPSVIDEQRPIWSSAPFPEAAGPMSASSGGDFFKSHKLSRLRRSEFLIGGYVGARALLLSAAPQDLSY

SEQ ID NO: 152807 - protein, 77 aa, Glycine max
  Coding DNA Sequence Number=SeqID_61122
MESHNFPGKEFSDVGSIIHLVAWYKVYHLAKPIHHHKDRVYTSLGSRKPKDKVHTNVYPRCRGDGVHLDLISTNYKT

SEQ ID NO: 152808 - protein, 125 aa, Glycine max
  Coding DNA Sequence Number=SeqID_61123
MERSMIDVASCGALGDMTPVEAMNLIEKMTSNSQQFSARNDAIVLRGVHEVATNSSSSAENKKLEGKLDALVNLVTQLAMNQKYAPVARVCGLCSSADHHTDLCPSLQQFGVNGQSEAYAANIYK

SEQ ID NO: 152809 - protein, 214 aa, Glycine max
  Coding DNA Sequence Number=SeqID_61124
DFSIGKCIVALELDRSRRFVAGDLIPIDLEINATSRRRNTKRIINFLQDLEAAATPGEEPRSSEASSSFPTQGQSHTAVRGDTIVDKQPRRVTLEDYSNAIRSSLFSFSLSGEAKRNISLSETLERFHGLLRKTLTHGFSEPIQVNIFIDGLRPQSKQLLDASTGGKIKLKTPEVAMELIENMAASDIAILRDKVHIPTKRSLLELTSQDALLA

SEQ ID NO: 152810 - protein, 114 aa, Glycine max
  Coding DNA Sequence Number=SeqID_61125
MDSSKNNSIISCTELLGVGSHLLNQIPSFNRGHITKSSTTGSINHTPLHVAKSLIEILKKEMFINLVYSYKLSPLSCLMPEMSFLMAVVLDAGKNFSKSTFLRSSQLKMDLGAR

SEQ ID NO: 152811 - protein, 163 aa, Glycine max
  Coding DNA Sequence Number=SeqID_61126
MHVRQDLPIMVRTRGLGHALGRIIGKALGREDHHDLDDVPQGQRPTAFVRRQREVAPIAEDDPVLHEDVYAHAAEAIHDVEGFPSGPRDPSVLTNYGDHVAVIVWNGEERLELKLSSHGRKVQKFGRPALEIEGLVAAIGLSPLIACSVDTGDWGLISAFVER

SEQ ID NO: 152812 - protein, 161 aa, Glycine max
  Coding DNA Sequence Number=SeqID_61127
  Homolog annotation: Hit_ID=Q0ZCD3; Match level="QueryCoverage=93%, HitCoverage=11%, E-value=2e-07, Identity=26%"; Hit description =Integrase
MERSMIDVASGGALRDMTPVEARNFIEKMALNSQQFSSRSDAIVIRGVHEVATNSSSSAETKKLEDHHTDLCPSVQQSDAIEQPEAYVANIYNRPPQPQQQNQPQQNNYDLSSNRYNPGWRNHPNLRWSSPSQQQPYFHNVVGPSRPYIPPPIQQQQQQQQ

SEQ ID NO: 152813 - protein, 75 aa, Glycine max
  Coding DNA Sequence Number=SeqID_61128
GFFRRSPGAYQHGWRRATFTRAGSPWATFWSEDKNEWQKPVKILKDERKRGWGHDRPIVALLCAKQAWNVAARQP

SEQ ID NO: 152814 - protein, 354 aa, Glycine max
  Coding DNA Sequence Number=SeqID_61129
  Gene Ontology: Mol. function=protein dimerization activity; Cellular component=cytoplasm; Biological process=proteolysis
  Homolog annotation: Hit_ID=A6T995; Match level="QueryCoverage=98%, HitCoverage=96%, E-value=1e-130, Identity=63%"; Hit description =Putative acetylornithine deacetylase
  Pfam annotation: Domain name=M20_dimer; Domain location=171-261; Score=23.5; E_value=0.00079; Accession=PF07687.5; Description =Peptidase dimerisation domain
  Pfam annotation: Domain name=Peptidase_M20; Domain location=68-351; Score=125.1; E_value=2.1e-34; Accession=PF01546.19; Description =Peptidase family M20M25M40
  Pfam annotation: Domain name=Peptidase_M28; Domain location=65-241; Score=-30.1; E_value=0.00036; Accession=PF04389.8; Description =Peptidase family M28
  Pfam module annotation: Pfam domain module=M20_dimer::Peptidase _M20::Peptidase_M28; Domain location=171-261::68-351::65-241
MPARSLPLAQQLLSFNTINPPGNELACVQFLAAWLQEQGFVVKLTAFGEQRANLIARLPGQMPGKPLAFTGHLDTVPLGNQPWQFDPFGHDIDGDRLYGRGASDMKAAVAAFVLACVQHKAAIAAGRGVVLLLTGGEETGCHGAQALIAAGQLPEIGALIVGEPTANQPVIGHKGALWLRCETRGKTRTEPCRSWASTPSTWRLMRWPTLNVGRIEGGLNINSVPDRAAFDVDIRSAPNLQHAVIRQQLATFLGDSVHISTLVDLPAVLSPERHQWIQSVYRACEAVTQEPAEARIVPYFTDASLLLPALSDPPCIILGPGEPTLAHQTDEYCLVSRLSEAEQIYGQLIAGWMR

SEQ ID NO: 152815 - protein, 157 aa, Glycine max
  Coding DNA Sequence Number=SeqID_61130
MTYQASSKANQNSIQNLEIQGCKSYSMENCQWEQELQPYNQYEEERISKLDNLLMQLKESYESTQHTIKNLKIQFGKLEKEVTKFLVTREEHIVEVEAHEESLVEEHDSREKNEEKSEERTQEQLEKCSQVEIQQESILQVNITSHQLIVKEERHGE

SEQ ID NO: 152816 - protein, 175 aa, Glycine max
  Coding DNA Sequence Number=SeqID_61131
  Homolog annotation: Hit_ID=Q6WAY4; Match level="QueryCoverage=86%, HitCoverage=28%, E-value=6e-17, Identity=36%"; Hit description =Putative uncharacterized protein
MGSSQMPLLKKRFYQVKVKSLGITSLKELGQLMGQLQRQAFRKAYGKIWDLAMVEVSTEAIASLAQYYDQPLRCFTFGDFQLSPMVEEFEEILGCPLGGRKPYLFAGFYPSLARISKIVQISTQELDRRKQVENGVPRKYLEAKARILADKGEWAPFIDILTLLIFGGVLFPNVD

SEQ ID NO: 152817 - protein, 67 aa, Glycine max
  Coding DNA Sequence Number=SeqID_61132
MDSRITKVEEDVTIICDCLDLPPPPPSDCHHQKGGDCGSNAFQGYFDDAKESRVKQNSIDSRIKIQG

SEQ ID NO: 152818 - protein, 109 aa, Glycine max
  Coding DNA Sequence Number=SeqID_61133
MNGAEDDVSLCVLSGFSAYSNKKFIRITTQACRSRLTKGAEDDISQCVLSGFSSYRQQKVYTDNHSGISARQHDSKVSMTDLVSAEDDVNLRVSTGLSAAIGEGRRRRP

SEQ ID NO: 152819 - protein, 149 aa, Glycine max
  Coding DNA Sequence Number=SeqID_61134
  Gene Ontology: Mol. function=chitin binding; Cellular component =extracellular region; Biological process=chitin metabolic process
  Homolog annotation: Hit_ID=UPI00006A17C9; Match level="QueryCoverage =84%, HitCoverage=100%, E-value=7e-14, Identity=31%"; Hit description= UPI00006A17C9 related cluster
  Subcellular localization annotation: CTP_CleavageSite=72; ConfidenceScore=5.60e-01
VVMLVRMVRTLLFAAARVKSCPSMHSSCVIASLSGCARTVGPSSNIRGPLKVRTRSPLKARACSPLKFRTCRLSKARECSPTMEMTCNPLKVRACSPTKVKAHDPLTARKCSPLKARTCSPLEVRACSPPMVRTCSPLKARTCSPLNGE

SEQ ID NO: 152820 - protein, 136 aa, Glycine max
  Coding DNA Sequence Number=SeqID_61135
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=71%, E-value=1e-24, Identity=69%"; Hit description=LacZ protein
MRILEHKGRVVPVWFRLCKKSFTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 152821 - protein, 34 aa, Glycine max
  Coding DNA Sequence Number=SeqID_61136
MVGKALWTGIRRSCVQAFLAKKDCVRLFGPLFWY

SEQ ID NO: 152822 - protein, 122 aa, Glycine max
  Coding DNA Sequence Number=SeqID_61137
ALRANAPLPYPQLVTLFLRHFQIPLDDEPFVQVKRSFAIGAGAKDALPQQDECTPSPPPQRDYSSALMNEVLSELRGLRTYVGERFDSLDGRFEGMDTCITQLVEDVTYLRRCFDLPPPSKS

SEQ ID NO: 152823 - protein, 136 aa, Glycine max
  Coding DNA Sequence Number=SeqID_61138
  Subcellular localization annotation: CTP_CleavageSite=7; ConfidenceScore=5.12e-01
MPISPCRCIEIAPTRRPVGPKKSNRAVGFPALVTGLYQSYRVPVPPTRNRTHKDTQWTRRSPTGPWGFQLWLRASVVLQGARSPRQGHVIIGIVPARHPVDPKKSNRVLELSNYLWKDFDSQRCDAYSRDEKESGF

SEQ ID NO: 152824 - protein, 118 aa, Glycine max
  Coding DNA Sequence Number=SeqID_61139
  Homolog annotation: Hit_ID=Q6WAY3; Match level="QueryCoverage=63%, HitCoverage=3%, E-value=4e-07, Identity=44%"; Hit description =Gag/pol polyprotein
MNFAARKPVEFIPIPVSYADLLPYLLDNSMVAITLAKVHQPPFLREYDLNATCACHRDAPGRSIEHCRALKRKVQGLIDMGWLKFEENRVIFNFHRKWVQAIGLFAQATCAPEFGLPR

SEQ ID NO: 152825 - protein, 80 aa, Glycine max
  Coding DNA Sequence Number=SeqID_61140
MQKKLSNCAANFANYAEKWLCSASHAKAWRVDGDPVREERGEGYVCARELKFKGGQLGMVCLCLACGNGKVDLCHRPIAT

SEQ ID NO: 152826 - protein, 69 aa, Glycine max
  Coding DNA Sequence Number=SeqID_61141
MVLFGNLVQPPIVDADSPIVLHPSRNQLLLLIFDLCERLQFWCGRLDSGRRRWFLSLYLIKKVSGMCTS

SEQ ID NO: 152827 - protein, 52 aa, Glycine max
  Coding DNA Sequence Number=SeqID_61142
MLQPYGISIGLKEHSNPVTPKDYTPKSPSRPLLPDSDTAHELYNTPDLTLVF

SEQ ID NO: 152828 - protein, 250 aa, Glycine max
  Coding DNA Sequence Number=SeqID_61143
MAPRKLASKRSRKDKAAEGTSSAPEYDSHRFRSAVHQQRFEAIKGWSFLWEQRVQLRDDEYTDFQEEIGRRRWASLVTPMAKFDPEVVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPLPKCQLVWRLPGTLWIQISPTGPWISRADHRTLPVVRSPRGTYQ

SEQ ID NO: 152829 - protein, 25 aa, Glycine max
  Coding DNA Sequence Number=SeqID_61144
YINDPRPLEPERLKVLQIQWAQYYL

SEQ ID NO: 152830 - protein, 91 aa, Glycine max
  Coding DNA Sequence Number=SeqID_61145
MRARARVMGEVEEVQEHIKADMEALKEKMATMMEAMMNIKEIMEVNAAAIAATSVVAKVNSTPPSGLNQMNHPTSDMVGKDLGSTGGPHYV

SEQ ID NO: 152831 - protein, 58 aa, Glycine max
  Coding DNA Sequence Number=SeqID_61146
MTSEAAKEILEKIASQGSFVPHGRQDVLTVAIGRAEHPSCVRAAGAGVTIKQYFGSAP

SEQ ID NO: 152832 - protein, 43 aa, Glycine max
  Coding DNA Sequence Number=SeqID_61147
LENDAILPRKGPVTRVMSKRLQEDWARVAEEGPRILMNLRIDF

SEQ ID NO: 152833 - protein, 100 aa, Glycine max
  Coding DNA Sequence Number=SeqID_61148
MASGNRLPRVGNRLQGFKNEDRRLRWSLEAKGASGNRLPACVIDYTEGWVTGCVIDYQRRKALRYPSYLHVMIVMAAQLIRDRVETECLKGAWETLEGNT

SEQ ID NO: 152834 - protein, 234 aa, Glycine max
  Coding DNA Sequence Number=SeqID_61149
  Gene Ontology: Mol. function=protein kinase activity; Cellular component=integral to membrane; Biological process=protein amino acid phosphorylation
  Homolog annotation: Hit_ID=A4WA92; Match level="QueryCoverage=23%, HitCoverage=15%, E-value=9e-22, Identity=83%"; Hit description =Diguanylate cyclase
  Pfam annotation: Domain name=GGDEF; Domain location=1-135; Score= -2.3; E_value=7.7e-07; Accession=PF00990.12; Description=GGDEF domain
MLDIDYFKRYNDTYGHQAGDDCLTRVARVLKQSVRTPEDVVSRYGGEEFLVILFNCPEHRGKGCPAYSGRPARRGHPARCLSGQRPCHGEHGDYEYGGGASRHRNHRPRRRGAVPGERGRAGSVVTVIKPAHAHRFSFTPAVQPVRAKVASSAGLLHPAERQVGVNQRVAVYPNGARLQPVGILQRLADILRPDAGRQAIFGVVCQLERLFPVGDAHQVDHRAEHLFAGQAQPG

SEQ ID NO: 152835 - protein, 154 aa, Glycine max
  Coding DNA Sequence Number=SeqID_61150
  Gene Ontology: Mol. function=hydrolase activity
  Homolog annotation: Hit_ID=Q7CYY4; Match level="QueryCoverage=99%, HitCoverage=59%, E-value=1e-68, Identity=88%"; Hit description =Hydrolase
MGYSMGARISAFLAMAHPERVRSLVFGGLGIGMVEGVGDWDPIAEALLAPSLDVVTHERGRMFRAFADQTKSDRLALAACIETSRVLVTRDQAAKIDAPTLIAVGTKDDIAGSGEELAAIMPHARAIDIPGRDHMLAVGDRVFKAAVLDFYRSF

SEQ ID NO: 152836 - protein, 290 aa, Glycine max
  Coding DNA Sequence Number=SeqID_61151
MAKFDPEIVLEFYVNAWPTEEGVRDMRSWVRGQWIPFDADAIGQLLGYPLVLEEGQECEYGQRRNRSDGFNEEAIAQLLCIPGQDFARTAAGRRVRIMRTNMTTLTQIWMTLLLSNILPSDHNSDLPLPKCMAPTRHPLDPDKSNRALGFPSLITGLCQSFGVPVAPTKVIRPPITRAFIEKYCTQRQAQGDAPQAAGAPPPPHQAGQAGAFDMEQYLRHLMSLSMQSQGFASFSCPTPDQFRAEVAWPGDWPEAQAGEAPPEAPDGGEEAHEDEEMADLLDFLGGSGDT

SEQ ID NO: 152837 - protein, 196 aa, Glycine max
  Coding DNA Sequence Number=SeqID_61152
  Gene Ontology: Mol. function=heat shock protein binding; Biological process=protein folding
  Homolog annotation: Hit_ID=Q3E8V1; Match level="QueryCoverage=20%, HitCoverage=27%, E-value=3e-10, Identity=78%"; Hit description =Uncharacterized protein At5g28950.1
MGDSQENNKGKSRDKDNYVSWTMEDTNELLHLLVDAMNRGLRDANGSLSKQNVERIILPQLNAKTKDEVVSKPSHPSHNKLRGKSMVDYEYLKIVVGGGVSSGNNSISVDPDDTDATTFEPENRTVGIEEFSYDPNSDTFITPNNYEPAYQPPSPRSACNFDLEFMYVLSGWEGSAHDSKVLSDALARKNGLKVPQ

SEQ ID NO: 152838 - protein, 78 aa, Glycine max
  Coding DNA Sequence Number=SeqID_61153
MCGISCQSSRHQLDLAPYASGPYNAQWNAPRLLYDKHTLRSSRILGEMEVDEPWLGLWLPLNYQVDMGASQHRTPELG

SEQ ID NO: 152839 - protein, 101 aa, Glycine max
  Coding DNA Sequence Number=SeqID_61154
MVLGQNSKMVVTNGAFPTGGETLEICITSRIAVSLKTTWLGSWRWDMRWRRNLFDHESHLAVHFMEEISSVPIQRQEDVCHLFFNCKLTNGLWWESMRWFG

SEQ ID NO: 152840 - protein, 142 aa, Glycine max
  Coding DNA Sequence Number=SeqID_61155
  Gene Ontology: Mol. function=transcription factor activity; Biological process=regulation of transcription, DNA-dependent
  Homolog annotation: Hit_ID=P0ACQ6; Match level="QueryCoverage=93%, HitCoverage=43%, E-value=4e-67, Identity=92%"; Hit description =Hydrogen peroxide-inducible genes activator
  Pfam annotation: Domain name=LysR_substrate; Domain location=1-131; Score=-23.0; E_value=0.099; Accession=PF03466.11; Description=LysR substrate binding domain
DDAGYLRKTHPWAERDRVPMADLAGEKLLMLEDGHCLRDQAMGFCFEAGADEDTHFRATSLETLRNMVAAGSGITLLPALAVPQERKRDGVVYIPCIKPEPRRTIGLVYRPGSPLRSRYEHLAEAIRSTMDGHFDKALKEAV

SEQ ID NO: 152841 - protein, 97 aa, Glycine max
  Coding DNA Sequence Number=SeqID_61156
MDAKAPSQGPKKGRMSSSKGLRTKLGYDRPHLLVLLSYYPLQLWGKSHILVLFTLRPTRFFLEIDGRVLGISPFEGLVVGSGIFKRKEINMQMNENG

SEQ ID NO: 152842 - protein, 85 aa, Glycine max
  Coding DNA Sequence Number=SeqID_61157
MAEQSEILFNQLVYSCAFEKHRGHEEFIPDHFLGFQLSGETHAFHDQGKTVIKENTVVLMPLQSLQGVVFQASSVILQKTIQYAS

SEQ ID NO: 152843 - protein, 448 aa, Glycine max
  Coding DNA Sequence Number=SeqID_61158
  Gene Ontology: Mol. function=betaine-aldehyde dehydrogenase activity; Cellular component=cytoplasm; Biological process=glycine betaine biosynthetic process from choline
  Homolog annotation: Hit_ID=A7MFA7; Match level="QueryCoverage=96%, HitCoverage=91%, E-value=0.0, Identity=78%"; Hit description =Putative uncharacterized protein
  Pfam annotation: Domain name=Aldedh; Domain location=15-448; Score =631.7; E_value=6.3e-187; Accession=PF00171.13; Description=Aldehyde dehydrogenase family
MSRFTEQHLYIDGQYVAAAAGDTFQTINPANGEVLAEVHEAAQADVDRAVAAAQKGQKIWAAMTAMERSRILRRAVDILRERNDELAALETLDTGKPLSETQAVDIVTGADVLEYYAGLIPALEGQQIPLRDTSFVYTRREPLGVVAGIGAWNYPIQIALWNLRRRWRPLAEIYSEAGVPDGVFNVLNGRGAVTGQLLTDHPGIDKISFTGGVASGKKVMANAAGSTLKEVTMELGGKSPLIVFDDADLDLAADIAMMANFYSSGQVCTNGTRVFVPTALQQAFEAKIAERVARIKAGDVNDPATNFGPLVSFPHRDNVLRYIESGISEGARLLCGGKRMSGAAFDNGAWVEPTVFTDCRDEMTIVREEIFGPVMSILTYDSEEEVVRRANATEYGLAAGLVTRDLNRAHRVIHQIEAGICWINTWGESAAECRWAVTSTPASAARMV

SEQ ID NO: 152844 - protein, 102 aa, Glycine max
  Coding DNA Sequence Number=SeqID_61159
MSIELIHESSKLWIQHIPEFLNKIEVKAIRPRTLIPSTTPHCFFDLLVREWGNQLFSLPLRNRFEVNSIQGQCPPNPPADPFTRPPSPFFGTPFAAATSQTP

SEQ ID NO: 152845 - protein, 180 aa, Glycine max
  Coding DNA Sequence Number=SeqID_61160
  Homolog annotation: Hit_ID=Q474S2; Match level="QueryCoverage=99%, HitCoverage=61%, E-value=2e-30, Identity=41%"; Hit description =Putative uncharacterized protein
  Subcellular localization annotation: CTP_CleavageSite=46; ConfidenceScore=5.06e-01
MSERFGDVVVLTGLILCLYLFNFDVPSSVRALFFIFVTVSGLGLAVFFAVTKVFVYLNRHLVLSSHTPRGLRILKTSYALTAFETTIQRSIEGRLSALFLISIMIWGCEIAAVTVATRQIMTAYPDIAEIVTSGLLASITGSSLQVEAAALVYQSGAVIVLSLLFITMLTLTFHRTRRSK

SEQ ID NO: 152846 - protein, 71 aa, Glycine max
  Coding DNA Sequence Number=SeqID_61161
  Homolog annotation: Hit_ID=A5BEV8; Match level="QueryCoverage=85%, HitCoverage=7%, E-value=4e-08, Identity=44%"; Hit description =Putative uncharacterized protein
GFIDHIVDVKADDNCGYRSIAALLGMGEDSWSLVRNELIKELGKWSHDYINLFGGTERFEELRLVWTSGWI

SEQ ID NO: 152847 - protein, 102 aa, Glycine max
  Coding DNA Sequence Number=SeqID_61162
MFKKRIEKSEKKVFNEKKAKKAYITWDANDMDSSEDSENEVVNLSIMAKSYESDEEKGHGICRNLLFGGRVTRGLTGESSKKGKCAESPPMFIRGNVGKTEK

SEQ ID NO: 152848 - protein, 47 aa, Glycine max
  Coding DNA Sequence Number=SeqID_61163
MKNFHRIAYGSVTEVFGNFTEVLRKPQKPRKPFFKNVEELAAQLLPP

SEQ ID NO: 152849 - protein, 46 aa, Glycine max
  Coding DNA Sequence Number=SeqID_61164
MGAKYLEAVKQRLHAIKQWSPDKIRVIEKIIQWKSRARNYADTVDL

SEQ ID NO: 152850 - protein, 44 aa, Glycine max
  Coding DNA Sequence Number=SeqID_61165
LGNDIHGAPKNNGEWRIALEGTALGNDIHGAPKKSLLAGPNGPP

SEQ ID NO: 152851 - protein, 72 aa, Glycine max
  Coding DNA Sequence Number=SeqID_61166
MVQVEARDHNMAGLCGVSKGFGLGIIIIPTVATGMESSATTLLPIFFSFTSALQIMLSTMRKLIGDGALVER

SEQ ID NO: 152852 - protein, 198 aa, Glycine max
  Coding DNA Sequence Number=SeqID_61167
MSPFLVRDFGAQNSKTIQRIHKAWETPLKKDQELRGIRNGIIGGYHEWLKVHIRAREFEASEEDEEVQTLKSELGKAKLAKEKFKLAATHVRKECAGLREENAITARALEQETKRARKEEYGRNKFRGALWGSNSELKLRKEERDQSRAHSMVLKEELVACSRSKRSLSQRLCETETNMLAIIAKYQEELGLATAHEA

SEQ ID NO: 152853 - protein, 120 aa, Glycine max
  Coding DNA Sequence Number=SeqID_61168
MIMRGQDIYNSQDEATTSPYSSESEEAKGEESSEEIYPKEEGQPLMVKEKCKEVSVSSKRLAKKESHFAIKTHIKETFSLRQHPHLLLCKKTLVSIATPLGLEIVPQVKKLLDEVWFVRA

SEQ ID NO: 152854 - protein, 80 aa, Glycine max
  Coding DNA Sequence Number=SeqID_61169
  Subcellular localization annotation: CTP_CleavageSite=31; ConfidenceScore=5.13e-01
MGKAIVVAATSAVAKVNPMPPSDLNQMNHPTSDMVGKDLGSMDGPMMCKFKTSMSSLPTIHHPMWRTLPMRMSILHSDTH

SEQ ID NO: 152855 - protein, 183 aa, Glycine max
  Coding DNA Sequence Number=SeqID_61170
MEKRVLPEASSKSFFSLGMEWQGHVLEATTANPWRKGGTQGSSAHEGQAIIEGFSSHIPCLIPCLHLTKESSSSSSSTAHSRDKGVLEGKNQSGRSWSEKLGNTSCVMTMTRCEFCTSEFNVKFFQGVALEEDDNKAEALDSRMCSTRMPPKPSYMLSKEIRQRNGFEARVEGIFGMSRKREV

SEQ ID NO: 152856 - protein, 744 aa, Glycine max
  Coding DNA Sequence Number=SeqID_61171
  Gene Ontology: Mol. function=ligase activity, forming carbon-nitrogen bonds; Cellular component=cytoplasm; Biological process=tRNA processing
  Homolog annotation: Hit_ID=Q8RY55; Match level="QueryCoverage=99%, HitCoverage=98%, E-value=1e-161, Identity=45%"; Hit description =RASPBERRY3
  Pfam annotation: Domain name=ATP_bind_3; Domain location=113-321; Score=226.8; E_value=4.9e-65; Accession=PF01171.11; Description=PP -loop family
  Subcellular localization annotation: CTP_CleavageSite=18; ConfidenceScore=5.32e-01
MARGLILSSPTLTATTCLFASISKTPPKSFNLSFGLKLIHHHYHLIPSPCSFSVDSSPSQCSIDISKYTETFSRRMAMAGLKPHHRIGQLLFVSLIFPAEKLNLFCKMQIFAQLALGVSGGPDSMALCVLTAGWKTAGADAVTSENGGFIDGLLAIIVDHGLRAESKEEANIVSHRVSKMGIRCEIACCDWPSGRPKQGQLQEAAREMRYQIFQEVCAQHRIGVLLIAQHADDQAELFILRLSRNSGVLGLAGMPFTSQIFPTYTQSYREVQANQGILLVRPLLEFSKEDMYKICQGGSENWVEDPTNQSPLYARNRIRMVLNNLSSSAFKFELQALISACRITRTYVDQIAYSLIRDAVVIKDHGYVVIDLQILCPLKVEDICLMKFLSLILQFVSQRQRQIRGSALKLLMDYIRTFPCKNSVTAAGCYLCPDPGSRGSRVLVCCCSNGCAFPLKIEYFESQSQGQQGCCVANELEKIIEAEKSYANHLVLDASDVHFLDVNPELVLTEAKRLNIIGESTYNSIFALQKQETAHFRSKTEVISDSASKHGVTPFSKSLQPGQFCYFMDRFILTWKLKNNIDNDKLSGLVDYEMDLGEETRSLCCTSCVAGNNKVPEVRHMIESDWLYLAELSKYPLSKNFPQYEVKSVNGTKQIMDRTSPCLHYASVSAKQALRLLKSIPVAARRSLPVLINQQGQLLSIPHWDLILHSGIFQSVNFKHCPFLMVHMEFKPKIPLGGGHTSFI

SEQ ID NO: 152857 - protein, 75 aa, Glycine max
  Coding DNA Sequence Number=SeqID_61172
MVVYVLETTPKFSVGGMPKEKKVQVADDSLSEWHPLSKAYSSLSGLGNPRRERVRDVFAQCAASQPIEDGVSSRA

SEQ ID NO: 152858 - protein, 107 aa, Glycine max
  Coding DNA Sequence Number=SeqID_61173
  Gene Ontology: Mol. function=monooxygenase activity; Cellular component=endoplasmic reticulum; Biological process=electron transport
  Homolog annotation: Hit_ID=Q9FSZ4; Match level="QueryCoverage=96%, HitCoverage=71%, E-value=1e-33, Identity=65%"; Hit description =Putative uncharacterized protein
  Subcellular localization annotation: CTP_CleavageSite=44; ConfidenceScore=5.17e-01
MPSLTFLSNPYFFAALSASLTLLMVQVLFRKLNKRHSKKKYHAVAGTIFNQMLNFNRLHHYMTYLAAKHRTYRLFNPFRYEVYTSEPTNVEYILKTNFENYGKVDIC

SEQ ID NO: 152859 - protein, 177 aa, Glycine max
  Coding DNA Sequence Number=SeqID_61174
  Homolog annotation: Hit_ID=A7PY22; Match level="QueryCoverage=72%, HitCoverage=4%, E-value=6e-48, Identity=68%"; Hit description =Chromosome chr15 scaffold_37, whole genome shotgun sequence
MTPPDILRWFLRNCLRFDFVKSDFSSSENYFLASMEFTVISTNLKTIFRNPKAIKPYAVPSPEHCNLPAAAMHTSSHMVEVVGLNAPAAQVAQHKWQPNTPDGQGTPFFFQHGKATSGSVGGNLTRTFKGPAGTGEEWQYPQALAFSVSGIRSQAIVSITCDKEIITGNYIVKICCL

SEQ ID NO: 152860 - protein, 115 aa, Glycine max
  Coding DNA Sequence Number=SeqID_61175
  Homolog annotation: Hit_ID=A7PY44; Match level="QueryCoverage=43%, HitCoverage=10%, E-value=6e-10, Identity=63%"; Hit description =Chromosome chr15 scaffold_37, whole genome shotgun sequence
MLKMWRPYSSARKALMLWGRWCLESGKMGLFSGIFMGVLFGIALMAGWARMMKYRSAKRIAKAMLEKLLINREVISRKTVPKTPTTELHLGFVLDKNWVSIGFMGVSNCQQSIHW

SEQ ID NO: 152861 - protein, 204 aa, Glycine max
  Coding DNA Sequence Number=SeqID_61176
  Gene Ontology: Mol. function=ARF guanyl-nucleotide exchange factor activity; Cellular component=intracellular; Biological process =regulation of ARF protein signal transduction
  Homolog annotation: Hit_ID=A7PER9; Match level="QueryCoverage=74%, HitCoverage=11%, E-value=2e-38, Identity=56%"; Hit description =Chromosome chr11 scaffold_13, whole genome shotgun sequence
MVGAFSQNIMTLTGLPMILLSESDLTNPLCGVSCYVLLSAPGWFFTDMGVISFNLAEELHYMSSNRINYFNFVIFAMVDELHEKMLEYSRRENAERESRSTEETLKLAMELLSDMYLQSLRQITESSGFRTFWSGILRRKDTCMKADLGQYGPSTLGEIIPDLLRKIITQMKEEGILEPRYVGDYIYLDTVDICPHLKDELFPL

SEQ ID NO: 152862 - protein, 67 aa, Glycine max
  Coding DNA Sequence Number=SeqID_61177
MDYGIIVTITWGTEKSIQFRSTPCTLWPVCRVEKKYGTVGMGTHWPNNSPQSIDSSQEEKNGYLTKP

SEQ ID NO: 152863 - protein, 1129 aa, Glycine max
  Coding DNA Sequence Number=SeqID_61178
  Gene Ontology: Mol. function=mismatched DNA binding; Cellular component=MutSalpha complex; Biological process=response to DNA damage stimulus
  Homolog annotation: Hit_ID=Q9SMV7; Match level="QueryCoverage=99%, HitCoverage=97%, E-value=0.0, Identity=57%"; Hit description=DNA mismatch repair protein MSH6-2
  Pfam annotation: Domain name=MutS_I; Domain location=310-424; Score =165.3; E_value=1.6e-46; Accession=PF01624.11; Description=MutS domain I
  Pfam annotation: Domain name=MutS_II; Domain location=430-566; Score =26.1; E_value=0.00013; Accession=PF05188.8; Description=MutS domain II
  Pfam annotation: Domain name=MutS_III; Domain location=582-809; Score= 59.5; E_value=1.1e-14; Accession=PF05192.9; Description=MutS domain III
  Pfam annotation: Domain name=MutS_V; Domain location=814-1069; Score =408.7; E_value=8.8e-120; Accession=PF00488.12; Description=MutS domain V
  Pfam module annotation: Pfam domain module=MutS_I::MutS_II::MutS _III::MutS_V; Domain location=310-424::430-566::582-809::814-1069
MEGARQGEVETVSPMGGARQADVMVPPPNGNVTAAVNQRPPADDVRGTDTPPEKVPRRVLPANFAPNEKESGPSLFESIMHKFVKVDDNERVTQRVCVSHIYQEGNACVDALAKLACNMEVDVLMYEQPPAYLTLLLCSDVIRVTAPQLISLSHSLNGSLPKSSLPVGICADTDCKVVNKAEAAFQPLVKVKDNAVNFKEKANQENIVVVETDDNVTGPETPGMLPLASHVKRSREDGSKFGSLLNSGKRVRFLDGSLELDMTKKEAEVASKFEWLDPSRIRDANGRRPDNPLYDRTTLYIPPEVLGKMSASQKQYWSVKCKYMDVLLFFKVGKFYELYEMDADIGHKELDWKITLSGVGKCRQVGISESGIDDAVLKLVARGYKVGRVEQLETSGEAKSRGANSVVRRKLVQVLTPSTNVDGNIGPDAVHLLAIKEENNVLDNGAVVYGFAFVDCARLRFWVGSIDDDASCSALGALLVQVSPKEVIYDSRGSRTLQFTPVQSITDLVNNEIRDLIHSKGYFKGSSHLLDHVLSNVIHREITLSALGRLIGHLDRLMVHFCTYNDALLERNGDLYPYQVYKGCLKMDGPTMINLELFFNNEDGSLYNCLDKCVTSSGKRLLRNWICCPLIDPEIINKRLDVVDDLMANPEIVPHIAQHLRRLPDLEHLLGRIKSSLQLSGPLLLPLLGKKILKQRVKVFGSLVRGLRTALSLLLLLQKEQPLISSLTKVFKLPILTGSNGLDQFLAQFEAAVDSDFPNYQNHNVADSDAETLKILAELFLEKAAQWFEVVHAINCIDVLRSFAVTSTFSCGTMSRPVIVASKGTSKDNGRTVLKMKGLWHPFALGDSGCLPVPNDVILGENEDGLYPRTLLLTGPNMGGKSTLLRSTCLAVIMAQLGCYVPCESCVLSAVDIIFTRLGAKDRIMTGESTFFIECTETASVLQNATQDSLVILDELGRGTSTFDGYAIAYAVFRHLIEKVNCRMLFATHYHPLTKEFASHPRVIMQHMACAFNSKSDTHSMRDQELVFLYRLASGPCPESYGLQVALMAGIPEKTVNIASKSSQKMKKSIGQSFRSSEQRSEFSTLHEEWLKTLVSISRIEDCNSLDEDALDTLISLWYELKTSFISGK

SEQ ID NO: 152864 - protein, 194 aa, Glycine max
  Coding DNA Sequence Number=SeqID_61179
MCHPGVPFVNREGLMVHRRWLVSPLARHAPRQVHDGGGSGESGSVKHCVCSPSQHPGSFRCRLHHGDIEWNDALSDIFEQVERVVDNLKSVNGERGVDVGGATRPDAAAAAAGDEAELAAAVADGDGEGVIGEGEEVSIVDFNGDGEGEVENGPRVGSDPDAVESDSGKADLRVGGVEEESGAGDEEEEEERGG

SEQ ID NO: 152865 - protein, 239 aa, Glycine max
  Coding DNA Sequence Number=SeqID_61180
MRLWWKGSDGEYNKITMDSHALELSNYVIANSCEVELFVECAGGNKVVVDGNFSGDSKDSSDESVKDEGDSSNDACASVFVHKDDDIANNQRVCVELIEVSNDYFNQEENLNLPSEVQSNAHFRLVDKVDGGKKVVGKGEKASSGGKKLPGRDHNTRRCSLPPLVVPEEVNEEASRAIEVVAEDTTQGANVEVQTRQLNVVKGGIEGATEGGNAVQTGQVNVVEGDTKGVAEAGTEGGG

SEQ ID NO: 152866 - protein, 142 aa, Glycine max
  Coding DNA Sequence Number=SeqID_61181
MVNWGVIPTLAMTLLPAAPDLDVQKGCAYTSLIGFLADDDKEHPVFPTNLKLLLPKPTASSSMASQGHGNKLIVSTSPKSDSGGGGGGTGSLPKGQCLCSPTTHEGSFRCRLHRGHTASPANWMKRSKSMPANKPVVSDSTC

SEQ ID NO: 152867 - protein, 692 aa, Glycine max
  Coding DNA Sequence Number=SeqID_61182
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=92%, HitCoverage=84%, E-value=0.0, Identity=65%"; Hit description=BY-2 kinesin-like protein 10
  Pfam annotation: Domain name=Kinesin; Domain location=134-452; Score =435.7; E_value=6.6e-128; Accession=PF00225.14; Description=Kinesin motor domain
MPRSNSAVHHHRQSSDNFMFDAHGRWLLSSTYAQEFGTRSSSLRRNDDDRVLASGLLDLHSFDTELLPEMYGVHNEYLTNHTVRGQSSDDYESILSGNKLVPRSRGLPESHLLKSVSTEKERAKNAAKIKVVVRKRPLNKKEIAKKEEDIISIDSNFLTVHERKLKVDLTEYIEKHEFVFDAVLNEDVSNDEVYAETVEPIVPLIFQRTKATCFAYGQTGSGKTYTMQPLPLKASHDLLRLMHHTYRNQGFQLFVSFFEIYGGKLFDLLNDRKKLCMREDGKQQVCIVGLQEYRVSKVETIKEFIERGNATRSTGTTGANEESSRSHAILQLCIKRSADGTDSKPARLVGKLSFIDLAGSERGADTTDNDKQTRIEGAEINKSLLALKECIRALDNDQGHIPFRGSKLTEVLRDSFVGDSRTVMISCISPSSGSCEHTLNTLRYADRVKSLSKGNSSRRDPLSSSNLRDSTVLPGSSVLSRDETMEDEITYVSSDKNRFGWPKQLEREPSPPNNVDRVPSGRMGGNLAPSMYSDPQNGQRGSQNARTANEYDYLGLAYEQDRRRKTSKRVDNNQLAAVEDNRKIESRVKHVDESDFEANHSDPHDNLNALLKEEEDLVTAHRRQVEETIGIVREEMNLLVEADQPGNQLDDYIYKLNTILSQKAAGIFQLQSQLAQFQRRLNEYNVVVTSGN

SEQ ID NO: 152868 - protein, 144 aa, Glycine max
  Coding DNA Sequence Number=SeqID_61183
  Gene Ontology: Mol. function=cysteine-type endopeptidase activity; Cellular component=endoplasmic reticulum lumen; Biological process =proteolysis
  Homolog annotation: Hit_ID=Q6Y1E6; Match level="QueryCoverage=61%, HitCoverage=33%, E-value=2e-20, Identity=48%"; Hit description =Cysteine protease 8
  Pfam annotation: Domain name=Peptidase_C1; Domain location=49-144; Score=-114.5; E_value=0.0019; Accession=PF00112.14; Description =Papain family cysteine protease
MVAKNHFYHIAFAMLLCMAFLAFQVTCRTLQDASMYERHEQRMTRYSKAKGSSYTVKDQGQCELVDCDTKGVDQGCEGGLTDDAFIFIIQNHGLNTEANYPYIRVLMESAMQMKQPRMLLLLITGYEDVPANNEKAHTSKSCGQ

SEQ ID NO: 152869 - protein, 88 aa, Glycine max
  Coding DNA Sequence Number=SeqID_61184
  Homolog annotation: Hit_ID=A5AV98; Match level="QueryCoverage=98%, HitCoverage=11%, E-value=1e-18, Identity=51%"; Hit description =Putative uncharacterized protein
MTVADSIKIALPKTDNAKEFMELVGERSQTADKFLVGTLMSTLITMKFDGSRTMYGHAIDMTNIAIRLKTLGIIVNENFLVQFILNSL

SEQ ID NO: 152870 - protein, 248 aa, Glycine max
  Coding DNA Sequence Number=SeqID_61185
  Gene Ontology: Mol. function=phosphoprotein phosphatase activity; Biological process=intracellular signaling cascade
  Homolog annotation: Hit_ID=Q5XM22; Match level="QueryCoverage=53%, HitCoverage=89%, E-value=2e-41, Identity=56%"; Hit description =Resistance-like protein HAAS-2
MELLEVFGEEARAETVRARGAYVRLSWVREIYEMRCRTRRWIVAAHAYLLHLVGWTLFSNKSATNVHVVHLEAFRNLGQSGGYAWGAAALVHMYDQVDEASRITTRQIGGYLTLLQCWTYEHFPSVHQCVTDDAYKETSPRASQWLITKAHMKGIIGASYRARCDDLTVIDVCWFPYSDHRGVRGFEMISSFQGQLRWGPTLVTVRPERVLRQFGYIQSISPLPVSASLSYDDIDDRWMHFSDHVVAA

SEQ ID NO: 152871 - protein, 290 aa, Glycine max
  Coding DNA Sequence Number=SeqID_61186
  Homolog annotation: Hit_ID=Q6WAY6; Match level="QueryCoverage=67%, HitCoverage=31%, E-value=2e-27, Identity=37%"; Hit description =Putative uncharacterized protein
MGTNQTGKKFYQVKVKSLDTTNIKELRRLMEPLQMQAFRKTYGKILELTIAEVSIEAIVSLTRYYDQPLRIATVVKDSARGLDRIKQTRNGIAGLPRRYLEDKARGMANQGDWVPFMDVLALLIFGVVLFPNVDGLVDLAAIDAFLAYHHRKESPVVAVLADLFDTFDRRCEKSSARIICCLPALCVWLVSHLFKQDTRHPCPLLSHRSCTEKRRIDWDQLLAGIGGRTINWFPQWKEGKEGVLFSCGGYPNIPLIGTRGCINYNPALAIRQLGYPIRGAPTEESMSLFL

SEQ ID NO: 152872 - protein, 320 aa, Glycine max
  Coding DNA Sequence Number=SeqID_61187
  Homolog annotation: Hit_ID=Q9ZQF8; Match level="QueryCoverage=45%, HitCoverage=11%, E-value=5e-07, Identity=28%"; Hit description =Putative non-LTR retroelement reverse transcriptase
MGHYERKSSSWVKTRELQVHQGQQSTRAGSGQGQHVTEVLSLILPMLYLGCAIWWDCLAQTPPSIPELQQLAEATQIGEPASSSAEVRQLVDHLNEQAREVASEASMERTPRALAMWTAGLTLAFAISLALAQKTSEMGKKGGGDLLCDRCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRKATREGVKPAKGGLQGDNSNRVAKR

SEQ ID NO: 152873 - protein, 47 aa, Glycine max
  Coding DNA Sequence Number=SeqID_61188
MNKKLKRSKNNSSESKNNSSESKDISGESRTSQEFKNRGRIPDSGRR

SEQ ID NO: 152874 - protein, 165 aa, Glycine max
  Coding DNA Sequence Number=SeqID_61189
NEQPEAYAANIYNRPPQQQNQQQQNNYDLSRNRYNPGWRNHPNLRWANPPQQQQQSVPPFQNAVGPSRPYVPPPMQQQHQRQQATEAPSQPSLEELNPKNVSAITLRSGKQIEVPPPVAAPAPEPVKLHSTPEKEDELASQKRKLPDHEGANKNFHASGPSSIST

SEQ ID NO: 152875 - protein, 91 aa, Glycine max
  Coding DNA Sequence Number=SeqID_61190
  Subcellular localization annotation: CTP_CleavageSite=31; ConfidenceScore=5.13e-01
MMTKVMNKKLKRSKKNSSESKNNSSESKNISSESRTSQEFKNQEEFKTQEESLQSRIKIQDSRSQESRSRFKTQDSRMKKRLNQDKYCGIL

SEQ ID NO: 152876 - protein, 78 aa, Glycine max
  Coding DNA Sequence Number=SeqID_61191
MQSQGLVVPPEPLVCPSSPRVSTKGSCVDPSGNDLEIGDSDRCGLYLEADPARLVAIGRVYEGSTVVHNTPLLYGQVK

SEQ ID NO: 152877 - protein, 216 aa, Glycine max
  Coding DNA Sequence Number=SeqID_61192
MGAKYLKMRSRRDAAAEGSNATPEFDSHHFRSAEHQQRFEAIKGWSFHKERCVQLREDEYTDFQEEIARRHWTSLPTPMAKVDPEIVLEFYANAWPTEEGVRDMRSWVTGQWIPFDADALSQFLGDPLVLEEGQQCEFGQRRNMADGFDEEAIAQLLCTPGQDFARTAAGRRVQIHECLYRFSLSQQGQGFTPFACPTPEQFWAEVAWPKDWPEAQ

SEQ ID NO: 152878 - protein, 147 aa, Glycine max
  Coding DNA Sequence Number=SeqID_61193
MIFFFKKCGASIGCGRRETRRTAPASQESSHRYTSRSGGAHQRGGPRSCLVSLIECCGWMCWLHAKTMQTASSIGAFAVAVTRGEYAIATSGFHGIASPIGDFAMQGGVASQTGEFQAQGAGFSAFSGFSVGRLFQLAGAGVQAKGK

SEQ ID NO: 152879 - protein, 167 aa, Glycine max
  Coding DNA Sequence Number=SeqID_61194
  Gene Ontology: Mol. function=DNA topoisomerase (ATP-hydrolyzing) activity; Cellular component=chromosome; Biological process=DNA unwinding during replication
  Homolog annotation: Hit_ID=Q9KIR1; Match level="QueryCoverage=100%, HitCoverage=22%, E-value=4e-81, Identity=91%"; Hit description=DNA topoisomerase IV subunit
  Pfam annotation: Domain name=DNA_gyraseA_C; Domain location=5-52; Score=19.4; E_value=0.013; Accession=PF03989.4; Description=DNA gyrase C-terminal domain, beta-propeller
  Pfam annotation: Domain name=DNA_gyraseA_C; Domain location=54-108; Score=33.5; E_value=7.7e-07; Accession=PF03989.4; Description=DNA gyrase C-terminal domain, beta-propeller
  Pfam module annotation: Pfam domain module=DNA_gyraseA_C::DNA_gyraseA_ C; Domain location=5-52::54-108
MAADDQKLLMASDAGYGFVCTFNDLVARNRAGKVMITLPDNARALPPMEIHGADDMLLSITAAGRMLMFPVADLPQLSKGKGNKIVSIPAAQAAAGDDKLAWLFVLPPQASVTLHVGKRKLTLRPEDLQKFRAERGRKGTQLPRGLQRIDRVEVDAPVRASGGDSEE

SEQ ID NO: 152880 - protein, 44 aa, Glycine max
  Coding DNA Sequence Number=SeqID_61195
MASIIVAICSFMAFMSAFICSCTSSTPPITLPLARVRGKCKDHA

SEQ ID NO: 152881 - protein, 126 aa, Glycine max
  Coding DNA Sequence Number=SeqID_61196
MGPVLPDSQRPFLGGCAEKGKELEEAAQSGSVDGVIDTSFLVRRHVKWKMARTKKTREMTTEAIKEIVEKIASHFQLTIRIIFLYFVNAMCKCVFSVQDSFEEQASQGSFIPHGRQDVLIAAIGRP

SEQ ID NO: 152882 - protein, 115 aa, Glycine max
  Coding DNA Sequence Number=SeqID_61197
MVIDQSLFYDLTQLSSEGVPFQGAVKDDWKFDFSVHDARQLVYTNQVDMTGRLLVGSLAFESRILHYLIVRILLPRSSNLAQVSEEDLIVMCSSLPLPSFIFFYLQALIHGFLWW

SEQ ID NO: 152883 - protein, 87 aa, Glycine max
  Coding DNA Sequence Number=SeqID_61198
MATTSTISIAQVDAMDEFIQFEDEDMSQVGKSQLDTYLEEANIPNKYHPNLDVLQYWKDNQAVSRSLIIGLWYFKHPNYDRGFRIGI

SEQ ID NO: 152884 - protein, 15 aa, Glycine max
  Coding DNA Sequence Number=SeqID_61199
VNAVKIFPNAQNGLE

SEQ ID NO: 152885 - protein, 149 aa, Glycine max
  Coding DNA Sequence Number=SeqID_61200
QFLGDPLVLEEGQECEFSQRRNRADGEAGADHVHQHDFPNPDMDDVVAQQSGVCHPDTDERHVAQLIADAIYLFAGMPPTKHPLDPNKSNRALGFPAFITGLCQSFGVPVTPSKVIRPPITRAFIEKYCTPRQAQGDAPQAADAPPPPH

SEQ ID NO: 152886 - protein, 78 aa, Glycine max
  Coding DNA Sequence Number=SeqID_61201
MMGKSPRVNGLVGPRLTKGAEDDIAKESFEMDNQSGYLRPCHVTQRCQYDRNCEAADKSEALAPTYPQMRNSDLRSSG

SEQ ID NO: 152887 - protein, 99 aa, Glycine max
  Coding DNA Sequence Number=SeqID_61202
AADTPPPYQAGPAELFDTEQYLRHLVRQQAANHRAHSQGFTSFPCPTPDQFRAEVAWPGDWPEARAGEAPAEAPNEADEAHEDEEMTDLLDFLGGSGAT

SEQ ID NO: 152888 - protein, 65 aa, Glycine max
  Coding DNA Sequence Number=SeqID_61203
YTMNSIITVLYFNGRASKKAIQIKRGISFNALKKKIGDKENILPCKFVMTKTLRRCWKLKLIKLN

SEQ ID NO: 152889 - protein, 77 aa, Glycine max
  Coding DNA Sequence Number=SeqID_61204
MSAQNKLLAKTLETLTTTLSNLPQQLHAVQPSPSSVMHIGGCNICGGAHESGSCMAQEDASIGQGWKSYPGNNFNQG

SEQ ID NO: 152890 - protein, 92 aa, Glycine max
  Coding DNA Sequence Number=SeqID_61205
MCYFRQIFILYVLGEVFIKHPKHGSIPHNLQWLQKKLWGGFPGPTTPCLSNRLVSLTTKIWSNLLVTALMVKTGFYFMSYAERKFGKSFIQK

SEQ ID NO: 152891 - protein, 99 aa, Glycine max
  Coding DNA Sequence Number=SeqID_61206
MGELEKVQEQMKADMEAMKEQMATMMEAIISMKKIREVDMVAVAATNAVAKYGRPHDVKIQNEHAFPSYGLPPNYTPPNVAYTLNENLNNSTPILIENQ

SEQ ID NO: 152892 - protein, 146 aa, Glycine max
  Coding DNA Sequence Number=SeqID_61207
  Subcellular localization annotation: CTP_CleavageSite=29; ConfidenceScore=5.41e-01
MASPLASPPHPPPPLDASASSSALKRTCKASHLRSLSTRPPGADRPVVHIDPTTGKADGPHRKKLRTYLGIVARDKVDVTYENWKEVPTAQKDLIWEDIQFKSDLTRKWALETDQDGVDDTVCDKYDISKEKWAQFCQIHRDPSWE

SEQ ID NO: 152893 - protein, 72 aa, Glycine max
  Coding DNA Sequence Number=SeqID_61208
  Homolog annotation: Hit_ID=UPI0000ECBAF8; Match level="QueryCoverage =56%, HitCoverage=48%, E-value=1e-16, Identity=100%"; Hit description= UPI0000ECBAF8 related cluster
MQPKVVWGSKNRESRVARPGMQAWHWPSFYNVVTGKTLALPNLIALQHIPLSPAGVIAKRPAPIALPNSCAA

SEQ ID NO: 152894 - protein, 347 aa, Glycine max
  Coding DNA Sequence Number=SeqID_61209
  Homolog annotation: Hit_ID=Q84VI1; Match level="QueryCoverage=84%, HitCoverage=53%, E-value=1e-92, Identity=79%"; Hit description =Envelope-like protein
TSRRSKVAIPSKKRKEISSSDSDEDVELDVSTSKKAKTSGKKVPGNVPDAPLDNISFHSIGNAERWKFVYQRRLALERELGRAALDCKEIMDLIKAAGLLKTVSKLGDCYEGLVREFIVNIPSDISNRKSDDYQRVFVRGKCVRFSPAVINKYLGRPTDGVIDIDVSEHQIAKEITAKRVQHWPRKGKLSAGKLSVKYAILHRIGAANWVPTNHTSTVATERSPLSLHYKLFEGTHVPDIVSTSGKAASGAVSKDALIAELKDTCKVLEATIKATTEKKMELERLIERLTDSGIDDGEAAEEEEDPAEQEEAAEEDKEAAEEEEEAAEEEEDAAEETESDDDSEATP

SEQ ID NO: 152895 - protein, 121 aa, Glycine max
  Coding DNA Sequence Number=SeqID_61210
MGIAPTRHPVDPEKSNRALGFPALVTGLYQSYRVHVHPLARSCHPDIGIAPARHPVDPKKSNRVLGFPALITGLCHFYGVPVNPSKFIRPLLIRLSSRSTTPPGRRRARHHSSIRMAGSGQ

SEQ ID NO: 152896 - protein, 85 aa, Glycine max
  Coding DNA Sequence Number=SeqID_61211
MLNGMPRGSSVTSTRCVSSRILGEMEVDEPWLGLWLPLNYQVDTGSSLAYDNGIWGEPYRLFAAKFLFFGGLRHWKCGRQALWLI

SEQ ID NO: 152897 - protein, 68 aa, Glycine max
  Coding DNA Sequence Number=SeqID_61212
MPCQRQPDKETFLWVLCRQSYAPKGHHPAWCGNSVHDPILFEQGIHGSVTKMGALITNDGSKDSNPAK

SEQ ID NO: 152898 - protein, 111 aa, Glycine max
  Coding DNA Sequence Number=SeqID_61213
MSARDISLEVKILVFPELDTPLPVERPSLDGLEALLVLDTPKTLHLLRYCLHGGGIVLRRRDGVLCGGSVVLCLYDGDFRGGGAVLRCRDGALLSGFCVSVAECRQQSQIE

SEQ ID NO: 152899 - protein, 183 aa, Glycine max
  Coding DNA Sequence Number=SeqID_61214
  Gene Ontology: Mol. function=oligopeptide transporter activity; Cellular component=integral to membrane; Biological process =oligopeptide transport
  Homolog annotation: Hit_ID=A7R6G1; Match level="QueryCoverage=86%, HitCoverage=36%, E-value=2e-83, Identity=87%"; Hit description =Chromosome undetermined scaffold_1268, whole genome shotgun sequence
MEAITPKSILMNARTSIKNHNKALDASVIWGMIGPKRLFGPDGLYRNLVWLFLIGAVLPVPIWVLSKIFHEKKWIPLINIPFITYGFAGMPPATPTNNASWLVTGMIFNYFVFRYSKRWWQKYNYVLSAALDAGTAFMGVLIFFALQNVDHNLKWWGSELDHCPLATCPTAPGIEVEGCPVFK

SEQ ID NO: 152900 - protein, 64 aa, Glycine max
  Coding DNA Sequence Number=SeqID_61215
MEVDEPWLGLWLPLNYQVDMGARMAFVDNWAVVKEKTHINPFTGKDQIRKALKVPLELPGSPPL

SEQ ID NO: 152901 - protein, 129 aa, Glycine max
  Coding DNA Sequence Number=SeqID_61216
  Homolog annotation: Hit_ID=A2I5F0; Match level="QueryCoverage=55%, HitCoverage=38%, E-value=6e-21, Identity=70%"; Hit description =Polynucleotidyl transferase
DELSNTKMENFPNASAYHQCLKSPADQLKNVGAPMSKSHLVIQLVLGLTSAYQGVGTLIRQSDPLPSFYQARSMLTLEEAELAKEAAMGLELAMKKKSGGGGLGSNGGKSGCCLMILGTVCRPPASTAG

SEQ ID NO: 152902 - protein, 94 aa, Glycine max
  Coding DNA Sequence Number=SeqID_61217
  Homolog annotation: Hit_ID=A5AT23; Match level="QueryCoverage=97%, HitCoverage=9%, E-value=1e-27, Identity=69%"; Hit description =Putative uncharacterized protein
MDIDYAIRKNESPAITNESSLVVVALYEQWERSNQLNVMFIKTKISVGIHDFVNQHEKVQNLLKAIDDQSITSDKALASTLIMKFSSLRLTSVK

SEQ ID NO: 152903 - protein, 143 aa, Glycine max
  Coding DNA Sequence Number=SeqID_61218
  Homolog annotation: Hit_ID=A6FJQ2; Match level="QueryCoverage=26%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGEQIADVTGDVLTSWRRLVAVRRCCSKHGDRGSRSRKLMIHDVGYNVQDILLENTGIAKSIEAAGSTMSDTMSRTSCPKILELLKALKLQDPR

SEQ ID NO: 152904 - protein, 111 aa, Glycine max
  Coding DNA Sequence Number=SeqID_61219
MITMIVDTLPVFYCKKLVGYMPSSFVDLVFAGKRIEVGMKRGKFDYLASAGTSNRRFGASRAIKKEGEAHAVASAPTWPKPQQTPHNTYQYAQHQPSFSARVGNPSSLVPV

SEQ ID NO: 152905 - protein, 153 aa, Glycine max
  Coding DNA Sequence Number=SeqID_61220
  Homolog annotation: Hit_ID=UPI0001652057; Match level="QueryCoverage =60%, HitCoverage=32%, E-value=7e-09, Identity=35%"; Hit description =conserved hypothetical protein
MKLAKYRLKAQVEKDEGLSGEGQSPRVEKDEGPNLSSFIGSGVYPDLSSFTGSGVYPDLSSFTGSGVYPDLSSFTGSGVYPDLSSFIGSGVYPDLSSFTGSGVYPDLSSFTGSGVIQIFVACIKRSAPTQAKGPSGEGRRPKWRRTKPPSGEG

SEQ ID NO: 152906 - protein, 137 aa, Glycine max
  Coding DNA Sequence Number=SeqID_61221
MSTKFSTIRVLIIYASILISSSFYLKYFLWTLSYPNFVRGLLLDGIQPLIDRFKVLGTLCCTICEVPRRAGNQKEVLLRNPPTWAFQILPPEGGCFWRKQPALTWASWVANSSPILLYIGGGVKKKKVQPSWHFVFT

SEQ ID NO: 152907 - protein, 123 aa, Glycine max
  Coding DNA Sequence Number=SeqID_61222
DHAILRDRTHQPTKKSLLELTSHDALLAQNKSQVVPCVVKLMTQANASPLKKALKKFISWGISRGKGIPKEDFQAFSKVLIISKDNGGHTLATSSIKTRVDPQTGQFNKGLTSFKGRLSWKRP

SEQ ID NO: 152908 - protein, 50 aa, Glycine max
  Coding DNA Sequence Number=SeqID_61223
MSGPCTGGTTRPVKDRSASPAEGTSRPVHTGGGPIDPTQGPTTSFLTATT

SEQ ID NO: 152909 - protein, 174 aa, Glycine max
  Coding DNA Sequence Number=SeqID_61224
SSNLAQVSKEDLIVMWAFHKGRQIDWAYLVRYHMHTALRLNAPLPYPQLVTLFLQHFNIPLDSKPYVPIKRSFLIGASVIASFGYQKEHDGSWVKKGARHVDEEGHGGEDSSLLQKILDKFDGLQTFVGERFDTLELQVDMCFNEMESRITKVEEDVSYIRSSFDLPPPQPPSS

SEQ ID NO: 152910 - protein, 116 aa, Glycine max
  Coding DNA Sequence Number=SeqID_61225
MASMMEAMLGMRQLMEKNVAIAVAVSSAAEADPTLLATAHHPPPNAVGREKSTQGHNNNPHLGYNRVAYPYGLPPNYTPPVMHDDAGHVSSPFLERKPPQQPHEAYEDHQEHAQGD

SEQ ID NO: 152911 - protein, 127 aa, Glycine max
  Coding DNA Sequence Number=SeqID_61226
MHEKEWHRSVFALCPYLGTYRTISKGIITQDNNIVARALHGRARARLTCALSKGGKVHGVATNVYLWKTSEKPKEPVKMKILSSGVVFTLEEGISTSYVDKSGALAPTYPPLERKSDLRSSSLYMDQ

SEQ ID NO: 152912 - protein, 78 aa, Glycine max
  Coding DNA Sequence Number=SeqID_61227
MKNFHRIAYGSVTEAPRLGFSSRKHIFSPKTAKMHSKGFLLETSRNFTDSTMMGGKHFEVVKRRSHADKQWSPDESRV

SEQ ID NO: 152913 - protein, 136 aa, Glycine max
  Coding DNA Sequence Number=SeqID_61228
  Gene Ontology: Mol. function=nucleic acid binding
  Homolog annotation: Hit_ID=A2Q1D6; Match level="QueryCoverage=99%, HitCoverage=29%, E-value=8e-18, Identity=33%"; Hit description =Ovarian tumour, otubain, related
MAKSLVEHPYVGRLTKDEKIIVVDMTKSMVKPRNILLTLKEHNAKQIYNAKLAYRSSIRGSNTEMQQLMMVLDRDRTYKTNRYKLPLLDIVGVTPTGMTFSAALAYLEGEHLNNVVWALQRFQSLFMRVDALPRII

SEQ ID NO: 152914 - protein, 232 aa, Glycine max
  Coding DNA Sequence Number=SeqID_61229
  Homolog annotation: Hit_ID=UPI00016621D1; Match level="QueryCoverage =81%, HitCoverage=39%, E-value=9e-08, Identity=28%"; Hit description =UPI00016621D1 related cluster
MHALGFRRLHVLVFRGLLALAFKGLHILAIRGLHALTLRGLHVVAIRGSRTLTFRGLHILPIRGSRTLTFRSLHVLAFRGLHVLAFRGLHVLAFKGPHRATRPRHQRATRPHLERTTCPHLQKNTRPHLQRTIRTRLRGLHVLIFRGLHVLDFRGLHVLAFRGLHVLTFRGVHVLAFRGPHVVAFRGLHVLTFRGLHTLPSEDYTSSPSEGYMSSPSESYTASPSEDYTSSP

SEQ ID NO: 152915 - protein, 42 aa, Glycine max
  Coding DNA Sequence Number=SeqID_61230
MEYLLVGDEQKRETESKNAKNDDPRTANSGGSPRRAQLAQAS

SEQ ID NO: 152916 - protein, 430 aa, Glycine max
  Coding DNA Sequence Number=SeqID_61231
  Gene Ontology: Mol. function=L-seryl-tRNASec selenium transferase activity; Cellular component=cytoplasm; Biological process =selenocysteine incorporation
  Homolog annotation: Hit_ID=A8G7W0; Match level="QueryCoverage=99%, HitCoverage=92%, E-value=1e-148, Identity=64%"; Hit description=L -seryl-tRNA(Sec) selenium transferase (EC 2.9.1.1) (Selenocysteine synthase) (Sec ...
  Homolog annotation: Hit description=synthase) (Selenocysteinyl -tRNA(Sec) synthase)
  Pfam annotation: Domain name=Cys_Met_Meta_PP; Domain location=88-425; Score=-296.5; E_value=0.051; Accession=PF01053.11; Description=CysMet metabolism PLP-dependent enzyme
  Pfam annotation: Domain name=SelA; Domain location=79-430; Score =763.0; E_value=1.9e-226; Accession=PF03841.4; Description=L-seryl -tRNA selenium transferase
  Pfam module annotation: Pfam domain module=Cys_Met_Meta_PP::SelA; Domain location=88-425::79-430
MKALYSQLPAIDSLLRDPALQPLLAQSGTAFITRQLRGMQQEARDHIQQHQSLPHWHASWPDEALRRAQQQQQSALRPVFNLTGTVLHTNLGRAQLSDRAIAAVSACLRQPVTLEYALDDAARGHRDRAVSALLCELTGAEAACIVNNNAAAVLLMLASLAAGRDVIMSRGELVEIGGAFRIPDVMRQAGCRLVEVGTTNRTHLKDYRGAIGGDSGLLMKVHTSNYQIQGFTHAVPEAELVQLGDAHGLPVISDLGSGSLVDMTAYGLPPEPMPQQLIAAGVSLVSFSGDKLLGGPQAGIIVGKKALIDQLQQHPLKRALRVDKMTLAALEATLQLYRQPETLHEALPTLRLLTRSAHDILQQAERLMPALEHAFSADFSLAIAACSSQIGSGSLPVERLPSFAITFTPRDGHGSQLNALAQRWRQLARP

SEQ ID NO: 152917 - protein, 878 aa, Glycine max
  Coding DNA Sequence Number=SeqID_61232
  Gene Ontology: Mol. function=formate dehydrogenase activity; Cellular component=formate dehydrogenase complex; Biological process=electron transport
  Homolog annotation: Hit_ID=Q0SZ85; Match level="QueryCoverage=31%, HitCoverage=100%, E-value=1e-115, Identity=76%"; Hit description =Protein fdhD
  Pfam annotation: Domain name=FdhD-NarQ; Domain location=424-667; Score=417.2; E_value=2.4e-122; Accession=PF02634.6; Description =FdhDNarQ family
MVRMFCAPTECCVQPSAYRNEVEIRFWRAADALDHFRRITADVLLQQIPDAARMVQAVIAFGKAVVAQLVVPAGFVIFAIGFVVAAEQAIVEMVILPHDQAGIGVRLHIFMLDFVILQQPQQHTRQEGNVGAGADRRVKVCHRCRAREARIDNNQFGFVVNFGFHRPAETDRMRLSSVSAHHHNQIGITDVDPVVGHRTATKCWSKTCYRWSVSDACLVVDRQHTERSGRSAQHAGGEPAVYRHAGGVLRDKVGVAIGFHQLRDARKGVIPADALPFVGAWRTVFRIFQTAVAVDKIKQARAFRTERAAAHRMVRIPFDVENGLFGVFRAIAEARGFRRKAEQCCRGSCHTASADLEEFSSADVHGRGSEWLHAGLRQKRPDITTTLMWLLCETREVKAKQQKSNQNVNEIAGLSQTTVWQRHAITETESDWLAQEVPVALVYNGISHVVMMATPDNLQAFALGFSLSEGIIEQPGEIYGMDVVPGCNGFEVQIELSSRRFMALKAQRRAMAGRTGCGVCGVEQLDQIGKPVQPLPFTQTFDLACLDNGLAQLRDFQPIGNLTGCTHAAAWMSPQGELQGGCEDVGRHVALDKLLGQRSQQHWQQGAVLVSSRASYEMVQKSAMCGVEILFAVSAATQLAVEVAERCNLTLVGFSKPGRATVYSHPQRLINARKWKKTSSQKPNRQDIKSILLVRNEGKIGDAIVSTCFLRALFEAGYRVDILARDKYDTAIGSEVVTLLRDNAYDLLIDTAIWQTALYMPKMIADINPKMTLGFNKPGWLKPYDINIQFDHLNNHVKNIYRAVLDYLQVETVDGLNYEIFYPERIDAEIHQSGMFSADEHNILINIYASHADRDLSEQQLNELIGAIVRHNAATNIV

SEQ ID NO: 152918 - protein, 48 aa, Glycine max
  Coding DNA Sequence Number=SeqID_61233
MVKYCVKSKTEMNRGARGRVRMDARLVVNISMSRVRLRTIEKCYWEAA

SEQ ID NO: 152919 - protein, 54 aa, Glycine max
  Coding DNA Sequence Number=SeqID_61234
GIAQAERHPPISKSAKGQAFKHLVNEWQGKMVLFGNLVQPPIVNADSPNCSAPE

SEQ ID NO: 152920 - protein, 93 aa, Glycine max
  Coding DNA Sequence Number=SeqID_61235
MSIWKCSIDVTSRGFTTTDAGYCIFYSINDEDMTKSKGKDPLEGLGGPMTRARARKAKKALQQVLSILFEYKPKFQGEKSKVVSCIMAQMEED

SEQ ID NO: 152921 - protein, 148 aa, Glycine max
  Coding DNA Sequence Number=SeqID_61236
METCLGVEELLQRMIDQGRLEVGSEGREEQHICMQSTDGSSVAKPKPLVIYFTKGTASQKPGHPLAAKPVPFPYQNSHAVPWRYTPPRGKEEEATDVSSLSAKVTNITGLSGVTRSGRVFAPPDLPVQPANVKGKGKVVEEQDDQAPH

SEQ ID NO: 152922 - protein, 221 aa, Glycine max
  Coding DNA Sequence Number=SeqID_61237
MRTWGCINYNPVLAIRQLGYPMRGAPLDESITPFITRGFSDPNAKPWNEKPRRPERKNTCQQSFEGLYKAAVVSSSSRRGEKESSRVKGMILKDELKAYLRSKRNLSQQLSETEGNMWAVIDECKEKLNLAATHEQRLEDEYAKISAEREARERVIDSLHQEATMRMDRFALTLNRSQELPRLLAKAKAMADTYSAPKKIHRLLSYCQHMIDLMGHMIRNR

SEQ ID NO: 152923 - protein, 88 aa, Glycine max
  Coding DNA Sequence Number=SeqID_61238
  Subcellular localization annotation: CTP_CleavageSite=34; ConfidenceScore=5.47e-01
MGEKLATQLAQASKVASSRSNSLLEEGSGRPNFRRSYGNSRIAQKHLFSTSATLRNFTDRASLLPFDFRDVSGLHSLRNKGRQVSHSS

SEQ ID NO: 152924 - protein, 120 aa, Glycine max
  Coding DNA Sequence Number=SeqID_61239
EEPRIGADCLSVTSNKFEIYNEEARNAAQKHKPKRVKSVNADVETFGDHWKVQIGDSTVLKIGDSAKVVIKQDMKGGEHKYGFNNNKREKPEKVRLVDDETGDKHELYEVLRMPSSTKNQ

SEQ ID NO: 152925 - protein, 56 aa, Glycine max
  Coding DNA Sequence Number=SeqID_61240
RNRSLVIDYQVLRLCNSSLASGNRLPRLCNRLPEMKSLKLLLLIACSGYETYCAAA

SEQ ID NO: 152926 - protein, 60 aa, Glycine max
  Coding DNA Sequence Number=SeqID_61241
MENWRTALRNNFAGLQTPLRNNFAGLQTRRWRMHEQRQAMPFMGLRKKLENGELANSAKQ

SEQ ID NO: 152927 - protein, 175 aa, Glycine max
  Coding DNA Sequence Number=SeqID_61242
  Homolog annotation: Hit_ID=A5BSR3; Match level="QueryCoverage=46%, HitCoverage=25%, E-value=1e-07, Identity=40%"; Hit description =Putative uncharacterized protein
MKKWALTADQDGVDDNDVWKKAQAIQKQNTVPHVLSRGGYEYLEQKLLAEKTKKKLEEAAQPGSVDGIIDPPSPVRHHVKWKMARTKKIGEMTTEAAKEITEKIDSFKEQATQESFVPRGRQDVLTVSIERPEHPRHVCAAGAGVTINQYFGSAPWTSHNSSSLPLEELQQLTQT

SEQ ID NO: 152928 - protein, 52 aa, Glycine max
  Coding DNA Sequence Number=SeqID_61243
MGEIVEAKLHDESRVIQRCFEDNNDDNKGDDKKLKGQSKNEFKMFKKESRTI

SEQ ID NO: 152929 - protein, 106 aa, Glycine max
  Coding DNA Sequence Number=SeqID_61244
  Subcellular localization annotation: CTP_CleavageSite=53; ConfidenceScore=5.33e-01
MDRSMTLTNAPRSSMAFSNLLFPIMQGIQKVPGSLHFSGISFRNLAYLGIYLMASRRGMFTSTFLKVSKISFSTSSIFFLGIALGGNGRGIRGCGKSKLLEEAPPA

SEQ ID NO: 152930 - protein, 69 aa, Glycine max
  Coding DNA Sequence Number=SeqID_61245
MGDQEETQEQMKADMSALKEQMASMMEAMLGMRQLMEKNMATAAAVSSAADADPTLLATAHHTPPNTVG

SEQ ID NO: 152931 - protein, 102 aa, Glycine max
  Coding DNA Sequence Number=SeqID_61246
MASRDQVWSFCTHDTRRYLTVIRTPLLFRHSCVRWQAETKFGHSAHMIRGDTLRLSAPLCYLDTVRVRWQAETKFGHSAHMIRGDTLWLFAPILLLSVRQNA

SEQ ID NO: 152932 - protein, 83 aa, Glycine max
  Coding DNA Sequence Number=SeqID_61247
MNGSTGVKPKVEVERDAKVGVLILFSFSDVQAHSMKRKSLTSWILGHGHRNTEFKNLRHLGKQQALVRPDSELELAKKEAPGA

SEQ ID NO: 152933 - protein, 67 aa, Glycine max
  Coding DNA Sequence Number=SeqID_61248
MECPKAPPRYAHVAFESYPQKNGGLREPSRGYGYHCIIKNWQSQHGFLPHPHPFHLPQFSHSSKQDD

SEQ ID NO: 152934 - protein, 45 aa, Glycine max
  Coding DNA Sequence Number=SeqID_61249
MWEEEKKEWKGPWEEEEEEKEEDTRDRGARSNIAGAPSNIKKSPF

SEQ ID NO: 152935 - protein, 59 aa, Glycine max
  Coding DNA Sequence Number=SeqID_61250
DEQKAQVNQRTSQENQEQVKSSRIKKNSRFKKKAYKQESRFKIQDLKNQDQDSRLKIQE

SEQ ID NO: 152936 - protein, 220 aa, Glycine max
  Coding DNA Sequence Number=SeqID_61251
MASNSQQFSARNDAIVIRGVHEVATNPSASSETKKLEGKLDALVNLVTQLALNQKSVSVARVCGLCSSTDHHTDLCPSMQQPGAIEQPEAYAANIYNRPPQPQQQNQPQQNNYDLSSNRYNPGWRNHPNLRWSSPQQQQQQPAPSFQNVVGPSRPYIPPPIQQQQQPQKQPTVEAPPQPSLEELVRQMTMQNMQFQQETRASIQSLTNQMGQLATQLNQQ

SEQ ID NO: 152937 - protein, 121 aa, Glycine max
  Coding DNA Sequence Number=SeqID_61252
  Gene Ontology: Mol. function=isomerase activity; Cellular component =endoplasmic reticulum; Biological process=cell redox homeostasis
  Homolog annotation: Hit_ID=B0HC01; Match level="QueryCoverage=28%, HitCoverage=72%, E-value=1e-11, Identity=100%"; Hit description =Putative uncharacterized protein
  Pfam annotation: Domain name=ERp29; Domain location=81-121; Score= -17.6; E_value=0.031; Accession=PF07749.3; Description=Endoplasmic reticulum protein ERp29, C-termi
GAGAYGKTPATRPFYGSWPFAGLLLTCSFLRYPLILWITVLPPLSELIPLAAAERPSAASHWHDRFPDWKAGSERNAINAGIVESLDVLVKEFVAASDEEKKSMFTRMEEEVEKLKGSASR

SEQ ID NO: 152938 - protein, 325 aa, Glycine max
  Coding DNA Sequence Number=SeqID_61253
  Gene Ontology: Mol. function=aspartic-type endopeptidase activity; Biological process=proteolysis
  Homolog annotation: Hit_ID=A7PT07; Match level="QueryCoverage=69%, HitCoverage=14%, E-value=1e-48, Identity=42%"; Hit description =Chromosome chr8 scaffold_29, whole genome shotgun sequence
MAIPFKTKDVNEEVTSKYIKSLMEQANYTNKYLQALGETIKTKVVPKQKSIEEASPSIPIEKPLFKPFKVSEKAKRKIKELRKTKSLIEGIGDNHSELLNKIGSLLKVIPDTPQTSENTSKMVTRNSDQNSDNTTEIGSVSEKNINPINSKHWKTPSKLYYQRPTAPDLLLEERGENFFKSFSANNIYEWNIDAQTEYNIMNTLQHMTMVATAYQNSHEFSEETIIDILVAGFSGQLKGWWDNYLTNKEKSKIYSAVKTDLNGKVITNDDDQEIPDAVNTLIFTIAQHFIGDPSLWNDRSAELLSNLKCRTLADFRWYRDTFLTR

SEQ ID NO: 152939 - protein, 135 aa, Glycine max
  Coding DNA Sequence Number=SeqID_61254
MHGSKLVGGGCMNENAIHGAPKKRRGWRIALSNHYAWLQTPGWRMHERKRNSWGSEKRRGWRIALSNHYAWLQTRGWKMLERKHNSWGSEKRRGWRIALSNHYAWLQTRGWRMHERKRNSWGSEKKARMENCTKQ

SEQ ID NO: 152940 - protein, 102 aa, Glycine max
  Coding DNA Sequence Number=SeqID_61255
GVWLRGYAARIGVATNLTAELWAWAVRTGLRIALARSFEKGYRKKKIGQTKTKVALLPSREMKKWTSKSKTKNEEALPSLLPSSLSLLQATDKKVRESGLDS

SEQ ID NO: 152941 - protein, 34 aa, Glycine max
  Coding DNA Sequence Number=SeqID_61256
RGASETFSVRNFVKVFDRSSTFFIRSSSFFDLQR

SEQ ID NO: 152942 - protein, 321 aa, Glycine max
  Coding DNA Sequence Number=SeqID_61257
MTTRKTKIVAMQADLYDTFDRRCEKNSTRIVCCTPVLYVWLVSHLFRQEVRHACPLESHRSCTEKGGANWDQLLASKEGASVNWFPRWKEGRTGVLISCGGFPNVPLMGTRKVRKAWEVLQKKDKELRGSNNGPIGGYREWLKAHVQGLDWLPSLRTTKREEDEAPEEDEEVQALRTELKQAQTTKERFKSAALKIRKENDELRDVNMATTKALEQETKRARREEHGRNKFRGALWGSNSKLKLQREERDQLRVDGLILKDELKACLRSKRSLSQRLCETETNMLAIITKYQEELSLATAHEHRVADEYAQVYAEKEARGR

SEQ ID NO: 152943 - protein, 64 aa, Glycine max
  Coding DNA Sequence Number=SeqID_61258
MASSGMGAGDGSGIWLLGYEGPTPSRRRRLGSWPDHPCIKVIHAHDGWQAQALKALHDNGLPPV

SEQ ID NO: 152944 - protein, 55 aa, Glycine max
  Coding DNA Sequence Number=SeqID_61259
MGLKEHSNRVTPKAYTSKSPSGPLPPDSGPTPKNHFLQADTAHELYNNHDLTLVF

SEQ ID NO: 152945 - protein, 145 aa, Glycine max
  Coding DNA Sequence Number=SeqID_61260
MKDKRDEEEKLEKQKKKKDSKALSSKPKGKEKDSSKKIVKKENHFATKGDIKRALILKQSFYLLLSRETSISTAIPLKLEVIPQVKEFLDEGLVHKSFNPCALLVPKIEKGVEERIHEFQEPLDLRSNPFQGGGNDTILPPKGIG

SEQ ID NO: 152946 - protein, 192 aa, Glycine max
  Coding DNA Sequence Number=SeqID_61261
MEKFKLAATHIRKECAGLREENATTARALEQETKRARKEEYGRNKFRGALWERDQSRAHSMVLKEELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 152947 - protein, 83 aa, Glycine max
  Coding DNA Sequence Number=SeqID_61262
PLGPSGIFLQKAVASGGSNPARLGELGGNHLPYFAINRGGRQEGRAEALPKRFRNVFREEFRKDFNRSSTFFIRSSSFFDLQR

SEQ ID NO: 152948 - protein, 169 aa, Glycine max
  Coding DNA Sequence Number=SeqID_61263
MAPKKLSTKRSRRDATGEGSSAALEFASHRFRSAEHQQRCEAIRGWSFHKERRVQLREDEYTDFQEEIARRRWTPLVTPMAKFDPEIVLEFYANAWPTKEGVRDMCSWVRGMEPTRHPLDPEKSYKALGFPALITGLCQSYEVPVTPSKVIQPSITRAFIEKYCTPRQA

SEQ ID NO: 152949 - protein, 136 aa, Glycine max
  Coding DNA Sequence Number=SeqID_61264
LTEARNQSWKPQGPFGLLRVTGSIDPSAGGNRHPVGLQRPITRAGNPKAPLDFFGGRLALWSLGKMLLNSNVIHVRVVMLVRMVRTRLFAAARGKSCPGMHSRCVIASLCGCARTVGRPPISGGGPGTDKRKLLAP

SEQ ID NO: 152950 - protein, 78 aa, Glycine max
  Coding DNA Sequence Number=SeqID_61265
MLVRMIHTRHFAAARVKSCPGMQSSWALASLSGCAHTVGRLPISGGGKGVQPSDGESVQPSEVQDVSPFEGEGVQPSE

SEQ ID NO: 152951 - protein, 147 aa, Glycine max
  Coding DNA Sequence Number=SeqID_61266
MAPPDSIPSVEQFNEMVAWPGTQPSLHREDEGPIAQVPQHVEDESSEDTIPEPFDIGEEANETQVRQVATATPKRSLEATSEPFAPMVNLPSPQPAADPSTPLLQMPEDPTTPILAMDTSPPTTPVLQLTDEENGQTQDTQDQSQEF

SEQ ID NO: 152952 - protein, 67 aa, Glycine max
  Coding DNA Sequence Number=SeqID_61267
MENWRTALRNNFAGLQTRWWRMHEQRLAINSWGSKKSGEWRVGEQRYAITSRDSTRVGGGCMNSARQ

SEQ ID NO: 152953 - protein, 48 aa, Glycine max
  Coding DNA Sequence Number=SeqID_61268
MTSEVGSIVPELSPCDPHSPPTNPQTMDPSSSTSSHHSDSDWPIAIRK

SEQ ID NO: 152954 - protein, 90 aa, Glycine max
  Coding DNA Sequence Number=SeqID_61269
MVNIDPATNKADEASDSRRKKKLLKTVGERWRQFKSDLTRKWALAADQDGVDDTVCEKYDISKEKWAQFCQTHRDPSWEDVRKKAQAIQK

SEQ ID NO: 152955 - protein, 110 aa, Glycine max
  Coding DNA Sequence Number=SeqID_61270
MPLSPVILVTLADSELMSEAPSFLSLGDTHLHDTAWLFLYGNGIDKPFGSRHVLQRFGPARPTRLDGINHSLSMIGKRVCLYVGPVLLKRQPSGFCQTLDLVFEGHALFD

SEQ ID NO: 152956 - protein, 114 aa, Glycine max
  Coding DNA Sequence Number=SeqID_61271
MNEEEEEDVLSPELERLIAQEEREMKPYQEETELVNLGTGEGKKEVKVGSSIVATYPSAGGRRVTRGMRVPRKEYARSRHQRLFEENVGKTGKGAIYELLSERFGSCIYARGRY

SEQ ID NO: 152957 - protein, 83 aa, Glycine max
  Coding DNA Sequence Number=SeqID_61272
  Subcellular localization annotation: CTP_CleavageSite=29; ConfidenceScore=5.33e-01
GQYDRDCGAANKSKALAPTYPPMRNSDLRADNRKASLRATSSWVMVTKSGVVDKSEALAPTYPPMRNSDLRSSGELVRLEKVS

SEQ ID NO: 152958 - protein, 92 aa, Glycine max
  Coding DNA Sequence Number=SeqID_61273
MTVTGFGSILGRIDSLLKGNPSLALEGMNLFRFWRGSITMPIGWTSQNSGADIEDEEITNLRSNPLQGEGDDAILPRKGPVTRAMSKRLQED

SEQ ID NO: 152959 - protein, 192 aa, Glycine max
  Coding DNA Sequence Number=SeqID_61274
MVILEDPRHPEAAGPMTCGDKLWSFRTPLLPFRHICVRWQRRDKLWSFLHPFVILEAAGPMTCGDKLWSFRTPPFAIQTQLFDGTQRQIMVILQPFYHPEVGGPMTCGDKLWSFRTPLLPFRHSRVRWHAETNYGHSAPFCHPEVAGPMTCGEKLWSFRTPLLPFRHSRVRWHAETNYGHSAPFVIQRRRAR

SEQ ID NO: 152960 - protein, 87 aa, Glycine max
  Coding DNA Sequence Number=SeqID_61275
MSLVQPRNPRNGNSDFQYFNNIIEMKDSGIRMLCMENKWVYDPNMVGSWYLTHATKNVTKMQGSCMSKHENKRYAVCRTKSMLNAYA

SEQ ID NO: 152961 - protein, 224 aa, Glycine max
  Coding DNA Sequence Number=SeqID_61276
RLEVGDEGREEQHICMQSADERSFGRPKPSVIYFTKDAASQKPQYPPATKTVPFPYQNSHAVPWRYTPPSEREEETTDVNSLSAKVTNIMGLSGVTCSGHVFAPSDLPTQPANIKGKAKMVKEQNDKTTPTPNEDIPIKGLPEKRDGCGKKEVSLEEASDSEPHRALLVKVLNEAHVAQDISVEGFGACMPRIFFINGFLCFLEDKWQRNGEGGEGGDTTSRRR

SEQ ID NO: 152962 - protein, 282 aa, Glycine max
  Coding DNA Sequence Number=SeqID_61277
  Gene Ontology: Mol. function=alcohol dehydrogenase (acceptor) activity; Cellular component=outer membrane-bounded periplasmic space; Biological process=methanol metabolic process
  Homolog annotation: Hit_ID=P38539; Match level="QueryCoverage=42%, HitCoverage=21%, E-value=3e-69, Identity=100%"; Hit description =Methanol dehydrogenase subunit 1
  Pfam annotation: Domain name=PQQ; Domain location=46-83; Score=40.9; E_value=4.7e-09; Accession=PF01011.12; Description=PQQ enzyme repeat
  Pfam annotation: Domain name=PQQ; Domain location=5-42; Score=23.4; E_ value=0.00083; Accession=PF01011.12; Description=PQQ enzyme repeat
  Pfam module annotation: Pfam domain module=PQQ::PQQ; Domain location =46-83::5-42
MYPGPNGPTKKEMGQIRAFDLTTGKAKWTKWEKFAAWGGTLYTKGGLVWYATLDGYLKALDNKDGKELWNFKMPSGGIGSPMTYSFKGKQYIGSMYGVGGWPGVGLVFDLTDPSAGLGAVGWPSIARRAVTLFSAPRVKRANMFPDVKRVRAGWISACLTLAFSLLPFPALAANALNVCAGKAELPFSNDKQEGFENKIANVIGKALNMPINYFWWTNPLTLQKDMEAGKCDVLIGTDPNDPRVLATKPYYRSAYVFITRKDREIDVTSWDHPYLKEKNFRI

SEQ ID NO: 152963 - protein, 204 aa, Glycine max
  Coding DNA Sequence Number=SeqID_61278
MTQPPPRERTLREMVAPDFTYESLCIQYPDEDVPYVLKTGLIHLLPKFHGLAGVHEVATNSSSSAETKKLEGKLDALVNLVTQLAMNQKSAPVARLYGLCSSADHHTDLCPSVQQSKAIEQPKAYAANIYNRPPQPQQQNQLKQNNYDLSNNWYNPRWRNHPNLRWSSPSQQKQQQQPYFHNVAGLSRPYVPPPIQQQQQQLQP

SEQ ID NO: 152964 - protein, 165 aa, Glycine max
  Coding DNA Sequence Number=SeqID_61279
MATMVEAMMSIKKIMKANTVAIAATSAVAKVNPMPPSDLNQMNHPTSARAGKDLGSTGGPYYAQIKNKHAFPPYGLPPNYTPPNVAYTPNEDTHEIPHHNLADFEPCLGYATEGQAVGGIPLQNTLEGPQFCPQPQPLHFTAGKIPPIMEGKGKVGSSGGKAQGH

SEQ ID NO: 152965 - protein, 152 aa, Glycine max
  Coding DNA Sequence Number=SeqID_61280
  Subcellular localization annotation: CTP_CleavageSite=64; ConfidenceScore=5.09e-01
MFAHSIKGCRPLGRTYGVLIPSPCVNTTPEPFHLKVRRSRLFRFFRRFPQINVGGDSARIPFVEHASRESRVALPPKGVRNDQILSPHVIGRSVPGYGKRMQLPQEPLNKRPRGLARKSMAGTNFAELYGVAIMNSSCEGKKGTSREHIAWF

SEQ ID NO: 152966 - protein, 125 aa, Glycine max
  Coding DNA Sequence Number=SeqID_61281
MGDQEETQEQMKADMSALKEQMTSMMEAMLGMRQLMENNVATAAAVSSAVEANPTLPATAHHPLPNTVGQERSTLGHISNPHLGYNRVAYPYGLPPNYTPPIMRDDAGHVPSPILEGEPPRQPDE

SEQ ID NO: 152967 - protein, 16 aa, Glycine max
  Coding DNA Sequence Number=SeqID_61282
MAKLDHLEERLRAIEV

SEQ ID NO: 152968 - protein, 67 aa, Glycine max
  Coding DNA Sequence Number=SeqID_61283
  Homolog annotation: Hit_ID=A5AYU6; Match level="QueryCoverage=94%, HitCoverage=11%, E-value=3e-11, Identity=52%"; Hit description =Putative uncharacterized protein
MVNLCLMGKDYESDEEVSLKKKCYINSRCSKHMTGDSSKFTHISPKKSGHVTYGDNNKGRILGVRKI

SEQ ID NO: 152969 - protein, 190 aa, Glycine max
  Coding DNA Sequence Number=SeqID_61284
  Homolog annotation: Hit_ID=UPI00016621D1; Match level="QueryCoverage =93%, HitCoverage=40%, E-value=3e-14, Identity=31%"; Hit description =UPI00016621D1 related cluster
GLHILAIRGLHTLTFRGLHVLAIRGLHVLIVRGLHALTSRGLLALAFRGLHVLAFRGLHLLTFRGLHLLAIRELHGLTFRGLHALTFRGLHVLTFRGLHILTFRGLHVLTFRGLLVLTFKGLHLLAIKGLHALTFRGLHVLSFRGMHVQTFRGQHILTFRGVHILTFRGLHTLTFRGLHVLAIRGFMSSP

SEQ ID NO: 152970 - protein, 185 aa, Glycine max
  Coding DNA Sequence Number=SeqID_61285
  Gene Ontology: Mol. function=protein binding; Biological process =defense response to fungus
  Homolog annotation: Hit_ID=A7QXE8; Match level="QueryCoverage=72%, HitCoverage=20%, E-value=8e-37, Identity=58%"; Hit description =Chromosome undetermined scaffold_222, whole genome shotgun sequence
  Pfam annotation: Domain name=LRR_1; Domain location=100-122; Score =12.0; E_value=1.8; Accession=PF00560.24; Description=Leucine Rich Repeat
  Pfam annotation: Domain name=LRR_1; Domain location=125-145; Score =1.1; E_value=1.9e+02; Accession=PF00560.24; Description=Leucine Rich Repeat
  Pfam annotation: Domain name=LRR_1; Domain location=24-41; Score=6.1; E_value=23; Accession=PF00560.24; Description=Leucine Rich Repeat
  Pfam annotation: Domain name=LRR_1; Domain location=49-73; Score=8.1; E_value=9.6; Accession=PF00560.24; Description=Leucine Rich Repeat
  Pfam annotation: Domain name=LRR_1; Domain location=75-97; Score=3.3; E_value=75; Accession=PF00560.24; Description=Leucine Rich Repeat
  Pfam module annotation: Pfam domain module=LRR_1::LRR_1::LRR_1::LRR _1::LRR_1; Domain location=100-122::125-145::24-41::49-73::75-97
LRYLDLSLSGFMGLIPHQLGNLSNLQHLNLGYNYALQIDNLNWISRLSSLEYLDLSGSDLHKQGNWLQVLSALPSLSELHLESCQIDNLGPPKGKTNFTHLQVLALSNNNLNQQIPSWLFNLSKTLVQLDLHSNLLQDLFLSVNSGWAPPFQLEYVLLSSFGIGPKFPEWLKRQSSVKVLTMSKA

SEQ ID NO: 152971 - protein, 84 aa, Glycine max
  Coding DNA Sequence Number=SeqID_61286
NIHKLLISVFLAYLGCLDLLGFLLSLDFLAPTPTQLHTSLLVELLLFYECILDCQGINITAFMSCTWRSMRNATEISSNLTEQN

SEQ ID NO: 152972 - protein, 83 aa, Glycine max
  Coding DNA Sequence Number=SeqID_61287
PLGPSGIFLQKAVASGGSNPARLGELGGNHLPYFAINRGGRQEGRAEALPKRFRNVFREESRKGFDRSSTVLHSFFIVLRSST

SEQ ID NO: 152973 - protein, 92 aa, Glycine max
  Coding DNA Sequence Number=SeqID_61288
IHNSSQHPFVAWPSEGCVEEVKDAEALVPVPTDEEAVSPAKPPESPNEEVMWDATIFGVFNQNFSLYIKHEDLSEIAHGGQCLSISVIQLWI

SEQ ID NO: 152974 - protein, 238 aa, Glycine max
  Coding DNA Sequence Number=SeqID_61289
  Homolog annotation: Hit_ID=A2Q6B4; Match level="QueryCoverage=35%, HitCoverage=37%, E-value=2e-07, Identity=33%"; Hit description =Ribosomal protein L33; Nucleic acid-binding, OB-fold
MDLKEDFSDIIAGQLQFDLLVDIIGVVDEVVFHQISPRSKRVVFKLMNLSNELVLCTLWDDYCVQFMECLDQHENEGPLIMLLTNARIKEGQGSYPCSISNSLKASKLTINEPLTPIEEFNQKLSELGIEIRSVLTRHSQWSSQPSGSVQLSSRETFISKSEAKSIYEINNLCECYKKIDVYPEPFVCPCGKHNDRAVLRVEVMVNYKDENTKFLLWDRECTELIGQSVDEVNTLKIE

SEQ ID NO: 152975 - protein, 124 aa, Glycine max
  Coding DNA Sequence Number=SeqID_61290
MVEFSPTIGICGRCLIRIRLDYHEESGSPIGNLVPLDLEIEATLRRNRAERGRKLLQYRTIASILEKETHFSDSLSLDSPSSRESATQLPEAAIMADEQHQRITLEDYSSSSVPLFFTSIACPK

SEQ ID NO: 152976 - protein, 233 aa, Glycine max
  Coding DNA Sequence Number=SeqID_61291
MAPKRLSAKRSRKDATGEGSSAALEFDSHWFQSAEHQQRFEAIKGWLFHRERRAQLKEDEYSDFQDALSQFLGDPLIMEENQQCKFRQRKNQVDNFDEEAIAQLLCIPGQDFARTTAGRRLRIMRTSMTTLTQIWMTLLLSNVLPSDHNSDLPLPKCRMAPTRHPLDPEKSNRALGFPALITSLCQFYGVHVTPSKVIRPPITRAFIEKYFTPRQAQSDEHQAAGAQPPTRQA

SEQ ID NO: 152977 - protein, 35 aa, Glycine max
  Coding DNA Sequence Number=SeqID_61292
MATIAVSSRYGGKSAWDTGIGVVFVIGSVVDMLCG

SEQ ID NO: 152978 - protein, 176 aa, Glycine max
  Coding DNA Sequence Number=SeqID_61293
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=47%, E-value=1e-60, Identity=73%"; Hit description=DNA -directed RNA polymerase subunit beta'
  Pfam annotation: Domain name=RNA_pol_Rpb1_2; Domain location=91-169; Score=49.5; E_value=1.1e-11; Accession=PF00623.11; Description=RNA polymerase Rpb1, domain 2
GAIREQLADLDLRILMDSSLIEWKELGEEGSPDNENEWEDRKEKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRLDFDGDQMAVHVPLSLEAQAEARLLMFSHTNLLSP

SEQ ID NO: 152979 - protein, 81 aa, Glycine max
  Coding DNA Sequence Number=SeqID_61294
  Subcellular localization annotation: CTP_CleavageSite=38; ConfidenceScore=5.18e-01
MHVCKFSQGDACDEWPRGSLPQRGPGRTRRPKELVPPRSTTVTALGALCTSSASKPSKDGRFSGSDASSSGTTSILISRRK

SEQ ID NO: 152980 - protein, 352 aa, Glycine max
  Coding DNA Sequence Number=SeqID_61295
  Homolog annotation: Hit_ID=Q2HW90; Match level="QueryCoverage=86%, HitCoverage=59%, E-value=2e-34, Identity=31%"; Hit description =Putative uncharacterized protein
MRSNQAPSFEKRFYHVKVKSLELAGLRELGQRMDQVQCQAFRMAYGKIWDLAMIEVTIEAIASLAQYYDQSLRCFTFGDFQLVPTIEKFEGILGCSLGGRKPYLFSEFYPSMERVAKVVKILAQELDRVKQNRNGVVGIPRQCLEERAKALADQGKWTSFVDILALLVFKIVLFPNVDGLVDLAAIDAFLAYHYSKESPDIAILADAYDIFNLRCEKSNARIVCCTPALYVWLVSHVFCHQGRHVCPLQGYHMCVEKEKSNWERLLASMVGASVSWFPRWKEGGAGVLCSYEGFPNIPLMGTRGYINYNPVLAIRQLGYPMRGASSEEIIVPFVAQGFSEGNAKMLQRIQKA

SEQ ID NO: 152981 - protein, 114 aa, Glycine max
  Coding DNA Sequence Number=SeqID_61296
MTGRLLAGSLAFESRILHYLIVRILLPRSSNLAQGARPVDEEGHLHGGEDSSLIQKILDRFDGLQTFVGERFDTLELQVDMRFNEMESRITKVKEDVSYICTSFDLPPSPPPSS

SEQ ID NO: 152982 - protein, 58 aa, Glycine max
  Coding DNA Sequence Number=SeqID_61297
MAFMGLRKKVENGELRQAMTFMGLRKKVENGDWRTVRYAITSRGSRLVGGGCMNSARQ

SEQ ID NO: 152983 - protein, 77 aa, Glycine max
  Coding DNA Sequence Number=SeqID_61298
  Gene Ontology: Mol. function=RNA-directed DNA polymerase activity; Biological process=RNA-dependent DNA replication
  Homolog annotation: Hit_ID=Q8L7J3; Match level="QueryCoverage=79%, HitCoverage=3%, E-value=8e-10, Identity=45%"; Hit description=Gag -pol polyprotein
MEASNLLRGRPWQYDKDVLHNGVTNKFSLGHKGKKVALTPMSPKAFEKLDFKEGSGSTTRNISFYDTYPMMVLSGPP

SEQ ID NO: 152984 - protein, 114 aa, Glycine max
  Coding DNA Sequence Number=SeqID_61299
MFSKKEGMMRIMKLAKYRLKAQVEKDKAPEWRRMKAQTYQGNPCGVYPDLSSFTGSGVYPDLSSFTGSGVYPDLSSFTGSGVYQDLSSFTGSGVIQIFVTCIKRSAATQVHIKL

SEQ ID NO: 152985 - protein, 56 aa, Glycine max
  Coding DNA Sequence Number=SeqID_61300
MTKARQQGVRKGGRGWWLPPSSPRQAGMLPPEGTAFCWKILEGPSGPDCYLYPPVY

SEQ ID NO: 152986 - protein, 100 aa, Glycine max
  Coding DNA Sequence Number=SeqID_61301
  Homolog annotation: Hit_ID=A5BEV8; Match level="QueryCoverage=60%, HitCoverage=7%, E-value=1e-09, Identity=50%"; Hit description =Putative uncharacterized protein
KTARKPLYKRNLKESWASSSKGNNTRKSSLPWIQTENVSVDKWMDITEMGYVIASRYNVILVSLSQQQSMTFFPLRSQPPPDSSGHRMICVGHVFRNHFV

SEQ ID NO: 152987 - protein, 155 aa, Glycine max
  Coding DNA Sequence Number=SeqID_61302
MVKEECKEVSVSSKRTLVSTATPLGLKVIPQVNELFDVGLVHKSLNPCSLLVPKIGIIRHQIPKIGGMRNVLSGATLFCKITHAPNIFMIHIHRDSLGSDQGVPTDPKRIKVILEWPTPPSVEGRSPKFQEPLDLRSNPFQGGGDDAILPPKGIG

SEQ ID NO: 152988 - protein, 47 aa, Glycine max
  Coding DNA Sequence Number=SeqID_61303
MEKKMKNNELKSMAEEWRRKKDDCRHHFKEKMSREQAHHHRKPWIRA

SEQ ID NO: 152989 - protein, 282 aa, Glycine max
  Coding DNA Sequence Number=SeqID_61304
KIDADSLNTFLETLVVLAEDYREIEVALCILGRGFILNTEGHPGKILKKDLNTLAQVWSVLSYSNLAPTSHTSNLKVDRARLIFGLISRLDMNIGALISWVVSESLTFERLSPVINLTYIRKNCWNLEDLIVSIRGARRARARPAELPSTSAASTPAAPCVPAQTDSQWWPPGSIPSVEQFREMVAWPGTQPSLHREDEGPTAQAEETQVAAATPDRSLEATSEPFAPVVSLPSPQPAANPSTPLLEMPEDPTTPVLAMDPSPLATPVFHLTDDEDVQTHDT

SEQ ID NO: 152990 - protein, 101 aa, Glycine max
  Coding DNA Sequence Number=SeqID_61305
MAQPPPHERTLREMAAPDFTYESMCIQYLDEDVLYVLKTELIHLLPKFHGLAGLSNMERSMIDAANGGALGDMTPAEARNLIEKMTSNSQQFSARNDAIVI

SEQ ID NO: 152991 - protein, 46 aa, Glycine max
  Coding DNA Sequence Number=SeqID_61306
MKNERRTMKNREKREVVAAQLAQASRVTSTKRHRLLLEPSGRPKWV

SEQ ID NO: 152992 - protein, 138 aa, Glycine max
  Coding DNA Sequence Number=SeqID_61307
MDQLEKGYRAYHPPSKKFYISMDVTFNEHKFFMWILHFREEMKVKCIIIMLVRLDSSDVPSDLISDNTNVDEIDHEIVSLDPTLDNTNSDETDHEIDPCLCETTSTPNTESTTIQYNLPPHSNRGQPPAKNEPDLQAK

SEQ ID NO: 152993 - protein, 93 aa, Glycine max
  Coding DNA Sequence Number=SeqID_61308
  Gene Ontology: Mol. function=sugar:hydrogen symporter activity; Cellular component=periplasmic space; Biological process =carbohydrate transport
  Homolog annotation: Hit_ID=A4W565; Match level="QueryCoverage=100%, HitCoverage=28%, E-value=5e-36, Identity=83%"; Hit description=D -xylose ABC transporter, periplasmic substrate-binding protein precursor
MKIKNLTLTLCTTLLLASFAGHAKEVKIGMAIDDLRLERWQKDRDIFVKKAESLGANVFVQSANGNEETQMSQIENMINRGVDVLVIIPYNGQ

SEQ ID NO: 152994 - protein, 112 aa, Glycine max
  Coding DNA Sequence Number=SeqID_61309
VCDIYPRIELANGQTKYAKYSDSKSIQMPKLRRITSLKIENEASLYELWKAPVADDESDEQNDSDSDEVYFVEAFGKKRHCVAPFAEEIPIVVPRYAIMPLATVALESMDQR

SEQ ID NO: 152995 - protein, 147 aa, Glycine max
  Coding DNA Sequence Number=SeqID_61310
MAPKKLSMKRSRKKAAGEGSSTALEFDSHRFRSVEHQQRFEAIKGWSFHRERRVQLREDEYTDFQEEIARRCWTPLVTPMAKFDPEIVLEFYANAWPTEEGVRDMRSWVRGMPPTRHPLDPDKSNRALGFPALITGLCQSFGVPVTP

SEQ ID NO: 152996 - protein, 79 aa, Glycine max
  Coding DNA Sequence Number=SeqID_61311
MSSSVEIEDKAYWAVKTCNFSMDQAGEERKLQLIEIKSDSTNKSFKVNGHRLKSFLTNPSLVDIVVEETSLLHPTLPPP

SEQ ID NO: 152997 - protein, 120 aa, Glycine max
  Coding DNA Sequence Number=SeqID_61312
CGVEWKKSEALRVERLNLDSVVNGEFFCLCPVLLGCDSLCCLNVVLLGCCGSLGGLMGTRGWWVYARIVDVENLLCTIARPPPKWYLEICRGGQETLGTSGGVLLPKSKLDQSRPNPSIV

SEQ ID NO: 152998 - protein, 170 aa, Glycine max
  Coding DNA Sequence Number=SeqID_61313
MSQARYDRSRFVSHDAWDRRYIDNVLGRKILLERNVKLYITEFDEFRTEVETRNWHKELTNFSEGSIDVAIVKEFYDNLYDPEDKSPKQVKVRGHLIKFDADALNTFLKTPVVIEEGERLPAYSRARHEDGYELGVPHLRSDLSYSTAQLLEARFSSLDYSLVKGSRSHI

SEQ ID NO: 152999 - protein, 53 aa, Glycine max
  Coding DNA Sequence Number=SeqID_61314
QARARLSKLFRFQMTVLFSNGSALDGVNGYSKWVLARSCNMDIAIGAGEIMQL

SEQ ID NO: 153000 - protein, 78 aa, Glycine max
  Coding DNA Sequence Number=SeqID_61315
MSGFTRNSPQISASPYQLDFTLYASGSYNAQWNAVGLLHDKHTLRSSRILRKVEVDEPWLGVMATIELLSGYGIKFSI

SEQ ID NO: 153001 - protein, 118 aa, Glycine max
  Coding DNA Sequence Number=SeqID_61316
MASKKRKSTASRPQAQYDTKRFHSLDAWNRHNDNILGRNILPERNMQIYHTEFHEFKVELERHNLHKRLTNLQDGSIDVAMVKEFYSNLYTTEEQAPKQAIVRGHLIKIDADSLNEFL

SEQ ID NO: 153002 - protein, 136 aa, Glycine max
  Coding DNA Sequence Number=SeqID_61317
MNLELESAAFRVTGSPNSSFHSLWIIILIRGTVYTMVIDQSLFYDLTKLPSEGVPFEGALIDEWKFDFSVHDARRLVCTNQADMTGRLLAGSLAFESRILHYLIVRILLPRSSNLAQVYKLIGHTLLDIACIRHCD

SEQ ID NO: 153003 - protein, 131 aa, Glycine max
  Coding DNA Sequence Number=SeqID_61318
  Subcellular localization annotation: CTP_CleavageSite=48; ConfidenceScore=5.31e-01
MYPPLFSLNLVDVPSTRDAPSLVLSQTQVDVPSTCTTKDVPSNVLRQRSQAVKPLILCEWGYKRILRREKGDTKEFRRLVIRSFGKGRRETQKEFRRLVLGEFFLAKGEENDKMNNTSFQGLENQKTSESF

SEQ ID NO: 153004 - protein, 125 aa, Glycine max
  Coding DNA Sequence Number=SeqID_61319
DSKSRGGQRQIMVIPHTFSPSRGDRVRWHVETNYGHSAPCVTRGERIRQYQDDVSVLSYPNFVRGPSVVGMRPSFDHFEQPGPLGPSRMFLQKAVASGGSNLAHQIFNRSSSFVVPSSSFFGLQP

SEQ ID NO: 153005 - protein, 46 aa, Glycine max
  Coding DNA Sequence Number=SeqID_61320
MKGNQQRGPQWSRQLSQPTLRREGDARLADACSTKGIRAESPPTFI

SEQ ID NO: 153006 - protein, 91 aa, Glycine max
  Coding DNA Sequence Number=SeqID_61321
MTEINEGSSTKTVEAKLHDELRLIQRCFDDNKGEDKNLKGQSKNEFKIESRTLQDSRGKLIPRIKNQDSRIKLPRIKIKIQDSRFKNQENT

SEQ ID NO: 153007 - protein, 165 aa, Glycine max
  Coding DNA Sequence Number=SeqID_61322
  Homolog annotation: Hit_ID=UPI00006A2D9E; Match level="QueryCoverage =99%, HitCoverage=85%, E-value=4e-13, Identity=15%"; Hit description =UPI00006A2D9E related cluster
LHALAFRGLHVLAVRGLYVLTFRGLHVLALRGLHVLTFRGLHALAIRGLHVLPFVGLHALTIRGLHVLASRGLRVLAFRGLHILSFRGLHVLAFRGLHALAFVGLHALPIRRLHVLAFRGLYVLTLRALHALAFKGLPVFAVRGLHVLAFRGLHVLTLRGLHTLM

SEQ ID NO: 153008 - protein, 105 aa, Glycine max
  Coding DNA Sequence Number=SeqID_61323
MTIICLRMLSGSPPLDEKRRRMTIICLYVPSNTIVSEWRKVSGMTIICLRISSGPPPLDDKRRIMTIICLYVPSDTIVSEWRKGQYDRDCGAADKSEALAPMYPQ

SEQ ID NO: 153009 - protein, 697 aa, Glycine max
  Coding DNA Sequence Number=SeqID_61324
  Gene Ontology: Mol. function=cobalamin transporter activity; Cellular component=integral to membrane; Biological process=cobalamin transport
  Homolog annotation: Hit_ID=A7ML93; Match level="QueryCoverage=75%, HitCoverage=87%, E-value=0.0, Identity=68%"; Hit description=Vitamin B12 transporter btuB precursor
  Pfam annotation: Domain name=Asp_Glu_race; Domain location=538-696; Score=136.6; E_value=7.2e-38; Accession=PF01177.13; Description =AspGluHydantoin racemase
  Pfam annotation: Domain name=Plug; Domain location=2-98; Score=66.8; E_value=7.3e-17; Accession=PF07715.6; Description=TonB-dependent Receptor Plug Domain
  Pfam annotation: Domain name=TonB_dep_Rec; Domain location=349-568; Score=17.1; E_value=0.0029; Accession=PF00593.15; Description=TonB dependent receptor
  Pfam module annotation: Pfam domain module=Asp_Glu_race::Plug::TonB _dep_Rec; Domain location=538-696::2-98::349-568
VTRDDIDRWQAKSLTDVMRRLPGVDIAQNGGLGQLSSLFVRGTNSSHVLILIDGIRLNQAGVSGSSDLSQIPLSLVQRIEYVRGARSAVYGSDAIGGVVNIITGRDKPGTTLSAGVGSKGYQNYEGSTQQQLGSATKLTMAGNYTYTRGYDVVANLPDVYGDPAQKDRDGFMNKTLYGALEHQFSDGLSGFVRGYGFDNRTAYDGTYSYDNSFNINGLNDTRQLYSQTWDSGLRYSNDIYSTQLIASYSRSKDYNYDPRTGRYGPSTTLDDSKQYNVQWGNTLQVAQGSVSAGVDWQKQTTEPGTAYVADSTELRNTGIYATTQQQLGSVTLEGAVRGDDNSQFGWHGTWQGGASWAFVDGYSVFANYATAYKAPRLGQLYVGSGLLWPDRAGNWRVSGYRNDIDNLIDSDPTTYIYYNIDKARIKGVEATASFDTGPLSHQISYDYVDARDAETDQPLVRRAKQQVKYQLDWTIYEFDWSLTYHYLGDRYDTDYNHAFTPQRVKLGGVSLWDLAVSYPVTSQLTVRAPATASDLRPTVLVFDSGVGGLSVYDEVRQLLPGLHYLYAFDNAGFPYGEKSEEYIVERVVAVVEAIVQRVPLALVVIACNSASTVSLPALRQRFEFPVVGVVPAIKPAARLTRNGVVGLLATRGTVKRPYTHELVAQFARECKIEMLGSAELVELAEAKLHGETVSLDD

SEQ ID NO: 153010 - protein, 70 aa, Glycine max
  Coding DNA Sequence Number=SeqID_61325
  Subcellular localization annotation: CTP_CleavageSite=26; ConfidenceScore=5.37e-01
MPSISKRPIKGWISSSNNPRTKLGIMASPPASPPPPPPPPPPPLPPPPAPSNASASPSAVKQTRKALGRN

SEQ ID NO: 153011 - protein, 205 aa, Glycine max
  Coding DNA Sequence Number=SeqID_61326
  Subcellular localization annotation: CTP_CleavageSite=59; ConfidenceScore=5.13e-01
MAFLGETSSQTVVNSTLGFIFQMDPLFTTTVVFPFKLPLQFPFEYLSDVIFKRNQFRFQCMQLKDDADVNTMLICNHEFSFVGLIELLCSIARTPNGILNLLEATMTPTHDALLYYNGRWNMSCQNEFVGYLFTGKNPRNFDIPTGCTMDELKDLIKQVAPRGIPLYGIDETQIVRRLFFRKPTHHEYSEKVIKFEIFELKTTMT

SEQ ID NO: 153012 - protein, 90 aa, Glycine max
  Coding DNA Sequence Number=SeqID_61327
MCPNPHRSYRRFIHRPSSSAAKASHPSINIERAKEIKRKIGEAKKRENERRNSSWWPGQILGLDHLSTSHLTSPHSGTPVKFNRKEVSNK

SEQ ID NO: 153013 - protein, 178 aa, Glycine max
  Coding DNA Sequence Number=SeqID_61328
  Homolog annotation: Hit_ID=Q2HSI4; Match level="QueryCoverage=71%, HitCoverage=62%, E-value=3e-12, Identity=32%"; Hit description =Putative uncharacterized protein
MFFMIRTQGLGHALGAGRGRGISEDAHEADVPLRRRPTASTHRQRVRLCEDVTERPEDVPQLHEDVPHTEGVATDGSLGSPAADEGFPGGPRDPSILTDFAEHVAHSIWSKQERPDLKLVSHGRKVYKIGRPTPEIKGLIVGTGLSPLIRYSVITTDPRLISAFVKRWHRETSTFHLP

SEQ ID NO: 153014 - protein, 88 aa, Glycine max
  Coding DNA Sequence Number=SeqID_61329
MEELINKTQPSLNNPNIITLARRIHKRIPLLILYCCHSAPTNKGSRSSQATPPPHGDHPKSQGSSKPSDMPPSTSIPPHEKLQVLTEK

SEQ ID NO: 153015 - protein, 105 aa, Glycine max
  Coding DNA Sequence Number=SeqID_61330
MAAERASCSHPSEVLGFRYLPCRTLCDLPYATTNLCSSICIVNGEQQSSRYSTLGLATPLHYSRIDNYAYYNFAAQTGSCMGRNEPRNESEDHGSTLNGVIHEKE

SEQ ID NO: 153016 - protein, 95 aa, Glycine max
  Coding DNA Sequence Number=SeqID_61331
MYPKVHENPKVFSCISGPFFLELSIQCPCGVGLHHSFPLEKDLTSNPEVLEILGFFSSTPVKRIKTYVLVMFGTWFLTNSMSGATSIEKYGTNIL

SEQ ID NO: 153017 - protein, 169 aa, Glycine max
  Coding DNA Sequence Number=SeqID_61332
  Gene Ontology: Mol. function=aspartic-type endopeptidase activity; Biological process=DNA integration
  Homolog annotation: Hit_ID=A7PPN0; Match level="QueryCoverage=95%, HitCoverage=30%, E-value=3e-34, Identity=42%"; Hit description =Chromosome chr8 scaffold_23, whole genome shotgun sequence
MALEEGKLYQPLPGVKPDDIKQEEWNLLDRQALGVIRLTLAKNVANIVNKKTTASLMKALSDMYEKPSIANKVYFMLQLFNLKMGEVSSSIRDNKLNLNDIRDLILSKDVHKKDSRESSSHVSNSALNTEDIGRRTTHKCQNGQGRSKSRGKGQTKFRSDIICWNCDKR

SEQ ID NO: 153018 - protein, 50 aa, Glycine max
  Coding DNA Sequence Number=SeqID_61333
  Subcellular localization annotation: CTP_CleavageSite=22; ConfidenceScore=5.02e-01
MTEARQKGVRKGRSLPPSSSRRAQLAQGSNVASSRSNSLLEEESGRPKWA

SEQ ID NO: 153019 - protein, 78 aa, Glycine max
  Coding DNA Sequence Number=SeqID_61334
MSVSACYQAFYLTDSKNNVYTDNHSGISARQRDSNVSMTDPVSAEDDVNLRVSTGLSAAIDEGRRSDVSLCLLSGFSS

SEQ ID NO: 153020 - protein, 90 aa, Glycine max
  Coding DNA Sequence Number=SeqID_61335
MNVEEQLKIFAGGACHPDRPGEQGCFLQKQQPSTGRIWKAQVGLIAICTSLFTKCTPFTFLAFEEVTKTHGLRKTPPFDFRHITELSRIA

SEQ ID NO: 153021 - protein, 62 aa, Glycine max
  Coding DNA Sequence Number=SeqID_61336
MEDAPVSPRVALPPKGSYLVHGPKIHPKTHENPMAFSYISGSIFWSLLSNTLGGRIASSPPP

SEQ ID NO: 153022 - protein, 84 aa, Glycine max
  Coding DNA Sequence Number=SeqID_61337
MAIMLGVVDLRLWCPKLGSFGVVVLEIVSGLQAVDFRQLEVLVVKKVHEFEVKKGENMESKEDWRERNTCSLSLVKTIQGLGIQ

SEQ ID NO: 153023 - protein, 39 aa, Glycine max
  Coding DNA Sequence Number=SeqID_61338
MTEARQKGVRKQNRGGACHPARPGELSSPRRAQLGQASK

SEQ ID NO: 153024 - protein, 223 aa, Glycine max
  Coding DNA Sequence Number=SeqID_61339
STLEDPLNAVKEDGPSRAKRLGEVATSRRFIYQSLQAVCMVSRGGDERDECLFHLEESHDMETCPAVEELLHRLMDCGQLEVSIGGREEPQICMQSEEKKVPLTPKALVICFTRKGTGSTPIYPRTAPKPTPFAYQSNKVVPWKYTPPASSERVATEVDSLSAKVTNITGLSGVTRSDVATPSKEVDPPAVRGAEKKEGLQGKIVTLEEAHEFLRLIQQSEFK

SEQ ID NO: 153025 - protein, 82 aa, Glycine max
  Coding DNA Sequence Number=SeqID_61340
MNENAIHGAPKNGCEWRIALSNHYAWLQTRGWRMHERKFNSWCSEKGLRMENCTKQSLCMAPNSWVENDMNENAIHGAPKKG

SEQ ID NO: 153026 - protein, 66 aa, Glycine max
  Coding DNA Sequence Number=SeqID_61341
MTQKLVTRGDTLRLSAPRHSVTPSVIDEQRPIWSSAPFTEMSEFLIGGYVGARALLLSAAPQDLSY

SEQ ID NO: 153027 - protein, 111 aa, Glycine max
  Coding DNA Sequence Number=SeqID_61342
MSLLSGDFHLRQQHRSALYIAARFNVVTDRYHIEPHIFEVARNCDLAHRVLNFTVFNPEARRTARVVAGHGADAGTHHLGNDQTASHLLHQIVKAVALTGDAPVMNAARVA

SEQ ID NO: 153028 - protein, 281 aa, Glycine max
  Coding DNA Sequence Number=SeqID_61343
  Gene Ontology: Mol. function=motor activity; Cellular component=cell projection
  Homolog annotation: Hit_ID=UPI00006A2D9E; Match level="QueryCoverage =79%, HitCoverage=97%, E-value=1e-15, Identity=17%"; Hit description =UPI00006A2D9E related cluster
RATRPRLYRATCRPFRGLHALAFGGLHALAFRALHALAFIGLHVLAYRGRDALVFRGLHVLAFMGLHALAFRGLHALAFRGLHTLALRGLHVFAIIGGYVLAFKGLHILIFRGLHVVTFRGLHALAFRGLHDLAFRGRLVLAFRGLHALAFRGLHVLAFRGLHVLIFRGLHVLTFRWLHPLAFTGLHDFLVFRGLHTLAFRGLHALAFRGLHALAFEGLHALAFRGLHTLTFRGLHALAFRGLHALAFKWHHVLNFIGLHALAFRGLRVLTFSGLYIRTLR

SEQ ID NO: 153029 - protein, 173 aa, Glycine max
  Coding DNA Sequence Number=SeqID_61344
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Subcellular localization annotation: CTP_CleavageSite=50; ConfidenceScore=5.09e-01
LSGFATSDLSVDFCDARQGGGAYGKTPATRPFYADTARRSRTTERSESVSEEAEERPIRKPPLPAPDNNFTQETAMTMITNSSSVPGLHSKWFSGMDKERRGAQENSLHDQNGLMWNPPRGMQAWHWPSFYNVVTGKTLALPNLIALQHIPLSPAGVIAKRPAPIALPNSCAA

SEQ ID NO: 153030 - protein, 145 aa, Glycine max
  Coding DNA Sequence Number=SeqID_61345
MLDVWDLPDGEFILVEVDHWGNPMGWEGKTLNVIRSLVRRHQCAPINFLSWKDMPKDYITDMVELIQVCKTKEEMVAHIPDPRVDPYHYRDLVHYWCSEKGQKIRNINKRSHSKYEDLHCMGTNNLPRRIHEMTTKAKGVQPSRT

SEQ ID NO: 153031 - protein, 141 aa, Glycine max
  Coding DNA Sequence Number=SeqID_61346
MSDLSILFSIVYVVYKLENPDESLETSNNNFQNCPMCGVACQCRDSYAILLKFQPARINWTLHLMLQGHTVLNGMPQGSSMICTCCVQVVSSENGGGGNLAETGFVVDLGMAFMDNWVVGKEKEWQSQHGFLPHSHPLHLP

SEQ ID NO: 153032 - protein, 115 aa, Glycine max
  Coding DNA Sequence Number=SeqID_61347
  Homolog annotation: Hit_ID=A5BP71; Match level="QueryCoverage=65%, HitCoverage=19%, E-value=6e-11, Identity=45%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MAIIVSAEACGYVSMNYYQYIDVVYTNEHILKAYSAQWWPLGNEAAIPPSDEAWTLIPDPTTIRAKGRPKSTRIRNEMDWVEPSDHRQKCSRCGAEGHNRRRCPMQSDRGSNSFN

SEQ ID NO: 153033 - protein, 115 aa, Glycine max
  Coding DNA Sequence Number=SeqID_61348
MAINSWGSGLDGGGRMNDNQFMGLRIRFVGGGCTNSARQSIRGAPDTLAISSWGSGLDGGGCMNDDQFTGLWIRFVGGGCTNSARQLSYPNFVRGPLLGGMQLVFGHFEVLGTHH

SEQ ID NO: 153034 - protein, 144 aa, Glycine max
  Coding DNA Sequence Number=SeqID_61349
MEANVTKVLRSTAIDCRFRMLEAFLTQTRHERGSVAVSDTAHFLSAAIWTRPSGHASSFLFLFFFSFEISFNNKNCNTRFDFSVFTVLLPSCLRNHDPLVSFELQPASVYRPSPASSNHHAIIDVVHRSCRHITTRAVVALLTT

SEQ ID NO: 153035 - protein, 50 aa, Glycine max
  Coding DNA Sequence Number=SeqID_61350
MDLNIGESRTRTLLSNMVTAPTIRGLLQRGFLYLYYSILVQPTLLYPICV

SEQ ID NO: 153036 - protein, 341 aa, Glycine max
  Coding DNA Sequence Number=SeqID_61351
  Homolog annotation: Hit_ID=Q9C659; Match level="QueryCoverage=34%, HitCoverage=63%, E-value=4e-11, Identity=30%"; Hit description =Putative uncharacterized protein F28B23.18
MEDLNTIGADCVVISCCCQCLMLQILVFVLLKLPGKLIRKTREYAKKLRHRKANNDRRMGREMGSYKDVLLRIHEQSFRIQVEMALTDGADHNCGGCMDEVEKVMEEFYQKGEFAFGSFWGRKGPCGAPTIVNDHNDGCKEKESPRGQFQSHLTSRIMSEDEFLSCRLVSFGAHIIFVMPDSTKPSGSSDKLHDAFIRLTNQQLSLGESMNFMTHKIDELFHRVSPLLTTSPPIPSSLSHSSPAPALNHRMKLDVPRFDGTDPLGWIFKINQFFEYHSTREHDCLTIASFYMEGPANSIRTVAVQGSYRDLIQVDTEGKSGALIVGVLIIISLGHKGVPYQ

SEQ ID NO: 153037 - protein, 132 aa, Glycine max
  Coding DNA Sequence Number=SeqID_61352
MVRVLDLRCKFRIIGVCFPLLYKTEEISKENVEKVRSALQQLYDEYAALSNEESSSNEMSVGGINSSTIHVPNTSVMTGFYQLMSLVHEKEAVPPMKSELDVYLKEKNTYIPNNGNSSFSALEWWRNNNFKY

SEQ ID NO: 153038 - protein, 75 aa, Glycine max
  Coding DNA Sequence Number=SeqID_61353
MFSKKERMMRILKLAKYRLKAQVEKDKAPEWRRMKAQRFIKVILVASTLTYLPSPEVASTMTYLPSLEVASSKSP

SEQ ID NO: 153039 - protein, 252 aa, Glycine max
  Coding DNA Sequence Number=SeqID_61354
  Homolog annotation: Hit_ID=A7PP47; Match level="QueryCoverage=91%, HitCoverage=52%, E-value=6e-84, Identity=64%"; Hit description =Chromosome chr8 scaffold_23, whole genome shotgun sequence
  Pfam annotation: Domain name=LMBR1; Domain location=3-252; Score= -36.2; E_value=9.9e-06; Accession=PF04791.7; Description=LMBR1-like membrane protein
  Subcellular localization annotation: CTP_CleavageSite=88; ConfidenceScore=5.60e-01
MSFPHVNSPPPSLVALCTKGSGLVGKVDFTIRHLSSSTTSFPSTWTFSSGQPCIGSDAHQIFGGVGIACLPLGLIFSFIRRPKAVITRSQYIKEATELGKKARELKKAAEALHQEERTGSKGRKFRKNVKGVEKELFQLEEDVKLLEEMYPQGEKAETTWALTVLGYLAKYVLGILGLIVSVAWVTHIIIYLLIDPPLSPFLNEVFIKLDDVWGLLGTAAFAFFCFYLLLAVIAGAMMLGLRLVFITIHPMK

SEQ ID NO: 153040 - protein, 156 aa, Glycine max
  Coding DNA Sequence Number=SeqID_61355
  Subcellular localization annotation: CTP_CleavageSite=49; ConfidenceScore=5.57e-01
MTLSYNLRQGGTSSSSSASGTGSSTGTGSWVAEASPPPKREGWTPGQATCARKSSTLTASCWPELCNLFMMMIWPLCRLYSIANNVSNEKEDGPVGGVGAGKGVGAKALPLGLPGPSKSHCWIIKIPTVLLHICHINGRAETLQGPGIRSDSSSFA

SEQ ID NO: 153041 - protein, 408 aa, Glycine max
  Coding DNA Sequence Number=SeqID_61356
  Gene Ontology: Mol. function=binding
  Homolog annotation: Hit_ID=A7PP51; Match level="QueryCoverage=90%, HitCoverage=59%, E-value=2e-56, Identity=49%"; Hit description =Chromosome chr8 scaffold_23, whole genome shotgun sequence
MESLEGKSFGCMISILHSIYLIVRSIAYGTDKDSESPSSQGGPDAAVWDVNISSTFLKKLFPRFPLNPVDHLSEKDCDRLFDLNMIVAKIFFELNEWTSLPPNLLETFLEFFENALLGKFCRATQSGKAVWEECLVQLLSFIPKFLSRGASSWTSRLLQAFTQTFRESKPGSLMKLACVSAIEDMLTPIESMLSIETSNPENLELQDALLAWIRELPLLLIQLGDKHPTCSQVLHSAYRDGHIKIADYLSVFITLVLRFKVSPARKATELRKVVFIPGQEKVNLVIYEIGSAGFKSDPLCQTLKSMTTVLCSYMAQMGDNSLVLQIVEKVPQMPSLDNSCSLLRMLVTVDSKPTRLSEQSIIILGQHLSEYLMDAVQQDSGEGDVEKQAEWNQAFTGNQCDVLDLCLK

SEQ ID NO: 153042 - protein, 75 aa, Glycine max
  Coding DNA Sequence Number=SeqID_61357
MVSIEGSLSGESVDNESKVHGYNNEVFEVSENIVAPVLVPAVEKGTSMKVAPWPKKHPMLKDKCSPPPIMLLKYN

SEQ ID NO: 153043 - protein, 543 aa, Glycine max
  Coding DNA Sequence Number=SeqID_61358
  Gene Ontology: Mol. function=heat shock protein binding; Cellular component=ribonucleoprotein complex; Biological process=protein folding
  Homolog annotation: Hit_ID=A7QL00; Match level="QueryCoverage=62%, HitCoverage=60%, E-value=1e-114, Identity=63%"; Hit description =Chromosome chr8 scaffold_115, whole genome shotgun sequence
  Pfam annotation: Domain name=Peptidase_M24; Domain location=23-181; Score=-40.7; E_value=3.1e-06; Accession=PF00557.15; Description =metallopeptidase family M24
MTPLPVKEDKSGGLEASYFRMQTGNVYKNVKRKIERGVAFPTCLSVNNVVCHFSPLASDEAVLEEGDILKIDMACHIDGFIAAVAHTHVLQEGPVTGRAADVIAAANTAAEVALRLVRPGKKGGSKSFSFSVGGGSGDSNPFGFGLDDLFGSFFGGGGGGSQFGGFGSSAKSQSGSKSSSKSLRAVNSQIYKKEIENAGMTWLLLSYMPSSMEIQYFESTIEEVASSLHGALKVGSINCEKEVSFCKELSIYPRRAPRLIVFSYKENEKGYLVEYRGDLAAKNLKAFCQEYLPRFSKRTDLNHLDQFSTTGKLPMVLLLSTKKDTPVIWRVLSGLYHKRITFIDAEVHDVSDPRVKTLGVDALPAIVGWLPNGEKRVLKTGISVKDLKSAVLDLSNILDSFEKVSKKESSGQAKEAQTDSDEGRVPLLSKSNIEALCGEKTPVCIIGAFRSSKAREKLESILSLVSPKSLSRRPNQGSSSSRDSISYALLDAAKQKSFLKAFDKTGGVLVDVFDVYKSEREGDTCKRHSNAQVRIRLRAIDYI

SEQ ID NO: 153044 - protein, 88 aa, Glycine max
  Coding DNA Sequence Number=SeqID_61359
MARMRVEIVELLVSSYQILDILAICLAISLHSQIVSVSWLLLSIDSLSGYAYAFADIYLMSLEMEFVKFFGINNDVDSLTDGVIKEVA

SEQ ID NO: 153045 - protein, 134 aa, Glycine max
  Coding DNA Sequence Number=SeqID_61360
  Gene Ontology: Mol. function=transferase activity, transferring glycosyl groups; Cellular component=cytoplasm; Biological process =metabolic process
  Homolog annotation: Hit_ID=A4F1R4; Match level="QueryCoverage=50%, HitCoverage=18%, E-value=4e-19, Identity=54%"; Hit description=UDP -glucose:anthocyanidin 3-O-glucosyltransferase
MNLFIGLVLIGQPELFIHIIPDKTNNTLSIIDKGIGMTKAAKIKYLRVNFHDLINLKTTILRELDWPFFGDQGVAGRLIEDVWEIGVVMEGKEEGKKIRDNALKVKQTMQDATRPEGQAARDLKTLIEIISTTS

SEQ ID NO: 153046 - protein, 120 aa, Glycine max
  Coding DNA Sequence Number=SeqID_61361
MGLYWPLDILPYVGLEWGFVEIGWYGIVIEVEEEVEMDQDDDNDAGNNLVFEDDDALNWATAMVVGSSSRKQKTVQENDEDLDFEENIDLESEEEEIMVNFEASDGEEGEGDVPLPYDNN

SEQ ID NO: 153047 - protein, 47 aa, Glycine max
  Coding DNA Sequence Number=SeqID_61362
MVISSDKYNGVGSGSMDMGSLVSIVFPGGLTSVFGKTDVNTNTVAYL

SEQ ID NO: 153048 - protein, 131 aa, Glycine max
  Coding DNA Sequence Number=SeqID_61363
  Subcellular localization annotation: CTP_CleavageSite=92; ConfidenceScore=5.29e-01
MLWMLGDGHGLGQHDQITHIAQSNSSRLGFPALMTTLCDAKGSLHKVNTFSYRVSISSPSSSQSCHQRFSRSGSLGQGSSLPLPGEGGDTSRAGADVDVGDDDVADGGDDEDYVVDVTAAQGVWDPWPTQD

SEQ ID NO: 153049 - protein, 191 aa, Glycine max
  Coding DNA Sequence Number=SeqID_61364
MHDSEVAEPHSALEECSEGEHCPSSRARRPQRQSRSDREGIRLNARCSLSSVQIRTEAGGAKSRQNRQRAQGHGGLARGCAVRPRQKAQGLCYGTRKALGLSALLALNPCIEYKMAMGLSVRRNQQEEWKRRESMGNKKRFMKLLIVMAFALSMSIALGVRPGCYSCINGPTLGERDLLSAPRTTFFGLRS

SEQ ID NO: 153050 - protein, 63 aa, Glycine max
  Coding DNA Sequence Number=SeqID_61365
MAVMNPSGDDSEEEMAVIGLVDINDPSLRRIPKLSAEWYSNLLKRKPMALKIIKEIEKNAVVL

SEQ ID NO: 153051 - protein, 44 aa, Glycine max
  Coding DNA Sequence Number=SeqID_61366
MWCIKEASVKSNAVVHHRGSFVTVHRRGKRRDPVLFPPLLPAMA

SEQ ID NO: 153052 - protein, 181 aa, Glycine max
  Coding DNA Sequence Number=SeqID_61367
  Gene Ontology: Mol. function=aspartic-type endopeptidase activity; Cellular component=small subunit processome; Biological process=DNA integration
  Homolog annotation: Hit_ID=A5CB76; Match level="QueryCoverage=99%, HitCoverage=64%, E-value=3e-38, Identity=44%"; Hit description =Putative uncharacterized protein
MPSSGPVFSFSGTPTITTAKLNWKNYMSWSASVELWFLGQGYHDHLEKGVDAVPNDKRAEWEKLDFQLCAVLWQSVEPDVLEILRSFKTCCSFWKKAQEIFANDIQSLFDATQKVAALKQTSHDMIAHVGKARAAVEELKRFLAAKSLEEVNRKLDKFYMVLILRSLHADFDHVRDQILAR

SEQ ID NO: 153053 - protein, 241 aa, Glycine max
  Coding DNA Sequence Number=SeqID_61368
  Gene Ontology: Mol. function=magnesium chelatase activity; Biological process=chlorophyll biosynthetic process
  Homolog annotation: Hit_ID=Q8GYY1; Match level="QueryCoverage=29%, HitCoverage=18%, E-value=2e-09, Identity=47%"; Hit description=Heat stress transcription factor A-3
MVSGSYILVLKETKFEYSEPVLYLDVGIWHPLAPISSPSCPLPVARNTISIWSLTANFDKLNSLSHPLECLQGNPVPAFLSKTFDPVDDPSLDPIMSWCYSGVSYMEIFKSTADASFSPNLQAFIMDLQHIIPLLRKSSKLMLYFILGHMVPFKAARLPWWLCRMKLPKNAQQLSLADMEKSSEQEEAKEEEEANLRERRFKEAYFNSTLDSLRGTELPPMHLTNGVTWEFNDKDYFEKLM

SEQ ID NO: 153054 - protein, 168 aa, Glycine max
  Coding DNA Sequence Number=SeqID_61369
MVRTRGLGRALGQVTGIGVGRGNRDDSDAAPQRRRPTPSARRQRVAVTVTHDEPMVPAPDVQDDPMEAPAAVEDIVADIPADTVFLQMMILTNFAFLYTSIQERPELKRSSHGRKVHSLGRLVPAIEGLVAGTGLSPLIACSVDTGDRGLLSTFVERWHRETSSFHLS

SEQ ID NO: 153055 - protein, 98 aa, Glycine max
  Coding DNA Sequence Number=SeqID_61370
MACGDKSWSSATFLSSRDNQVRWHAETNMVIYPLLSKTQCLLIETIKVSPPSSRDNQVRWNVETIMVIHTLFAIHRQASSMACGDHYGHPFSLFSRLF

SEQ ID NO: 153056 - protein, 49 aa, Glycine max
  Coding DNA Sequence Number=SeqID_61371
MMLVKYGLCDAILPRKGPVTGAMSKRLQEDWARAVEEGPRVLMNLRVDF

SEQ ID NO: 153057 - protein, 79 aa, Glycine max
  Coding DNA Sequence Number=SeqID_61372
  Subcellular localization annotation: CTP_CleavageSite=60; ConfidenceScore=5.20e-01
MPKLPLPFRLLHSVSSMNSVAMNSALHQAFFKRHNASFGFREGEGEGGGGRWRHMRYTVMGSSSFDLRKIGLLSDLRIP

SEQ ID NO: 153058 - protein, 290 aa, Glycine max
  Coding DNA Sequence Number=SeqID_61373
  Gene Ontology: Mol. function=binding
  Homolog annotation: Hit_ID=Q3EC58; Match level="QueryCoverage=39%, HitCoverage=13%, E-value=1e-25, Identity=54%"; Hit description =Uncharacterized protein At2g06210.2
MSSAKSMHLGTISWICSVRTSRIKGQTTHADNIDFAVGCVDKDSKTIDAEVVEEIKVEETENLQQKMQEKEGDFSIIIKESHSWVVNVIDVEGDNAELQLLKEKDGSSLLTKQGILAWVAMQKFSASTLQKTKRTVDEVRATVAELQNVVCVFSQLSAASNLHIHGFDEKKIDTHVGYCNHLLSAAKVHLEAVEREEQQVLQRQKLARQVALTEEARRKAEEQRKFQMERRKLEEVCHFSFQIPALRTRTLKWMDVMHAQRNRGIACTSQSKRVAAQQRTGTLLLVTAVI

SEQ ID NO: 153059 - protein, 140 aa, Glycine max
  Coding DNA Sequence Number=SeqID_61374
MESRVSALDKLASKHGKVITDLKTDMDLINERLLEMRQIKELLLEFKKGKTPSDSGENLVNRDKKLEEENNDNNSISELKHGQLKSLENILEVKREESMEEEPSEIKIKKTIEEIKETKQQQQQRLIPLGGVGYMDQLPS

SEQ ID NO: 153060 - protein, 590 aa, Glycine max
  Coding DNA Sequence Number=SeqID_61375
  Gene Ontology: Mol. function=protein serine/threonine kinase activity; Cellular component=plasma membrane; Biological process=two- component signal transduction system (phosphorelay)
  Homolog annotation: Hit_ID=Q5DW42; Match level="QueryCoverage=94%, HitCoverage=57%, E-value=1e-176, Identity=59%"; Hit description =Phototropin
  Pfam annotation: Domain name=PAS; Domain location=182-294; Score =13.8; E_value=0.021; Accession=PF00989.15; Description=PAS domain
  Pfam annotation: Domain name=PAS_3; Domain location=207-300; Score =7.2; E_value=0.021; Accession=PF08447.2; Description=PAS fold
  Pfam module annotation: Pfam domain module=PAS::PAS_3; Domain location=182-294::207-300
MEKLKVSAKNDPAASSDQADSFPIFKMRDSQNVGLQNSRRVEDDAKAVRLDGGSVIVPSNSANSKEPINKWMAFAKKPGFTVDGNSATKDKSTSEDNYSRNHLNEKSSSIVTEANIAERTAEWGLVVNSRNFKALGGENTSGSFDGDRSRNLSDRFVEPTRTSGESNYGSESSSGVFPRVSQELKEALATLQQTFVVSDATKPDCPIMYASSGFFTMTGYSSKEIIGRNCRFLQGPETDKNEVAKIRDATRNGRSYCGRLLNYKKDGTPFWNLLTITPIKDDHGNTIKFIGECAKDVKSFLGVSKTIEAFRRFIRASGQWGTKFFIRKQPLYICKGKAAYNIPPSYLRIAKSLLAMGMQVEVSKYTEGVNEKALRPNGLPKSLIRYDARQKEKALGSITEVVQTVKDPKSIINDRNGDTAAKPEEQEKFNFDFVLPKSADIGNTNTPGRQASPLYIQRMSSSQDKSRTSQSGRISFKGLKGRSLSSAEEKSIVEPEVLMTKEIEWSNNLEHSLRERDIRQGIDLATTLERIEKNFVISDPRLPDNPIIMDAESHIKVEAASSSFYTKGSFVVFFLVGECSSKHAPSLTKV

SEQ ID NO: 153061 - protein, 475 aa, Glycine max
  Coding DNA Sequence Number=SeqID_61376
MVRTTGLGQALGRVIRRILGREVSSYADEAPQQRRPTVSAHRKWEDAIVAEDVQHMDHADDEIHEQPEEATVDDVVIDTKGFPGRPHDTLVLMDYVYHVTMKERHELKLSSHERKVEKFDRPAPKIEGLVTITLDDVSSLLHLAITCVFHSFEPLHVDDVMFLLVELLEVSAEEARAETVQYNAMGHMCDYPGCETYIRANMMQHNAVALVHMYENLNDVSKSRTRQLAGYITVLQCWIYEHFSSVSFAIVAKNYDERKPCACRWKFGKALPVSTYRKRLDILTSDGISDEVHLLSYTDRRGPTQHGDPPRHPPVPHHDTFVESVVAQHPVVATTMDEAPEGAHVDVDQPRHAVCWIYKNFPFVGFVIAAEDYDERKPCACRWKFGKALLVSTYCKHLDILSYTDAFREFEVISLFFRHIRWGPSIVIHRPERIFSEYIAPVGQICVALGQCSPDVAQHPVVATTMDEAPEGQML

SEQ ID NO: 153062 - protein, 89 aa, Glycine max
  Coding DNA Sequence Number=SeqID_61377
  Subcellular localization annotation: CTP_CleavageSite=39; ConfidenceScore=5.66e-01
MVVYIAKGGVNLSVSSVKIPKTLKNPSRGASVTLPRRFREQIREGFSVVLHRFSSVLRSSTGLISSSQLRIRRSKSPAFVDHPKRSLMV

SEQ ID NO: 153063 - protein, 75 aa, Glycine max
  Coding DNA Sequence Number=SeqID_61378
MATIELSSRYRSKLFRYKIHFLVGVFGLRLALNVRPANFVDDLGIAFVDDWMVGNEKGRYWLSDDIVGLVGSLAM

SEQ ID NO: 153064 - protein, 197 aa, Glycine max
  Coding DNA Sequence Number=SeqID_61379
MATPMSTACYLDKDETGQSIDIKKYRESSKKQKGSSSTTTAAGCRRQGTSGDPPAPIPPSLSSHRSSILFSSDDQHQRYYSQFYNRVILDPKYLDLEFFDGETFDCYQVFQNSTLVDFMSMKLPYFPEFVKVVYNNLKIQDGVLYSEVHSIPIVVDQSLFYPRWCSLLSRCFWLFDVAKGGENKGRIYHELRHKFQS

SEQ ID NO: 153065 - protein, 28 aa, Glycine max
  Coding DNA Sequence Number=SeqID_61380
MTPQGINLDKSEFGSTGTLREAFSPKKA

SEQ ID NO: 153066 - protein, 59 aa, Glycine max
  Coding DNA Sequence Number=SeqID_61381
MKVHHQESVLDKNLREEASMEEENEKERERERERESGIRIFQGYVKGILAYSKNMPKAS

SEQ ID NO: 153067 - protein, 81 aa, Glycine max
  Coding DNA Sequence Number=SeqID_61382
MRLHCHQVSRRPSMTTDSPPLLMAHTDPGIGPNISIPQWSRQLSQPTLRREGDAGLTGASSKGGRHPKLPPTFIQGKRQKN

SEQ ID NO: 153068 - protein, 60 aa, Glycine max
  Coding DNA Sequence Number=SeqID_61383
MGLTDAILPRKGPVTRATSKRLQEDWARAAEEGPRVLMNLRVGYPRNIGFFSPCILGHLD

SEQ ID NO: 153069 - protein, 65 aa, Glycine max
  Coding DNA Sequence Number=SeqID_61384
  Subcellular localization annotation: CTP_CleavageSite=34; ConfidenceScore=5.43e-01
MASFSQMQSQFRSQMQSQGLALPPEPLVGPSSPRVSTKESYVDTSGNNPETGTSKGEIVDSNPFY

SEQ ID NO: 153070 - protein, 105 aa, Glycine max
  Coding DNA Sequence Number=SeqID_61385
MAILIANTSTTFHKDERLGNTNGFMIPTWLAHEKNARIKHEQNMKTKGMHFVEQKCPMCAVRRVLWIFQLPVTKDETNIQRVRDDMMQTRKSTTWGCTQYGNIHK

SEQ ID NO: 153071 - protein, 78 aa, Glycine max
  Coding DNA Sequence Number=SeqID_61386
MQWHSHFWDFGQIEKSFASQVLQGKVAEGPQMFAISGVIVVVIVVAAGLVEERMVCLGQQHSGNKVVVFAAVVKDSTI

SEQ ID NO: 153072 - protein, 314 aa, Glycine max
  Coding DNA Sequence Number=SeqID_61387
  Gene Ontology: Mol. function=peptidyl-prolyl cis-trans isomerase activity; Cellular component=integral to membrane; Biological process=protein folding
  Homolog annotation: Hit_ID=A6T5I4; Match level="QueryCoverage=63%, HitCoverage=31%, E-value=4e-90, Identity=87%"; Hit description =Peptidyl-prolyl cis-trans isomerase D
  Pfam annotation: Domain name=Bac_DNA_binding; Domain location=29-125; Score=131.2; E_value=2.9e-36; Accession=PF00216.12; Description =Bacterial DNA-binding protein
  Pfam annotation: Domain name=SurA_N; Domain location=181-299; Score= -57.9; E_value=5.8e-05; Accession=PF09312.2; Description=SurA N -terminal domain
  Pfam module annotation: Pfam domain module=Bac_DNA_binding::SurA_N; Domain location=29-125::181-299
HDSPDITAARSRHEGFWCDINYKERKRTVNKSQLIDKIAAGADISKAAAGRALDALIASVTESLQAGDDVALVGFGTFAVKERAARTGRNPQTGKEITIAAAKVPGFRAAERCYTMMDNLRTAANSVVLKIIFGIIIVSFILTGVSGYLIGGGNNYAAKVNGQEIGRAQFENAVASERNRMQQQLGDQFSELAANENYMKTMRQQVLNRLIDESLLDQYARELGLSISDDQVKQAIFQTQAFQSNGKFDNERFSGIVNQMGMTTDQYAQALRNQLTTQQLINAVAGTDFMLPGESDQLAALVSQQRVVREATID

SEQ ID NO: 153073 - protein, 209 aa, Glycine max
  Coding DNA Sequence Number=SeqID_61388
  Pfam annotation: Domain name=G-patch; Domain location=72-111; Score =26.4; E_value=0.0001; Accession=PF01585.14; Description=G-patch domain
MDSLGGSRSLYAPPKIEIRIGRAFGYRIGRGRHLAAEESLETSFQSFEVESISSVDSFSGQACLSNAAVMMARIMLGNGYEPGMGLGKDNGGITSLINAKGNHGKYGLGYKPTQADIKRSIAGRKSGGQSSRLRQENDVPSTLDLVRPCPPDFQLGNWRVEERPGIYATSIISDDESPEGTNTWDPLINFEQETNQMEDEGNEDVGLPP

SEQ ID NO: 153074 - protein, 41 aa, Glycine max
  Coding DNA Sequence Number=SeqID_61389
MAPKKLSAKKSMRDAAAEGTSVVPEFDSHRFKSAEQQQRFE

SEQ ID NO: 153075 - protein, 37 aa, Glycine max
  Coding DNA Sequence Number=SeqID_61390
METTKGFLLASIVAEWVILLSNAGEDLMLSVKSATSW

SEQ ID NO: 153076 - protein, 94 aa, Glycine max
  Coding DNA Sequence Number=SeqID_61391
  Homolog annotation: Hit_ID=A5B4U1; Match level="QueryCoverage=98%, HitCoverage=13%, E-value=2e-30, Identity=69%"; Hit description =Putative uncharacterized protein
MDIDFDIRKDEPPAIIDESNPADVALYEQWERSNRLSVMFIKTKSSARIHDSVDLHEKVRDLLKAIDDQFITSDKTLASTLIMKFSSLRLTSVT

SEQ ID NO: 153077 - protein, 76 aa, Glycine max
  Coding DNA Sequence Number=SeqID_61392
MEDARTALGNQFVGIRTRWMREQRLTINSWRSGLDGGGYMNDDQFMGFRIRFDDGGCTNSARHSIRGTPNSMVEDG

SEQ ID NO: 153078 - protein, 91 aa, Glycine max
  Coding DNA Sequence Number=SeqID_61393
MDEDQWAYYSKMSEEVDMDFQDEQDCGANEGHVDCSDAFNTSQVFATREDVLQWARMVAHENGFVAVIMRSDTYNGSRERTSFVLIGCERS

SEQ ID NO: 153079 - protein, 39 aa, Glycine max
  Coding DNA Sequence Number=SeqID_61394
MVKLCLVKSQGTNKVLLQGAVGADGLYSFHNIKLQDHKP

SEQ ID NO: 153080 - protein, 67 aa, Glycine max
  Coding DNA Sequence Number=SeqID_61395
MADEHQQRVTLEGKLFQGLPNEDPYAHSVTFIEICNTVKIVGMPDEAISHFIFIFLSSRSHEVAPLI

SEQ ID NO: 153081 - protein, 237 aa, Glycine max
  Coding DNA Sequence Number=SeqID_61396
  Gene Ontology: Mol. function=protein disulfide oxidoreductase activity; Cellular component=cytoplasm; Biological process=cell redox homeostasis
  Homolog annotation: Hit_ID=A1G226; Match level="QueryCoverage=100%, HitCoverage=70%, E-value=1e-126, Identity=97%"; Hit description =Glutaredoxin-like protein
  Pfam annotation: Domain name=Fe-S_biosyn; Domain location=115-199; Score=28.6; E_value=4.6e-06; Accession=PF01521.11; Description=Iron -sulphur cluster biosynthesis
  Pfam annotation: Domain name=Glutaredoxin; Domain location=20-84; Score=106.9; E_value=6.3e-29; Accession=PF00462.15; Description =Glutaredoxin
  Pfam module annotation: Pfam domain module=Fe-S_biosyn::Glutaredoxin; Domain location=115-199::20-84
MSLDPALRSRIESILNANRVVLFMKGQPSMPQCGFSAKAVGALQDLGVEFAHVNVLADQEIREGIKAYGDWPTIPQLYIDGELVGGSDIVLQMAASGELSSVLGLAAPDRTPPSITVTPAAVEMLKGALADAPGAALQLTIDAGFQPNFQLAPHDEGAIAAESNGLRVQFDLSSARRANGITIDWVDDIRGKGLAIDNPNAPKPVQEISVRDADDMVRAGNITLVDVRPADEREIAA

SEQ ID NO: 153082 - protein, 105 aa, Glycine max
  Coding DNA Sequence Number=SeqID_61397
LGRIDGDSVLRETRIWATWEYMSSVGGGQQGMSGTWRYVAGVRRPWGRQVGRAPGSQQIKGTKTTKQGGLCGGWPAVNLVLENEVRKLWGLLVIDYQGGVIDYQA

SEQ ID NO: 153083 - protein, 209 aa, Glycine max
  Coding DNA Sequence Number=SeqID_61398
KGHALRCPYRTRARARVMGEVEEIQEKMKADMEAIKKKMATMMEAMMSVKKIMEANAVAIAATSVVAKVNPMSPSGLKQMNHPTSNMVAKDLGSTGGPHDVQIQNEHAFPSYGLPLNYTPPNVAYTPNKNTHEIPHHNLADFEPWLGYATEGQAVGGIPLQNPLEGPQYHPQLHLLHSTTVKNPHDYGRNGIEFLQPGGSTSSRAAATA

SEQ ID NO: 153084 - protein, 37 aa, Glycine max
  Coding DNA Sequence Number=SeqID_61399
MDFEPVIPDPDVQDDPMGAPAVVEDIPADAGSEAAED

SEQ ID NO: 153085 - protein, 153 aa, Glycine max
  Coding DNA Sequence Number=SeqID_61400
LGHHFKNSVAPPTYLALLILLPVAAASGDKSCLTGATLPEGRKADRYPVSGRVGTGERTRELPGGNAWGAEPMEKRQQRGGLFRRFLAFCWPFAHMFFPALSPDSVDNRITAFEKRKSAQYANRLSPRVGRFINAAGTTGFPTGKRAVSATQL

SEQ ID NO: 153086 - protein, 313 aa, Glycine max
  Coding DNA Sequence Number=SeqID_61401
  Gene Ontology: Mol. function=motor activity; Cellular component=cell projection
  Homolog annotation: Hit_ID=P15305; Match level="QueryCoverage=85%, HitCoverage=87%, E-value=1e-19, Identity=22%"; Hit description =Dynein heavy chain
  Subcellular localization annotation: CTP_CleavageSite=61; ConfidenceScore=5.04e-01
MPPLWFQFLAFLCTRWGPFSKYPHLQRATRPHLQRTTHPCLQRTTHPRLRGLHALAFIGLHALAFRGLHVLPFRGLHVLPFRGLHVLTFRGLHVLTFRGLHAIAFRGLHAVPLRGLHVLRGLHALTFRGLHVLAFRGLHILPLRGLHVLAFRGLHALAFKGLHVLPIIGLHVLAFRGLHALNFSGLHALAFRELHVLPFRGLHALTLRGLHVLTIRGLHILAFRGLHVLTFRGLHILTFSGLHALPFKELHVLPFRGLHALTFRGLHILTFRGLHVLAFRGLHALASPSEDCTSSLLEGYTSSPLEGYTTSAS

SEQ ID NO: 153087 - protein, 78 aa, Glycine max
  Coding DNA Sequence Number=SeqID_61402
MRGTVHEPQGGPWVLVTLTVERTTRPRLEGTTRPHHQRAARPHHQRTTRPHHQRAARPHHQRTTCPRLERATRPHLGY

SEQ ID NO: 153088 - protein, 162 aa, Glycine max
  Coding DNA Sequence Number=SeqID_61403
GHLVIVSGEEDVVHHLRRFPLKVASPVRCAGDGSPGDAGARLRAQNGFGQEQRRQDQPGQGPRLGQQAKEAPPYHISRRFMSAGIRREDLSSSVPAPLPILIHLHVYFFTLKNTRSDDESCEGTNTRDPTINFEQEAGQMENEEDEDVGLPPELERIIAQED

SEQ ID NO: 153089 - protein, 148 aa, Glycine max
  Coding DNA Sequence Number=SeqID_61404
  Homolog annotation: Hit_ID=UPI0000F2ADE5; Match level="QueryCoverage =37%, HitCoverage=9%, E-value=1e-07, Identity=48%"; Hit description =PREDICTED: similar to PDZ-LIM protein cypher3s isoform 1
MTDSLDESNSCFLIRVNPWDYTSSPLEDYMSSPSEGYTPSPSEDYTSSPSEDYTFSPSEGYTPSPSEDYTSSSFSFRGLHVLTFRGLHVLAFRGLHVLAFRGLHGHAFKGRHVLNFRRLHALAFKGLRVLTFSGLHIHTLREFKVLCP

SEQ ID NO: 153090 - protein, 58 aa, Glycine max
  Coding DNA Sequence Number=SeqID_61405
MSLEEAHHHRRPWIRAWRKKEMNEGRGREEHEILCSKRAMKYELTNPRSIPRFSTKCA

SEQ ID NO: 153091 - protein, 101 aa, Glycine max
  Coding DNA Sequence Number=SeqID_61406
  Homolog annotation: Hit_ID=A5BBN5; Match level="QueryCoverage=89%, HitCoverage=11%, E-value=7e-09, Identity=39%"; Hit description =Putative uncharacterized protein
MTIEESIHVSFDESNAISPRKDILDDIVESLEQMHIHGEDSKGKGEGRNEDPPVEVKANNDLPREWKASRDHPLDNIIGDISRRVTTVGSSGLRIIKRGGG

SEQ ID NO: 153092 - protein, 56 aa, Glycine max
  Coding DNA Sequence Number=SeqID_61407
MTKFREDPTVNEGWEAFLPRQHHVAFSRSFIKRLSPKASSRSFLVASLRSFLKRLL

SEQ ID NO: 153093 - protein, 107 aa, Glycine max
  Coding DNA Sequence Number=SeqID_61408
MAKQENFICRKKKTLSARESFFKKIAQCRLKNISRGYFTTDVGDEDMTKSKGKDPLEGLGGPMTRARARKAKEALQQVFSILFEYKPKFQGEKSKVVSCIMAQMEED

SEQ ID NO: 153094 - protein, 121 aa, Glycine max
  Coding DNA Sequence Number=SeqID_61409
MKIKEKKGRWLPPSLPRRAGLLPLEGTAFCWNLREGPKLYGLRNDTHFLSGILRNFTDYATMPFSLPECCGTLRIAQQCFLSKSEMLRNFTDYLTMGVKYLKAIKRRLHATKQWSPDEIRV

SEQ ID NO: 153095 - protein, 104 aa, Glycine max
  Coding DNA Sequence Number=SeqID_61410
SYLLSVSNSFKASKLMINELVLEIQDFRERKSNVSFFKQEIVCVTVAKITTIVMDNYSWCYPACGQCYKKNDIEIVSFTCPCGKENDQPVLRYRVEVMVNHKGE

SEQ ID NO: 153096 - protein, 433 aa, Glycine max
  Coding DNA Sequence Number=SeqID_61411
  Homolog annotation: Hit_ID=A5B5G7; Match level="QueryCoverage=53%, HitCoverage=15%, E-value=1e-08, Identity=25%"; Hit description =Putative uncharacterized protein
MASRKRKAHASTSQARYDRSRFTSQEAWDRYSSVVIGRKILPERNVMLYYTEFDEFTEELERRNRHKELTNFMDGNIDVAIMKEFYANLYDPEDKSPKQVRFRGHLVKFDADALNTFFMTPVIIEEGENLPAYSRFSQLRPNPQELAARLCIPGKGFELNVDGNADGLPLKILRKNLTTLAQTWSVLSFSNLVPTSHTSDITLDKARLIYGIIQKMDTNLGHIISCEISLIAQHNSSRLGFPTLITDLCKARGVTSDSLTFESLSPAINVAYVKKNCWNLDDLAVTFKGPCKAKGKMSEAPSSSDIPLILALSTSTSPLVPAPPTGPSSITSKTLFAMLQSLHKGQASATQEPEPVEDDVPPESFIIETDPVPREEVAAQEPSSPIPVSPAPVIDDSHPSALALEPEQPIVQDPPAAPVLDLNEHAEDHPQED

SEQ ID NO: 153097 - protein, 94 aa, Glycine max
  Coding DNA Sequence Number=SeqID_61412
MEGYSASDSRTKKKVFQTVSERWRQLKYDLTRKWDVRKKAQAIQKQNTAPHVLSSGGYEYLEQKLMVEKTKKKLEEAAQSGSTEGVNDPSSPIR

SEQ ID NO: 153098 - protein, 223 aa, Glycine max
  Coding DNA Sequence Number=SeqID_61413
DLAMIEVSVDAIASLTQYDDQSLRCFSFGDFQLAPTIEEFEGILGCPIGGRKPYLFSGYYPSMARIVGVEKAKTLASQGEWVSFIDVLALLVFGTVLFPNLDGLVDLAAINTFLAYHHSKESSVIAVLAEAYDTFDLRCEKSNARIVCCRSVCLQQGHHMCSGKDKANWEELLAGMIGASVSWFPRWKGGTVRIPYERCTIRGTITPFIAQGFMKLIQRYFRG

SEQ ID NO: 153099 - protein, 210 aa, Glycine max
  Coding DNA Sequence Number=SeqID_61414
MDNEEGVQEQMKADLSALKDQMASISEVMLKLQKTIEDKATATASSTVREAEPVLQPALNPGRDRNTAVFGRRYSLQAYPYGLPLDFTPRATPEDLSQAPTFEGQLQPYDDYPGQDDEEGDTHLGPLLHLKDPSPHELPQPNIVRHIPASPTPVKESVPVTEDRGKIEALEERLRAVEGLDNYPFSDLADLCLVPNIVIPPKFKVPDFDK

SEQ ID NO: 153100 - protein, 178 aa, Glycine max
  Coding DNA Sequence Number=SeqID_61415
MSKSCGFGMTGPLDELISCFLIRVDPWLLVPITFRGLHVLTIRGLHALTSRGLHVLALRGLHALTLGTSYPHCQRATRPRLERTTRPHHQRAARPHHQRAARPHLERTTCPRLERATRPHLGGLHALTSRGLHVLALRGLHALTLGTSYPHHQRAARPHFQRTTCPRLERATRPHLGY

SEQ ID NO: 153101 - protein, 66 aa, Glycine max
  Coding DNA Sequence Number=SeqID_61416
  Gene Ontology: Mol. function=RNA binding; Cellular component =intracellular; Biological process=mRNA processing
  Homolog annotation: Hit_ID=A7PW23; Match level="QueryCoverage=92%, HitCoverage=3%, E-value=8e-18, Identity=70%"; Hit description =Chromosome chr8 scaffold_34, whole genome shotgun sequence
MMGDREKQIRAAEERLLEDDVPITADEFEKMIRSSPNSSFTWIKYMDFMVSMAAVEKARSIAERYI

SEQ ID NO: 153102 - protein, 229 aa, Glycine max
  Coding DNA Sequence Number=SeqID_61417
  Homolog annotation: Hit_ID=A5ADW6; Match level="QueryCoverage=49%, HitCoverage=4%, E-value=5e-09, Identity=31%"; Hit description =Putative uncharacterized protein
  Pfam annotation: Domain name=Retrotrans_gag; Domain location=86-167; Score=5.6; E_value=0.015; Accession=PF03732.8; Description =Retrotransposon gag protein
HSITGESVHSVIGDFEHPDLEHYNFEHSDSEHSDFAHSENMAQPPPRERTLREMAAPDFTYESLCIQYPDEDVPYVLKTGLIHLLPKFHGLAEGVAKDWLYYLAPRSITSWDDLKRVFLEKNFPASKTTTIRKDISGLNNMERSMIDAASGGALGDMTPAEARNLIEKMASNSQQFSARNDAIVIRGVHEVATNPSASSETKKLEGKLDALVNLVTQLALNQKFVLVAR

SEQ ID NO: 153103 - protein, 56 aa, Glycine max
  Coding DNA Sequence Number=SeqID_61418
MAHMVGSHKSHPISQNNSNIPPKEMEVMRLSIFNGFCAREYEDHPGEKPYSFGCFR

SEQ ID NO: 153104 - protein, 224 aa, Glycine max
  Coding DNA Sequence Number=SeqID_61419
  Subcellular localization annotation: CTP_CleavageSite=63; ConfidenceScore=5.01e-01
TQGSFVPHGRQDILNTAIGRPEHGGRVRAAGSGVTITQYYGRASRTCSSSSTSISQQQLDEVVARLREDMTGQIREELRTQIKEELRTQLEEENKRSLEIMTNALKEAIKKELSNKGSPELLQIQSDIQQVAARVSTQGSNVVTNVQASQEHHADAIPLMGLYVQLKDGTTSCNCWVWFVFCSSFSFCFICINFCFVYGSFKVFPAEISRTYAVQAIAEWDILQ

SEQ ID NO: 153105 - protein, 143 aa, Glycine max
  Coding DNA Sequence Number=SeqID_61420
MNVATTKDLEQEPKRARKEEHGQNKFRGPLWGSNSELKLRREERDQSRAHSMVLKEELAVCSRSKRNLSQHLGETETNMLAIVSKYQEELNLATAHEHRVADEYAQVYAEKEARGRVIDSLHQEETMWMDRFALTLNGSQELP

SEQ ID NO: 153106 - protein, 72 aa, Glycine max
  Coding DNA Sequence Number=SeqID_61421
KAVASGGSNPARLGELGGNHLPYFAINRGGRQEGRAEALPKRFRNVFREESRKGQPFFDVLHSFFIVLRSST

SEQ ID NO: 153107 - protein, 110 aa, Glycine max
  Coding DNA Sequence Number=SeqID_61422
IIREKFDEPAPSWLKVSVDLRDRWFGEFKKEYRWHPQEEQAIRAVFETKDFLNKSSTAKANRSVDRGASTYCGGSISTAAHFEKLVILLHIYVFKGVLKTTNCLGDDGEN

SEQ ID NO: 153108 - protein, 111 aa, Glycine max
  Coding DNA Sequence Number=SeqID_61423
MWLEEFMRDPRLSTTFLWAMINSRLVLRKFEMVAEGPAKPVDMSDPDIDPLYLMTLIIPQLFLKSLQVSWDASVFGVYNDNFPLYIKHEDLSKIVHGGECLSISVIQLWIL

SEQ ID NO: 153109 - protein, 194 aa, Glycine max
  Coding DNA Sequence Number=SeqID_61424
MATIVEAMMSIKEIVEVSAAYQTRARARVMGEVEKVQEQMKADMEAMKEKMAKMMEAIISMKKIKEVDMVAVATTNVVAKVNPMPPSGLNQMNHPTSNMVADFEPWLGYATEGQVVGGIPFENTLESPQFRPQPQPLHFAVGRAPPAMAEKGKADHLKERLRAIEGGEDYAFANLEKLFLIPKHGHSQVQGAGL

SEQ ID NO: 153110 - protein, 160 aa, Glycine max
  Coding DNA Sequence Number=SeqID_61425
MGDQEETQEQMKADMSALKEQMASMMEAMLGMRQLMEKNMVTAAAVSSVAEADPTLLATAHHPPPNTVGRGRSILGHNSNPHLGYNRVAYPYGFPPNYTPPVMQDDAGHVSSPILEGEPPRQPDEVHKDHQEYAQGDVEFYPPIPVKGPSPNTLPLPNLA

SEQ ID NO: 153111 - protein, 108 aa, Glycine max
  Coding DNA Sequence Number=SeqID_61426
  Gene Ontology: Mol. function=transferase activity, transferring glycosyl groups
  Homolog annotation: Hit_ID=Q8ZPW3; Match level="QueryCoverage=76%, HitCoverage=19%, E-value=3e-40, Identity=89%"; Hit description =UPF0229 protein yeaH
RYDPAQWNIYAAQASDGDNWADDSPLCHELLAKKILPMVRYYSYIEITRRAHQTLWREYEDLQARFDNFAMQHIREPDDIYPVIPKHSPLCPHGLIGIFPFSYRYPVA

SEQ ID NO: 153112 - protein, 330 aa, Glycine max
  Coding DNA Sequence Number=SeqID_61427
  Gene Ontology: Mol. function=two-component response regulator activity; Cellular component=integral to membrane; Biological process=two-component signal transduction system (phosphorelay)
  Homolog annotation: Hit_ID=A4WCF8; Match level="QueryCoverage=66%, HitCoverage=91%, E-value=1e-103, Identity=88%"; Hit description=Two component transcriptional regulator, LytTR family
  Pfam annotation: Domain name=HATPase_c; Domain location=21-119; Score= 40.0; E_value=8.2e-09; Accession=PF02518.17; Description=Histidine kinase-, DNA gyrase B-, and HSP90-like ATPase
  Pfam annotation: Domain name=LytTR; Domain location=234-329; Score =104.8; E_value=2.6e-28; Accession=PF04397.6; Description=LytTr DNA -binding domain
  Pfam annotation: Domain name=Response_reg; Domain location=100-204; Score=74.9; E_value=2.7e-19; Accession=PF00072.15; Description =Response regulator receiver domain
  Pfam module annotation: Pfam domain module=HATPase_c::LytTR::Response_ reg; Domain location=21-119::234-329::100-204
IEQARFQSRLQVSLSVPDELAYQHLPAFTLQPIVENAIKHGTSQLLGTGQITIAASRFNHHLVLDIEDNAGLYQPSASGGLGMSLVDKRLRAHFGDDCGITVACEPDRFTRITEQPDIEIVGECANAIEAIGAVHKLRPDVLFLDIQMPRISGLEMVGMLDPEHRPYIVFLTAFDEYAVKAFEEHAFDYLLKPIEEKRLEKTLTRLRQERTAQDVTVLPENQQPLKFIPCTGHSRIYLLQMDDVAFVSSRLSGVFVTSAEGNEGFTELTLRTLESRTPLIRCHRQYLVNMAHLKEIRLEDNGQAELVLRAGQTVPVSRRYLKSLKEAIGL

SEQ ID NO: 153113 - protein, 94 aa, Glycine max
  Coding DNA Sequence Number=SeqID_61428
SLRSKLRVFLVYAIEPASGPTLDHAEFAGCGPATASYERGGVSTEEPSTGVLDMSSSQPESSAPMPDLPLPQDSPSGTPALDLNEYAMDSAQDH

SEQ ID NO: 153114 - protein, 87 aa, Glycine max
  Coding DNA Sequence Number=SeqID_61429
WMYPPLELIHKRCTLSYSQYNNPSRCTLYLYHKGCTLQCVKAKDSQAVSPLNLCKGKQKISQVGDTKELRRLVLRFFWQKEEVNEEE

SEQ ID NO: 153115 - protein, 144 aa, Glycine max
  Coding DNA Sequence Number=SeqID_61430
QVWSFGTHDTRRYLTVIRTLLSSRGGGPDDKQRPKTKFGHSAPMIRGDTLWLFAPFCHPEAAGPMTSRDQVWSFCTHDTRRYLMVIRTLLSSRGGGPDDKQRPKTKFGHSAPLYHPEAAGPMIRGNTRVVIRINILLLSVRQNA

SEQ ID NO: 153116 - protein, 78 aa, Glycine max
  Coding DNA Sequence Number=SeqID_61431
MSVKHLIERLRVHDKTNHILEDQPGSRCFARMLQPCGIGTSLKKCSNQVYLPPRPTLRRVCQGLSLLIQVQPRKHFST

SEQ ID NO: 153117 - protein, 72 aa, Glycine max
  Coding DNA Sequence Number=SeqID_61432
MEALVEDYEDGNGKNESRQFIDGLKRKYDIALVFLEGENVKALGPLSDLLGSTKVGISLLRILNCDEEIRPT

SEQ ID NO: 153118 - protein, 62 aa, Glycine max
  Coding DNA Sequence Number=SeqID_61433
MDKSLRAGEDEWREKERRSTKFCASKEPMDPKSTLRLMRTLGPSLASLAQSSWSLLSNALAG

SEQ ID NO: 153119 - protein, 123 aa, Glycine max
  Coding DNA Sequence Number=SeqID_61434
VVYKSKGETKDIELVEDADSSSETSNKSENYKEEARNATQKHKPKRVESVNADVEAFGDDWKTGDSIVLKIGDSTKVVIKQDMKGIRHKYGFNNNKCEKAEKVRVVDDETGDKHQLDEVLRMP

SEQ ID NO: 153120 - protein, 179 aa, Glycine max
  Coding DNA Sequence Number=SeqID_61435
MTTLTQTWMTLLLNNVLPSDHNYDLPLPKCQLVYAILTRMSVHVAQVIADAIYLFVGMPPTRHPLDPDKSNRALGFPALITGLCQSFGILVTPTKAWSVIYSTWFASRRPTIGGRCRYMSVSTGSASVSMGRVSLLLHAILQSRLGLRSHGPEIGLRPRQGSSPQDPPVRQRKPVWMKK

SEQ ID NO: 153121 - protein, 255 aa, Glycine max
  Coding DNA Sequence Number=SeqID_61436
  Homolog annotation: Hit_ID=A1G224; Match level="QueryCoverage=89%, HitCoverage=52%, E-value=4e-30, Identity=87%"; Hit description =Methyltransferase type 12
AIPTPLVKRSRSTVAGRISSARRCTTRVLQHLPDADGQPVLDLGCGLGLFAHVLRQRGGTQRYLGVDVDAGKIARAQRAAVELHDVRFDCVDVQAPLPAQCRARPAAGRAAVPGRGPAAGTAARGQCAGGSRWLPAAAHAAGHRRWPRPHHAGGGPAGLAGRLDGHAAAPLPRSRGAATTLAKRDCSVTAPRPLHGRTPFNSWTAGGTPEPVAPLPCTPLTSPQARLIAEAFRPAQAWGSRRDYYYTRSKLGSDP

SEQ ID NO: 153122 - protein, 285 aa, Glycine max
  Coding DNA Sequence Number=SeqID_61437
LNVLALRGLQVLTIRGLHALTSRGLHVLALRGLHVLTIRGLHALTSRGLHVLALRGLLALALGLHALTFRGPHVLTFRGLHALAIRGLHVLTFVGLHALTFRGLHVLANRGLHAFTFRGLHVLANRGLHALTLRGLHALTSRGLYIFALRGLHALTFRGLRVLIFSFPFNGSWATPDIGGRPTVRAQPEREAITQLLCIPGQDFTRAAAKRRVRIMRTNMTTLTQMDRTHKDTPVDPKKSKQGPRVSSSGYGPLSVLQGARIAPARHPVDPKKSNRVLELSSSNY

SEQ ID NO: 153123 - protein, 279 aa, Glycine max
  Coding DNA Sequence Number=SeqID_61438
  Gene Ontology: Cellular component=integral to membrane; Biological process=transport
  Homolog annotation: Hit_ID=Q7D2T7; Match level="QueryCoverage=100%, HitCoverage=43%, E-value=1e-100, Identity=67%"; Hit description =Putative uncharacterized protein
MLAYFVAISFDLNRPSWAVATVYIVAHPLSGAISSKSVYRLLGTVIGGGATILMVPNLVNEPILLSGVIIVWVSGCTFVSLLDRTPRSYVFLLAGYTVLLAGLPLVNAPANTFDIVVSRTEEIGLAIICASIVSHVVFPVHVGTALLNRIDGWMARAQKLFEVTATGKMDETQNRMERHALAGEAADLRSFAVHLQYDGSRYRSRVALVKSLQHRMVSFLPLLSELEDLRRSLGRLDPAGRYKALAIVAEADSRPGGSFSTIGALAFPGSLPTWEKLLL

SEQ ID NO: 153124 - protein, 89 aa, Glycine max
  Coding DNA Sequence Number=SeqID_61439
MQRRSAAVDLIPIDLEINAICRKRNSERIRNFLQDLEAAATSEEEPRSSEASSSFPVARHSHIEPIEDTIMAEEPRRVTLEDYSSSNVP

SEQ ID NO: 153125 - protein, 231 aa, Glycine max
  Coding DNA Sequence Number=SeqID_61440
  Subcellular localization annotation: CTP_CleavageSite=6; ConfidenceScore=5.52e-01
MNSLPSAVHVSSTFESGVPRIDRLALFANSPFSTFIRSPINSLSSTVHASSTIESGVPRIDCLALFANSPFSTFIRSPMNSLPSAVHVSSTFESRAPRIYCLALVANSPFSTFIRRPINSLSSAVHASSTIESGVPRIDCLALFANSPFSTFIRSPMNSLPSAFHAYSTNESGAARIDCLALFANSPFSTFMRSPMNSLLHVSSTFESGVPRIDCLALFASSSFSTFIRSL

SEQ ID NO: 153126 - protein, 86 aa, Glycine max
  Coding DNA Sequence Number=SeqID_61441
HNRRKFRNENVSNFRKKVFWKLLRPIPEEVIPENTSGRPSSGMGLSNFRKHFFRKLLKSIPEEGLLEVFSGITSSGMDLSNFRKKV

SEQ ID NO: 153127 - protein, 112 aa, Glycine max
  Coding DNA Sequence Number=SeqID_61442
MSGFTHDSPQISASPYQLDLAPYASEPNNAQWNAPGLLRDKHTLRSSRILGEMEVDEPWLGLWLPLNYQVDMGANFVVDLGMAFVDNWAVGKEKVCYWLSNDIVGLVGNLAV

SEQ ID NO: 153128 - protein, 78 aa, Glycine max
  Coding DNA Sequence Number=SeqID_61443
MEGEGTFLVDQFKWRVHPLGLSKRTREGTSLLDLCLVKDFTRLKKISRTAGCLGTGCRPGLWLNQYKSCGCLPLPYTL

SEQ ID NO: 153129 - protein, 128 aa, Glycine max
  Coding DNA Sequence Number=SeqID_61444
IRSNKALGFPALITGLCQSFGVPVTPSKVIRPPITRAFIEKYCTPRQAQGDAPQAADAPPPPHQADLVGSFGIGAVFTALGLPAGGQPQGADQFRAEVAWPGDWPEAQAREAPAGLPAMQRRPAWMRR

SEQ ID NO: 153130 - protein, 53 aa, Glycine max
  Coding DNA Sequence Number=SeqID_61445
MFAKFLIFFCNASIFRIVVRLPWWQRRMILPENVEELSLADMEKSKPTRKKMK

SEQ ID NO: 153131 - protein, 186 aa, Glycine max
  Coding DNA Sequence Number=SeqID_61446
MAPRKLFAKRSRKDAAAEGTCAAPEFDRHRFRSSEHQQCFEAIKGWSFHRERRVQLRDDEYTDFQEEIAHRRWTSLVTPMAKFDPDVVLEFYANAWPTKEGVRDMRSWVRGQWNPFDADALSQFLGDPLVLEEGQKCEFSQRRNRADGFDEEAIAQLLCIPGQDFAQTAAGRRVRIMRTIIASVTQ

SEQ ID NO: 153132 - protein, 53 aa, Glycine max
  Coding DNA Sequence Number=SeqID_61447
MTSVVGDTKEVEDDFLVDNSGRASLDPLSVLRPPLREAPDALGGITAFLIPMF

SEQ ID NO: 153133 - protein, 255 aa, Glycine max
  Coding DNA Sequence Number=SeqID_61448
  Homolog annotation: Hit_ID=A2FDT0; Match level="QueryCoverage=50%, HitCoverage=18%, E-value=2e-08, Identity=33%"; Hit description =Putative uncharacterized protein
MPSPLEDYTSLAFREDYIGLHALTLRGLHVLAIRGLRVLAFKRAPSPHLQRAKFPSPFRGLHALAFKGPTHPHPSEDYTTSPFRGLHVLAFRGLHALTLRGLHAPQLQRTTPFRGLHILAFRGLHALTFRGQHVVAFRGLHVLTFRGLHVLPSRGLQVLTFRGLHVLAFRGLHALTFRGLHVLAFRGLYVLTFKGLHVLPFQGTTRPHLSEDYMPSPLEDYMSSPSEDYTSSPSGDYTSSPSEDYTSSPSKGYTP

SEQ ID NO: 153134 - protein, 107 aa, Glycine max
  Coding DNA Sequence Number=SeqID_61449
MHTQSFTIPQFLKIGLTHKKFPVESPTVATCPFAGVRGEAHGCAFQRRKDAWSHHQRLFVENIGKNRRKPVKKKIPSSRVVFTLEEGRQKQGSCSYVPSIEEEIRPT

SEQ ID NO: 153135 - protein, 123 aa, Glycine max
  Coding DNA Sequence Number=SeqID_61450
MVGQGGEVLRSMGGPCMVQSKNSFPLYGLPPNYTPPNAMHVPSKNASHFVPILLEGQQPQLGHAPFAQPMGEAREKPRDHALGKFESYPTYAAKGPAFGGMPQPNAMGAPQHCSLQPLHFSVG

SEQ ID NO: 153136 - protein, 391 aa, Glycine max
  Coding DNA Sequence Number=SeqID_61451
MDRQRTALKDLQWRTTREVDDHHAFKGSLKEALCLAKDIKLSAGWEATRHTYVRKRGPNRCKQQTGGMKSKGPTGEGSNRRGTNSKLKWAARSHALSVRPRAKRPEERAKPARITAEEQGTRLASTSALSALMNLSERAKRVPQTLSACIRQQAGALSAGLGLRMASRKRRAVPTPGEASNWDSSRFTSEIAWHRYQDNIQLRNILLERNVELGPGMFDEFLQELRRRRWDQVLTRLLKKRIDVALVVRFDDDTINDFLDTPVILEDGEEYPAYTRYLSTHPDPDAIAATLCTPGGGTLDLRLSEKDGYGRGQLYISADQLDCPVQYLEAWGVVSDTLIFESLSPAINLAYVKKNCWNLADPSITFPGAHQTRTRAPASISEAPPTSQPSS

SEQ ID NO: 153137 - protein, 185 aa, Glycine max
  Coding DNA Sequence Number=SeqID_61452
  Homolog annotation: Hit_ID=Q6WAY6; Match level="QueryCoverage=85%, HitCoverage=26%, E-value=2e-15, Identity=32%"; Hit description =Putative uncharacterized protein
MAPPLTSSPLSSAASPWCEKNSARIVCCLPTLCVWLVSHLFQQDIRHSCPLQSYRSCVEKRRVDWNQHLAGIGGNTINWFPRWKEGKEGVLFSCGDYPNVPLMGTRGCINYNPALAIRQLGYPMRGAPMEESLSPFLVRDFGAQSLKVVQKVHKAWRSPLRKDKELRGIRNGVIGGYHEWLRVHT

SEQ ID NO: 153138 - protein, 149 aa, Glycine max
  Coding DNA Sequence Number=SeqID_61453
  Homolog annotation: Hit_ID=A7UQU7; Match level="QueryCoverage=67%, HitCoverage=17%, E-value=1e-14, Identity=42%"; Hit description=IMP dehydrogenase/GMP reductase, putative
  Pfam annotation: Domain name=DUF1723; Domain location=97-144; Score =21.0; E_value=0.0017; Accession=PF08330.1; Description=Protein of unknown function (DUF1723)
MAPADVEDTGADIPTDTGAQAAEDEHEGFPGGPSDLSMLTQYANHVACSIWTGKERPELKLSSHGRKVHSLGRSVPAIEGLVVGTGLSPLIVCSVDTGDWGLLSSFVERWHRETSNFHLPVGELTITLVSTEAARAETGQCRGPYVRLQ

SEQ ID NO: 153139 - protein, 131 aa, Glycine max
  Coding DNA Sequence Number=SeqID_61454
  Subcellular localization annotation: CTP_CleavageSite=64; ConfidenceScore=5.44e-01
MERSSTLSLTSILSPLRNLAMLVLSSSLSLALKRSSSIFLSLFFNTHTPLSKPLELVHKLPFIVGGNVPLPKGTFKIIPILYWRIPMNPSFPNKGSPPIEGIPLKPKGSQWNFSLFANMMARKELFNLHFP

SEQ ID NO: 153140 - protein, 200 aa, Glycine max
  Coding DNA Sequence Number=SeqID_61455
MAFLGETSSQTIVNSRLAFIFPNGSIIHNDTGVYFQTSTPVPIRVPNSCDFASLKTRIHNTLQLSNKQFLDEIHYRKPFTDTDGIINLLERTMARTHDAILYYNGKWNMSPQNKFVGCAFTGKNPKKFQIPSTCTIDELKNLIKQVAPKGIPHLGIHESQTVRRLFFCQPAHFEYSDTVIKYEINELITNEELLKGVSTI

SEQ ID NO: 153141 - protein, 115 aa, Glycine max
  Coding DNA Sequence Number=SeqID_61456
MAAQLIRDRVEMECLEGAWETLEGNTRCRFRGTIRFTATSLVHPDEPTRTLQRTVEWILPTPTPYRLVEPVQVIEGDEDPLLEVDSPEEVMSASEADSMEDSGPGEMAISGGSSS

SEQ ID NO: 153142 - protein, 116 aa, Glycine max
  Coding DNA Sequence Number=SeqID_61457
MARRDKLWSFCALLSLQGGGPDDMRDKLWSFRTPFCHSDTVVSDGTQQTNYGHSAPFVSAVDKPVDTRRFTSSSAAHKICHTDIMSHADGRKYPSGYSYKHSFAICKTERLIACRD

SEQ ID NO: 153143 - protein, 205 aa, Glycine max
  Coding DNA Sequence Number=SeqID_61458
  Gene Ontology: Mol. function=nucleoside-triphosphatase activity; Cellular component=intracellular; Biological process=chlorophyll biosynthetic process
  Homolog annotation: Hit_ID=A8GL65; Match level="QueryCoverage=84%, HitCoverage=34%, E-value=5e-55, Identity=64%"; Hit description=Mg chelatase, subunit ChlI
MTRAADVRYRFVSKSIDAGGLPETTVKEARERVRSAIINSGFTFPAKRVTINLAPADLPKEGGRYDLPIAIAILAASEQLPGDKLAHYEFLGELALNGALCGVQAAIPAAMAALQAGRQMVLAEQNQQDVGLIQQGETLVGKHLVEICAFLHNQTALTVAHYQPETVPHEQQDLSDIIGQQQGRRALEITAAGGHNLLLLGPPGT

SEQ ID NO: 153144 - protein, 26 aa, Glycine max
  Coding DNA Sequence Number=SeqID_61459
MATPMSTACYLDKDETDIKQIPMNLT

SEQ ID NO: 153145 - protein, 75 aa, Glycine max
  Coding DNA Sequence Number=SeqID_61460
MSRKRYEGASAQIFFMETIFLTNFKEKKEKLATQLAQVNSACPSELGCFLQKAPLSNELPGRPKWAWLLFAPPVY

SEQ ID NO: 153146 - protein, 197 aa, Glycine max
  Coding DNA Sequence Number=SeqID_61461
MMSFINVEFLQDVRKKAHAIQKQNIAPHVLSHGGYEYLEKKLMDEKTKKKLEEASQSGSTDTVIDPSSPIRQHVKWKMARMKKTCQMTSEAAKEIADKIDLLEEQASQGSFVTHGRQDVLTVAIGRCDDQAILWTRSKDLPHDFLHGSRRPRAYDSTNQGPAGGADHRKSDLIANVILQPNAVPVSVTNAITGGTTS

SEQ ID NO: 153147 - protein, 108 aa, Glycine max
  Coding DNA Sequence Number=SeqID_61462
  Gene Ontology: Mol. function=RNA-directed DNA polymerase activity
  Homolog annotation: Hit_ID=Q2HSQ4; Match level="QueryCoverage=50%, HitCoverage=56%, E-value=2e-13, Identity=64%"; Hit description=RNA -directed DNA polymerase ; Zinc finger, CCHC-type; Peptidase aspartic, catalytic, putative
MARYLHGLNREIQDIVELHHYASLKDLIHQAIKVEQQVKRKQTYKKERVSSLKSHEKGHIVSQCPNKRIMAVLVNGVITSASFSGSSSSSTESESQCDVQPLKGFLLM

SEQ ID NO: 153148 - protein, 170 aa, Glycine max
  Coding DNA Sequence Number=SeqID_61463
MDAGWLTFQEDRPNVRTNPLANHGGGAVNAVESDRPHRSKPLRDVATPRRFIFEALQKGDQGRLEVGIEGKEEQHICMQSTEGSGVAKPKPLVIYFTKSAASQKPGHPLMAKPVPFPYQNSHAVPWRYTPPGKKEEEVTDVSSLSAKVTNITGLSGVTRSGRVFAPPDLP

SEQ ID NO: 153149 - protein, 24 aa, Glycine max
  Coding DNA Sequence Number=SeqID_61464
ESRKAFNRSSTFFIRSSSFFDLQR

SEQ ID NO: 153150 - protein, 63 aa, Glycine max
  Coding DNA Sequence Number=SeqID_61465
MKHFTDTLISANISMMIGCGITWMLWKLGRIDGDPTLRGTGIRATWEYVSSVGGGQQGMVGYT

SEQ ID NO: 153151 - protein, 85 aa, Glycine max
  Coding DNA Sequence Number=SeqID_61466
MDERPCGLGMAPTRYPLDPDKSNRALGFPAPITGLCQSYRVPVTPSKAAGALPPPRQADPVGPLGVERYLQHWVRQQAVNHRGQV

SEQ ID NO: 153152 - protein, 124 aa, Glycine max
  Coding DNA Sequence Number=SeqID_61467
  Subcellular localization annotation: CTP_CleavageSite=53; ConfidenceScore=5.10e-01
MTGVMVLNRGQQPKLGPHQSHFFAVARNVKVFWLTATATAILNHDRSLWCNVVESNFWALADKYSRLLTNSCRGANVDWEAVLCARKGSGLRAWAWINAKGKGRKFSYYEWEMNPRACLNCLLL

SEQ ID NO: 153153 - protein, 99 aa, Glycine max
  Coding DNA Sequence Number=SeqID_61468
MKEMIRQALSVFDENNMLCDASSIRACRPRIFFINGFLCFLEDEWQRNGERERERRRHFKEKMSLEEAHHHRRPWIRAWRKNEMNEGRGREEHEILCSK

SEQ ID NO: 153154 - protein, 43 aa, Glycine max
  Coding DNA Sequence Number=SeqID_61469
DAGGGMVDEALAIMEILASHHEGRVAIGQADRGRHPNQINMKM

SEQ ID NO: 153155 - protein, 113 aa, Glycine max
  Coding DNA Sequence Number=SeqID_61470
MFGSKAIDAFLAFHDRKEIPLIAILADLYDTFDRRCEKNSARIVCCTLTLYVWLVSHLFRQEERHIFPLEGHRSCAEKKEANWDRLLASKEGASVNWFPRWKEGRTDILVSCG

SEQ ID NO: 153156 - protein, 126 aa, Glycine max
  Coding DNA Sequence Number=SeqID_61471
MFGSRGIVAANDRSRPIGSRYTPPSEREEEATDVSSLSAKVTNITGLSGVTPCGRVFAPSDLPTQPTNIKGKAKMVEEQNDKTTLTQNEDFPVKGLPEKRDGCGKKEVSLEEASEFLRIIQQSEFK

SEQ ID NO: 153157 - protein, 61 aa, Glycine max
  Coding DNA Sequence Number=SeqID_61472
MASPLSLPSPFCCHSSSKKQRNPLMKKILCLQAPMELTSHPHSFELACYGRLNPQLGILAE

SEQ ID NO: 153158 - protein, 133 aa, Glycine max
  Coding DNA Sequence Number=SeqID_61473
  Homolog annotation: Hit_ID=A2Q4S5; Match level="QueryCoverage=77%, HitCoverage=18%, E-value=3e-13, Identity=35%"; Hit description=IMP dehydrogenase/GMP reductase, putative
MGSCCPGAYCWIYEHFPSVAECNTDSEYDDASPCACRWIATKKTMNSISTETYRQCLDRLRILDVCWMPYGEHRQGPVAIRYRPERVMRQFGYVQSIPAPPVDSWVSFDEIDDRWMHYSDHLALAGEMCVMPG

SEQ ID NO: 153159 - protein, 295 aa, Glycine max
  Coding DNA Sequence Number=SeqID_61474
  Gene Ontology: Mol. function=helicase activity; Cellular component =chromatin; Biological process=viral genome replication
  Homolog annotation: Hit_ID=Q2QZU2; Match level="QueryCoverage=100%, HitCoverage=17%, E-value=9e-74, Identity=45%"; Hit description=AT hook motif-containing protein, putative, expressed
MMLTTCKGATSFEDIRTIENVLYPTYREACFAMGFLQDDREFVEAIKEAKDWGTTNYLRKLFVLMLLSGAITKPAELWNQTWNWLAEDIAYHYKKTTLNIELEIDDEQLKNLTLLEIEKLLHPHQTSLKDYPTMPYPEGANLALCLENSLILSELNYNNDEARSEFENLFLSMTDEQKQIYHKIMEAVNNNEGRMFFLYGYGGTGKTYIWRTLANSLKAKNQIVIMVASSGIASLLLPGGRTAHSKFKIPVPIFEDSTCNILQGSQLAELLNQTNLIIWDEAPMAHKFCFQALDQ

SEQ ID NO: 153160 - protein, 138 aa, Glycine max
  Coding DNA Sequence Number=SeqID_61475
  Homolog annotation: Hit_ID=Q51617; Match level="QueryCoverage=39%, HitCoverage=79%, E-value=5e-13, Identity=70%"; Hit description =Putative uncharacterized protein
  Subcellular localization annotation: CTP_CleavageSite=17; ConfidenceScore=5.69e-01
MLCKKAVSSFGPPIVVRSKLAAVLSLMVMAALHNSLTVMPSVRCFSVTGVSRGPFVSRVSVMTVKTSDTCSSRRRSQLVCKRMPGADKPVRARQRMRKENPHQAPFAIQAAQLLGRAIGAGLFAITPAGERGMCCKGD

SEQ ID NO: 153161 - protein, 122 aa, Glycine max
  Coding DNA Sequence Number=SeqID_61476
  Pfam annotation: Domain name=zf-CCHC; Domain location=40-57; Score =10.5; E_value=0.039; Accession=PF00098.14; Description=Zinc knuckle
MKDQAPSVLGVPPSKQKDDKGKNIEEINPKASSQDRTSNIKCFKCIGNGRIASQCPIKKTMIMRDQDIYSSQEEATSSPSSSGSEGEATSDEHIEEVYPYEEGDLIMMRRLIGSQSCDLTQT

SEQ ID NO: 153162 - protein, 176 aa, Glycine max
  Coding DNA Sequence Number=SeqID_61477
MAPKKLSTKRSRRDAAAEGSSATPEFDSHRFRSAEHQQCFQAIKGWLFHRERRIQLREDEYTDFQEEIARRRWTSLVTPMAKFDPEVVLKFYANAWPTEEGVRDMRSWVRGRPVVRVQPEEEQGRRVRRGGHCPAVMHTGAGFRPDRCREAGVYHAHQHDHLDPDVDNIAAQQCPA

SEQ ID NO: 153163 - protein, 195 aa, Glycine max
  Coding DNA Sequence Number=SeqID_61478
  Pfam annotation: Domain name=Transposase_23; Domain location=110-180; Score=-15.5; E_value=0.059; Accession=PF03017.5; Description =TNP1ENSPM transposase
  Subcellular localization annotation: CTP_CleavageSite=29; ConfidenceScore=5.00e-01
ASQGSFVPHGRQDVLTIVIGRPEHPGRVRAVGVGVTIKQYFGSAPRTSRSSSSMPPEDLQQLTQQIRDQLEESITEKGLALPPEPEVGPSGPRVSTKESCVAPSGNDLETGDSDKCGLYIEENPSRLVAIGRLYEGSTAVHNIPLLHGQVKVGVEEVKDAKALVLVPIDEVTLVGQTLNIFLAWLTHLVKRLSKQ

SEQ ID NO: 153164 - protein, 47 aa, Glycine max
  Coding DNA Sequence Number=SeqID_61479
MAEPSKKRKGTSSQSQRHSGSQEMPIPSSIPSGSLFSSKKQQSMKAP

SEQ ID NO: 153165 - protein, 62 aa, Glycine max
  Coding DNA Sequence Number=SeqID_61480
  Subcellular localization annotation: CTP_CleavageSite=23; ConfidenceScore=5.06e-01
MGRATLSPSSCNLCPNMRSPSARCMVVRICWMFLYVDMSNRIFSTHTRNGPEETCLKEIQEG

SEQ ID NO: 153166 - protein, 108 aa, Glycine max
  Coding DNA Sequence Number=SeqID_61481
MGETHEVLQDHTLAGFGVYPGYTTEEQAFSGITVLNAPGISQCCPLSQPLHFVRGEGPFTVLEKERTEHMKERLRAIEGGENYAFPDMAELCLVLDVVIPPKVQGARF

SEQ ID NO: 153167 - protein, 115 aa, Glycine max
  Coding DNA Sequence Number=SeqID_61482
SEVQVPLDQRLYEESGTTLKKIIVVLFEHLLLVISLQLNSRRQQIKLTRAGRNAPSGALPLTLKSAFCAYRRKEDAGPFEEREPMSVNLDENESMSEYRPWESTMSYLSNYSSAV

SEQ ID NO: 153168 - protein, 69 aa, Glycine max
  Coding DNA Sequence Number=SeqID_61483
MLTNPDTSYQEQAQEVSLVCIKNKLKRLALTDPLKLLQEHNKGKGNFTKEKKHRVVTMLELNMRYPSHV

SEQ ID NO: 153169 - protein, 102 aa, Glycine max
  Coding DNA Sequence Number=SeqID_61484
  Gene Ontology: Mol. function=nucleic acid binding
  Homolog annotation: Hit_ID=A5C3F7; Match level="QueryCoverage=62%, HitCoverage=6%, E-value=8e-13, Identity=53%"; Hit description =Putative uncharacterized protein
MEKSEKKNLSEKKLKKAYITWDENDMESSEDSENEEINLCLMAKSYESDEEVSLRKKWYIDSGCSKHMTGDASNFTHISPKKSGHVTYGENNKGRILGVGKI

SEQ ID NO: 153170 - protein, 165 aa, Glycine max
  Coding DNA Sequence Number=SeqID_61485
  Homolog annotation: Hit_ID=Q5QJQ3; Match level="QueryCoverage=18%, HitCoverage=24%, E-value=2e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNASRETCRASCINESANARGEAVCVLGALPLPRSLTRCARSFGCGERYQLTQRRSFAPSWAVCTNPPFSPTAAPYPVTIVLSPT

SEQ ID NO: 153171 - protein, 139 aa, Glycine max
  Coding DNA Sequence Number=SeqID_61486
MSALKDQMASMMEAMLGMKRLIESNAATTAAASTIAEADPCLPLRSTPNFMPPAMHENTNHAVSFTFERQPPQPVRGAHGEPRERVSGDVDSCPPFTTEGPAPNALPQPNITRVSQPRPMQPLLFSVRGPPPTMEGVIP

SEQ ID NO: 153172 - protein, 77 aa, Glycine max
  Coding DNA Sequence Number=SeqID_61487
MPQTSDKVDLLHQWIPLLLEDEWQQNEERERERRRHFKEKMSLEEAHHHRRPWIRAWKKKEMNEGRGREEHEILCSK

SEQ ID NO: 153173 - protein, 180 aa, Glycine max
  Coding DNA Sequence Number=SeqID_61488
MERSMIDAASGGALGDMTPAEAKNLIEKMASNSQQFSARNDAIVIRECKRNLYLSQGSVVCAPLLTTIQTFALPCSNLEQLSSSKLMLQTFTIDLLNLSSKINHNRTITTSPATDTTLDGGITLISDGLALSNNNRSLLLPSKMLLAQADHTFLHQSNNNNSPRNSQQLKVLHNLPSKNL

SEQ ID NO: 153174 - protein, 52 aa, Glycine max
  Coding DNA Sequence Number=SeqID_61489
MASYGGELFLDSSSLEVPFNFKKQRTPLMKKIQGLQTPHGATSCGIRAPSSR

SEQ ID NO: 153175 - protein, 69 aa, Glycine max
  Coding DNA Sequence Number=SeqID_61490
LDRVQQNAETNHGRSASCINRVEQVRQYRDDVSVPLAGRFTGRKGQLSYPNFIRGPSVVGMRPSFDHFE

SEQ ID NO: 153176 - protein, 64 aa, Glycine max
  Coding DNA Sequence Number=SeqID_61491
VKVSVEKFTNADAYIPVPTEEVMWDAIVFGVFNDNFPMYIKHEDLSEIAHGGQYLNISIIQLWI

SEQ ID NO: 153177 - protein, 86 aa, Glycine max
  Coding DNA Sequence Number=SeqID_61492
MGVVTGADSNQAHLGLPGDSNKRRCLLVEATQLAWASWAATTSLFSPINRGKRAEQKCSTLLVFRILSKLVRKIVSVKKIQAEALP

SEQ ID NO: 153178 - protein, 27 aa, Glycine max
  Coding DNA Sequence Number=SeqID_61493
IPNKGPIGNLGISLLGDQMVADLLAVG

SEQ ID NO: 153179 - protein, 114 aa, Glycine max
  Coding DNA Sequence Number=SeqID_61494
MSRNFTNYLTMGAKYLEVVKRGSHPNNGWLQVVPSVVRLMKQANRQGYTQGGFSGFQQGPYNQQGQWRSHPNNQFIKDQGGPSNRPIQQGPNIFQRTTKLEETDSVYASNNVKS

SEQ ID NO: 153180 - protein, 144 aa, Glycine max
  Coding DNA Sequence Number=SeqID_61495
MTDLVSAEDDVNLRVSTGLSAAIDEGRRRRHSKKVYTNNHSGISARQRDSKVSMTDLVSAEDDVNLRVSTACRPRLTKGAGDDVSLCVLNQAFRLTDSKKAFLVKHITRALGVGGTFFSSDCMQICGSSLPPLDTSSCPQSMSR

SEQ ID NO: 153181 - protein, 218 aa, Glycine max
  Coding DNA Sequence Number=SeqID_61496
MGQATSHLPCLADTSGQVFITAACLKLGHLTLFHEQVVVSPAKPPPKPDPEVDDPLYLMTLTIPELFLRPYQVTWDATMFGAFNPDFPLYIKHEDLSEIAHGGQCLSISVLKLWIMHLTDTSMRAGNYDIYGFLEPQSIQRFGQSQFESESYIKTWMQSSKRDVYLGAYLNGLDNYLQGIINSLNQRLLLGGLSSSVIDKKEVLSAATMSCTGCPPSF

SEQ ID NO: 153182 - protein, 131 aa, Glycine max
  Coding DNA Sequence Number=SeqID_61497
MLLSSNVIYICVRVVMLVRMIRTCLFAAARVKSCPGMHSSCVIASLSGCACTVGRPPILGGGPRTVKRKLLVRMWSTLKMRTRSPLKVRACSPLKARMCSPLEVRACSPLLARTCSPLQGEGVQPSVGEDV

SEQ ID NO: 153183 - protein, 175 aa, Glycine max
  Coding DNA Sequence Number=SeqID_61498
  Gene Ontology: Mol. function=aspartic-type endopeptidase activity; Biological process=DNA integration
  Homolog annotation: Hit_ID=A5C3T2; Match level="QueryCoverage=93%, HitCoverage=17%, E-value=2e-45, Identity=57%"; Hit description =Putative uncharacterized protein
  Pfam annotation: Domain name=zf-CCHC; Domain location=139-156; Score =28.7; E_value=2.1e-05; Accession=PF00098.14; Description=Zinc knuckle
MDIDYAIRKDEPPAITETSEPDAVDLYEKWERSNRLSVMFIKTNISASIRGSVDQHDKVRDLLKAIDEQFTTSEKSLASTLIMQFSSIKLTGTREDERLIMEEGEKVNLTTSNSGKDRKKSVGTNKGKIPTQPTIKKESKCFFCKKKGHMKKDCPKFKSWFEKKGYGKPKEASGK

SEQ ID NO: 153184 - protein, 55 aa, Glycine max
  Coding DNA Sequence Number=SeqID_61499
MTKARQKGVRKENEGGACHPAHPGELGCFLQKAPPSRELPGRSKWAWLLFEPPIY

SEQ ID NO: 153185 - protein, 109 aa, Glycine max
  Coding DNA Sequence Number=SeqID_61500
MRPLRENRGGACHPARPSELGCFLQKQPPSGGTSWKAQVGLNFTDCTLTLPFNFRHVTELHGLCYSAFLSASEISRNFTNCLTMGAKYLKVVKRGSHPNNGWSPEEIRV

SEQ ID NO: 153186 - protein, 128 aa, Glycine max
  Coding DNA Sequence Number=SeqID_61501
MKMKANKIRNELKVSDSNTYQLKTEERTKNGEERRKIFMDLLTKTSQKCYGSTSHRGQGPLKLNLLPLFIGEMGRCLPPRGFLRKISERTQLLSSPPFSYFTKKLWKPYRSILDLIFLFFLFPFTNIK

SEQ ID NO: 153187 - protein, 51 aa, Glycine max
  Coding DNA Sequence Number=SeqID_61502
MTLRQHGLSLGSSSSMDSFAPWKMNGSGMEKEEREETPLQGEDESRRSSPP

SEQ ID NO: 153188 - protein, 117 aa, Glycine max
  Coding DNA Sequence Number=SeqID_61503
MVVILPKEHPVVWFCSLHNWPDNYLKGIINSAIKGLDVASQPKSMASARWIVVKCNRQKGSTECGYYGMHWMSTIILGTFRNNWEAYFNDLRPLVPERLKALWIQWAQFYLRVRDQA

SEQ ID NO: 153189 - protein, 141 aa, Glycine max
  Coding DNA Sequence Number=SeqID_61504
  Homolog annotation: Hit_ID=A5AL60; Match level="QueryCoverage=73%, HitCoverage=9%, E-value=5e-07, Identity=32%"; Hit description =Putative uncharacterized protein
NETFSQSRLEDVDIFGKCAEDADISGEGADDNSRLEDVDIFGKDVGDDPEDADISRKSASDDSRLEDADISGEGADDDSWPKDADISGKGAEDVDISGKGAGRLRMPTDSQVTIAKSGAVDKSKAFAPTYPQFVMRNSDLR

SEQ ID NO: 153190 - protein, 43 aa, Glycine max
  Coding DNA Sequence Number=SeqID_61505
MALESYEGGELFDQITRKPVTNDVLINIHPRAPLAIDTFGTMA

SEQ ID NO: 153191 - protein, 91 aa, Glycine max
  Coding DNA Sequence Number=SeqID_61506
MVGYAPSSFVDLVFAGKRVKAGLKRGKFDHPALMNEKIGANEEDENEEGTHVVTAIPIRPSFPPTQQCHYSANNNPSPYPSPSYPQRPSLN

SEQ ID NO: 153192 - protein, 150 aa, Glycine max
  Coding DNA Sequence Number=SeqID_61507
MPPSGLNQMNHPTSDMVGKNSGSRETPHDVQIQNEHAFPPYSLPPNYTPPNVVYTPNENVNNSTPILIESQQPQSDHAHVSQPMGETHEIPHHNLANFEPCLIYATEGQAVGGIPLQNTLEGPQYHPQPHPLHSTVDKNPHPMEEMGEFG

SEQ ID NO: 153193 - protein, 18 aa, Glycine max
  Coding DNA Sequence Number=SeqID_61508
MSAIEFSIHSLNEICMMS

SEQ ID NO: 153194 - protein, 162 aa, Glycine max
  Coding DNA Sequence Number=SeqID_61509
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIAYNFGNSYDHDVRTSSRGYGHRYSVELTEPVIRALDNPRALLNFFGPT

SEQ ID NO: 153195 - protein, 133 aa, Glycine max
  Coding DNA Sequence Number=SeqID_61510
  Subcellular localization annotation: CTP_CleavageSite=82; ConfidenceScore=5.56e-01
MPISPCKSISWSVSSRHGDRTHKTPSGPGKVQQGPGVSSSGYGPLSVLQGARTPPARSRHHRECLSPPAKSSDPLPIELSSRSTAPQAGAGRSTTAALGWPVAGNRHTTTTSKVHLSSSIKRLERFLRHMADQ

SEQ ID NO: 153196 - protein, 273 aa, Glycine max
  Coding DNA Sequence Number=SeqID_61511
  Gene Ontology: Mol. function=RNA methyltransferase activity; Cellular component=intracellular; Biological process=RNA processing
  Homolog annotation: Hit_ID=A7MIJ9; Match level="QueryCoverage=82%, HitCoverage=99%, E-value=6e-77, Identity=65%"; Hit description =Putative uncharacterized protein
  Pfam annotation: Domain name=Leader_Thr; Domain location=251-273; Score=33.3; E_value=8.8e-07; Accession=PF08254.2; Description =Threonine leader peptide
  Pfam annotation: Domain name=SpoU_methylase; Domain location=2-153; Score=134.0; E_value=4.2e-37; Accession=PF00588.10; Description=SpoU rRNA Methylase family
  Pfam module annotation: Pfam domain module=Leader_Thr::SpoU _methylase; Domain location=251-273::2-153
MHFPLILVSPARPENIGAAARAMKTMGFSELRIVASDAWQDPAARRVAHGAGEILDHVKTYDTLSAALADVDFSVATTARSRAKFRYYATPAQVETILQEKRQWLNRIALVFGREDSGLTNEELEQVDLLTGIPMAQDYPSLNLGQAVMVYCYQLSALHQVAAAPVEAANAQQLQALRQRFHQLLVTLEVSNDAKLADWIDQRIGLLEQRDSAMLHRLLHDVEKKLIDNCSGKPAPDSRRTRQRQTEKISMRNHSLNTTIIITTTITTGNGAG

SEQ ID NO: 153197 - protein, 88 aa, Glycine max
  Coding DNA Sequence Number=SeqID_61512
MITKIITKDDDKGDDKKLKGQSMNEFKIFKIESRTLQDSREKLISRIKNQDSRDQDSRFKRSRFKTQDSREGLIKISMKRFSQKLSST

SEQ ID NO: 153198 - protein, 139 aa, Glycine max
  Coding DNA Sequence Number=SeqID_61513
MFSRNSLTPVMCLEQPLSRYQSSLADALSEEQILSWLSDFISKSKVYSLLLLLIDTKARFLLFFSALSESPSSKVQKRTNEFIYSHVANVLGLLFIAVTFMSNLLGKDLRIFLTSFSSVILSPKAVQALAISRMFMWKS

SEQ ID NO: 153199 - protein, 137 aa, Glycine max
  Coding DNA Sequence Number=SeqID_61514
MYETDDGITFEGPKKAIQIKRGISFESLKKRIHDKIFNCRNNMSHNESGSARVGTNSKEDFDDDYYLISNSYVEDSLDEDEDIDEISDIDDEAARLIEPLTVVQSGEGVEVRLHSGILLLTIVILIGVILTKKKFAI

SEQ ID NO: 153200 - protein, 173 aa, Glycine max
  Coding DNA Sequence Number=SeqID_61515
AFLLPLIKGRELDPFQGYHRLLLIDIVVEGRSGYSNSRQFKSDLTRKWALAADQDGVEDTVCDKYGISKEKWAQFCQTRRDPSWEDVRMKAQAIQKQNTAPHVLSCGGYDYLEQKLLAEKTKKKMQEAAQLGSVDGVIDASSPVRRHVKWKMTRTKKTGEMTTEAAKDIAEKI

SEQ ID NO: 153201 - protein, 157 aa, Glycine max
  Coding DNA Sequence Number=SeqID_61516
MVCPPDFTPRTTPDDLSQAPTFEGQLPPHADYPLQEDDEGDAHVGPLLPLKEPAPHELPQPNIVCHVPSPSAPVKELVPVAKDKGKIDLLEERLRAVEGLDNYPFSDLSDLCLVPDIIIPPKFKVPDFDKYKGTTFQRVIFGCIAEGWGHILRTKSC

SEQ ID NO: 153202 - protein, 293 aa, Glycine max
  Coding DNA Sequence Number=SeqID_61517
  Gene Ontology: Mol. function=transcription factor activity; Cellular component=cytoplasm; Biological process=branched chain family amino acid biosynthetic process
  Homolog annotation: Hit_ID=A8GL55; Match level="QueryCoverage=100%, HitCoverage=96%, E-value=1e-112, Identity=69%"; Hit description =Transcriptional regulator, LysR family
  Pfam annotation: Domain name=HTH_1; Domain location=3-62; Score=80.3; E_value=6.2e-21; Accession=PF00126.18; Description=Bacterial regulatory helix-turn-helix protein, lysR family
  Pfam annotation: Domain name=LysR_substrate; Domain location=86-293; Score=124.8; E_value=2.6e-34; Accession=PF03466.11; Description=LysR substrate binding domain
  Pfam module annotation: Pfam domain module=HTH_1::LysR_substrate; Domain location=3-62::86-293
MDLRDLKLFLHLAESCHFGRTARAMHVSPSTLSRQIQRLEEDVGHALFLRDNRTVTLTEAGERLRQFAQQTLLQYQQLRHVMDLNGPSLSGELRLFCSVTAAYSHLPPILDRFRAEHPQVEIKLTTGDAADAIEMVQSGEADLAIAGRPESLPASIDFTPLGLIPLVLIAPALPCPVRSQATQEQPDWSQIPFILPDQGPARRGIDLWFRRHRIANPQIYATVSGHEAIVSMVALGCGIALLPDVVLENSPEPVRNRVLTLENVESVAPLELGVCVQKKRLGEPLINAFWHLL

SEQ ID NO: 153203 - protein, 123 aa, Glycine max
  Coding DNA Sequence Number=SeqID_61518
MGSFTDSAWEWNLSWRRPLFDNEVASTVGFLEDISHTALQQHAADSWVWKPESNGYYSSRSAYILLQGNSEEGNMDDIFKDLWKLKIPAKASIFAGSIKEETASHLFFDCSKTQHFGGNPYHG

SEQ ID NO: 153204 - protein, 124 aa, Glycine max
  Coding DNA Sequence Number=SeqID_61519
  Pfam annotation: Domain name=zf-CCHC; Domain location=90-107; Score =14.5; E_value=0.0099; Accession=PF00098.14; Description=Zinc knuckle
MKEGIGHILDLTPIGEKRKESLKRLTLISHTSMGRTMKYTLKSYGSHSYPKKDQGQGILGVTPSTPKDDKGKTIEKQPLKASMQEKTSSIKCFKCLGRGHITSQFPTKKPMIIRGQDIYSSQDE

SEQ ID NO: 153205 - protein, 162 aa, Glycine max
  Coding DNA Sequence Number=SeqID_61520
  Gene Ontology: Mol. function=nucleotide binding; Cellular component =intrinsic to membrane; Biological process=defense response
  Homolog annotation: Hit_ID=Q2YE87; Match level="QueryCoverage=100%, HitCoverage=12%, E-value=3e-81, Identity=90%"; Hit description=NBS -LRR type disease resistance protein Rps1-k-2
MPRGMSKLNHLQRLDFFVVGKHEENGIKELGGLSNLRGDLELRNMENVSQSDEALEARMMDKKHINSLQLVWSGCNNNSTNFQLEIDVLCKLQPHFNIESLYIKGYKGTRFPDWMGNSSYCNMTSLTLLDCDNCSMLPSLGQLPSLKNLRIARLNRLKTIDA

SEQ ID NO: 153206 - protein, 57 aa, Glycine max
  Coding DNA Sequence Number=SeqID_61521
MGVQIATRPTWPSRMFLQKTVASGGSNLARLGELGGKHLLSFPINRGRREEQKVQPS

SEQ ID NO: 153207 - protein, 104 aa, Glycine max
  Coding DNA Sequence Number=SeqID_61522
MNTHSNLTYFYHRAHSTLVPSGGVYRVFFEPQFQEQCRGFCGFKRGVSGSIENNVGQCRCRGSDFQQISGGRRKRRAISSMRRKRRASARFSSAPVVKCQRFNL

SEQ ID NO: 153208 - protein, 198 aa, Glycine max
  Coding DNA Sequence Number=SeqID_61523
  Homolog annotation: Hit_ID=A5B939; Match level="QueryCoverage=68%, HitCoverage=85%, E-value=2e-20, Identity=47%"; Hit description =Putative uncharacterized protein
MDGAKARELYPAVGARTKPRCVGGRGGRCKTQGASPGGAVVGADLGGSSKYSNENFEGRRGESLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRQNSQLRTGTDKGNPTV

SEQ ID NO: 153209 - protein, 35 aa, Glycine max
  Coding DNA Sequence Number=SeqID_61524
MSKRFQEDWARAAEEGPRVFMNLRVDFRAHGPRSP

SEQ ID NO: 153210 - protein, 171 aa, Glycine max
  Coding DNA Sequence Number=SeqID_61525
MQLPQKPLNKRPRGLARKSMAGTNFAELYGVAIMNSSCEGKKGTSREHIAWSKRSLSQCLCETETNMLAIIAKYQEELGLAMAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 153211 - protein, 107 aa, Glycine max
  Coding DNA Sequence Number=SeqID_61526
MAKFDPDIVLESYANAWPTEEGVRDMRSWVRGQWIPFDADALSQFLGYPLVLGRGPGMRVWPEEEPVRWDFARTAAGRRVRIMRTNMTTPDSDLDDFAAQQHPAQRS

SEQ ID NO: 153212 - protein, 61 aa, Glycine max
  Coding DNA Sequence Number=SeqID_61527
MGHLSDQGVPKDPKRIKIIPDWPTPPSVEGRSPEYEEPRDLRSNPFQGGGDDAILPHKGIG

SEQ ID NO: 153213 - protein, 101 aa, Glycine max
  Coding DNA Sequence Number=SeqID_61528
MMLDFEILAHFLHHFVIQIGAVATCPFAGERGEAHGCAFQRRKDARSRHQRLFVENIGKIEGNRSKTKILSSGVVFTFEEGRQKRGSCSYVPSIEEEIRPT

SEQ ID NO: 153214 - protein, 229 aa, Glycine max
  Coding DNA Sequence Number=SeqID_61529
  Homolog annotation: Hit_ID=Q2HW90; Match level="QueryCoverage=64%, HitCoverage=29%, E-value=2e-12, Identity=29%"; Hit description =Putative uncharacterized protein
MVEEFEEILGCPLGGRRPYLFSGFYPSLARISKIVQISVQELDHRKQVENGVVGISRKYLEAKARILASKGEWAPFIDILALLIFGGVLFPNVDELVDLAPIDAFLAYHNHKGSPVVAMLADLYDTFDQRCEKSNTRIVCCTPALYVWTNVETLRKVRKAWEVLQKKDKELRGSNNRPIGGYRKWLKAHVQGLDWLPSLRTAKREEVEAPEEDEKVQALRAELRASPNS

SEQ ID NO: 153215 - protein, 36 aa, Glycine max
  Coding DNA Sequence Number=SeqID_61530
MESFDAHARCPSLPQCKALRYQSLSFVMTCSWEPIE

SEQ ID NO: 153216 - protein, 289 aa, Glycine max
  Coding DNA Sequence Number=SeqID_61531
  Pfam annotation: Domain name=Transposase_23; Domain location=71-141; Score=8.2; E_value=0.00015; Accession=PF03017.5; Description =TNP1ENSPM transposase
QLTQQIRDQLEESITEKVTRQVMASFSQLQSQMQSQGLAVPPKPLVGPGPSGPQVSTKESCVDPSGNDPETGDSDRCSLCIEADPARLVAMGRVYEGSTVVHNTPFLPGQVKVSVEEVTDADAPVPVPTDEVFLVGQALHTFLAWPTHLVKSLSQQVVVSLPKPPLKPDPEVDDPLYQVRWDATMFGVINPNFPLYIKHEDLSEIAHGGNSDIYGFLEPQSIQRSGQSQFESESYIKSWMQSSQRDVYLGAYLNGPDNYLKGIINSAIKGRDDAPQPKSKAYARWIVVK

SEQ ID NO: 153217 - protein, 215 aa, Glycine max
  Coding DNA Sequence Number=SeqID_61532
  Pfam annotation: Domain name=Transposase_23; Domain location=95-165; Score=1.5; E_value=0.00081; Accession=PF03017.5; Description =TNP1ENSPM transposase
MSRCCIGRQSTLDVSCCRSRCHHQAILWIGSTNGPARGVHYRESDQVGHGFLQPASVANAISGLAVPPEPLVGPSGPRVSTKGSCVDPSGNDPETGNSDRCGLYIEADPARLVAMGRVYEGSTVVHNTPLFPGQVKVSVEEVTDADAPVPVPTDEVSLVGQTLQTFLAWPTHLVKSLSQQVAVSPPKPPPKPDPEVDDSLYLMTLTIPELFLRPY

SEQ ID NO: 153218 - protein, 163 aa, Glycine max
  Coding DNA Sequence Number=SeqID_61533
MTQELVTRGDTLRLSAPRHSVTPSVIDEQRPVWSFAPFPEMSTSSGRDFFKSHKIRRSKSIAFVGRPTRSVILTLRSCDMRRQNLVIPHPFAIQTQSCPMARRDKNWSFCTLCHPEAAGPMTRGDKIWSFRTPLPFRHSRVRWLAETKIGHSAPFVIQRRRAR

SEQ ID NO: 153219 - protein, 111 aa, Glycine max
  Coding DNA Sequence Number=SeqID_61534
IGKLVDDMTKVVVRREEEYAEIETHQESILQVNTIHHQLIRKEEKDEVSIIPEYPCMATTGYVVGKDKGRMELTVEDQKISFDLFEAMKHPDMSDAYFEEEEVEQEIALST

SEQ ID NO: 153220 - protein, 249 aa, Glycine max
  Coding DNA Sequence Number=SeqID_61535
  Homolog annotation: Hit_ID=Q2HW90; Match level="QueryCoverage=86%, HitCoverage=41%, E-value=1e-23, Identity=34%"; Hit description =Putative uncharacterized protein
RGEWAPFIDILALLIFGGVLFPNVDGLVDLATIDAFLAYHDHKESPVVAMLADLYDTFDQRCEKSSTRIVCCPLALYVWLVSHLFHQEVRHACPLESHRSCTEKGGANWDRLLAYKEGASVNWFPRWKEGRTGVLISCGGFLNVPLMGTRGCISYNLVLSIRQLSYPMRGTPLEEELAPVISRGFNKTNVETLQKVCKAWEVVQKKEKEIRGSNNGPIDGYRKWLNGSQDLPRLLAKAKAMVNTYSDPE

SEQ ID NO: 153221 - protein, 22 aa, Glycine max
  Coding DNA Sequence Number=SeqID_61536
MELMELKQKGELECTHRLERDF

SEQ ID NO: 153222 - protein, 44 aa, Glycine max
  Coding DNA Sequence Number=SeqID_61537
MDHWKAAKRVMRYLKRTKYYMLTYKSAKQTYYFIHYDDIICGML

SEQ ID NO: 153223 - protein, 90 aa, Glycine max
  Coding DNA Sequence Number=SeqID_61538
MSVLELYIEKDVAGGSMFHSANYVTSCGHNVSHHESELPRNISNLHDDEDDDDDYLASNSYVEESLDEDDSVPGIQNPFWNDALHYNNIN

SEQ ID NO: 153224 - protein, 96 aa, Glycine max
  Coding DNA Sequence Number=SeqID_61539
DCHHKNGGDCGSNIFQGYFDDAKESRVKQNPKIQESSFKNQDSRFKNQDSRLKIQESREDSIKISIKKFFKTLSSTRNFHKIITEEFYSLVIDYQK

SEQ ID NO: 153225 - protein, 136 aa, Glycine max
  Coding DNA Sequence Number=SeqID_61540
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPAPSLSPTIADGTDHHD

SEQ ID NO: 153226 - protein, 125 aa, Glycine max
  Coding DNA Sequence Number=SeqID_61541
MSEVEEAQEQMKADMEAMKEKMATMMEAMMSMKKIMEANTVAVAATSVVAKMNPMPPSGLNQMNHPTSARVGKDLGSTGGPHYAQIQNKHAVTPYGLPSNYTPPNVVYTPNENVNNSTPILIESQ

SEQ ID NO: 153227 - protein, 62 aa, Glycine max
  Coding DNA Sequence Number=SeqID_61542
  Homolog annotation: Hit_ID=A6FJQ2; Match level="QueryCoverage=61%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGDPAQPAIMQQG

SEQ ID NO: 153228 - protein, 80 aa, Glycine max
  Coding DNA Sequence Number=SeqID_61543
  Subcellular localization annotation: CTP_CleavageSite=66; ConfidenceScore=5.42e-01
MRKHMNHSMRIAKRSSGAKWTLWAQCTSTTKHNFSALSVTRESGRAQGSRPCAKCEISSLSETFVSCQAKRTNGDNPKST

SEQ ID NO: 153229 - protein, 94 aa, Glycine max
  Coding DNA Sequence Number=SeqID_61544
MSTRKYESGYSKIQKKRRVKALIASQKGAMDKFIKMDEKNELENIGGYSLNEQDNNLDMGGSKNREAVSDEENYNSDSQTHDNEEEIGRLDEYI

SEQ ID NO: 153230 - protein, 127 aa, Glycine max
  Coding DNA Sequence Number=SeqID_61545
  Gene Ontology: Mol. function=chlorophyll binding; Cellular component =integral to membrane; Biological process=photosynthetic electron transport
  Homolog annotation: Hit_ID=Q2MI75; Match level="QueryCoverage=96%, HitCoverage=27%, E-value=1e-62, Identity=86%"; Hit description =Photosystem II P680 chlorophyll A apoprotein
MDNGDGIAVGWLGHPVFRDKEGHELFVDGDGIVRADVPFRRAESKYSVEQVGVTVEFYGGELNGVSYSDPATVKKYARRAQLGEIFELDRATSKSDGVFRSSPRGWFTFGHASFALLFFFGHILARC

SEQ ID NO: 153231 - protein, 200 aa, Glycine max
  Coding DNA Sequence Number=SeqID_61546
  Homolog annotation: Hit_ID=UPI0000ECBAF8; Match level="QueryCoverage =18%, HitCoverage=42%, E-value=3e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTRISASLVLVLFAVFACREESTCRHASLALAVVYNVVTGKTLALPNLIALQHIPLSPAGVIAKRPAPIALPNSCAA

SEQ ID NO: 153232 - protein, 110 aa, Glycine max
  Coding DNA Sequence Number=SeqID_61547
  Homolog annotation: Hit_ID=A2Q141; Match level="QueryCoverage=53%, HitCoverage=16%, E-value=6e-08, Identity=45%"; Hit description =Transposase, putative
MQHLMKLLERDQYIHWHRLKDEVVVRDLFWCHPDAVKLCNACHLVFVIDSTYKTNRFHIDKNVKAKCKSLIGEKNAWDYVMDNWGLNQLIGLSKEYYKIALETYVVFGMP

SEQ ID NO: 153233 - protein, 58 aa, Glycine max
  Coding DNA Sequence Number=SeqID_61548
  Gene Ontology: Mol. function=oxidoreductase activity; Biological process=negative regulation of transcription
  Homolog annotation: Hit_ID=A7PUZ6; Match level="QueryCoverage=67%, HitCoverage=16%, E-value=6e-10, Identity=79%"; Hit description =Chromosome chr4 scaffold_32, whole genome shotgun sequence
MLMLTSLLLLVHRMREKKYFGARMFNLESTRGGSPYGAGVFAGDGTRQASEMELELAE

SEQ ID NO: 153234 - protein, 114 aa, Glycine max
  Coding DNA Sequence Number=SeqID_61549
  Subcellular localization annotation: CTP_CleavageSite=52; ConfidenceScore=5.89e-01
MRRNSPASSSDTSFLPQPSFFSKKPFTGIFSFGVGIVLSFCSFSIFAFPLTYAGCVGSPVILVTLADNELMSVASSFLSLGGAYLHGTAWLIRYGNEIGLTTEGYQGVWGAASL

SEQ ID NO: 153235 - protein, 294 aa, Glycine max
  Coding DNA Sequence Number=SeqID_61550
  Homolog annotation: Hit_ID=Q6WAY6; Match level="QueryCoverage=24%, HitCoverage=12%, E-value=3e-10, Identity=43%"; Hit description =Putative uncharacterized protein
EATQSIGFLVGRKARKEFPFSCGDYPNVPLIGTRGCINYNPALAIRQLGYPMRGAPTEESLLPFLVRDLGAQSLKVIQRVHKAWRSPLKKDKELRCIRNGVIGGYHGWLRVHTRGLDWLSKLKVINEENFEAPEEDEEEKFKSAATYIRKECTELQKENVATARALEQETKRARKEEYGREKFRGALWGSNNELKLRREERDRSRRSLAQHLEATEQSMLAIIGQYKEELNQSVAHEQKLVEDFAQVYAEKEARGRVIDALHQEATMWMDRFALTLNGSQDLPRLLAKAKAMAE

SEQ ID NO: 153236 - protein, 69 aa, Glycine max
  Coding DNA Sequence Number=SeqID_61551
MEDLITKRNSLSQNNANVITLAQQLLTIILLLAPCCSHSASTNKVRNHHRCNVVRTINRYQGNSLSVST

SEQ ID NO: 153237 - protein, 61 aa, Glycine max
  Coding DNA Sequence Number=SeqID_61552
MVVGGCGSSVWFDGGLQWRLDLLGRGREKGEKERQEGREKKEQRKIEKREKEIKTCLVTKI

SEQ ID NO: 153238 - protein, 52 aa, Glycine max
  Coding DNA Sequence Number=SeqID_61553
  Subcellular localization annotation: CTP_CleavageSite=18; ConfidenceScore=5.04e-01
MDMNIGVNFPKARKTKLRVADVPSSFAPITGIPSSSTSAPLPALTDLSAQSS

SEQ ID NO: 153239 - protein, 94 aa, Glycine max
  Coding DNA Sequence Number=SeqID_61554
  Subcellular localization annotation: CTP_CleavageSite=38; ConfidenceScore=5.36e-01
MAPRKLSIKRSRKDARPKGLVPLPSSIAIVSGALSTCSVSKPSRDGPSTERDASSSGTMSTQWIPFAKFDPDIVLEFYANAWPTEEGVRDMRSW

SEQ ID NO: 153240 - protein, 146 aa, Glycine max
  Coding DNA Sequence Number=SeqID_61555
MSLSYCHKHQPMKHCAIASDFRQMVARINIEIILMDEKANKIFAPIKNVDPGKWNDVVKVVEKNLDSPTKHTFKLNFVNFTKVKKQDFPMIPEMVYDFILLDDVLTGNVNPDYLMEAYAVSIQNSMYGSKLFINEDLKDIEDYKNG

SEQ ID NO: 153241 - protein, 233 aa, Glycine max
  Coding DNA Sequence Number=SeqID_61556
MVRARRLCSDLGKVIGRALGTQVSGDADEAPQRRRPTTFAHRQQAVAPIAEDVEHMDHVADEVINIFFQEHPELKLSSHRRKVQKFGRSAPEIEGIVVTTGLSPLIECSLDTGEVTITLDDVASLLHLPITSAFHTFDALHVDKVVDLLVELLEPGDPLRHLPMVHDDTFIEPDPPQQSVVAAAMQKPHVPALVDVDMPQHVVKACQRIAKRLERLINMRIVTAGIEAYIVTE

SEQ ID NO: 153242 - protein, 235 aa, Glycine max
  Coding DNA Sequence Number=SeqID_61557
  Pfam annotation: Domain name=GRP; Domain location=134-214; Score= -21.2; E_value=0.011; Accession=PF07172.2; Description=Glycine rich protein family
MSSSPLWSTLYIISNVGIVLFLMEILEGDDVVEAVKVDSVADTDDEGDGVGDIGVIDDDGGVCESRKQNWRELICKWSEEKVRVHGIKGVQRGSQFEGKIYQGSNAKASGGGDANSGGSDDLMVIVVMMVVVVAAMLVAMTMTEVLVVATVVAMMLVVVMVAVTIDEGGIVASGGGGDNDGGIDGGGGGGGATNYGGNKDGGDGVGDDGGDNGSDSDIDSDDDAGSDDVNKKYHC

SEQ ID NO: 153243 - protein, 79 aa, Glycine max
  Coding DNA Sequence Number=SeqID_61558
  Subcellular localization annotation: CTP_CleavageSite=52; ConfidenceScore=5.22e-01
MCQLCTGGLVGACTLSATLSRLVHISEFRLSARLFAQRMDSSSVLSGISPCSANMHSSSFFQILPHAQPKECCTQQMAR

SEQ ID NO: 153244 - protein, 230 aa, Glycine max
  Coding DNA Sequence Number=SeqID_61559
  Subcellular localization annotation: CTP_CleavageSite=26; ConfidenceScore=5.03e-01
MNSILVSPKLGLGLVLTLQDYISPTQAASVGPTTTRFQQPANIPNVVFSITWWEHNNMLHVDCFYNFFRYRSALVDAPDYRPRIVDFYIWWTQPMPSYYHFAVPMLEVIIPSKSYSPPVDDTMSSTKSDSSSKDTDATSSALMSPQSVLLETWVPPEVNLMDLVSKDEGKVAEEDTSRPMSTRSVLPKSWVPPWVDLIDLVFEDEGEDVEKDTSIKEDTLMDEEKPIMEL

SEQ ID NO: 153245 - protein, 63 aa, Glycine max
  Coding DNA Sequence Number=SeqID_61560
MAEGHRVWMMRLPEREDKSGIVCSLIIAGTGDGGGEYHQLDVVMTTEMQHLLNRNNEELYRRI

SEQ ID NO: 153246 - protein, 203 aa, Glycine max
  Coding DNA Sequence Number=SeqID_61561
MKKIIGLQAPMELTSGTSYESMTRKKPKAYYKGVEKYFKCGSHLKWPEGVVSRESISAVKKLGHLKDIVSRNVDSSRRSDEVHNATKFDLPNKDRKDSQGICFLGKVYGVSSSFTSYLFHGAGFGSKKKYMFRKVTIQLKLVEGDSVGTGPFLSQCIELFSSADNQICINELNITSLGIIDIPICLGGSISSTGSTLYVLMFS

SEQ ID NO: 153247 - protein, 37 aa, Glycine max
  Coding DNA Sequence Number=SeqID_61562
MKMLSIPHDMNGSGMEKKEREETPLQGEEESRRSSPP

SEQ ID NO: 153248 - protein, 223 aa, Glycine max
  Coding DNA Sequence Number=SeqID_61563
GGGPDDMQEPFGPTLFHLLSSRGGRPDDMREPFGPTLFHLLPSRGGGPDDMREPFGPTLFHLLSSRGGGPDDMREPFGPALFHLLSSKGGGPDDMREPFEAADPMTCENHLVSGGEPDDMPEPFGPALLPFVILARDSESRGGRRQIMVIPDTFSPSRGDRVRWHTETNYGHFAPCHPGSIVFEDTQRQIVVILRLVSSKRNELDNIRIMEIDRPTGVSLERN

SEQ ID NO: 153249 - protein, 87 aa, Glycine max
  Coding DNA Sequence Number=SeqID_61564
MKTITSTFEGMSDQAAAWKIEPKSHVQIRGYECGYYVMHWMWCVVAGGLKDDWNKWFSHGSALDVEAITILRKKWATYFLAIRKRGC

SEQ ID NO: 153250 - protein, 137 aa, Glycine max
  Coding DNA Sequence Number=SeqID_61565
MSEIEEVQEQMITMMKAMMSMRRMMEVNTTTVVATSTAIEVDPTQPPGFNQVNCPSSNMVGQGGKALGNAGSPHFVQIQNKHFFPPYGLPPNCTPPSVAHAPDENVDNFAPIPIKSQQPQSNHAHVSLPMGETHEVP

SEQ ID NO: 153251 - protein, 206 aa, Glycine max
  Coding DNA Sequence Number=SeqID_61566
MLMFNEQYSCVGPIELLRTINRTPDGILNLLQSTITPTQDAILYHNGKSNIPHQEKKSTINNIQILAKIKNKNQNSVKIKNENKNQHLAKIENKNKNKKSTLSQKQKPDRKSTAVLKVLAKKLAQSHGGVKLDLELDESHGSINQPDLEPDLELVEVRNQLNEGKKVDETRKEVIQVKEQRKEEDQRCRKLEKSEERENEACISYF

SEQ ID NO: 153252 - protein, 299 aa, Glycine max
  Coding DNA Sequence Number=SeqID_61567
MVVPKSENDARISLNYQGTSLESRLPRRKLRRSDWASFSTETGSSRCEVSTENYDGSWWLLVVVVMEKKLGTLEMVLEEGRRKKWRFSKATRITKAETLKCFCSRKRNVSHTLDVVSPIATGVTVQVSSATRIAPMRNVLNTIVLMSTLFSVQYKIRTNSSIYHHAHNWVGSSYQGGHAFNNNNNGTLFNLRYLWGMPKLRPQRLGLDSSQPFNGTSRQNSITSQNRNQSQNDQGNAYHNGSEQLQGSGRNRKNEPLFARISNNTLIALRQQVDYSNHDTMNMLSQQITTVLNPLVQTS

SEQ ID NO: 153253 - protein, 76 aa, Glycine max
  Coding DNA Sequence Number=SeqID_61568
MKGRRHKYGFNNNKREKAEKKRVVDDETGDKHQLDEVLRRSSSISKRGTSSNLKHQERLRKKLALEEGRIFVANEQ

SEQ ID NO: 153254 - protein, 280 aa, Glycine max
  Coding DNA Sequence Number=SeqID_61569
MALKKLSMKRSRRDATGEESSADPEFDSHRFRSAEHQQRFEAIRGWSFHRERRVQLREDEYTDFQEEIARKRWTPLVTPMAKFDPEIVLEFYASAWPTEEGVRDMRSWVRGQWIPFDVDSLSQFQGDPLVLEEGHKCEFSQKRNRANDFDKEAIAQLEAGADHAHQHDHLDPDMDDSAAQQCMAPTRHPLDPDKSNRALGFPALITSLCQSYGVPITPSKVIRPPITRAFIEKYCTPRQAQGDAHQAADASPPPRQADPAGSLGVERYLQHWVRQQAANH

SEQ ID NO: 153255 - protein, 67 aa, Glycine max
  Coding DNA Sequence Number=SeqID_61570
MGDQEEVEEQMKADMSTLKEQMTSMMDAMLGMRQLMENNAAIAAAVSSAAEADPTHPATAHHPIPNV

SEQ ID NO: 153256 - protein, 216 aa, Glycine max
  Coding DNA Sequence Number=SeqID_61571
  Homolog annotation: Hit_ID=Q84VI1; Match level="QueryCoverage=96%, HitCoverage=30%, E-value=9e-71, Identity=71%"; Hit description =Envelope-like protein
MASSPKETSASGSPAVPSSPHQEQSEFNIQPIQIIPGQASVPEKLVPRRQQGVKIAENPSLATSPREVDTEMDKKIRSIVSSILKDASVPEADEDVPTSSTPNVSVPDVNKDVPTSSAPNAEALPSPSEEESTEEEDQASEETPAPRAPEPAPGDLIDLEEVESDEEPIANRLAPGIAERLQNRKGKTPLKRSGRIKTMAQKKSTPITSCHIQKEQ

SEQ ID NO: 153257 - protein, 54 aa, Glycine max
  Coding DNA Sequence Number=SeqID_61572
MDKSLKVGEYEWRERERRNTKFCASNELWFSPLIQDQVQDAPLSVLKSHEACKA

SEQ ID NO: 153258 - protein, 138 aa, Glycine max
  Coding DNA Sequence Number=SeqID_61573
MTFLGETSSQTIMNSTLCFIFPNGFIVHNDSGVYFQTSNPVPIRVLNACDFQTLKTRIHNTLQLTDKQYLDEIYYRQPFADPGKNPKKFDIPSGCSMDELKDLIKQVALQGIPLYEASFMMMNQVDSSSFDDDKKPKE

SEQ ID NO: 153259 - protein, 81 aa, Glycine max
  Coding DNA Sequence Number=SeqID_61574
  Subcellular localization annotation: CTP_CleavageSite=34; ConfidenceScore=5.28e-01
MSQRALLRASEARLTSALSKGGKMRGKMSPTFICGKRRENRRKPVKMKILSSGVVFTFEEGRQKRGFCSYVPSFGEEIRPT

SEQ ID NO: 153260 - protein, 246 aa, Glycine max
  Coding DNA Sequence Number=SeqID_61575
MHDMQIMVRTRGLGRALGRGIGKGRGGQDEHHADDVPRRRRSTVSVRRQRVHVSVAEDVADMTEDVPQMTEDVPPMTTDVPAAGVEGLANDVATGSVANHAKGFLGGPRDPSVLTSFAEHVANNIWTGESPTIREFYPLSWRGGIGRLAPSCGSNAFKGYFDDAKEFKNQEKDSREFSSFKFSRIKNNQEQDSRLKIQESREDLIKISMKRFFQKLSSTWIFLKTCLPKSFYSLVIDYQIVVIDYQ

SEQ ID NO: 153261 - protein, 106 aa, Glycine max
  Coding DNA Sequence Number=SeqID_61576
MVTSKKTVKVRLGFVLNRNREASLEDSAPIEGFLSVWGFNREIRRFVVATSGCGDKEGERNGVFPRLHESQRLTHSSSSALGKGSVSHTPDVVSPIATVRSSKNVL

SEQ ID NO: 153262 - protein, 64 aa, Glycine max
  Coding DNA Sequence Number=SeqID_61577
MVVGSDAKALGHYVLAMALFADQCPYELAMAVKEVLSRKDKFEFKRNNHSSFFAKEPDVASNVV

SEQ ID NO: 153263 - protein, 64 aa, Glycine max
  Coding DNA Sequence Number=SeqID_61578
MEKCKEASTPMTISTYLDLDEKVSKLVEKIGRVSLELNVRKVVLQVEKCEILRFRRSNLVLVEI

SEQ ID NO: 153264 - protein, 42 aa, Glycine max
  Coding DNA Sequence Number=SeqID_61579
MDKSLKVGEDEWREKERRSTKFYASNEPINPRSSSRFSTKCA

SEQ ID NO: 153265 - protein, 58 aa, Glycine max
  Coding DNA Sequence Number=SeqID_61580
PAGTNQVLHRILEWDAGVNVVSGSSTMLAPRAVLLTGWGAAGAVRWADALSAAGGPFT

SEQ ID NO: 153266 - protein, 77 aa, Glycine max
  Coding DNA Sequence Number=SeqID_61581
ADLEGLYHFSRSQQGFCCTPFVCPTLDQFAAEVAWPGDWPDAQAGEEPTGSPGRMDEPRMDEDMTDLFNFLGGSGAT

SEQ ID NO: 153267 - protein, 97 aa, Glycine max
  Coding DNA Sequence Number=SeqID_61582
MTKARQKGVRKENGGDACYPARPSEQGDFLQKQPLSGGIFWRAQVGLNLADYIIIPFLTYGMLRNLTNCATMLPFEFRHVTELRKLPDDGCQVPPNG

SEQ ID NO: 153268 - protein, 97 aa, Glycine max
  Coding DNA Sequence Number=SeqID_61583
MDPEKSNRVLGFPALITSLCQFYGVPVTPNKAGIGRDTTAAWGWPAVGNKCTTATSRAPQLIHKKVRDRQVIMRPAQDVKEALLGGNLVPFESMLVI

SEQ ID NO: 153269 - protein, 186 aa, Glycine max
  Coding DNA Sequence Number=SeqID_61584
  Subcellular localization annotation: CTP_CleavageSite=40; ConfidenceScore=5.18e-01
MGIPNCGFQGYNQGNSSGFHQGGAGFNHGPPGFNQGRNFTQGSGWRNQGNQYKEKRNQQPYQPPCQHPSQGPTQQEKPTNIEELLLQFSQETQSHQKSTDAAIWNLEVQMGQLAHDKAERPTRTFGANTEKNPKEECKAVLTRGQKKEQEEGKVEEEDRLEEDRTETPEERTEEEEKVASPPKTKS

SEQ ID NO: 153270 - protein, 93 aa, Glycine max
  Coding DNA Sequence Number=SeqID_61585
  Subcellular localization annotation: CTP_CleavageSite=27; ConfidenceScore=5.04e-01
MASERGDKKFLNAKTSPLSSLLYLGARVARPGELTCMSWRKGTLTMSPPSLWQKKTANTKDTGLPCSDVLCLFSAEKGRRSVGRDPIPNCIRS

SEQ ID NO: 153271 - protein, 59 aa, Glycine max
  Coding DNA Sequence Number=SeqID_61586
MRKDLQKDVIFLDIWRFHGGVDNMEFFHILMRVFTCKTMKLGQQVDQSSFKNIWDILIR

SEQ ID NO: 153272 - protein, 258 aa, Glycine max
  Coding DNA Sequence Number=SeqID_61587
  Homolog annotation: Hit_ID=Q6WAY6; Match level="QueryCoverage=67%, HitCoverage=29%, E-value=6e-15, Identity=35%"; Hit description =Putative uncharacterized protein
MLADLYDTFDRRCEKSSTRIVCCTPTLYVWLVSHLFRQELRHACPLESYRSCTEKGGANWDQLLANKEGASINWFPQWKEGRIGVLISCGGFPNVPLMGTRGCISYNLVLAIRQLGYPMRGAPLEEEIAPVISRGFNKTNVETLQKDNELRGSNNGPIGGYRKWLRAHVQGLDWLPSLRTAKREEVEAPEEDEEVQALRTEIEQAQTVKERFKSAALKIRKENAELRDINTATTKALEQETKRARREEHGRNKFRGAL

SEQ ID NO: 153273 - protein, 137 aa, Glycine max
  Coding DNA Sequence Number=SeqID_61588
  Homolog annotation: Hit_ID=A5C070; Match level="QueryCoverage=57%, HitCoverage=8%, E-value=1e-07, Identity=38%"; Hit description =Putative uncharacterized protein
MEVRDKVELLPYRDLDELVQLCIRVEQQLKRKSSSKSYGFHSYPRKDQAQGILGTAPSKPKEDKGHIASQCPTKKTMIMRGQDIYSIQEETTSSPSSSGSGDKVRGEESSEEVYPHEEVVIYLNPKEITSFIHDAKF

SEQ ID NO: 153274 - protein, 395 aa, Glycine max
  Coding DNA Sequence Number=SeqID_61589
  Homolog annotation: Hit_ID=Q2HW90; Match level="QueryCoverage=81%, HitCoverage=70%, E-value=6e-32, Identity=31%"; Hit description =Putative uncharacterized protein
MGTNQNSKRFYQVKLKSLDVTSLKELGRLMGPLQRQAFRKVYGRILDLTAAEVFTEAVISLAQYYDQPLRCFTFGDFQMVPTIEEFEEILGCPLGGRKPYLFSGFLPSLSKITAVVGDSAKELDRTKQTRNDVVGLPRKYLEDLAAIDAFLAYHHSKESPVVAILADLFDTFDRRCEKNSVRIVCCLPALCVWLISHLFRQDTRHPCPLQSYRSCAEKGRVDWDQHLAGIGGSAINWFPRWKEGKEGVLFSCGDYPNVPLIGTRGCINYNPTLAIRQLGYPMRGAPTEESLSPCLVRDLGAQGLKVIQRIHKAWRNPLKKDKELRGIRNGVIGGYHGWLRIHARGLDWLSKLKVINEENFEAPEEDEEVRALKLELGKARLAKEKFKSAATHIRK

SEQ ID NO: 153275 - protein, 67 aa, Glycine max
  Coding DNA Sequence Number=SeqID_61590
MEVEEPWRGLWLPLHYQVVFGHWECGKQACLVAYLGMAFVDDWVMGNEKGRYWLSDDIVGLVGSLAM

SEQ ID NO: 153276 - protein, 138 aa, Glycine max
  Coding DNA Sequence Number=SeqID_61591
MTLLLSNILPSDHNTDLPLRKDRTHKTPRGPGEVQQGPGVSSSDYGPLSVLWSVCHPQTRSSGPILIGLSSRSIAPPEQAQGETPQHPGDGCQRAIDAPPPPPESLSSSTKAGAWPTTRGRPEGDQVQSQRQAIVLGL

SEQ ID NO: 153277 - protein, 152 aa, Glycine max
  Coding DNA Sequence Number=SeqID_61592
MKDKRDEEEKLEKQKKKKDSKALSSKAKGKEKEEKDSSKKIVKKENHFATKGIIRHQIPMIGGMMNLLSGATLFCKITHAPNIFMICVHRDSLGRNNQHENKEKGLPMDPKRIKVILEWPTPPSIKGNLGLQYLNKLLQKVLRKESMSFKNL

SEQ ID NO: 153278 - protein, 107 aa, Glycine max
  Coding DNA Sequence Number=SeqID_61593
  Subcellular localization annotation: CTP_CleavageSite=93; ConfidenceScore=5.62e-01
MHTQSFTIPQFPKIGLTHKNSPQWSRQLSQPTLLRASEARLTGAFSKGGKCAKSPPTFICGKRQKNRRKPVVKNIPDSRVVFTFEEGRQKWGSCSYVPSIEEEIKPT

SEQ ID NO: 153279 - protein, 164 aa, Glycine max
  Coding DNA Sequence Number=SeqID_61594
SEQESARGSFQGETPGIFIVLSGFATSDLSVDFCDARQGGGAYGKTPATRPFYADTARRSRTTERSESVSEEAEERPIRKPPLPAHELVTAVADPSLQHLILVYPYHVSWGCTLQCVGTKNSHEGKGRIKRILRWLGILKSRPAGMQAWHWPSFYNVVTEKTLA

SEQ ID NO: 153280 - protein, 83 aa, Glycine max
  Coding DNA Sequence Number=SeqID_61595
  Homolog annotation: Hit_ID=Q84VH5; Match level="QueryCoverage=45%, HitCoverage=5%, E-value=3e-13, Identity=94%"; Hit description =Envelope-like protein
MLSQHPNILNYTDSVKKRESALSLHYKLFEGTHVPDIVSTSGKAAASAEEKEGAAEEEEEAPEKEEDAAEDTESDDDDSEATP

SEQ ID NO: 153281 - protein, 137 aa, Glycine max
  Coding DNA Sequence Number=SeqID_61596
GSGPQDIQWTRRSPTGPWGFQLWLRASISPTGCPYPPARSCHRDIGIAPAGHPVDSKKSNRVLGFPALITGLCQFYGVPVTPNKVIRPPINRAFLKRYCAPRQAQGETPQQPGDGWQRATNAPPPPLEFISAHSQKG

SEQ ID NO: 153282 - protein, 256 aa, Glycine max
  Coding DNA Sequence Number=SeqID_61597
  Homolog annotation: Hit_ID=Q2HW90; Match level="QueryCoverage=84%, HitCoverage=41%, E-value=1e-24, Identity=34%"; Hit description =Putative uncharacterized protein
MANQEEWVLFADILALLIFGVVLFPNVDGLVDLAAIDAFLAYHHSEESPVVAILADLFDTFDQRCEKNSARIVCCLPALCVWLVSHLFQQDIRHPCPLQSYRSCVEKRGVDWDHYLAGIGGSTINWFPRWKEGNEGVLFSCGDYPNVPLIGTRGCINYNPALAIRQFGYPMRGAPTEESLSPFLMGDFGSQSFKIVQRVHKAWESMLRKDKDLRGIRNGIIGGYHEWLRVHTRGLDWLSKLKIINEENFEAPKEDE

SEQ ID NO: 153283 - protein, 143 aa, Glycine max
  Coding DNA Sequence Number=SeqID_61598
MIMKGQDIYSTQEETTSCPSSSGSEDDIRGEESSEEVYLHEEGDLLMITLTHLEHKFVLHPQTPSQVAKDQLTMKDKRDEKEKQKKKKDSKALSSKAKGKEKEEKDSSKKIVKKESHFATKGIMRHQITMIGGMIQHLHDSHT

SEQ ID NO: 153284 - protein, 110 aa, Glycine max
  Coding DNA Sequence Number=SeqID_61599
  Gene Ontology: Mol. function=penicillin binding; Cellular component =peptidoglycan-based cell wall; Biological process=peptidoglycan -based cell wall biogenesis
  Homolog annotation: Hit_ID=A3J3C4; Match level="QueryCoverage=82%, HitCoverage=11%, E-value=7e-20, Identity=54%"; Hit description =Bifunctional family GT51 b-glycosyltransferase/PBP transpeptidase, candidate murein ...
  Homolog annotation: Hit description=polymerase, glycosyltransferase family protein
  Pfam annotation: Domain name=Transgly; Domain location=46-110; Score=- 86.4; E_value=0.00086; Accession=PF00912.13; Description =Transglycosylase
MENGLEQVLETRRKRFSRTFFAVSQGFLGEMPDVEELENPDIYVASQIFSADGVLLGKFEKEKTQPITYKDLPPFLVYALQAKEDERFKEHSGIDLQSIARAVVYGGGRG

SEQ ID NO: 153285 - protein, 76 aa, Glycine max
  Coding DNA Sequence Number=SeqID_61600
NHSGISARQRDSSVSMTDLVSAEDDQKKVYTDNHSGIFTRQRDSSVSMTDLVRVADKSEALATTYPQMRNSDLRSS

SEQ ID NO: 153286 - protein, 167 aa, Glycine max
  Coding DNA Sequence Number=SeqID_61601
  Homolog annotation: Hit_ID=B0JCV8; Match level="QueryCoverage=86%, HitCoverage=19%, E-value=2e-09, Identity=30%"; Hit description =Misfit TNP1-like protein
QISNPTVKYGLDPETWAEFAKSRKTPNWQGIRKKAQEIQKFNDCPHVLSRGGNELLDKKLMEEKSKRGHEEHSCTESPTLNVDPPSPVARHLKWKIACTKRHGQMTPEVAQEIADKIEQATHGSFVPHGRQDILNTSLGRPEHPGRVRVARDRCHNKPILWPSLTCF

SEQ ID NO: 153287 - protein, 103 aa, Glycine max
  Coding DNA Sequence Number=SeqID_61602
WARSVAYEIGFVAVIMKSDTNTGVVSIGLGRKILLEEILAVRNVGVPSSFIGNQWLKGKVKKRLSFELQKVAVGLSAYPPLSIASARLAQRRIWQSINIKVVH

SEQ ID NO: 153288 - protein, 150 aa, Glycine max
  Coding DNA Sequence Number=SeqID_61603
YPHPQRTARPHPQRTARHPLQRTARPRLQRTALPGPHPDPGGGPTMQVQPKEEAIVQLLCIPGQDFTHATAKRRVWIMHTNMITLTQIWMTLLLSTISSSDRNTDLPLRKYQDSAHKAPSGPEGVPTGPGVFSSSYGPLSVLQGARSPDK

SEQ ID NO: 153289 - protein, 194 aa, Glycine max
  Coding DNA Sequence Number=SeqID_61604
  Homolog annotation: Hit_ID=Q2HW90; Match level="QueryCoverage=78%, HitCoverage=30%, E-value=4e-15, Identity=32%"; Hit description =Putative uncharacterized protein
MVEELEEILGCPLGGRRPYLFSGFHPSLARISKIVQISAQELDHRKQVENGVVGIPRKYLEAKARIFTGKGEWAPFIDILALLIFGGVLFPNVDGLVDLAAIDAFLAYHDHKESPVVAMLADLYDTFDRRCEKSSTRIVCCTPALYVWLVSHLFRQEVRHACPLESHRSCMEKGGANWDQLLANKEGASVNWFP

SEQ ID NO: 153290 - protein, 216 aa, Glycine max
  Coding DNA Sequence Number=SeqID_61605
  Homolog annotation: Hit_ID=A8GBP8; Match level="QueryCoverage=67%, HitCoverage=14%, E-value=2e-40, Identity=64%"; Hit description =Virulence protein SrfB
RCCATCSRCPPAASCGDSRGLPTTSPAALTPFSPPWPGSDRPLAPDEQAGKTLRIASIDIGGGTTDLAITHYSLDDGVGNNIKINPRLLFREGFKVAGDDILLDAIQQFILPAVQQAFEAAGVSAAPALMDRLFGNEASRMDGLRPCAAGRAANARRATRCSTGHEEYTRADSRAESVRIASLGDCCRSPVPAHQCWRLTQRRGGATHYWIDSGSI

SEQ ID NO: 153291 - protein, 312 aa, Glycine max
  Coding DNA Sequence Number=SeqID_61606
  Homolog annotation: Hit_ID=Q6WAY6; Match level="QueryCoverage=89%, HitCoverage=51%, E-value=2e-22, Identity=28%"; Hit description =Putative uncharacterized protein
MGRSGKGASCLGDFQLVLTVEEFEEILGCPLGGRKPYLFSGVYPSMERIAKVVKISAQELDRVKQNRNGVVGIPRKHLEEKAKALVDQDEWALFIDVLALLVFRVVLFPNMDGLVYLAAINAFLAYHHSKESLVVAVLVDAYNTFDRRCEKSGARIVYYTPALYVWLVSHLFRHEGASVNWFPRWKEGRVGVLSSCEGFSNFPLMGMRGCINYNLVLAIRQLGYPMRGAPLEESITPFIARGFSDPNAWMFQIVRKAWSAVQRKDKELRGSSNGIISSYHKWLKTRIQEITWLPKLKISSEEEAKTPEESEK

SEQ ID NO: 153292 - protein, 30 aa, Glycine max
  Coding DNA Sequence Number=SeqID_61607
MDEGVEVPYPVETGNNHALRRSFAANATLL

SEQ ID NO: 153293 - protein, 48 aa, Glycine max
  Coding DNA Sequence Number=SeqID_61608
MTGDASKFTHISPKKSGHVTYGDNNKGRILGVGKIACLVLVNYVTKAI

SEQ ID NO: 153294 - protein, 214 aa, Glycine max
  Coding DNA Sequence Number=SeqID_61609
  Homolog annotation: Hit_ID=Q84VH5; Match level="QueryCoverage=88%, HitCoverage=38%, E-value=1e-52, Identity=85%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGRLSVNQHPNILNNIDSVKKRESPLSLHYKLFEGTHVPDIVSTSGKAAASGAVSKDDLIAELKDTCKVLEATIKANTEKKMELERLIKDSQTMALMMEKQLRKKKMPQRIQIR

SEQ ID NO: 153295 - protein, 181 aa, Glycine max
  Coding DNA Sequence Number=SeqID_61610
LHALTLGTIYPHHLEDLHVLALRGLHVLALRGLHVLAIRGLHALTFRGLHVLALRGLHALTLGLHVLALRGLHVLTIRGLHALTSRGLHVLALRGLHALTLGTSYPQRQRTTRPRLERTTRPHHQRAARPHLQRTTCPHLGTTRPRLERTTRPHHQRAARPHLQRTTCPRLERAARPHLGY

SEQ ID NO: 153296 - protein, 171 aa, Glycine max
  Coding DNA Sequence Number=SeqID_61611
MDLIENMAASDIAILRDRAHIPTKKSLLELTSQDALLAQNKLLSKQLEAFTETLRCTICGGSHESGCCIPNEEQVTHEVNYMGNQPRNNFNAGGFSGFQHGQQCNQQHGQWRNHPGNQFNRDHGGSSIRSQQQGPSLYDHTTKLEETLAQFMQVSMSNQKSTESTIKNLEV

SEQ ID NO: 153297 - protein, 53 aa, Glycine max
  Coding DNA Sequence Number=SeqID_61612
MVDTPRLETITKEKNGCLISEAISGKVVHIGKRISNIYMLSVEHASFHELSFL

SEQ ID NO: 153298 - protein, 82 aa, Glycine max
  Coding DNA Sequence Number=SeqID_61613
  Homolog annotation: Hit_ID=A5BI38; Match level="QueryCoverage=98%, HitCoverage=10%, E-value=2e-18, Identity=50%"; Hit description =Putative uncharacterized protein
MTSIPQPVADNPVDQVDNETPENDEQPPEQHDPQENVDAAFESNYNIGAENNPKMFDQVMSCKESNLRYDAMKGEMNSMQSN

SEQ ID NO: 153299 - protein, 121 aa, Glycine max
  Coding DNA Sequence Number=SeqID_61614
GESGGAVASSDDASEMTIRGGDGGLLHTQEKMVDSPLEIVGQLALDQPAQVWPQVEQPHWVSHQWKLSFRPGYLLKKMLHRLCMIINSPRNKLCNIGTKVCELWTSCPTVTDGGAGVDDEG

SEQ ID NO: 153300 - protein, 90 aa, Glycine max
  Coding DNA Sequence Number=SeqID_61615
MLAIVNKYQEELNLATAHEHKVADEYARVYVEKEARGRVIDSLHQEATIWMDRFALTLNGSQELPWLLAKAKAMADTYSAPEEIHELLSY

SEQ ID NO: 153301 - protein, 100 aa, Glycine max
  Coding DNA Sequence Number=SeqID_61616
  Subcellular localization annotation: CTP_CleavageSite=37; ConfidenceScore=5.59e-01
MRVHCNQASRKPSMTTDSPPLLMFPQTRSPTVATYPSAGGRRETHGCVFQERKMRGVVTNVYSRKTSEKSERRGLRTLSMKGSGKIYFDFNERSFKALDH

SEQ ID NO: 153302 - protein, 85 aa, Glycine max
  Coding DNA Sequence Number=SeqID_61617
MTFLQSLPEDADIYGEGVDDDVCHCMLLGFESYRIANETSSLSRSEDANILGKRCKSLPEDADIYGEGVDDDVCGCLLLGFESYG

SEQ ID NO: 153303 - protein, 122 aa, Glycine max
  Coding DNA Sequence Number=SeqID_61618
  Subcellular localization annotation: CTP_CleavageSite=68; ConfidenceScore=5.89e-01
MGSPPASTPSPPPPPPSPPSPPPPPLPPPPTSDASASPSAVKRTRKASCLRSLSTRPPGAERPVVHVDPATGKADGPHMKKLRTYLGIVARDKVDITYENWKEVPTAQKDLIWEDIHVFLFS

SEQ ID NO: 153304 - protein, 128 aa, Glycine max
  Coding DNA Sequence Number=SeqID_61619
  Subcellular localization annotation: CTP_CleavageSite=84; ConfidenceScore=5.65e-01
MPISPGKSISWFVSSRHGDRTHKTPSGPGKVQQGPGVSSSGYGPLSVLQGARTPPSKVMPSRHRDRAHKTSSGPEEVQQGPRVSSSNYGPLSFLWSARRPQQVHQAPINWAFIKKYCAPRQTQGETPQ

SEQ ID NO: 153305 - protein, 36 aa, Glycine max
  Coding DNA Sequence Number=SeqID_61620
MMDTLEPYTGAMKGTMREPPANLGVGGVTNPGISVD

SEQ ID NO: 153306 - protein, 341 aa, Glycine max
  Coding DNA Sequence Number=SeqID_61621
  Gene Ontology: Mol. function=transferase activity; Cellular component= membrane; Biological process=teichoic acid biosynthetic process
  Homolog annotation: Hit_ID=A8GFL8; Match level="QueryCoverage=53%, HitCoverage=54%, E-value=3e-39, Identity=48%"; Hit description =Glycosyl transferase family 2
  Pfam annotation: Domain name=Glycos_transf_2; Domain location=13-186; Score=134.4; E_value=3.1e-37; Accession=PF00535.17; Description =Glycosyl transferase
MTAQPDSSSPLLSLIIPMFNAGADFTGCINALLAQTLTSLEIIIVDDGSTDGSGERADALAQQYPHIQVVHQPNGGVSRARNAGLAVARGKYVSFPDADDTMDPAMYQTLVDMAERDRLDAAQCNAGKSGFSRPARQLSSDDSAGSPHQHWRIKRAGVAQQGAENPALLHVVWLGIYRRELIEQLNLQFEPGLHHQDIPTASAPASTMSLSASLPDRPFVRMLEDQPTSRYRFSKVGRFTEKVAQLIDALAADVAVPHAERGVAGGPALAAAAGGADDAAHLSLASIPHRHTAALSRYGKPDSSPLCTGKYLAASAASSWRYAADHACHQCAAPALSAGQH

SEQ ID NO: 153307 - protein, 128 aa, Glycine max
  Coding DNA Sequence Number=SeqID_61622
KLQILTLKGLHFLAFRWLHVFAFRELHGLAFRGLHILAFRGLHVLTFGGLHALTFRGLHELAFKGLHVLAFRGLHVCAFTGLKSLGHPPDLGGGQTVRAQPDGGYHAATMHTGASFHPCRYKETSADH

SEQ ID NO: 153308 - protein, 195 aa, Glycine max
  Coding DNA Sequence Number=SeqID_61623
MARRDKLWSFCALLSSRGGGSDDMRRQIMVIPHTPFAIQTQSCPMARRDKLWSFCALLSSRGGGPDDMRRQIMVIPHTPFAIQAQSCPMARRDKLWSFCTLLSSRGGGPDDMRRQIKTQSCPMARRDKLWSFCTLLSSRGGGPDDMRRQIMVIPAHPLLPFRHSRVRWHAETNYGHSAPFCHPEAAGPMTCGDPN

SEQ ID NO: 153309 - protein, 90 aa, Glycine max
  Coding DNA Sequence Number=SeqID_61624
  Subcellular localization annotation: CTP_CleavageSite=55; ConfidenceScore=5.02e-01
MYIKYGPKYIMKHSQQNMLSNETKPPTYSQNNSKAPKFLKVKEASTRIKPRLLCKQSMGQNTPNGYDDGSNSHKGKLITFKLSFQNYHDM

SEQ ID NO: 153310 - protein, 86 aa, Glycine max
  Coding DNA Sequence Number=SeqID_61625
  Homolog annotation: Hit_ID=A5AV98; Match level="QueryCoverage=98%, HitCoverage=11%, E-value=3e-09, Identity=44%"; Hit description =Putative uncharacterized protein
MRIVETGNERFIENGEISGSTVPRDMEIKEDRVQVPLVCASSSKVIAPLVVVQNNNEEEQHNNKPMIYNEPIVEEPQEVALRRSQR

SEQ ID NO: 153311 - protein, 241 aa, Glycine max
  Coding DNA Sequence Number=SeqID_61626
  Homolog annotation: Hit_ID=UPI00016621D1; Match level="QueryCoverage =97%, HitCoverage=41%, E-value=6e-19, Identity=34%"; Hit description =UPI00016621D1 related cluster
GLHTLAIRGLHVLTFRGLHALAIRGLHVLTFRGLHALAIRELHVLTFRGSHPLAIRGPHVLTFRGLHALAIRGVHVLTFRRPHALAIREPHVLTFVGLHALTFRGPHVLTFRGLHALAFRGPHVLTFRGLHALAIRGLQVLTFRGLHALAIRGLQVLTFRGLHALAIRGLHVLTFRGPQALAIRGPHVLTFVGQHALTFRGPHVLTFRGLHALAIRGPHVLTFRGLHALAIRGLHVLTFRG

SEQ ID NO: 153312 - protein, 67 aa, Glycine max
  Coding DNA Sequence Number=SeqID_61627
MQLPNLSLKVRRPRLFWFFRRFPQINVGGDSACIPFLEDAPASHTSPSCRRVGCDSWRLRGGLFLES

SEQ ID NO: 153313 - protein, 75 aa, Glycine max
  Coding DNA Sequence Number=SeqID_61628
LGLECFVSHLDVTLTSSVGPECVELISNVQRAISGCKRWLLDLRTNTILVDFLPGLVAPRFKYNLHVLKRDVVTS

SEQ ID NO: 153314 - protein, 108 aa, Glycine max
  Coding DNA Sequence Number=SeqID_61629
MDLIENMAARCTICGGAHESRCCIPIEEQTTHEVNYMGNQPRNYFIAGGFSGFQHSQQYNQQQGQWRNHPGNQFNRDQGGPSTRPHQQGPSLYDRTTKLEETLAQFMQ

SEQ ID NO: 153315 - protein, 25 aa, Glycine max
  Coding DNA Sequence Number=SeqID_61630
DLAMGRTIGITKEQGWVILLVACGQ

SEQ ID NO: 153316 - protein, 210 aa, Glycine max
  Coding DNA Sequence Number=SeqID_61631
  Gene Ontology: Mol. function=helicase activity
  Homolog annotation: Hit_ID=Q2R1R7; Match level="QueryCoverage=93%, HitCoverage=13%, E-value=2e-35, Identity=36%"; Hit description=AT hook motif-containing protein, putative
MWNFESWISMHERKQVQTFLSRMFQPHTVLDADGYPIYRRRNNGHTIEKNGVIIDNRVTAVLIHDDNDPTHNGSTQNDEIKEYLDCRYICPYESTWRIFGFPIHGRNLAVERLHFHLPGQHSIVYEDHDDIDDVLSKPSISDSKFISWMNTNQNSVEGRNITYTEFVSKFVYSKKKRCWHLRKKGYTIGRLLWVSPITDELFYLRMRGIL

SEQ ID NO: 153317 - protein, 58 aa, Glycine max
  Coding DNA Sequence Number=SeqID_61632
MEKDVVYEFQVKGSRVVFTHGEGEKREVVATQLAQASSVASTRRHRLLLEDPGRPKWV

SEQ ID NO: 153318 - protein, 252 aa, Glycine max
  Coding DNA Sequence Number=SeqID_61633
MVARFHLPCYTIDSPACSQSSWYDFNNGNIEYGIDFEPLTLTVSRDKKVLLSQDAKSNIHYDTKNVAQADEDIAVLTVHKAIRDNKLSLLRDHCLAYDYDDVSDSKYFIVDVREDKRYAICGGDPNTSLHLFRFKVDKKNYSLLTDAGSDNGVFHPVKNRLYHPERTSVSVIKIRLVGVVAVMVFGMMSARADVVMSDYNSPEKVSSVFSNKDVLLKLKSILGPDYDTFSQNFDVYGEPHLTSAADCLWKAG

SEQ ID NO: 153319 - protein, 120 aa, Glycine max
  Coding DNA Sequence Number=SeqID_61634
MDKVDIFVPHPLTNACRLIQLSPECGCKPLVCLLKQPALLSVDFQDRSIRDYSSCTLVGVPDNPSLVFRILYNKRPRSLNPFSKIRRREEEVSLKRDRLYNEDQSKIPYRICKWLTKESF

SEQ ID NO: 153320 - protein, 135 aa, Glycine max
  Coding DNA Sequence Number=SeqID_61635
  Homolog annotation: Hit_ID=A5C7Z4; Match level="QueryCoverage=85%, HitCoverage=41%, E-value=3e-10, Identity=31%"; Hit description =Putative uncharacterized protein
MFTNILTHIRLHCNGHWQKVVILPKEHLVVWFCSLHNRPDNYLKGIINSALKGLDDASEPKSKALARWIVVKCNRQKGSTECGYYVMHWMSTIILGTFRNNWEAYFNDPRPLEPERLKALRIQWAQYYLRVRDQT

SEQ ID NO: 153321 - protein, 119 aa, Glycine max
  Coding DNA Sequence Number=SeqID_61636
MEVEEPWLALWLPLNYQVDNGASQHRTPKFGTGFMVDLGMAFVDNWVVGKEREWQSQHGFLPYSHPLYLPQFFLIRPSRMIKFASFQTRFDPFPDEDQIRKASKVPLELSDPSTFGCIL

SEQ ID NO: 153322 - protein, 53 aa, Glycine max
  Coding DNA Sequence Number=SeqID_61637
MAFFLSYTKLQTKLRDDPTVNEDWAAFLLRQLHVASSGSFIKRLPQEASSWFL

SEQ ID NO: 153323 - protein, 93 aa, Glycine max
  Coding DNA Sequence Number=SeqID_61638
MVPTGEVCVMPGQCVSDYMDWFFRISHPFITPDQASDPLPDDIPHVPEPGAPSTSARPAVEEPRHAVKFAMGLLREVGASSEPKGGHARLIDT

SEQ ID NO: 153324 - protein, 196 aa, Glycine max
  Coding DNA Sequence Number=SeqID_61639
MFQEDGPNVKTNPLASHGGPAVNAVEECGPQRSKQMKDVVTSRRFILKALREAGIIFFDGGEGDTCLIHSGVAHNVEVCPMAEDLLQGIMDQGRFEVGGASKGEQHVCMQSADKSPIKPKPLVINFTRDAATQKPRGFQPIPGKKPVPFPYKSDKAVPWKYAPQKPDGRKDESIRDDLSFAKVTNISGTSIMTRCG

SEQ ID NO: 153325 - protein, 159 aa, Glycine max
  Coding DNA Sequence Number=SeqID_61640
MALGFQLWLWASVSPTGCLFPPARSCHHDIGIAPARHPVDPEKSNRVLGFLALITGLCQFYRVLVAPNKVRPLLIRLSSRSTAPPGRRRARHHDSGQQTHRHHLWSSPQLIHKKVRVLPTTHGRPIGDQVQSQRRPAQDVKEALLGGNLVPFESMLVSS

SEQ ID NO: 153326 - protein, 77 aa, Glycine max
  Coding DNA Sequence Number=SeqID_61641
MSRASSSSAFVLPKNTQNLEAICVGHQFFTDGPHLSVLLKRLSSPTPGDVPHPHLSYPNFVRGPLLDDMRPFFGPCE

SEQ ID NO: 153327 - protein, 71 aa, Glycine max
  Coding DNA Sequence Number=SeqID_61642
MKTLIQCPAMQPASYSRLSDEKELALCVLHKIGLRHQPIIAWEPYLYRAPWYDLRCELHDCHPSMTGCKLT

SEQ ID NO: 153328 - protein, 161 aa, Glycine max
  Coding DNA Sequence Number=SeqID_61643
MTDPLDGPTSCFLIKVDPYVLVPITFRGPYVLAIRGLHILSCRGLHALAFRGLRVLIFSVLHIHALEEYKGSRPQVAQWARRSPTGPWGFQALESHPQRHQVDPKKSNRALGFPALVTGLCSPTGCPFPPARSRHDIGKDHAYKTPSGPEEVQQGLEVFKL

SEQ ID NO: 153329 - protein, 71 aa, Glycine max
  Coding DNA Sequence Number=SeqID_61644
MEWRRKRERRCHFKEKMSLEEAHHHRRSWIRAWRKKRKVKEYGRRKQHTRVFILVRQQPVPTSSTQATCGP

SEQ ID NO: 153330 - protein, 591 aa, Glycine max
  Coding DNA Sequence Number=SeqID_61645
  Gene Ontology: Mol. function=motor activity; Cellular component=cell projection
  Homolog annotation: Hit_ID=P15305; Match level="QueryCoverage=99%, HitCoverage=90%, E-value=3e-17, Identity=17%"; Hit description =Dynein heavy chain
MLHALTFRGLHVLAFKGLHVLTIRGLHVLAFRRLLALPFRGLHILAFRRLHVLAFRELHVLAFRGLHSLTFKGLHILALRGVHILSFRGLHVLPFRGLHAVAFRGLHVLVFRGLLVLAFRGLHALAFRGATRPRFRGLHIIAFRGLHVLPFRRLHALTFRGLQVLACRGLHALDFRGLHALFFRGLHALTFRGLHVLAFRGLRVLAIRGLHGLAFRGLLALPFRGLHVLDLRVLHVLTFRRLHTLTLRGIHATLIGLNVLAFRGLHVLAFRGLHALAFRGLHDLTIRGLHLLALRGLHAHAFRRLHALTFRRLHALTFRGLHATFRGLHVLAFRGLHVLAFRGLHALAFRGLHVLLFKWLYTLAFKGLHVLLFRGLHALAFRGATRPRFRALHIIAFRGLHVLPLRRLHALTFRGLHVLAFRGLHALDFRGLHALTFRGLHVLAFRGLRVLAVRGLHGLAFRGLLALPFRGLHVLDRRVLHVLAFRRLRTLTLKGLHATLRGLHVLAFRGLHVLAFRGLHALTIRGLHLLALRGLHAHAFRRLHALTFRRLHALTFRGLHATFRGLHVLAFRGLHVLAFRGLHALAFRGLH

SEQ ID NO: 153331 - protein, 103 aa, Glycine max
  Coding DNA Sequence Number=SeqID_61646
  Gene Ontology: Mol. function=helicase activity; Biological process =viral genome replication
  Homolog annotation: Hit_ID=Q9ZQR0; Match level="QueryCoverage=97%, HitCoverage=11%, E-value=1e-19, Identity=40%"; Hit description =Putative helicase
MSKPEEVWNQCWHWLVDDIAYQHSKSTMNSNERKTIYDRIIQVVNNNEGGMFFLYGFGGTGKTFIWRTLTSSLRAENQILIIVASSGIASLLLPGGITAHFQI

SEQ ID NO: 153332 - protein, 174 aa, Glycine max
  Coding DNA Sequence Number=SeqID_61647
MPISPCRCIGWDRAHKTPSGSEEVQQGPGGFQLWLRAFVNPTGRPFPQRGIAPTKTLSGPGEVNRALGFPALVTGLCSPTGCPSPRQGHVIIGIAPARHPVDPKKSNRVLELSSPNYGSLKGIRPPTNRAFIKKYCIPRQAQGETPQQPGDGQQRATDAPPSPLEFTSAHPQKG

SEQ ID NO: 153333 - protein, 268 aa, Glycine max
  Coding DNA Sequence Number=SeqID_61648
MQTPLSLFLGDPLVLEEGQECEYSQRRNRADGFEEEVIAQLLCIPGQDFSRTAAGRRVWIMRTSMTTLTQMWMTLLLSNVLPSDHNSDLPLPKCQLVYAILTRMSVHVAQLIADAIYLFAGMPPTRHPLDPDKSNRALGFPALITGLCQSFGVPVTPSKVIRPPITRAFIEKYCMPRQAQGDAPQAVDAPPPPRQADPAGSFGMEQYVQHLVRQQPANHRGAEVAWPGDWPEAYAGEAPVEAPDDAEEGRMDEEMTNLLNFLGGSGAT

SEQ ID NO: 153334 - protein, 156 aa, Glycine max
  Coding DNA Sequence Number=SeqID_61649
MPISPCKRIAPTKTPSGPEKVKQGPGVSSSGYGPLSVIQGAHSPCEGSHPQRHPVDPEKSNRALGFPALVMGLYQSYRVPVPPRQGYVIIDTQWTRRSPTGSWSCQALITGLYQFYGVPVTSSKGIRPPTDRAFIKKYCVPRQAQGETPQQHWDGR

SEQ ID NO: 153335 - protein, 140 aa, Glycine max
  Coding DNA Sequence Number=SeqID_61650
  Subcellular localization annotation: CTP_CleavageSite=3; ConfidenceScore=5.25e-01
MVEQSKKRKGSSSRSQRHSEAQDTPIPSSISSSSLFSSKEQRTWYTNLFSSRSIIDPKFIDMDFFSDESFECIQAFQNSNLIPFMSLKLPVYFELVKAFYSNLEIQESTLILEVSGIKMVIDQSFFYDLTQLSSEGIPFE

SEQ ID NO: 153336 - protein, 179 aa, Glycine max
  Coding DNA Sequence Number=SeqID_61651
  Pfam annotation: Domain name=G-patch; Domain location=1-42; Score =21.1; E_value=0.00054; Accession=PF01585.14; Description=G-patch domain
MVARVMLRNGFEPGMGLGKDCLGNADVVDIKGNPYKYGLGYEPGMPGRRNVPSRFRADRVWPGRISQCFTSAGMVSEEEVAAIEEEFPQDPPSFVQPCHPDSQVGNWRVISQSEVYTADSTYEGQFVEDPNNEGLTIDFDRDISQTINEEEEEDVPSPELERLVAQEEREMKPHQEEPN

SEQ ID NO: 153337 - protein, 70 aa, Glycine max
  Coding DNA Sequence Number=SeqID_61652
MACTHIPGFTRDSPQISASLHQLDLAPYASEPYNAQWNAPGLLLDKHTLRSSRILGEMEVDEPWLGLCYH

SEQ ID NO: 153338 - protein, 125 aa, Glycine max
  Coding DNA Sequence Number=SeqID_61653
MDNHQHGNHSDPAQARIKKKGIRQHKVNYQAQNIDSNIPDSSEDESSESTQGSASVSSPENQNYMSSVNEAAINREGYSDLVTNSCSVATVMQICGMMKESLNMEELHIQDSTYVVEVVREGLPQ

SEQ ID NO: 153339 - protein, 114 aa, Glycine max
  Coding DNA Sequence Number=SeqID_61654
VDGIDKLDAVGGIPLQNTWEGPQYHPQPHPPHSTTSKNLHAMAEMGKLDHLEERLRAIEGGKDYAFGNLEELLLVPNIITPPKFKVPDFDKYKGTTCPKNHLKTCCHMQKMRNC

SEQ ID NO: 153340 - protein, 100 aa, Glycine max
  Coding DNA Sequence Number=SeqID_61655
MDPKRIKVIPEWPTPPTLLIELVRNYILSWEDGQERGVEERIPEFQEPLDLRSNPFQGGGNDAILPIRALDRRLQEDWARDAREGPRVLMSLRIDFRPMG

SEQ ID NO: 153341 - protein, 66 aa, Glycine max
  Coding DNA Sequence Number=SeqID_61656
MNLGIPRSCGSACHQSLGTRLGVFFTKMRTCFSKETKLPTDQSNICFWMKNKVSIGEGEYADEIFS

SEQ ID NO: 153342 - protein, 110 aa, Glycine max
  Coding DNA Sequence Number=SeqID_61657
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=65%, E-value=2e-33, Identity=100%"; Hit description=LacZ protein
MLYTGQLKRHKCKIGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 153343 - protein, 51 aa, Glycine max
  Coding DNA Sequence Number=SeqID_61658
MNPKRIKVIPECPTPPSVEGRSLEYEEPRDLRSNPFQGGGDDAILPPKNYH

SEQ ID NO: 153344 - protein, 187 aa, Glycine max
  Coding DNA Sequence Number=SeqID_61659
QGVPFEGTLVDDWKHVYSSHDACKMVCNDHADMTGRLLASSFTFECRIMHYILCRVLLPRYRMHKALRANAPLSYPHPVTLFHQHFNVPLEDEPFVKVKRSFAIGVVAITSFGYWKDMDGQWVCKQDLPPPIPDERTPSPPPHRDTSSSLLNDVLTELRDLQAFVGDRFDAMDSRITRLEDDMSFIR

SEQ ID NO: 153345 - protein, 34 aa, Glycine max
  Coding DNA Sequence Number=SeqID_61660
MWDTLGVPMNPKRIKVIPEWPAPPSEEKFGASKT

SEQ ID NO: 153346 - protein, 18 aa, Glycine max
  Coding DNA Sequence Number=SeqID_61661
MDSVPAYTSILVLAVNIK

SEQ ID NO: 153347 - protein, 150 aa, Glycine max
  Coding DNA Sequence Number=SeqID_61662
MAAQLIHDRVVMECLEGVWETLEGNERCRFRGTIRLTATSLVHPEEPARTLQQPVEWILPTPTPYRLVESVQVIEVSFSEEDLEEDPEELPPEPAMDALHLPEDDEDPLPDVDSPEDNMSASEAGFTEESGPGGTTIIQTARLTLLILGG

SEQ ID NO: 153348 - protein, 94 aa, Glycine max
  Coding DNA Sequence Number=SeqID_61663
  Subcellular localization annotation: CTP_CleavageSite=35; ConfidenceScore=5.27e-01
VILVRSTVTDLPSTGSAFYPDLSSFTGSGVYPDLSSFTGSGVYPDLSSFTGSGVYPDLSSFTGSGVIQKLYSLYQVIRPVRFTSSGIRASALDT

SEQ ID NO: 153349 - protein, 168 aa, Glycine max
  Coding DNA Sequence Number=SeqID_61664
  Homolog annotation: Hit_ID=A2Q5X7; Match level="QueryCoverage=50%, HitCoverage=7%, E-value=8e-07, Identity=41%"; Hit description =Ovarian tumour, otubain, putative
MDCWGCLTDCPSEQQFDECLKKFEMACAPWPIFSDQGLFEPEVSIKEVMETISKRFKELDVCGKFTLKTKLWEIAYPDQNSMCPPPTKVNTKGAPKKAMSRNPRSTKRDPSYWEYVDAFESMQNSNSSVRRTASSSEQPNQRTMMPMLDQFQPFMHDFIDKIVDVKAD

SEQ ID NO: 153350 - protein, 40 aa, Glycine max
  Coding DNA Sequence Number=SeqID_61665
MAFVDNWVVGKEKEWQSQHGFLPHSHPLHLAPVFSFVQAR

SEQ ID NO: 153351 - protein, 106 aa, Glycine max
  Coding DNA Sequence Number=SeqID_61666
  Gene Ontology: Mol. function=protein kinase C binding; Cellular component=cell projection; Biological process=keratinization
  Homolog annotation: Hit_ID=Q9JKS4-3; Match level="QueryCoverage=85%, HitCoverage=13%, E-value=3e-13, Identity=42%"; Hit description =Isoform 3 of Q9JKS4
MTDPLNESISCFLIRVDPWVLVPSPSEGYMSSPSEGYMPSPSKGYTPSPLEDYTSSPLEDYTSSPSEGYTPLPSEDYTSSPLEDYTSLPSEDYMSSPSEGYMPSPS

SEQ ID NO: 153352 - protein, 108 aa, Glycine max
  Coding DNA Sequence Number=SeqID_61667
MTPSHALDPLPHGHALQPRVVPQAPQTDIPHVPEPGASSTSAEEPRHAVVKVFDDIAKRLERHLSLGVVTPGSSTHEVIEECLRLARSVTQDHLVYVRSRRRQRTDQA

SEQ ID NO: 153353 - protein, 115 aa, Glycine max
  Coding DNA Sequence Number=SeqID_61668
MPPTRHSLDPDKSNRALGFPALITGLNQSFGVPVTPSKVIRPPITRAFIEKYCTPRQAQGDAPQAANAPPPPHQVDPAGSLGMERYLQHLVCQQAANHRGQVQIHECLYQLSLSQ

SEQ ID NO: 153354 - protein, 124 aa, Glycine max
  Coding DNA Sequence Number=SeqID_61669
MTKSVGLKKKVLEEKGTDGKENDEQAVNEVAEVPYPVVPSKKEKDHHLVRFLDIFRKLEITMPFGEELQQMPLYSKFLKDMPIQQRPNIFQRTTKLEETLTQFMQITMSNHESTESALKNLEVQ

SEQ ID NO: 153355 - protein, 76 aa, Glycine max
  Coding DNA Sequence Number=SeqID_61670
MLRNFTDYLTMSVKYLEAVKRRLHATKQWSPDEIRKMMQSYLARALDRRLQVDWARDARENPRILMSLRIDFRPMG

SEQ ID NO: 153356 - protein, 75 aa, Glycine max
  Coding DNA Sequence Number=SeqID_61671
MVELMNQAVVFSLKNQHMKLIIWGTSQGRILMQQNQWRTHLGNQFNKDQGGPLNRPPQQGPNLYERTTKLEETFA

SEQ ID NO: 153357 - protein, 248 aa, Glycine max
  Coding DNA Sequence Number=SeqID_61672
  Gene Ontology: Mol. function=magnesium ion binding; Biological process=menaquinone biosynthetic process
  Homolog annotation: Hit_ID=A8GGY8; Match level="QueryCoverage=100%, HitCoverage=75%, E-value=1e-101, Identity=76%"; Hit description =Mandelate racemase/muconate lactonizing protein
  Pfam annotation: Domain name=MR_MLE; Domain location=103-198; Score =31.9; E_value=2.4e-06; Accession=PF01188.12; Description=Mandelate racemase  muconate lactonizing enzyme, C-terminal domain
MEAGVVLRNQRLKTRDGWVVQLRQGEREGWGEIAPLPEFSRETLAQAEQAALDWLQAWLAGNEPDDSALPSVAFGLSCAQAELEQRLPTQADFRKAPLCTGDPDELFETLSALPGEKVAKVKVGLYEAVRDGMIVNVLLEALPDLRLRLDANRSWTRAKADGFAKYVNPAWRDRIAFLEEPCKTRDESRDFARATGIAIAWDESVREADFVVQAEPGVAAIVVKPTLVGSLARCQALVAQAHAAGLTA

SEQ ID NO: 153358 - protein, 169 aa, Glycine max
  Coding DNA Sequence Number=SeqID_61673
MGEVEEVQEQMKADMEAMKEQMATMMEAMMSLKKIMEANAVTIAATSTVAKVNPMPPSGLNQMNHPTLAMTHEIPHRNLADFEPCLGYATEGQAFGGIPLQNTLEGPQYHPQLHLLHSTTSKNPHAMAEMGKLDHLGEKLRAIEGGKDYAFANLEEYFLVPNIITPPKS

SEQ ID NO: 153359 - protein, 146 aa, Glycine max
  Coding DNA Sequence Number=SeqID_61674
ASVFNSERLDILRDSIGHPSKKLLSFEFAQSFASVFNFERLDILRDSIGHPSKKLLSFEFAQSFASVFNFERLDILRDSIRHPSKKLLSIEFAHNFELRYSISSVSRYYVTQSDIRVKRYCRLNLLRASVFYFERLDILRDSIRHP

SEQ ID NO: 153360 - protein, 117 aa, Glycine max
  Coding DNA Sequence Number=SeqID_61675
MEAMKEQMTIMMEAMMSMKRMIEVRKPSVGKYGQPHFVQVQSKDSFPPYGLPPNYMPPNVAHTPIENVDNSAPIPIESQHPQSGHAQVSQPIGETHEAPRDHNLVDSEPHVGYATKG

SEQ ID NO: 153361 - protein, 124 aa, Glycine max
  Coding DNA Sequence Number=SeqID_61676
MDISEDTDIPVILRRPFMLTASCIVDMGKRKLELGFEDQKIDFDLFVKDKPAPEHNVCLQVMEGGQEVLKLCAKCIFGHVLSRESQALSTQPLHLRLIWSAKLAKDDLSQLQFDLNSAKLQADR

SEQ ID NO: 153362 - protein, 72 aa, Glycine max
  Coding DNA Sequence Number=SeqID_61677
MPIGWTSQKRGADIEEEELTDLRSNPLQGEGDGAILPRKGPVTRAMSKRLQEDWARAAEEGPRVLTNLRVDF

SEQ ID NO: 153363 - protein, 59 aa, Glycine max
  Coding DNA Sequence Number=SeqID_61678
MRPITAMHSQNVFFKRFLSGARLLRYVTGSHWLTMPGLGWDWSSLVLGNSTPPDVPKVS

SEQ ID NO: 153364 - protein, 153 aa, Glycine max
  Coding DNA Sequence Number=SeqID_61679
ASTFNFERLDILRDSIRNPSKKLLSFELALRGSTFNFEGPDILRDSIRHPSKKLLSFELAQRFNIQFQASRYITGLNQTSEKKVIVVCIGSELQHSISSVPIYYETQSDIRVKSYCRLNWLRGSTFNFERLDILRDSIRHPRKSSLSLELAYS

SEQ ID NO: 153365 - protein, 51 aa, Glycine max
  Coding DNA Sequence Number=SeqID_61680
MEFPEESLVRAEEGNSELNHQVNLPIVYASNKGRAVTSSGALPPCFVRVKR

SEQ ID NO: 153366 - protein, 170 aa, Glycine max
  Coding DNA Sequence Number=SeqID_61681
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=65%, HitCoverage=90%, E-value=5e-25, Identity=54%"; Hit description =Putative uncharacterized protein
MNSGKEQDDASMFSDSQSVISLAKNPVFHSRCKHIQLRYHFIRELISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 153367 - protein, 133 aa, Glycine max
  Coding DNA Sequence Number=SeqID_61682
  Gene Ontology: Mol. function=nucleic acid binding; Biological process= DNA integration
  Homolog annotation: Hit_ID=A5BFD6; Match level="QueryCoverage=99%, HitCoverage=14%, E-value=4e-22, Identity=42%"; Hit description =Putative uncharacterized protein
MTHDQELFRELDISQVSKVRIGNGDLITVEGKGTVAIESCTDVNDKEISSIKKRGKSFSFDPLNEERAAYPATVNSTEAWPKDDFTRMCLIYFLKSKSEVAGVFWRFKHWIEKQSGCMIQALRSDNGKEYTSA

SEQ ID NO: 153368 - protein, 125 aa, Glycine max
  Coding DNA Sequence Number=SeqID_61683
  Homolog annotation: Hit_ID=Q2QTJ2; Match level="QueryCoverage=96%, HitCoverage=8%, E-value=6e-07, Identity=31%"; Hit description =Transposon protein, putative, Mutator sub-class
  Pfam annotation: Domain name=zf-CCHC; Domain location=104-121; Score =9.8; E_value=0.051; Accession=PF00098.14; Description=Zinc knuckle
MTTNLSESVNFMFKNTRHLPVSSLVEETYFKTAQLFANRGRQTQAMINSGSQYSEVVFDAINSEYEGDQWGPDPRRKRTAKGRPVSTRIPTKMDEDENERASRKKCGLCRQHGHSRNNCPNVSSS

SEQ ID NO: 153369 - protein, 90 aa, Glycine max
  Coding DNA Sequence Number=SeqID_61684
MDDFTEDEDQQFFDHINKQSDDQTDDEEQFTLTKEGYTSSASYMKMVVHGAWAHAIHRGITNGLSRVSEVITLVSCRCLDKIIANSTNTS

SEQ ID NO: 153370 - protein, 109 aa, Glycine max
  Coding DNA Sequence Number=SeqID_61685
  Homolog annotation: Hit_ID=A7PKQ3; Match level="QueryCoverage=84%, HitCoverage=18%, E-value=2e-13, Identity=43%"; Hit description =Chromosome chr7 scaffold_20, whole genome shotgun sequence
MMFLHIKWYQALNESPIRHNQSPKVTSEVMAIAEDINDMSFISAQLAEVTSHTTDLGRDGWEKAENEGTSLKKQVQALTLRNSTLEDRVTYLDSAVKECVRQLRQTRCL

SEQ ID NO: 153371 - protein, 30 aa, Glycine max
  Coding DNA Sequence Number=SeqID_61686
MSLISSAMATTSEEIHSMPDAAKTRKLELS

SEQ ID NO: 153372 - protein, 149 aa, Glycine max
  Coding DNA Sequence Number=SeqID_61687
MERSMINAASGGALGDMTPAEARNLIEKMASNSQQFSARNDAIVLRGVHEVATDSSSSTENKKLEGKLDALQSRVNEKPKAYAANIYNRPPQQKNQQQQNNYDLSSNRYNPGWINHPNLRWVSPPQQQQPVPPFQNVAGPSKPYVPPPI

SEQ ID NO: 153373 - protein, 15 aa, Glycine max
  Coding DNA Sequence Number=SeqID_61688
MQYLGSDPRSSRNEQ

SEQ ID NO: 153374 - protein, 94 aa, Glycine max
  Coding DNA Sequence Number=SeqID_61689
  Gene Ontology: Mol. function=aspartic-type endopeptidase activity; Biological process=DNA integration
  Homolog annotation: Hit_ID=A5BWN3; Match level="QueryCoverage=94%, HitCoverage=9%, E-value=7e-11, Identity=41%"; Hit description =Putative uncharacterized protein
  Pfam annotation: Domain name=RVT_2; Domain location=1-84; Score= -195.8; E_value=0.1; Accession=PF07727.5; Description=Reverse transcriptase (RNA-dependent DNA pol
TKRDSHGNLEHYKARLVTKGFTQKDDIDYKETFSPLVGLGSSSSMDSFASWKMNKNAMEKEEREETPIQGEDESRRSSPPYEAMDKSLEEEGDE

SEQ ID NO: 153375 - protein, 122 aa, Glycine max
  Coding DNA Sequence Number=SeqID_61690
MAERGHGMNYMPQTFAQYPTQMYQYPFEGHHTDTSASEHLFGGVVETHPHFSWSTMTPSQQYHGPIPTPNVPLGVDLRHKFSAEADQIEAGRHRGRRNPDRQARRWDRPCGTSSRHHGHHNE

SEQ ID NO: 153376 - protein, 139 aa, Glycine max
  Coding DNA Sequence Number=SeqID_61691
MSHRSSRVNGEGTGHKDPLFRILDELSSLKLWKEKLERKEKGKERIEINQDEREQIREEERRKILKELRKEKHASYSSHDPCKSLSKELRDYCEGRHRSHLRPHSHRIEKERKSQEANINLPYFHGKDNVEAYLDWEIR

SEQ ID NO: 153377 - protein, 58 aa, Glycine max
  Coding DNA Sequence Number=SeqID_61692
MLNARGIYLSLDIISKFPMVRMLVIGLRTWCSNFTTIQRKKRGFWEKREETTLRGRGG

SEQ ID NO: 153378 - protein, 211 aa, Glycine max
  Coding DNA Sequence Number=SeqID_61693
  Gene Ontology: Mol. function=aspartic-type endopeptidase activity; Cellular component=small subunit processome; Biological process=DNA integration
  Homolog annotation: Hit_ID=A5CBT1; Match level="QueryCoverage=63%, HitCoverage=14%, E-value=8e-24, Identity=42%"; Hit description =Putative uncharacterized protein
YHDHLKKGVDAVPNDRRAEWEKLDFQLCAVLWQSVESDVLEILRSFKTCCSFWKKAQEIFANDIQSKARAAVEELKRFLAAKSLEEVNRKLDKFYMVLILRSLHLDFDNVRDQILAGDQVPSMDSLITRLLRVPQALKEENLAESVETSAMVASRGREGGRNNRGDCGGRSGPQVAQTEKSEPKFSDTEYQEYLKLKSEKSSSQASSSSVP

SEQ ID NO: 153379 - protein, 51 aa, Glycine max
  Coding DNA Sequence Number=SeqID_61694
MVTYYGCKLSMFQNMFGMGKKTGNYTSEELSLRIKGKKKSQRKLFISFDNL

SEQ ID NO: 153380 - protein, 115 aa, Glycine max
  Coding DNA Sequence Number=SeqID_61695
  Subcellular localization annotation: CTP_CleavageSite=27; ConfidenceScore=5.38e-01
MRALLGSFNSGNWSDSKVLDSAGLSCRAFTRNQSPTSNLVPLDLEIEATLRRNRAERRRKLLQDRIVASILEEKTHFSDLLSPDSPSSRESATQLPEAITMVEEHDQRITLEDYS

SEQ ID NO: 153381 - protein, 77 aa, Glycine max
  Coding DNA Sequence Number=SeqID_61696
MGNIDLKKLAYQNEPFIMANKLNKCFIFKILVMKGDDDSIVDTCVSPFSTQMPPNVNGEEEVDDVHANCNDHDEGEF

SEQ ID NO: 153382 - protein, 78 aa, Glycine max
  Coding DNA Sequence Number=SeqID_61697
MASEWRRKRESRHHFKETMILEEAHHHRRPRIRAWRKKEMTEGRGREEHEILCSKRALKFMVQPTNPRSIPRFSTKCA

SEQ ID NO: 153383 - protein, 50 aa, Glycine max
  Coding DNA Sequence Number=SeqID_61698
MFAYSPFAKRKPRAKRISVHALSCESQALSAQPLHLRLIWSTKLAKVELS

SEQ ID NO: 153384 - protein, 80 aa, Glycine max
  Coding DNA Sequence Number=SeqID_61699
MKKIQGLQVPHGATSVKVSDEELDDAILPRKGPVTRAMSKRLQEDWAIAVEEGPRVLMNLKVGYPKNIGYFSPCILGHLD

SEQ ID NO: 153385 - protein, 140 aa, Glycine max
  Coding DNA Sequence Number=SeqID_61700
MKREKHVSYSSHNSCKSLSEELRDYYEGRHRSHLRPHSHRRENERKPQEVNIKLPYFHGKDNEKAYLDWEIRVEQKLKRKPTLKSYGYHSYPKKDQGLGILGAAPSKPNDDKGKTIEKQPPKASMQEKTSSIKCFKCLGR

SEQ ID NO: 153386 - protein, 259 aa, Glycine max
  Coding DNA Sequence Number=SeqID_61701
  Gene Ontology: Mol. function=motor activity; Cellular component=cell projection
  Homolog annotation: Hit_ID=UPI00016621D1; Match level="QueryCoverage =90%, HitCoverage=40%, E-value=5e-24, Identity=34%"; Hit description =UPI00016621D1 related cluster
GLHIIDFRGLHVLTLRGLHVLTFRGLHTLAFRGLHVLAFKGLQVLAFRGLHALAFKGLHVLTFSVLHVFTFRGLHALAFRGLHVLAFRRLQVFAFRGLHALAFRGLHVLTFRGLHALAFKGLHVLTFRGLQVFAFRELHALAFSGLHVLAFRGLHALAFRGLHILTFRGLHALTFRGLHILAFRGLHVLAFKGLHVLAFRGLHMLAFRARHVLAFRGQHVLTFKGLHIRSFRELKFLGHPPDLEGRPTMWAQPEEEACL

SEQ ID NO: 153387 - protein, 120 aa, Glycine max
  Coding DNA Sequence Number=SeqID_61702
SAAVDLIPIDLEINAICRKRNSERIRNFLQDLEAAATSEEEPRSSEASSSFPVARHSHIEPIEDTIMAEEPRRVTLEDYSNPYAHLATYIEICNTIRLAGVPEDAIRLSLFSFSLSGEAK

SEQ ID NO: 153388 - protein, 83 aa, Glycine max
  Coding DNA Sequence Number=SeqID_61703
MSRFISDSPQISTSLHQLDLAPYALGSYNAQWNASGPLHDKHMSHSSRILRKMEVEEPWLGLWKPLNYPVDIGASQHRTPKLG

SEQ ID NO: 153389 - protein, 123 aa, Glycine max
  Coding DNA Sequence Number=SeqID_61704
MVLAEGEYLPVYSRYCRMPTDIREIEAALCIPGQGFVLNAEGHPRKIIRKDLATLARVWSVLSYSNLAPTSHTSDLTMDRARLIFGLVSQLDMNVGALISGQITSMAQSNSSRLGFPALITAL

SEQ ID NO: 153390 - protein, 181 aa, Glycine max
  Coding DNA Sequence Number=SeqID_61705
  Homolog annotation: Hit_ID=Q2HW90; Match level="QueryCoverage=95%, HitCoverage=38%, E-value=3e-18, Identity=32%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKKWSSRSTKEVFGGKGQRPWQNQGEWASFIDILALLIFGVVLFPNMEGLVDLAVIDAFLAYHNHKESPVVAILAMYDTFNRGCKKSDARIVCCALAL

SEQ ID NO: 153391 - protein, 75 aa, Glycine max
  Coding DNA Sequence Number=SeqID_61706
MTVEGEGRDRRRHFKEKMSLEEAHHHMRSWIRAWRKKEMNEGRGREEHEILCSKRALKSEPTNPRSIPRFSTKCA

SEQ ID NO: 153392 - protein, 99 aa, Glycine max
  Coding DNA Sequence Number=SeqID_61707
MVAEWRRKRERRRHFKEKMSLEEAHHHRRPWIRAWRKKEMNERRGREEHEILCSKRALKSEDCIRRPMAYCGIVTIHDVAGIMAETKQQLRFYSQDFFG

SEQ ID NO: 153393 - protein, 87 aa, Glycine max
  Coding DNA Sequence Number=SeqID_61708
  Subcellular localization annotation: CTP_CleavageSite=45; ConfidenceScore=5.20e-01
MGRATYAARSLHRCAYSLKLSAIGSVATYPSAGGRRVTRRMRVPRKEYARSHHQRLFEENVGKTGKDAIYELLSERFGSCIYARGRY

SEQ ID NO: 153394 - protein, 151 aa, Glycine max
  Coding DNA Sequence Number=SeqID_61709
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MVISFNSHVRFRRIAYRDARNLTTEALEKFKCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 153395 - protein, 36 aa, Glycine max
  Coding DNA Sequence Number=SeqID_61710
MCSATDYKVKSIGGGCDVEISILAMMILDFSVANWI

SEQ ID NO: 153396 - protein, 103 aa, Glycine max
  Coding DNA Sequence Number=SeqID_61711
MTHAVKDHRGKWAPNYEGPFVVKRAFSGGALGQDRLGLPFGVKTKHERQKPVKVLKDERNRGWGHDRPIVTLLCAKQAGNVAARQPRILCILQLSFTICLGKE

SEQ ID NO: 153397 - protein, 81 aa, Glycine max
  Coding DNA Sequence Number=SeqID_61712
MAAPNFQKGPSHGFRVCSPRVLFPELLIPSGACLTNRGQDHLELPSGVGTKHGQQKPIKVLRNGCKWGWGHDRLIVALSLR

SEQ ID NO: 153398 - protein, 71 aa, Glycine max
  Coding DNA Sequence Number=SeqID_61713
  Subcellular localization annotation: CTP_CleavageSite=56; ConfidenceScore=5.44e-01
LPSLVTDVWGANTFPARKYNSRAFHLKVRRSRLFRFFQRFPQINVGGDSARIPFVEHASREKTLSLFPPPG

SEQ ID NO: 153399 - protein, 80 aa, Glycine max
  Coding DNA Sequence Number=SeqID_61714
MEKSDKRNLKEKKENKGYITWEDNVINSSSDSENKIISLGIMMKDYENGKEQSRYSDSNFSKHMACIKVYSYFSPRKVDM

SEQ ID NO: 153400 - protein, 292 aa, Glycine max
  Coding DNA Sequence Number=SeqID_61715
  Homolog annotation: Hit_ID=Q6WAY6; Match level="QueryCoverage=55%, HitCoverage=26%, E-value=6e-16, Identity=33%"; Hit description =Putative uncharacterized protein
MVGTNWKSPNVKHLKGFSNSAQRCEKSSARIICCLPALCVWLVSHLFQQDTRHPCPLLSHRSCTEKRRIDWDQLLAGIGGRTISWFPRWKEGKEGVLFSCGGYPNIPLVGTRGCINYNPALAIRQLGYPMRGAPTEESMSPFLVRDFGAQNSKTIQRIHKAWETPLRKDHELRGIRNGIIGGYHEWLKLKVVSEESFEAPEEDEEVQALKSELGKAKLAEEKFKLAATHIRKECAGLREENAITARALNKRPRGLARKSMAGTNFAELYGVAIMNSSCEGKKGTSREHIAWF

SEQ ID NO: 153401 - protein, 64 aa, Glycine max
  Coding DNA Sequence Number=SeqID_61716
DLLKATLLAMRLGRVLGKVIDERQSTFVGGRFMLDGVMVANEVVTENKKGYISYESVQVEGTST

SEQ ID NO: 153402 - protein, 234 aa, Glycine max
  Coding DNA Sequence Number=SeqID_61717
MAQPPPCERTLREMVAPDFTYESLCIQYPDEDVPYVLKTRLIHLLPKFHGLAGHSHQEGYLRWPPNSQQFSARNDAIVIRGVHEVATNPSASSETKKLEGKLDALVNLVTQLALNQKSVPVARVCGLCSSVDHHTDLCPSMQQPEAIEQPEAYAANIYNRPPQPQQQNQPQQSNYDLSSNRYNPGWRNHPNLRWSSPQQQQQQPAPSFQNAAGPSRPYIPPPIQQQQQPQKQPT

SEQ ID NO: 153403 - protein, 201 aa, Glycine max
  Coding DNA Sequence Number=SeqID_61718
MAPRKLASKRSRKDKAAEGTSSAPEYDSHRFRSAVHQQRFEAIKGWSFLRERRIQLRDDEYTDFQEEIGRRQWASLVTPMAKFDPDIVLEFYANAWPTEEGVRDMRSWVRGQWIPFDADAIGQLLGYPLVLEQGQECEYSQRRNRSDGFDEEAIAQLLCIPGAGFCPNCCREASANYAHQHDHPDSDMDDFAAQQHPAHRP

SEQ ID NO: 153404 - protein, 128 aa, Glycine max
  Coding DNA Sequence Number=SeqID_61719
  Homolog annotation: Hit_ID=Q84VH5; Match level="QueryCoverage=41%, HitCoverage=7%, E-value=5e-20, Identity=96%"; Hit description =Envelope-like protein
KAAATGAVSKDALIAELKDTCKVLEATIKATTEKKMELERLIKRLSDSGINDGEAAEEEEEAEEEEEAAEEEEEAAEEEEVQQRIQNQMMMILMLPHDHQTFIFAVILTRNCFTAVGAWRQGEQKADV

SEQ ID NO: 153405 - protein, 96 aa, Glycine max
  Coding DNA Sequence Number=SeqID_61720
DRVHKIPSRPGEVQQGPGVSSSDYGPLLVLRSVYRPQQGRHRAKHHNSQGMAGKGQQTHRRHLQSPSAHLQRLERCLRPVVDQQATKSKAKGKQKY

SEQ ID NO: 153406 - protein, 148 aa, Glycine max
  Coding DNA Sequence Number=SeqID_61721
MGEVEEVQEQMKADKEATKEQMATMMEAMMSMKNIMEANAVTVAVTNTVAKVNLMPPSDLNQMNHPTSDTVGKDLGSTDGPMMCKFKMSTPSRHMACLPTIHHPIWRTLPMRMSITPLPYSLRADNPKLIMHMSLNRLGRHMKCPTKI

SEQ ID NO: 153407 - protein, 230 aa, Glycine max
  Coding DNA Sequence Number=SeqID_61722
  Homolog annotation: Hit_ID=Q84VI1; Match level="QueryCoverage=80%, HitCoverage=31%, E-value=4e-95, Identity=82%"; Hit description =Envelope-like protein
MDLIKAAGLLKTVTKLGDCYEGLVREFIVNIPSDISNRKSDDYQRVFVRGKCVRFSPAVINKYLGRPTNGVIDIDVSEHQIAKEITAKRVQHWPKKGKLSAGKLSVKYAILHRIGAANWVPTNHTSTVATESFAVKLPIAFPTVLCGIMLSQHPNMLNYTDSVIKRESPLSLHYKLFEGTHVPDIVSTSGKAAASGAVSKDALIANSRTHARCWKQPSKPPQRRKWSWNA

SEQ ID NO: 153408 - protein, 172 aa, Glycine max
  Coding DNA Sequence Number=SeqID_61723
  Gene Ontology: Mol. function=phosphoprotein phosphatase activity
  Homolog annotation: Hit_ID=A7R8Y3; Match level="QueryCoverage=77%, HitCoverage=39%, E-value=7e-17, Identity=33%"; Hit description =Chromosome undetermined scaffold_3090, whole genome shotgun sequence
FLWEPYTTTVLLMLPHICLIGSVAWCAVVPLIYFHVVEWHQPDRVLQQFGMQQPIPESPSQPQNIHGLTLKGKQDENWFQLLAPMISQWNNRADFRVDIYPRQEGLLSFNSDYMGEVAETLQYMVSPQGRNTWAVDDLMPYVEKLMILSEEQERITEPVAHGAASERRFPPL

SEQ ID NO: 153409 - protein, 152 aa, Glycine max
  Coding DNA Sequence Number=SeqID_61724
  Homolog annotation: Hit_ID=Q6WAY4; Match level="QueryCoverage=96%, HitCoverage=26%, E-value=6e-13, Identity=33%"; Hit description =Putative uncharacterized protein
MGTNQTKRRFYQVKIKGLDVTSLKELGRLMGPLQMQAFRKAYGKILNLTIPEIFTEAVVSLTQYYDQPLRCFTFGDFQLVLTVEEFEEILGCPLGGRKPYLFSGFLPSLSKIAIVVRDSTRELDRVKQTRNGVVGLPRKYLEGKARDKANQE

SEQ ID NO: 153410 - protein, 211 aa, Glycine max
  Coding DNA Sequence Number=SeqID_61725
MGEAEEVQEKMKAEMEAMKEQMATMMEAIISMKKIREVDMVAVAATNAVAKVNPTSPSGINQMYHPTSNMIGKDLGSTDDPMMCKFKTSTPSHHMACLPTIHHPMWHTLSMKISITPLRYSLRTNNLIRHISLKPWGRHMKFPTTIYLTSSLGSDMPLKGKLVGGIPFENTLEGPQYHPQPQPSRSTVVKNPHNYGRNGKAGSSRGKAQGH

SEQ ID NO: 153411 - protein, 141 aa, Glycine max
  Coding DNA Sequence Number=SeqID_61726
MIMRGQDIYSSQDEPTTSPSSSESEEAKGEESSEEIYPQEDGQPLVVKEKCKEVSVSSKRLAKKETHFTIKTNIKETFPLRQPPHFLFCKKTLASIAIPLGLEFIPQVKKLLDEGLVHKSLNPCALLVPKIGIINIKIQKK

SEQ ID NO: 153412 - protein, 68 aa, Glycine max
  Coding DNA Sequence Number=SeqID_61727
MTHYNPYPRKQKRKEGKFPIKEKAKRKERKFPIKKWEKAKRKERKFPIKEWEKEKRKERKFPTKEWEK

SEQ ID NO: 153413 - protein, 100 aa, Glycine max
  Coding DNA Sequence Number=SeqID_61728
  Homolog annotation: Hit_ID=A5AJN8; Match level="QueryCoverage=49%, HitCoverage=26%, E-value=9e-12, Identity=67%"; Hit description =Putative uncharacterized protein
MNFYNLPTTTPALCTIISPFLVNIIPSDGGEHATGTSFQMDSPSFLATQDERRHARSMLGPAEHNDEETVVTKTSDTEEDIVEMDYAQPHRKPPIHNEKP

SEQ ID NO: 153414 - protein, 500 aa, Glycine max
  Coding DNA Sequence Number=SeqID_61729
  Homolog annotation: Hit_ID=A7R0F1; Match level="QueryCoverage=68%, HitCoverage=93%, E-value=2e-55, Identity=38%"; Hit description =Chromosome undetermined scaffold_306, whole genome shotgun sequence
  Pfam annotation: Domain name=Transferase; Domain location=20-373; Score=-142.3; E_value=0.00048; Accession=PF02458.6; Description =Transferase family
MEVHENGGSPRQSQSLSELQIVTMMSVPPLKMTEPRAVRKVLVSEDNTRAIHGCYQVVMYYENLKEKEHGWCLAGLIVESLARVLLDHPLLAGRLQRREDTGFEIVANDSGIRLLEACYPTTLSHFLHLNEEQHHLVFWKEIDTQYPQFSPLFYVTNFECGGYSIGISCSLLLAEVFLVENFLGKWAEIHMNMSPQHEEIQTPIFHHPRLKNPESLPPDIISRTQRQNGVQSMVFTITTEDANFSMELWRELAMLCVKEAEQKLSTNLGSEFSLVVKESSEVAKVESCSMNGWSVEGMRVKHEMSASRWEEFGVYEVAFFEGNKPVQVSCWIDSVSDGYAMVVPLPYLKHKNACAIPMLNQVMSATRGATDAFSGVSRHVNTSLRKLGANNVEVGVGCGVVGAFPQSLQSAVSTVNTNQSSAGSMMQLATKSTDQVSQGQPEPQPVQIGSDFENNPLRGTAVGSAFGSRTEKVISNFLQNPLLKGEGGGLDEAVCTDSHK

SEQ ID NO: 153415 - protein, 297 aa, Glycine max
  Coding DNA Sequence Number=SeqID_61730
  Gene Ontology: Mol. function=amino acid transmembrane transporter activity; Cellular component=integral to membrane; Biological process=amino acid transport
  Homolog annotation: Hit_ID=A7QZM7; Match level="QueryCoverage=53%, HitCoverage=51%, E-value=1e-48, Identity=62%"; Hit description =Chromosome undetermined scaffold_279, whole genome shotgun sequence
MQTARQKLRLMVAKAFIVERSIERGKVKGKNVKVNDKVTTYARLLMETVEKQFADFITIGVVNGAATVYFSYIGYDSASTLAEEIKDPFKSLPIGIMGSILITTILYCLMALSLASIALFTELGIIIELVNIRTLLVFYLVANALIYRRYVITSHTPPIHTLLFQFLFSLGALGFSLSWKFNQQQWGLPLFGGLMITITAFYHHKVPHHTHADDADWCVPFMPWPPALSIFLNVFLITTLKLLSFQRFAMWACFITLFYVLYGVHSTYQAEEETEIGSNQLNSSSSNLQTKVEVQVL

SEQ ID NO: 153416 - protein, 477 aa, Glycine max
  Coding DNA Sequence Number=SeqID_61731
  Gene Ontology: Mol. function=hydrolase activity; Cellular component =cytosol; Biological process=response to other organism
  Homolog annotation: Hit_ID=A7QY36; Match level="QueryCoverage=43%, HitCoverage=86%, E-value=2e-86, Identity=68%"; Hit description =Chromosome undetermined scaffold_237, whole genome shotgun sequence
  Pfam annotation: Domain name=DUF862; Domain location=290-414; Score =155.0; E_value=2e-43; Accession=PF05903.5; Description=Eukaryotic protein of unknown function (DUF862)
  Pfam annotation: Domain name=NUDIX; Domain location=195-302; Score =21.1; E_value=0.0017; Accession=PF00293.19; Description=NUDIX domain
  Pfam module annotation: Pfam domain module=DUF862::NUDIX; Domain location=290-414::195-302
  Subcellular localization annotation: CTP_CleavageSite=67; ConfidenceScore=5.47e-01
MELKSLTSNSVCTSEFVHVGRTRTGTYSSLLSNFRSVRVSRQLNCFGGLFRRNNEASNKIYLADKAVISSVGPHNLAAETSFHHINGTNGSTSSLCSRNLRVLDAFDDVYEGVVIDSDRLPDNPSTFAANLRFSLSHWKKMGKKGIWLRLPSEQSDFVPIAIKEGFRYHHAEPGYVMLTYWIPEGPCMLPANASHQVGVGGFVINDSSESEELYAGAIREVKEETGIDTEFVEVIAFRHARNVAFEKSDLFFICMLRPLSAEIIVDDPEIEAAKWMPLVEFVEQPLIQEDSMFKKIIDICIACLEKLHDIEYGFGAHEYPSSGVFEVEPRSCPGFIFRRSVLLGSTDMSNSEFRAFIEHLSAKYHGDTYHLIAKNCNHFTDEVCQHLTGSPIPGWVNRMARVGSFCNCLLPESLQVAAVRHLPERLAFDDDDGSASDGLSASLEGEEDESNHHLLTGPNGDVAFLKEKPVRLAREHL

SEQ ID NO: 153417 - protein, 737 aa, Glycine max
  Coding DNA Sequence Number=SeqID_61732
  Gene Ontology: Mol. function=endonuclease activity; Cellular component=nucleus; Biological process=response to DNA damage stimulus
  Homolog annotation: Hit_ID=Q9LKI5; Match level="QueryCoverage=95%, HitCoverage=69%, E-value=0.0, Identity=62%"; Hit description=DNA repair endonuclease UVH1
  Pfam annotation: Domain name=ERCC4; Domain location=500-580; Score =126.4; E_value=8.5e-35; Accession=PF02732.6; Description=ERCC4 domain
MPCLSNLAILLDFGLNCLSEECSAYNRVWLPFDRYDAVTYLKYLDTLRVSESFRSVWIFAEASYKIFDYAKKRVFHLVRADGVKFNESSKSVKNKKRRTKGDDKDIEEAVDGTSSSSSNAGLILEEVLEEAPKWKVLRNVLEEVEEERQKQGMLREEVLAEGEDTNNGIVLVACKDERSCLQLEECITNGPKKVMHEEWKKYLLNKVQLRDIVNKKKKPKDPKPKGFGILDGVTPIKPVQSAETTSISKQEHDALLAAASKLRNIAENDHVGEDTPQPDSGGQGRAKRKRKVGIRNDPVILDGSGVQNNNKAQSTSDKIGMSDSKNKIDEDETNPISAGRFCETMQGETSVENIVLRRHTNPDAAARNGKSLPPVYFYALESDQPILDILKPSIVIVYHPDMTFVREIEVYKAENPSKRLKVYFIFYEDSSEVQKFEASIRRENGAFESLIRQKSLMMIPVDQSGHSLGLNSTLESDLNTPQNFVTRKAGGRKEAEKEMQVIVDMREFMSSLPNVLHQKGMNIIPVTLEVGDYILSPLICVERKSIQDLFMSFTSGRLYHQVETMVRYYRIPVLLIEFSQDKSFSFQSASDIGDDVTPNSIISKLSLLALHFPRLRIIWSRSLHATAEIFASLKANQDEPDETKAIRVGVPSEEGIVENDVRFHCCHRAENYNTSAVEFLRRCPGVTDSNYRAIMDGCKSLAELALLPVEKLAELMGGHKAARTLRDFLDAKYPTLL

SEQ ID NO: 153418 - protein, 109 aa, Glycine max
  Coding DNA Sequence Number=SeqID_61733
MGIPRGHLESRLGLAHSHIILTLSHTFEWGPIPEPWSLCPHLQKSMMMSFASMPTPQPAKCTLDLLIGEKKVPQRLKKRVRIKDGEEGFAVVIDEKERKDMQNRGKREA

SEQ ID NO: 153419 - protein, 87 aa, Glycine max
  Coding DNA Sequence Number=SeqID_61734
  Subcellular localization annotation: CTP_CleavageSite=56; ConfidenceScore=5.00e-01
MVNKSRKGHRNHLKKKTTKESGKKLRAWVTLGNWSEKQGSGKKRNRGFRFRSGKKRVAMHVQLDSSLVSHFSLPLKARASQHFCVFS

SEQ ID NO: 153420 - protein, 463 aa, Glycine max
  Coding DNA Sequence Number=SeqID_61735
  Gene Ontology: Biological process=protein localization
  Homolog annotation: Hit_ID=A2ZAC0; Match level="QueryCoverage=88%, HitCoverage=9%, E-value=6e-84, Identity=46%"; Hit description =Putative uncharacterized protein
MEMALRASENSLANGDLGFTLCSREREQRRLHKNTAPISGLSETSSDHEDTEPEQDNHGMIDVGIAERLFVTGVLDELKICFSYSYQSDQSLMKVLLNEEKRLFEFRAIGVQVEVSIRDNNIFVGTILKSLEIEDLVCGSQRWSQPCFLARSYIGTADENLLFYNTMTRDVESGGLIPTETDDKFYEAPETLADSVDYPMQSPGGTSEYPSSSPSKIQFNYSSLELPKFSRITGLLPSDTPSIRKELELNDTLESFVKAQIIIYDQNSAQYKNIDKQVIVTLATLTFFCRRPTILAIMEFMNSINIEDKNLATSSDSSSTAARMINDISRDVDDLQATAIEEHAVKGLFGKGKSRVMFNLTLKMAQAQILLMKENETKLACLSQESLLTDIKVFPSSFSIKAALGNLKISDDSLPSSHLYYWACDMRNPGGRSFVELLKANKNYPLLIQKTLSNMAGPVIKMQ

SEQ ID NO: 153421 - protein, 761 aa, Glycine max
  Coding DNA Sequence Number=SeqID_61736
  Gene Ontology: Biological process=protein localization
  Homolog annotation: Hit_ID=A7PCG9; Match level="QueryCoverage=95%, HitCoverage=45%, E-value=0.0, Identity=53%"; Hit description =Chromosome chr2 scaffold_11, whole genome shotgun sequence
MVTFDVCISFKVPWSRLGQDPVLVYLDRIFLLAEPATQVEGCSEDAVQEAKKSLIQEMELKLWEKSQQLKSEMHHPCTQGSAELLNFWTYLKWFNYTKPDSKSLVDVGLNTTLEATIKVASKEAVIKAGTIIGNLKLSISNIHIRYEDGESNPGHPFAAGVMLDKLLAVTVDDSGKETFITGGALDRIQKSVELDRLAVYLDSDIIPWHVNKAWEDLLPSEWFQGKLVCFCALSRRFDGSLLLLVDCTYWLGVRVFFYPDPVKDGGWEIFKFGTKDGKPADNLLRKHSYLLQPVTGKAKYSKLLPTEVADSKQPLQKAMVNLDDVTISISKDGYGDIMKLADNFAAFNQRLKYAHYRPLVPVKADSRSWWKYAYKAVSDQIKKASLTELVVYVSKRAMYEGAYQKDPTRWVLMQWVALYDRASLDTVVRLLSCDTEVKGSNRRNSLSTCNGEAVYIYPPQIPLDGGKMSWEQVLRYASLRKRYISLYASLLKSDPTQVTISGNKEIEDLDRELDIELILQWRMLSHKLLEKSAESNHNMRKQKAQKSWWSFGWTSQSSKEESEEFNFSEEDWNQLNKIIGYKEGDDGQLAVNSKADVIHTFLEVHMNHNASKLIGETKESVAELSCEDLSCSIILYPETKVFDIKLGSYKLSSPKGLLAESATSYDSLVGVFHYKPFDDKVDWRMVAKASPCYMTFGQYMKDSIDQIVKFFESNTAVSQTIALETAAAVQNKCSIDSELEEYIMKLTSSLVHPITQMMVDL

SEQ ID NO: 153422 - protein, 247 aa, Glycine max
  Coding DNA Sequence Number=SeqID_61737
  Gene Ontology: Biological process=protein localization
  Homolog annotation: Hit_ID=A7PCH0; Match level="QueryCoverage=58%, HitCoverage=19%, E-value=1e-47, Identity=60%"; Hit description =Chromosome chr2 scaffold_11, whole genome shotgun sequence
METSVTLVGDEAGIVRGNFMCQGPMWGVGYMNCTTPFGLTENLTFRYLKLHLGADAIALAHLTLSHIVYYLKILTSFTVAAEVLTQPPPLPGLRTGYETIGGFTSFSNDDEDYEGYDFSLFGELSEVRIVYLNRFVQEVVGYFMGLVPDSPKSVVKVTDQVTNTEKWFSASEIEGSPALDIVHITVKNTFQWIGGSKSEINAVHLETLTVQGKDLDVFPALCAHYDVEDINLNVGTGSNIGESLIQD

SEQ ID NO: 153423 - protein, 440 aa, Glycine max
  Coding DNA Sequence Number=SeqID_61738
  Gene Ontology: Mol. function=transcription regulator activity; Cellular component=nucleus; Biological process=regulation of transcription
  Homolog annotation: Hit_ID=Q69SJ2; Match level="QueryCoverage=29%, HitCoverage=96%, E-value=2e-45, Identity=67%"; Hit description =Vacuolar protein sorting 55 protein-like
  Pfam annotation: Domain name=PPR; Domain location=258-291; Score =10.1; E_value=0.5; Accession=PF01535.11; Description=PPR repeat
  Pfam annotation: Domain name=PPR; Domain location=292-325; Score =11.6; E_value=0.33; Accession=PF01535.11; Description=PPR repeat
  Pfam annotation: Domain name=PPR; Domain location=368-402; Score =34.0; E_value=5.5e-07; Accession=PF01535.11; Description=PPR repeat
  Pfam annotation: Domain name=Vps55; Domain location=17-133; Score =194.5; E_value=2.6e-55; Accession=PF04133.5; Description=Vacuolar protein sorting 55
  Pfam module annotation: Pfam domain module=PPR::PPR::PPR::Vps55; Domain location=258-291::292-325::368-402::17-133
MADLPGYLHACLNTGKLASLAILVSGGIVLQILACALYNNWWPMLSVLTYVLLPMPLLFFAGSDDSIFSESDNSWVNFTKFLTGASTVGGIAIPSILKHAGVIGWGAFAMELSSYFVFGMAVICYLWMSGDDDYNHAKLGGVGLNGGEDLPAAGLEVFGDGAIAGERDLVVGGGHGAKLENRDGGVRGPGNLHGAVHPWGLSEGSLFVLVNSWGIDDYDGRLRRGVVRMYSGFGLMDSACNVFEAQELFDMIPIQNKVVSTCMIAGYLSAGQVLKAWNLFNDMPGSDRDSIAWTEMIYGYVQNDLIAKAFCLFVEMMAHGAAITWYAIEDVYEDDLILENSLIAMHAKCGEIDDACRIVSNMTYRDKISWNTMIMGLSDHGRANEALKEYETMLEFGIYPDGLTFLGVLTACAHVSLVDKGWETGSYCLPWLMLMLFNLV

SEQ ID NO: 153424 - protein, 1108 aa, Glycine max
  Coding DNA Sequence Number=SeqID_61739
  Gene Ontology: Mol. function=hydrolase activity; Cellular component =cytoplasm; Biological process=mRNA catabolic process, nonsense -mediated decay
  Homolog annotation: Hit_ID=A7PCF0; Match level="QueryCoverage=97%, HitCoverage=84%, E-value=0.0, Identity=87%"; Hit description =Chromosome chr2 scaffold_11, whole genome shotgun sequence
  Pfam annotation: Domain name=ResIII; Domain location=323-462; Score= -5.7; E_value=0.00015; Accession=PF04851.6; Description=Type III restriction enzyme, res subunit
  Pfam annotation: Domain name=UPF1_Zn_bind; Domain location=1-113; Score=210.9; E_value=3.1e-60; Accession=PF09416.1; Description=RNA helicase (UPF2 interacting domain
  Pfam module annotation: Pfam domain module=ResIII::UPF1_Zn_bind; Domain location=323-462::1-113
MVRAKHKEVCLHKDSPLGETILECYNCGCRNVFLLGFISAKTESVVVLLCREPCLSVNALKDMNWDLSQWCPLIDDRCFLQWLVKIPSEQEQLRARQISAQQINKVEELWKTNPDASFEDLEKPGVDDEPQSVALKYEDAYQYQNVFAPLIKLEADYDKMMKESQSKDNVTIRWDIGLNKKRVAYFVFPKEDNELRLVPGDELRLRYSGDAAHPAWQSVGHVNSTRGTEEIRYKTPKIKLTAQEEVALELRANQGVPVDVNHGFSVDFVWKSTSFDRMQGAMKTFAVDETSVSGYIYHHLLGHEVEVQMVRNALPRRFGAPGLPELNASQVFAVKSVLQRPISLIQGPPGTGKTVTSAALVYHMAKQGQGQVLVCAPSNVAVDQLAEKISATGLKVVRLCAKSREAVSSPVEHLTLHYQVRHLDTSDKSELHKLQQLKDEQGELSSSDEKKYKALKRATEREISQSADVICCTCVGAGDPRLANFRFRQVLIDESTQATEPECLIPLVLGAKQLGPVIMCKKAARAGLAQSLFERLVLLGVKPIRLQVQYRMHPCLSEFPSNSFYEGTLQNGVTVNERQSSGIDFPWPVPNRPMFFYVQMGQEEISASGTSYLNRTEAANVEKIVTTFLKSGVVPSQIGVITPYEGQRAYIVNYMSRNGALRQQLYKEIELLHEFYSFQVASVDSFQGREKDYIILSCVRSNEHQGIGFLNDPRRLNVALTRARYGIVILGNPKVLSKQPLWNSLLTHYKEHECLVEGPLNNLKQSMVQFQKPKKIYNERRLFYGGGPGIASNDNFGNVGSGAGTSSDRRSSRGRGSYIPPGPPNGTHKPGVHPAGYPPVPRVPLPHFHGGPQSQPYAIPSRGAVHGPVGAVPHVPSPGSRGFGAGRGNSGAPPIGNHLPHQQGTQQPIGSTFNFPALENPNSQPSVGGPLSQPGFANNMHVQGAGQSFRDQFSMPGMSQDFLGDDFKSQGSHVPYNVTDFSTQASQSGYAVDYATQGAQGGFPGNFLNQNSQAGYSRFGSGNDFMSQDYMGHGSQGLFTQVGFSDPLQDDATQSHFSVANANPLQSQMNSLYSQPFAHYNTQPLNMQATQQQPQAQNSQNQKIHYNV

SEQ ID NO: 153425 - protein, 296 aa, Glycine max
  Coding DNA Sequence Number=SeqID_61740
  Gene Ontology: Mol. function=hydrolase activity; Cellular component =membrane; Biological process=metabolic process
  Homolog annotation: Hit_ID=A9PG52; Match level="QueryCoverage=78%, HitCoverage=94%, E-value=1e-107, Identity=79%"; Hit description =Putative uncharacterized protein
  Pfam annotation: Domain name=Hydrolase; Domain location=68-256; Score= 114.2; E_value=4e-31; Accession=PF00702.17; Description=haloacid dehalogenase-like hydrolase
MTVSSENCVSSRRGAGIHMHAIWFALLDIKTVMCLRPTVYDFKTVSLWQEVKFQDKGSQSSLTRLAPLEAVLFDIDGTLCDSDPLHYYAFREMLLEIGFNEGVPITEEFFIETVAGKHNDDIASVLFPGDLERGLKFVDDKEAMFRRLAAEQVKPLNGLDKVRKWIENHGLKRAAVTNAPRANAELMISILGLSDFFDAVIIGGECERAKPHPDPYLKGLEALKASKDHTFVFEDSVSGIKAGVAAGMPVIGIATRNPENLLMEAKPAFLIKDYEDPKLWAALEELDKAGAFSLNY

SEQ ID NO: 153426 - protein, 553 aa, Glycine max
  Coding DNA Sequence Number=SeqID_61741
  Gene Ontology: Mol. function=GTP binding; Cellular component =intracellular; Biological process=small GTPase mediated signal transduction
  Homolog annotation: Hit_ID=Q2QZ37; Match level="QueryCoverage=61%, HitCoverage=86%, E-value=3e-56, Identity=35%"; Hit description =GTP1/OBG family protein, expressed
  Pfam annotation: Domain name=GTP1_OBG; Domain location=226-390; Score= -87.5; E_value=0.003; Accession=PF01018.13; Description=GTP1OBG family
  Pfam annotation: Domain name=MMR_HSR1; Domain location=432-536; Score= 60.3; E_value=6.7e-15; Accession=PF01926.14; Description=GTPase of unknown function
  Pfam annotation: Domain name=Ras; Domain location=4-131; Score=33.4; E_value=6.6e-12; Accession=PF00071.13; Description=Ras family
  Pfam module annotation: Pfam domain module=GTP1_OBG::MMR_HSR1::Ras; Domain location=226-390::432-536::4-131
MASVFLGDQSVGKPASSLASWTQLDRKDLEVLFQATLGTHLLLYVIAYDVASRQTFLNTSRWIEEVRIERGSDAIIVHVGNKTDLVNKRQVSTEEGEAKSRELNVMFIEASAKAGFNIKALFRKIAAALPGMETLSSTKQEDMVDVDLRSFGGYQSQPQSGGSATTAPLNCSATRLVVALEDKATVIKHTEAFTQRCISRWSVTLYARYSDIPQNKSKLAPLQRRMVDQCKMFAKAGDGGNGCSILRKGRSDEMWMLCNGGYDNATLVSVFNVGGNGGRGGDVILLTACVSIGTVLHLVNGDIPSVVKTQSSTDVDPWDIPGALVDDVPDPSNGSTSSVTNEETDVKKSEKSRQVASTDVFSQLSTSNGAPEFGTEDIGEKQEILYNVAELTEEGQQIVIAHGGEGGLGNVSCSKDSRKPVTVQDPDTLSANAGKSTLLGAISRAKPAVGDYAFTTLRPNLGNLDYDDLSITVADIPGLIKGAHQNHGLGHAFLGNTKCTKGIPPWEQLRNLILELEYHQDGLSNRPSLIVANKTDEEGIADLKAGLKDARQC

SEQ ID NO: 153427 - protein, 333 aa, Glycine max
  Coding DNA Sequence Number=SeqID_61742
  Gene Ontology: Cellular component=integral to membrane
  Homolog annotation: Hit_ID=A9P8P8; Match level="QueryCoverage=88%, HitCoverage=97%, E-value=1e-86, Identity=56%"; Hit description =Putative uncharacterized protein
  Pfam annotation: Domain name=Tetraspannin; Domain location=6-196; Score=-42.0; E_value=0.022; Accession=PF00335.11; Description =Tetraspanin family
MACRGCWECLLKLFNFILTLTGLAIVGYGIYLFVEFSKASDDDNMPAISPVSDDSSLIQLGRPVLMAVSLSNDFFDNLPRACEIVKVKLLEWLVNRLWTCGYERIGASKAVCAYIYALIVLIKGIVIKFLKPIKYSILVALLILVELGCAAFIFFDKNWKEQIPTDKTGEFDAIYGFLIENWNIMKWVALGIVIFEALLFLLALIVRAANRPADYDSDEEFINPRQQVQQPLLNRLPAGPATGIPVAGTIDQRPSRNDAWSTRMREKYGLDTSEFTYNPSESNRFQQLGGVSSEVVDAPILLLQSQCLLWPMFCPWSLLACWENYDLVLKGSD

SEQ ID NO: 153428 - protein, 381 aa, Glycine max
  Coding DNA Sequence Number=SeqID_61743
  Gene Ontology: Mol. function=aspartic-type endopeptidase activity; Cellular component=cellulose and pectin-containing cell wall; Biological process=proteolysis
  Homolog annotation: Hit_ID=A7QY84; Match level="QueryCoverage=99%, HitCoverage=81%, E-value=1e-148, Identity=67%"; Hit description =Chromosome chr2 scaffold_241, whole genome shotgun sequence
  Pfam annotation: Domain name=Asp; Domain location=2-367; Score= -118.6; E_value=1.4e-06; Accession=PF00026.14; Description=Eukaryotic aspartyl protease
MDTGSDLVWFPCAPFECILCEGKFNATKPLNITRSHRVSCQSPACSTAHSSVSSHDLCAIARCPLDNIETSDCSSATCPPFYYAYGDGSFIAHLHRDTLSMSQLFLKNFTFGCAHTALAEPTGVAGFGRGLLSLPAQLATLSPNLGNRFSYCLVSHSFDKERVRKPSPLILGHYDDYSSERVEFVYTSMLRNPKHSYFYCVGLTGISVGKRTILAPEMLRRVDRRGDGGVVVDSGTTFTMLPASLYNSVVAEFDRRVGRVHKRASEVEEKTGLGPCYFLEGLVEVPTVTWHFLGNNSNVMLPRMNYFYEFLDGEDEARRKVGCLMLMNGGDDTELSGGPGAILGNYQQQGFEVVYDLENQRVGFAKRQCASLWDSLNRDKN

SEQ ID NO: 153429 - protein, 93 aa, Glycine max
  Coding DNA Sequence Number=SeqID_61744
  Gene Ontology: Mol. function=oxidoreductase activity; Cellular component=extracellular region; Biological process=hydrogen peroxide catabolic process
  Homolog annotation: Hit_ID=Q9SLH7; Match level="QueryCoverage=80%, HitCoverage=22%, E-value=2e-25, Identity=77%"; Hit description =Peroxidase 20 precursor
  Pfam annotation: Domain name=peroxidase; Domain location=1-92; Score=- 56.4; E_value=0.0013; Accession=PF00141.14; Description=Peroxidase
MWKWMTSEKLAGLNLNSLRGFEVIDKIKFLLEEECPITVSCADILAMAARDAVELRGGPRWEVLLGRKDSLESSFGGANIHSCSKFIFRGFHR

SEQ ID NO: 153430 - protein, 100 aa, Glycine max
  Coding DNA Sequence Number=SeqID_61745
MDVVKLMFSTYVAPLTSNEEGCTLSEFMHYYDCGCSSPHRRLLYVEKNITRAMIDPNFEVERSQFHRVRIDVSDGIEVDMAFDGGRQFEGKTRKTKSWDG

SEQ ID NO: 153431 - protein, 126 aa, Glycine max
  Coding DNA Sequence Number=SeqID_61746
MLPDIVPVEAIDENVSAEVQEVYSGSSHRHIRSSVSNSKFSDEEAYRRRRINTGYGSSAADLWLRGGGGANKRRRRRREEGARQNEEMLENDESAFLAHRTPIRQHPNPVQQCTLTARASLVNVFY

SEQ ID NO: 153432 - protein, 549 aa, Glycine max
  Coding DNA Sequence Number=SeqID_61747
MEDKKKDQERGFVCNQESQTNYEPQNNLQNGQPNVSVGPIAKISSPPPSRDNTPYSNQQQQPPIVPWPYTPQNATMHFPTQASPPGALNQWPQFAYSQLFAQSASPFWQPQPPGANAPKFFQPFTDTGFRGGPSSTIQTPLPNMCYNYTFPGFPNSWNPSSYMAQLYQMQHPYVFSFPGAPNFSSATPKVPDCLASGEHSSQKGIMRPPSKLSQKHQQLWEAQSAENVKLWSVINKLQAEVSDHKDRLKKLEEEVSSFKKEAEVLTNKVIGTIPILTEQPTKRGRAKRSLALVDASYESHLPAGGKKPALSNSLYQSKSPFGAVKSSIFEKVILKKVENKEITTRSNTKMVQHESNVKDVGPLESTCNTQINHSNPIMSACQGQVHQEYLGIQTCGIGVSVNSGKDEDLKVVNSEPSQPDKVLNNSSMVVSAKYAGNTGNGNFGLTSGIPSQDTPKDVLDVARGSFIQQGGNITPGWSLSFANEEDALEDVEDAMEESAKDENEVMGDDTSPAAVEIGVTKDLGGGWLPHDDAMATSPKAKAMSPLNDW

SEQ ID NO: 153433 - protein, 677 aa, Glycine max
  Coding DNA Sequence Number=SeqID_61748
  Gene Ontology: Mol. function=nucleotide binding; Cellular component =nucleus; Biological process=nuclear organization and biogenesis
  Homolog annotation: Hit_ID=A7QZH9; Match level="QueryCoverage=97%, HitCoverage=62%, E-value=1e-148, Identity=44%"; Hit description =Chromosome chr7 scaffold_275, whole genome shotgun sequence
MATPITPDSATLASRDPWKRLKQPAFDDNSIQRKDKAALIYDQLHHMGCLIFERKLLAFKYEQVKASIDSSEFMHKHDSAMNLSALIEARKREESLKMAIGINEACIASLEKALHEMRTECAETKVSAESKVSEAHQLIDEAQKKSTEAEAKLRAAESFQAEACGYYSVADRKLRDVEAREDELRRQIKSFKSEYVFKYFFGEYRALLYTRNAKDELTVDAAIPHLSNTLGVTLQFHILVAQPERGPHLFSRSQELDSLQKELEDTKTNTNKEHGALCDEKTNLKLMEATLTIREEALSKRESELNKKEQELLDLQVKLASRESDETQKVKAVQEAELGARKTNFEAELQIQLKLVENEIEMKRWAWELKEVDLTQREEKLQEREHELEILSRTLGEKEKDLVDMSSALKEKDQSLRASEKELELNKVLLQKDKEEINKTKLDVQMSLVSLENNLRQFDNAKERHEALKSETNDLSVLEVKLKEEIDVVRSQKLEIVAEADKLEAEKAKFEAQWELLDEKKEELRKEAEYIAEEKKAVSAFIKKERDKLRQEKENMRDQYKRDLESLTCEREEFMNKMAHEHDDWFGKMQQERANFLRDVEMQNRNMNILIDKRREEIESYLKEREKSFEEEKNNQLEYINALKEKVAKEYKQVSFEMRRLEVERPEISSDCEQRNK

SEQ ID NO: 153434 - protein, 45 aa, Glycine max
  Coding DNA Sequence Number=SeqID_61749
REKNPGDIGEVSPFPPVANDKKNYAALPVKPQFPADKRQPARNSN

SEQ ID NO: 153435 - protein, 1423 aa, Glycine max
  Coding DNA Sequence Number=SeqID_61750
  Gene Ontology: Cellular component=endoplasmic reticulum membrane; Biological process=vesicle-mediated transport
  Homolog annotation: Hit_ID=A7R6A4; Match level="QueryCoverage=100%, HitCoverage=100%, E-value=0.0, Identity=53%"; Hit description =Chromosome undetermined scaffold_1205, whole genome shotgun sequence
MASNPPFPMEDQTDEDFFDKLVEDDMEPVKSGHDEGYDSDEAKAFANLGINDVDAAAFENSNAAESGVEVKGEFSNVESDVGLEQEGNLMPVVSSVGFDGKVDPREDGIGMGSEVTSASASAVGTSDTAGSSGIKEVGWNSFHADLNGGGGLGSYSDFFSDLGDQSGDFTGNVYDNLSSEVKPDSAVQNDGLNASGNYVQYHEGQGYDGSLENRSNWQGDGLNASVNHVQYQEDQAYVASSEEHTNGQDLSSSQYWEDLYPGWKYDHKTGQWYQIDGNSATATTQQSSEANTAADWTAASDRETEISYMQQTAQSVVGTLAETGTTENVSSWSQVSEGNHGYPEHMVFDPQYPGWYYDTIAQEWRSLETYNSTIQSSGHGHENGNASANTFSPNDHSLYSEYSQADNYGQQGFDNQAVDGSWSGLYGTNHKQGFDMYTTGSATTRGDSITSGGNQQINHSYGSSISVNEHQQNTSSSFGSVALYNRVNHDRGLANGTFEPQSFGPTGDTVQQFNYSTTKFSEQKVFSNDFTENQKPFSYSPQSIQGGHQYSHAPHVGRSSAGRPSHALVTFGFGGKLIIMKDPNLLSSSYGSQNSVQGSVSVLNLIEVVMGNMDSLSIGDNTSNYFHALSQQSFPGPLVGGSVGSKELYKWLDERIAHCESPDMDYKKGERLRLLLSLLKIGCQHYGKLRSPFGTDTILKEYDTPESAVAKLFASAKTSGTQYGMPSHCLQNLPSEGQIRAMALEVQNLLVSGKKKEALQCAQEGQLWGPALVLASQLGEQFYVDTVKQMALRQLVAGSPLRTLCLLIAGQQAEIFSTDTSISGHPGASDMSQQSPQVGSDGMLDDWEENLAVITANRTKSDELVIIHLGDCLWKERSEITAAHICYLVAEANFESYSDSARLCLIGADHWKCPRTYASPEAIQRTELYEYSKVVGNSQFTLHPFQPYKLIYAFMLAEVGKVPDSLKYCQALLKSLKTGRAPEVESWKQLALSLEERIRIHQQGGYAANLAPAKLVGKLLNFFDSTAHRVVGGLPPPAPLPSQGTIHGSEQQYQNMAPRVSSSQSTMSLAPSASMEPISEWTADNNRMAKPNRSVSEPDIGRIPRQETTSPDAQGKAQASGGTSRFSRFGFGSQLLQKTVGLVLKPRSGRQAKLGEKNKFYYDEKLKRWVEEGAEVPAEEASALPPPPTTAAFQNGSTEYNSRFALKTESSPPIEGSNIRTASPELSPGMPPIPPSANQFLARGRLGVRSRYVDTFNQGGGTSANLFQSPSVPSVKPALAANAKFFVPTPAPSSNEQAMDAIAEGKQEDSATNEYPSTSATNDWSYRSPKHVSSTAIQRFPSMGNISKQGATEGSNSHLPHSRRTASWSGSFNDSFTPQKMGNMKPLGEALGMPLSRYSPDESSMHKPVKSSSYGEDLHEVEL

SEQ ID NO: 153436 - protein, 467 aa, Glycine max
  Coding DNA Sequence Number=SeqID_61751
  Gene Ontology: Mol. function=transferase activity, transferring hexosyl groups; Cellular component=soluble fraction; Biological process=carbohydrate biosynthetic process
  Homolog annotation: Hit_ID=A7QY80; Match level="QueryCoverage=91%, HitCoverage=90%, E-value=0.0, Identity=72%"; Hit description =Chromosome chr2 scaffold_241, whole genome shotgun sequence
  Pfam annotation: Domain name=Glyco_transf_8; Domain location=50-268; Score=-3.4; E_value=2.3e-06; Accession=PF01501.11; Description =Glycosyl transferase family 8
  Subcellular localization annotation: CTP_CleavageSite=27; ConfidenceScore=5.05e-01
MGRNAAAAAASLRWSTTLLLLLLGLVVGTKATSYRRNAYATMMYVGTPRDYEFYVAVRVLLKSLSKLNVEADLVVIASVDVPLREEEDGAKVVRVENMDNPYKRQDNFDKRFKLSLNKLYAWSLVDYDRVVMLDADNLFLQNTDELFQCGQFCAVFINPCVFHTGLFVLQPSMVVFKDMVRELQNGRENPDGADQGFIASYFPELLDKPMFHPPSNGTKVDGTYRLPLGYQMDASYYYLKLRWSVPCGPNSVITFPGAPWLKPWYWWSWPVLPLGLQWHEQRRQTLGYGAELAVILIQSAIYVGVIAMTRLARPSFSKLCYRRSDKSITLVHNSLKLVALWCILAAYVTPFFIIPHTVHPLLGWILYLLATFALCSIAINIFMLPMLPVLVPWLGIVGVLMVMAFPWYPDGVVRALFVFAYAFCSAPFLWASMVRIVQGLQLSLEREAFLPARLGESSPNSWFNKLY

SEQ ID NO: 153437 - protein, 253 aa, Glycine max
  Coding DNA Sequence Number=SeqID_61752
MTVIPTSTTAFHGCHSSPNHHNPQHPPNHLELSPASMDRLEVALAKLTLSQLNLVVAIDTLATTIDNLLQRLSPRNATPHFSSPVPVQALATIISTLLMSTLRLIPTSPPMPSLSPMPTPSPMPTPLPMPPSPSMPHPLPMLTVPSCPAPVQSFLPPLSSPLPMPVLHLPNLGLVCTTISFNKFFSIVPLYGTTMAAYKLQSVAFALCSRAKLGAIHQNRPWDPGITFGSHALNPNTLRTRCFCKGREMIERQ

SEQ ID NO: 153438 - protein, 170 aa, Glycine max
  Coding DNA Sequence Number=SeqID_61753
  Pfam annotation: Domain name=VQ; Domain location=39-69; Score=37.1; E_ value=6.2e-08; Accession=PF05678.5; Description=VQ motif
MEAYYSGSYPASTKPISLLHTVRKVQAKPWKKAAVAPPAPTPIRVYKVDAINFRDLVQQLTGAPEFKPADQEQHQLFPSVAPIAATFVDTPQKPMLSSKDNIAASSTVSSATNWYQGAKSEPLEMNLSSPSSYNWFFVPPISQGNMTSLEPGRLLSTVCFIWTSERTPAI

SEQ ID NO: 153439 - protein, 140 aa, Glycine max
  Coding DNA Sequence Number=SeqID_61754
MDKAEAIPALIPNELKPVETALIDDGSRFDIISGNLDDYDNASTSGNEEHDSQTTEKLTRAQRKKIRKKKLKEEAIHRGKLIGPLLPLTPTQVPEDAPTVRSNAPEEGDEDVGACAKSVKVKHRRMAKRLAKEKQNASIS

SEQ ID NO: 153440 - protein, 456 aa, Glycine max
  Coding DNA Sequence Number=SeqID_61755
  Gene Ontology: Mol. function=protein binding; Cellular component =nucleus; Biological process=regulation of transcription, DNA -dependent
  Homolog annotation: Hit_ID=A8R3J0; Match level="QueryCoverage=98%, HitCoverage=99%, E-value=1e-153, Identity=58%"; Hit description =Putative SHORT-ROOT protein
  Pfam annotation: Domain name=GRAS; Domain location=79-362; Score =225.6; E_value=1.1e-64; Accession=PF03514.5; Description=GRAS family transcription factor
  Subcellular localization annotation: CTP_CleavageSite=30; ConfidenceScore=5.13e-01
MDTTLFRVVSSFQHHQADQDHQSLNNSTTSSSSRSSRQEQNYPYPQEHDEECFNFFMDDEDLSSSSSKHYYPYQPHPPSTTDHSFSPTPGVDVVFPFEFSSGKWAQDILLETARAVADKNTTRLQQLMWMLNELSSPYGDTDQKLASYFLQAFFSRITQAGDRTYKTLASASEKTCSLRINPQDGAEPKLHIVDISNTYCTQWPTLFEALATRNDDTPHLRLTSVVTAGATAQKVMKEIGARMEKFARLMGVPFKFNVVHHVGQLSDLDFSVLDIKEDEALAINCVNTLHSIAAVGNHRDAVISSLRRLKPRIVTVVEEEADLDIGLEGFEFVKGFEECLRWFRVYFEALDESFPRTSNERLMLERAAGRAVVDLVACSPADSVERREKAARWARRMHGGGGFNTVAFSEEVCDDVRALLRRYREGWAMTQCSDAGIFLTWKEQPVVWASAWRALT

SEQ ID NO: 153441 - protein, 836 aa, Glycine max
  Coding DNA Sequence Number=SeqID_61756
  Gene Ontology: Mol. function=binding; Cellular component=nucleus; Biological process=mitotic chromosome condensation
  Homolog annotation: Hit_ID=A7PLQ2; Match level="QueryCoverage=89%, HitCoverage=77%, E-value=1e-158, Identity=43%"; Hit description =Chromosome chr7 scaffold_20, whole genome shotgun sequence
MVEGEFGGKRVLNFSESPIPAVKVAHPEEEGGRAQGLRASRGVRSVRFRRREHRGFEAVVGSVLDFTLVFEDGAWEAVSGVCVWAERSAWEGISGDDSVADFVREEVDAGGLWGYSVSGELIEAAIHAGSGVFAWYIRRVFGTFINQRTTDGVEKMLYRLAEPVIFSSLQVANSNVRQNALHLLLDMFPLEDPDATKEEKDTLLDKQFFLLERLLTDDCLEVRIIAVEGSCRILHLFWEVIPSPIITKVMTKIFDDMSHDGCNEHLMLDKVLAIRVAAVAELDVLLSALASDQPPVAQKITKLLIPSYFPSKIPIEEACNRCITLLKRAPMAGARFCQVAILEGAFKSHLMELVKVFLSWILAPDKLDANQIEGFLFATSYVCDSLACEPCYINALKELLDGEKMKGLLTVASKGQAQSSLFNIVSIVCPDDVAGLLEWIGVVTNCSGLPEDVDQQTKIRSAHKLLLSLGGFDDLIEALTAFLHKAAYRCHIKFGADMPSQSVGVAWQVRDLLLHEDSRKAILKSQSLEMWFVSLKLISDVSTVHCGHHEYMDVSPVLAYIALALQMTVDNVDRSSIQNGDTKRKKTKIDSSTLLSENILELTIEHVLNCLEKLFGADDIMKNHDADSSKILNVILTDSCESSITLPKAFALANNLLDLIISIESCMRSGYAVRIVAAAKTWLPDVLLALGSTSILKHTDCGEEHSTASEQMKLHFPKWPLILAKTELFEVNKAEDDESSQPEKFSAFTKLMEMLIILLKKIPSIMDAVGVIFMVSSVIGLEQKDFGMALGLLWIEREIAEENDDELEKLTYAKELIEPLWMYHLYETGRVSLADD

SEQ ID NO: 153442 - protein, 507 aa, Glycine max
  Coding DNA Sequence Number=SeqID_61757
  Gene Ontology: Mol. function=amino-acid N-acetyltransferase activity; Cellular component=cytoplasm; Biological process=amino acid biosynthetic process
  Homolog annotation: Hit_ID=O81008; Match level="QueryCoverage=92%, HitCoverage=67%, E-value=1e-161, Identity=66%"; Hit description =Putative amino acid acetyltransferase
MERAATMGRWRISNSCVRFARPGLTCGPIVDIAFLNHLGIRFVLVPGTHVQIDKLLNERGCQPMYVGRYRITDDESLEAAMEAAGGIRLMIEAKLSPGPSICNIRRHGDNSRWHEVGVSVASGNFLAAKRRGVVNGIDFGSTGEVKKVDVTRMRERLDGGCVVVLTNLGYSSSGEVLNCKGKYRELNGTDFSAEYVNQNTTSVTNGTYEVATACALAIGADKLICIIDGPILDESGHLIRFLPLQEADMLIRKRAKQSDAAANYVKAVDEEGFNSLECNNFNGTVKSPPIGCFTEWHNATFHNGVGFENGNGLGSGEQGFAIGGQERLSRMNGYLEGKNLRASPGAAAAYNIPPPYLRIAKSLWAMGYEGGVQRVHLLDGTISGVLLLELFKRDGMGTMVASDLYEGTRTAEVKDISGIKQLIHPLEASGILVKRTDEELLKTLDSFVVVEREGHIIACAAIFPHFEEKCGEVACIAVSPDCRGQGQGDKLLGMLLPLWLVILVLDG

SEQ ID NO: 153443 - protein, 211 aa, Glycine max
  Coding DNA Sequence Number=SeqID_61758
  Gene Ontology: Mol. function=nucleotide binding; Cellular component =cytoplasm; Biological process=small GTPase mediated signal transduction
  Homolog annotation: Hit_ID=Q8VY57; Match level="QueryCoverage=100%, HitCoverage=100%, E-value=8e-90, Identity=81%"; Hit description=ADP -RIBOSYLATION FACTOR-like protein
  Pfam annotation: Domain name=Arf; Domain location=7-207; Score=105.2; E_value=2e-28; Accession=PF00025.12; Description=ADP-ribosylation factor family
  Pfam annotation: Domain name=MMR_HSR1; Domain location=20-159; Score =15.3; E_value=4.2e-05; Accession=PF01926.14; Description=GTPase of unknown function
  Pfam annotation: Domain name=Miro; Domain location=21-159; Score= -5.8; E_value=0.035; Accession=PF08477.4; Description=Miro-like protein
  Pfam annotation: Domain name=Ras; Domain location=24-209; Score= -48.3; E_value=1e-05; Accession=PF00071.13; Description=Ras family
  Pfam module annotation: Pfam domain module=Arf::MMR_HSR1::Miro::Ras; Domain location=7-207::20-159::21-159::24-209
MGLWEAFLNWLRSLFFKQEMELSLIGLQNAGKTSLVNVVATGGYSEDMIPTVGFNMRKVTKGNVTIKLWDLGGQPRFRSMWERYCRAVSAIVKEVSRLQLLESLSRLDYPSKVSCADHSYVVDAADPDNLSISRSELHDLLSKPSLGGIPLLVLGNKIDKAGALSKQALTDQMDLKSITDREVCCFMISCKNSTNIDSVIDWLVKHSKSKS

SEQ ID NO: 153444 - protein, 77 aa, Glycine max
  Coding DNA Sequence Number=SeqID_61759
MKIPATLDETKNVFPDFCPRLIYHSNVTKEFLSNEKKQVYFPAHVWQRRIYQMGKLFNLECGLIKESPPLLQSPCEP

SEQ ID NO: 153445 - protein, 247 aa, Glycine max
  Coding DNA Sequence Number=SeqID_61760
  Gene Ontology: Mol. function=molecular_function; Cellular component =membrane; Biological process=auxin mediated signaling pathway
  Homolog annotation: Hit_ID=Q9FGL0; Match level="QueryCoverage=100%, HitCoverage=66%, E-value=6e-72, Identity=56%"; Hit description =Nodulin-like protein
  Pfam annotation: Domain name=DUF6; Domain location=94-222; Score =34.3; E_value=4.5e-07; Accession=PF00892.11; Description=Integral membrane protein DUF6
  Pfam annotation: Domain name=TPT; Domain location=85-222; Score= -35.2; E_value=0.066; Accession=PF03151.7; Description=Triose -phosphate Transporter family
  Pfam annotation: Domain name=ThiW; Domain location=84-174; Score= -91.4; E_value=0.03; Accession=PF09512.1; Description=Thiamine -precursor transporter protei
  Pfam module annotation: Pfam domain module=DUF6::TPT::ThiW; Domain location=94-222::85-222::84-174
MGTAMPNIAPGLIFIIAWISGLEKVNLSNKYSKVKILGTLLCVLGALTMSIMQSISDPETVKNATVELTPPLPSGLAFDIQKILGCLYLVVAVFILSSNVVLQAFALGDFPAPMSLGAITSLIGAFLTAIFQFLEDNEMNWLLVRSGDLVGFFILAGAVSGICLSFNGWALKKKGPVYVSMFNPIGTVCSVVFSAVTLEDTISIGSLAGMFLMFTGLYLVLWAKGKEGHAGGDGLECECDAETPLLS

SEQ ID NO: 153446 - protein, 39 aa, Glycine max
  Coding DNA Sequence Number=SeqID_61761
MERKASVAQMALLILMQCCVSPHLAWTPSSNEVHNMFNG

SEQ ID NO: 153447 - protein, 541 aa, Glycine max
  Coding DNA Sequence Number=SeqID_61762
  Gene Ontology: Mol. function=heat shock protein binding; Cellular component=cytoplasm; Biological process=response to stress
  Homolog annotation: Hit_ID=A7PLM4; Match level="QueryCoverage=97%, HitCoverage=99%, E-value=0.0, Identity=61%"; Hit description =Chromosome chr7 scaffold_20, whole genome shotgun sequence
  Pfam annotation: Domain name=DnaJ; Domain location=67-131; Score =97.2; E_value=5.2e-26; Accession=PF00226.22; Description=DnaJ domain
MVYLAVAGAGYSSVVGINNRRPEFFISIIPNGAIPTLYFVASLCRCCREHGFSSASESAWTDFPVENAYELLGVSETSSFDEIKASFRKLAKETHPDLAESKNDSTASRRFVQILAAYEILSDSQKRAHYDMYLLSQKKLMQRHPGQGSKLQIYKSQATAFKEMEVVEWLKWYRLTINNILAEKKMVVGTGYFDVFERDFYSAIYAAYYGPEIQSMELLPDCFEAEERSSYETPEVLHLVSGRDLFGMVCLANKVPEISITNNEKLTSFRSFHSGLCQSITDLNVHKNAKRSDDFETHRGHSSKTSSIVSDAYRHLELHISGRVIATASRALPRCCSDEMQTEDTEDHIHVFLNLYEDPKHISSDFWKDYLANGAVGRRIHLGTISGLGSSPDEGSCYVYNDKGTKTHVIMKHRTLMVKHMHWYEVSEKVSVCECRCTRARLPPSKFWLFEPRCGFHDIGGWYVETYGKDKNGRTMPSQRFWDGLDYSEQADRRLHPAMYLFALAYRTLDLEYAKASKKSFRNVVGAQMFRILHWCKKLVQ

SEQ ID NO: 153448 - protein, 1094 aa, Glycine max
  Coding DNA Sequence Number=SeqID_61763
  Gene Ontology: Mol. function=aspartic-type endopeptidase activity; Cellular component=membrane; Biological process=proteolysis
  Homolog annotation: Hit_ID=A7NU59; Match level="QueryCoverage=59%, HitCoverage=98%, E-value=0.0, Identity=59%"; Hit description =Chromosome chr18 scaffold_1, whole genome shotgun sequence
  Pfam annotation: Domain name=Asp; Domain location=541-882; Score= -12.2; E_value=7.1e-13; Accession=PF00026.14; Description=Eukaryotic aspartyl protease
  Pfam annotation: Domain name=Nramp; Domain location=68-417; Score =692.2; E_value=3.8e-205; Accession=PF01566.9; Description=Natural resistance-associated macrophage protein
  Pfam module annotation: Pfam domain module=Asp::Nramp; Domain location=541-882::68-417
MPPEQTQQPLLSEEQEETAYDSSEKVVVVGIDDHDGDVEAPPFSWRKLWLFTGPGFLMSIAFLDPGNLEGDLQSGAIAGYSLLWLLMWATAMGLIIQLLSARLGVATGRHLAELCREEYPTWARIVLWLMTEIALIGADIQEVIGSAIAIRILSNGVVPLWAGVNYGVRKLEAFFAVLIGVMALSFAWMFGEAKPNGVDVLVGILVPKLSSRTIQQAVGVVGCIIMPHNVYLHSALVQSRQVDPSKKGRVQEALNYYSIESTIALIVSFVINIFVTTVFAKGFYGTEIANSIGLVNAGQYLQEKYGGGLFPILYIWGIGLLAAGQSSTITGTYAGQFIMGGFLNLRLKKWIRALITRSFAIIPTIIVALIFDTSEESLDVLNEWLNVLQSVQIPFALIPLLCLVSKEQIMGSFRIGPVLKVYYLLYLNFGHTVPVSFRSAPPLRPVRLMASLWTQLISTVSLILSLARWVAVSGDSGNVLLFPSRHHEGSRPAMILPLHHSVPESSLSHFNPRRHLQGSQSEHHPNARMRLFDDLLRNGRYYTTRLWIGTPPQRFALIVDTGSTVTYVPCSTCKHCGSHQDPKFRPEASETYQPVKCTWQCNCDDDRKQCTYERRYAEMSTSSGVLGEDVVSFGNQSELSPQRAIFGCENDETGDIYNQRADGIMGLGRGDLSIMDQLVEKKVISDAFSLCYGGMGVGGGAMVLGGISPPADMVFTHSDPVRSPYYNIDLKEIHVAGKRLHLNPKVFDGKHGTVLDSGTTYAYLPESAFLAFKHAIMKETHSLKRISGPDPHYNDICFSGAEINVSQLSKSFPVVEMVFGNGHKLSLSPENYLFRHSKVRGAYCLGVFSNGNDPTTLLGGIVVRNTLVMYDREHSKIGFWKTNCSELWERLHVSNAPPPLMPPKSEGTNLTKAFKPSVAPSPSQYNLQLGELQIAQLIVVISFNISYMDIKPYITELTGLIAHELDVNTSQVHLMNFSSLGNGSLSRWVITPRPYADFFSNATAMSMIARLSEHRMQLPNSFGSYKLLEWNAEPPLKRTWWQQYYLVVALAVSLTLVLGISALGIFLIWKKRQQAEHSYKPVDVAVQEQELQPL

SEQ ID NO: 153449 - protein, 89 aa, Glycine max
  Coding DNA Sequence Number=SeqID_61764
MEERFGVVLAAESNDRERDPQRHTVFLGFRQRVRKKLNPSVVIVRAPSPHWTGLWPRHIVQTAKALLDTMCLITRTFFLHPIHLSLHPL

SEQ ID NO: 153450 - protein, 184 aa, Glycine max
  Coding DNA Sequence Number=SeqID_61765
  Gene Ontology: Biological process=embryonic development ending in seed dormancy
  Homolog annotation: Hit_ID=A5BGH4; Match level="QueryCoverage=90%, HitCoverage=84%, E-value=3e-38, Identity=51%"; Hit description =Putative uncharacterized protein
MVEQLAVAKPSRPSDEVQVRIANEIRAEFDALEPKRPIKPNRSEPDAVLQHPPDASVNNIPELHKFRSLQSRSHVSNHSLPLNYFAIISSAGIVDAHDEFVETQYYKELAAIDKQHHTTGSGFIKAVREGGEGGYEIHVNAAETQPRGYKSNPATNDWVPNSEEYQVFVSSKPNRRRVLDDIAR

SEQ ID NO: 153451 - protein, 301 aa, Glycine max
  Coding DNA Sequence Number=SeqID_61766
  Gene Ontology: Mol. function=unspecific monooxygenase activity; Cellular component=membrane; Biological process=electron transport
  Homolog annotation: Hit_ID=Q9XFX1; Match level="QueryCoverage=67%, HitCoverage=60%, E-value=4e-46, Identity=56%"; Hit description =Cytochrome P450
MLLAASYGDHWRNLRLEILSTHRLNFFLEIRNDETLKLLRNLAMASNNKKDLTKVEFRSMLEDLTFNIIMRMVCVKRYYGEENEGTIAEEANKFRDIMNEMAQFGLGSNLGDFVPVFEMVRFGWWPQEATKNWGEEDALFQGLINEHRNKNENSNTTMPHFSSEDCTVRGFGVARNTILFVNAWTIHGDPELRTDPKCFKPERHGSKNFGIDFSFVDSMLLSGKGLTRKKLTWLKDGELPKLMMVMAGDEHTHMVTATVVIVVTTMMTKVMDNGGGVNGDAVVVLEVVTIDDNDGNSVKSW

SEQ ID NO: 153452 - protein, 335 aa, Glycine max
  Coding DNA Sequence Number=SeqID_61767
  Gene Ontology: Mol. function=protein binding; Cellular component =nucleus; Biological process=cell division
  Homolog annotation: Hit_ID=A7PLG7; Match level="QueryCoverage=81%, HitCoverage=74%, E-value=1e-88, Identity=61%"; Hit description =Chromosome chr7 scaffold_20, whole genome shotgun sequence
  Pfam annotation: Domain name=Cyclin_C; Domain location=166-296; Score= 63.7; E_value=6.1e-16; Accession=PF02984.10; Description=Cyclin, C -terminal domain
  Pfam annotation: Domain name=Cyclin_N; Domain location=36-164; Score =98.1; E_value=2.7e-26; Accession=PF00134.14; Description=Cyclin, N -terminal domain
  Pfam module annotation: Pfam domain module=Cyclin_C::Cyclin_N; Domain location=166-296::36-164
MPRPHSPSFLLCQEHYSFTFQQHSQTLSNTQPSPLTFPDNLQHDLLLSLLSKQRATHSTLSPRHHVVRLISKLSNFHGFSPLTTVLAVNYFDRFVATLRFQSELKPWMTQLTAVACVSLAAKVEETRVPLLSDFQVEESKFLFEAKTIQRMELLVLSTLEWKMNPVTPISFFQHFLTSLGLKRHLHSESLRRCQRLLLSVIADSRVMSYLPSTVAAAIMIHVIKEIEPLNATEYRNQLLGLLKTSEEQVDECYKLMLRLLVCSKGIHNLRRKRLSEPSSPDGVIDASFSCDSSNDSWTVASPSVGPLIKRRKPQDQQMPLPPVNRVAIDVLKTPR

SEQ ID NO: 153453 - protein, 330 aa, Glycine max
  Coding DNA Sequence Number=SeqID_61768
  Gene Ontology: Mol. function=nucleic acid binding; Cellular component= nucleus; Biological process=RNA processing
  Homolog annotation: Hit_ID=A7PLE9; Match level="QueryCoverage=81%, HitCoverage=77%, E-value=2e-97, Identity=69%"; Hit description =Chromosome chr7 scaffold_20, whole genome shotgun sequence
  Pfam annotation: Domain name=RRM_1; Domain location=259-326; Score =33.5; E_value=7.8e-07; Accession=PF00076.13; Description=RNA recognition motif. (a.k.a. RRM, RB
  Pfam annotation: Domain name=RRM_1; Domain location=78-147; Score =46.8; E_value=7.6e-11; Accession=PF00076.13; Description=RNA recognition motif. (a.k.a. RRM, RB
  Pfam module annotation: Pfam domain module=RRM_1::RRM_1; Domain location=259-326::78-147
MAAYYSQPQPSGLLPYQYYQQPPPPPPPPMMAVVPPPPGAVVPPAHHLHPPYVAQHQQQAVFGSYGAPQSSTHEVRTLFVAGLPEDVKPREIYNLFREFPGYESSHLRSPSNSSQPFAFAVFASQKSAILAMHALNGLVFDLEKGSTLYIDLAKSNSRSKRTRIDDERVGADKKARGLTPSWSTPDSVHYCCVIVYSVAWSIHMPGMGNPAFNTNTFGYPSAQSLGNADGSAMSDSLFANLKKSSTPYIPQNSTPCATLFVANLGPSCNEQELIQVFSRYPGFLKLKMQSTYGAPVAFVDFQDVGSSTDALNSLQGTILHSSQSGEGMRL

SEQ ID NO: 153454 - protein, 282 aa, Glycine max
  Coding DNA Sequence Number=SeqID_61769
  Gene Ontology: Mol. function=transcription regulator activity; Cellular component=nucleus; Biological process=regulation of transcription
  Homolog annotation: Hit_ID=A7PLB8; Match level="QueryCoverage=75%, HitCoverage=96%, E-value=4e-52, Identity=57%"; Hit description =Chromosome chr7 scaffold_20, whole genome shotgun sequence
  Pfam annotation: Domain name=HLH; Domain location=26-75; Score=60.4; E_value=6e-15; Accession=PF00010.17; Description=Helix-loop-helix DNA-binding domain
EGVEAPAEEVPTKAASSRSSSKRSRAAEVHNLSEKRRRGRINEKMKALQNLIPNSNKTDKASMLDEAIEYLKQLQLQVQMLSMRNGLSLHPMCFPEGLQPLQLSQMGMELSERNRFTSLNMSATLPLHQDNNPLHYASNLPNKHNLPNQPSVPYPPYIDNPETSFGLEPRIQTDMKPLQHKGGSSEPIRGEDILQHQQSSGIHSDANTLGGSQVVKEFESGTRLSFPFDTQACEPKDNSNSSQPCIGGRDHSGVIIRNSETNIVGRREKVVSGNSKTEKSDF

SEQ ID NO: 153455 - protein, 392 aa, Glycine max
  Coding DNA Sequence Number=SeqID_61770
  Gene Ontology: Mol. function=protein serine/threonine kinase activity; Cellular component=anchored to membrane; Biological process=protein amino acid phosphorylation
  Homolog annotation: Hit_ID=A7PLB4; Match level="QueryCoverage=78%, HitCoverage=66%, E-value=1e-126, Identity=70%"; Hit description =Chromosome chr7 scaffold_20, whole genome shotgun sequence
MRRWTQLPNMSCQWKYPTKMFADTTFEPHLQGLAFNRYSWLTTHNSYALAGARSATGSVIVAPMNQEDKVDEQLKNGVRGFMLDMYDFQNDIWLCHSFQSKCFNFTAFQPAINVLKDMRTFLDGNPSEIITIFIEDYVTAPQGLTKVLRDSGLSKYMFPVSRMPKNGEDWPTVDDMVQKNQRLVVFTSKSAKEASEGIAYQWTYVVENQYGDDGMKAGSCPSRAESPAMNTKSRSLVLVNYFHSAPNRSQACADNSAPLLDMMKTCHEAAGNRWANFIAVDYYQRSDGGGAPLAVDEANGHLTCGCDNIAYCKKYHDYYLLLRFYHCKENAKSGTCDVPPISPPPPATETPSTGNQQTQNNNHTNNAYIGRTAKLMQSVVGILATTTFLAWL

SEQ ID NO: 153456 - protein, 242 aa, Glycine max
  Coding DNA Sequence Number=SeqID_61771
  Gene Ontology: Mol. function=transcription regulator activity; Cellular component=nucleus; Biological process=regulation of transcription
  Homolog annotation: Hit_ID=A7PLA9; Match level="QueryCoverage=96%, HitCoverage=98%, E-value=1e-42, Identity=43%"; Hit description =Chromosome chr7 scaffold_20, whole genome shotgun sequence
  Pfam annotation: Domain name=HLH; Domain location=139-186; Score =28.2; E_value=3.1e-05; Accession=PF00010.17; Description=Helix-loop -helix DNA-binding domain
MDVDILKTSTSDNISMDMMMTMMQMEKFPEFCEPFYNNNNNTSTAPLYPENELLINSTTTLPVFSNVINNPNVITPPPSSSNFIQQQPMTPHLEPNLEKRNSVAAMREMIFRVAVMQPIHIDPESIKPPKRRNVKISKDPQSVAARHRRERISERIRILQRLVPGGTKMDTASMLDEAIHYVKFLKKQVQTLEQAGASRPLNVVGFPTTASNANNNNSYSGFVKSCQPYPMLGSAASKQLLS

SEQ ID NO: 153457 - protein, 275 aa, Glycine max
  Coding DNA Sequence Number=SeqID_61772
  Gene Ontology: Mol. function=triacylglycerol lipase activity; Biological process=lipid metabolic process
  Homolog annotation: Hit_ID=A9PEF2; Match level="QueryCoverage=96%, HitCoverage=59%, E-value=1e-88, Identity=57%"; Hit description =Putative uncharacterized protein
  Pfam annotation: Domain name=Lipase_3; Domain location=26-172; Score =108.3; E_value=2.4e-29; Accession=PF01764.16; Description=Lipase (class 3)
MPDFQEKPTTQVLVVLDKHEDRDTYVVAFRGTEPFDADAWCTDLDISWYGIPGIGKMHGGFMKALGLQKNVGWPKEIQRDENLPPFAYYVIRDILRKGLSENPNAKLIITGHSLGGALAILYPTIVFLHDEKLLMERLEGIYTFGQPRVGDEAYAQFVYCNDIVPRLPYDNDLLFKHFGICLFFNRRYELRILEEEPNKNYFSPWCVIPMMFNAVLELIRSFTIAFKNGPHYREGWFLFGFRLFGLLIPGLPAHGPQDYINSTLLGSIEKHFKAD

SEQ ID NO: 153458 - protein, 136 aa, Glycine max
  Coding DNA Sequence Number=SeqID_61773
MGWLAGYEYDSTCVFRERQDSEASSFNILLEWEWNGTSVVLTFHAEAGMHQSSLATSERVWKTLDEVTCSRENKLRKKLRIHGFMDDTSPKGAFAVKATRGSTWDAPCVRSAAAAGASGRVGYPGATGRAGDPGAT

SEQ ID NO: 153459 - protein, 434 aa, Glycine max
  Coding DNA Sequence Number=SeqID_61774
  Gene Ontology: Mol. function=hydrolase activity; Cellular component =vacuole; Biological process=lipid catabolic process
  Homolog annotation: Hit_ID=A7PL78; Match level="QueryCoverage=86%, HitCoverage=91%, E-value=1e-129, Identity=63%"; Hit description =Chromosome chr7 scaffold_20, whole genome shotgun sequence
  Pfam annotation: Domain name=Patatin; Domain location=21-231; Score =269.8; E_value=5.5e-78; Accession=PF01734.13; Description=Patatin -like phospholipase
MENPSSPEAPAPKYENLITVLSIDGGGIRGIIPGVILDYLESQLQELDGEDARLADYFDVIAGTSTGGLVASMLAAPNPKANNRPLFAANEIVPFYLENSPQIFPQKRGGIFAPLVNIGKALTGPKYDGKHFHELIRNKLGGTKLHQTLTNVVIPTFDVKILQPTIFSSYQMAKEPTLDVLLSDICIATSAAPTFLPAHYFTKQDEQGKVIKEFNLIDGSVAANNPTLCAIREVTKQLIRKGNGGISINPLEYSRFLVLSIGTGSNKSEHKYNAKMVSKWGILTWLFNSGSTPILDCFSEASFDMVDYHNCVVFSALQSEDNYLRIQDNTLKGDLASVDVATKENLDNLVKVGQQLLKNTVTRVNLDTGLYEPVPDKGTNVCKITFGGKKGEKVQLTMTRRWEVNDRQLNEENNCCRYSNLNSIDSINIISIVA

SEQ ID NO: 153460 - protein, 359 aa, Glycine max
  Coding DNA Sequence Number=SeqID_61775
  Homolog annotation: Hit_ID=A7R5I2; Match level="QueryCoverage=82%, HitCoverage=29%, E-value=6e-95, Identity=61%"; Hit description =Chromosome undetermined scaffold_976, whole genome shotgun sequence
  Subcellular localization annotation: CTP_CleavageSite=64; ConfidenceScore=5.13e-01
MGEFHFHNVFDKDGNAQVQVGANSRAHRRSNSASDRNLKFSRGRVFHPIQKDKHESLASPPSVRASRFSSPLHDNLTGNKKTFSNPRASLEKDVEQLQLRIQHEKSMRILLERAMGRASSTLSPGHRHFAAQTKDLIAEIELLEEEVTSREQHVLAMYRSIFENCVSWPPSEQNSGVASPAHPRYESRKHPSIISSAFCSSKKFPLRPLQALISNNDLKNRIFGSSYAPLSCGKGEVYFGKTCPDSTKVNEKFSTKEKTPVLRTLKYHLNQCPNRLSEEMVKCMATVYCWLRSATSVNSEKSRSPLLSRSSTHAAQTRHGVGEDQDCSCKSVVEISWIATRKRHSSHASYAIDNFRLAL

SEQ ID NO: 153461 - protein, 2113 aa, Glycine max
  Coding DNA Sequence Number=SeqID_61776
  Gene Ontology: Mol. function=RNA binding; Cellular component=cell surface; Biological process=chitin metabolic process
  Homolog annotation: Hit_ID=A5CBI0; Match level="QueryCoverage=99%, HitCoverage=96%, E-value=0.0, Identity=40%"; Hit description =Putative uncharacterized protein
  Pfam annotation: Domain name=Agenet; Domain location=1686-1756; Score= 51.2; E_value=3.5e-12; Accession=PF05641.3; Description=Agenet domain
  Pfam annotation: Domain name=QLQ; Domain location=1053-1089; Score =9.7; E_value=0.023; Accession=PF08880.2; Description=QLQ
  Pfam module annotation: Pfam domain module=Agenet::QLQ; Domain location=1686-1756::1053-1089
MDYDDNDFQNQNLHLAGEGSAKFPPVLRPYALPKFDFDESLQANLRFDSLVETEVFLGIESNEDNQWIDAFSRGGSGIEFSSTAAESCSISRHGNVWSEATSSESVEMLLKSVGQEDYIPRQTVIQESDACDELACLAKQMDTNPKFDDKNEFRSSVSDLHPPGGIHTGFSGLKEDVGMEKPHGGVSQGHEGESSIDGTSSNPKLSDICRNIDLPVSEGSLTLDTNDKNNNTNQREVETVDDDSHHGKTQDDSSAVQTNIAESSIKNMGDDKRDPLQAQTYNQDLESSLMDKEAVVDTQTLDRDMVGSDAHHLDKPLCSIPTEENLEGGVVEGLETGLSSLEGSLTMESVAASGSPKVEKTSEDMCFSALSQNNVSEDVMLLNDVEMDDQSAPNTCVLPKSSSKDDSISEGQAVEVSNLNCENCPNMHQNVDVIEKTTHGGSSVTKEDELLNTGDHVDTVILSSKSETSMPTAEESNISTINEGNSDNMVGSFSSSSATAFSTKSSILGESTQICVNNEPDRQNDHEKCDLDVSVNDQDELMNTGDHVDTVILSNKSEASIFTSEENNISSIREGNSGKKVEGFPSGSVKDFSTKSSILGKSTQICANNESDRQNDQEKCDQVVSVNDQEHEKVPSDSSQKHCDVDKGVVSSSISEGSMEIKLTTSTVSIHVTPINNSVSQVVSENNSLTSHEIIDIPPSSKVVSTHEVTSHNEFQGITPVGNSSAEEKGESTAKAEEAGTSTLVGCSEQETASCPVPGTEKHHSSDTSRQLLHDSDCLHNVGTSAVKIGEPQGTANDKVIQESAKETGMPQVLCASSKKQSDVVTVSLVKDDKKTVQENPNESSSEKIGGGSHSLTEKENNQVEASPTQNPQVSEDLKENNTSKDERRSTPEVNSVNDLSKKGATADVGKMQPIPVTETVKTSLAVEEGSPSTSGRGPSKIKSVGDVAHGASKATPERKTRRASNRSAGKESSRRGSHAKDTTLARQTDRGDKSTKVSLSPSPGFQMMQSNEVQQFGHIDSNSTKSFAVVNTSTSSLPDLNTSASPPILFHQPFTDQQQVQLRAQIFVYGALIQGTVPDEAYMISAFGGSDGGRSLWENAWRTCMERQHGQKSHPANPETPLQSRSVARTSDLPHKQSAAQGKGISSPLGRTSSKATPPIVNPLIPLSSPLWSLSTLGLGSDSLQSSAIARGSVVDYPQAITPLHPYQTTPVRNFLGHNTPWMSQTPLRGPWIASPTPVTDNSPQISASPASDTIKLGSVKGSLPPSSGIKNVTSGVSTSSTGLQSIFTGTASLLDANNVTVSPAQHNSDPKPKKRKKVVVSEDLGQRALQSLAPGVGSHTSTPVAVVAPVGNVPITTIEKSVLSVSPLADQSKNDRNVEKRIMSDESLMKVKEARVHAEEASALSAAAVNHSLELWNQLDKHKNSGLMPDIEAKLASAAVAVAAAATIAKAAAAAANVASNAALQAKLMADEALLSSGYDNSSQSNQISLSEGTNNLGKATPASILKGANGINSPGSIIVAAKEAVKRRVEAASAATKRAENMDAIVRAAELAAEAVSQAGKIVTMGDPLPISQLVEAGPEGCLKATRESSQQVGLFKDINRDMVNNNVRDIPETSYTHNRDILSGGISAPIKINEKNSRGAKGHKVVSDLVKPIDVVPGSEPEIQAPPFTVSNGSENLVESSIKEGLLVEVFKDEEGFKAAWFSANILTLKDNKAYVGYTSLVAAEGPLKEWVSLECDGDKPPRIRAARPLNTLQYEGTRKRRRAAMGDYAWSVGDRVDAWIQESWQEGVITEKNKKDETTFTVHFPASGETLVVRAWHLRPSLIWKDGKWIESYKVGTNDSSTHEGDTPNEKRPKLGSHVVDVKGKDKMSKGIGAVESAKPDEMTLLNLAENDKVFNIGKSSKNGNKFDAHRMVRTGLQKEGSKVIFGVPKPGKKRKFMEVSKHYVAHENSKIGDRNDSVKLTNFLMPPSSGPRGWKNSSKNDAKEKHGADSKPKTSHTERIKDSSNLFKNAASKSESKVERAPHSASDGATGPFLFSSLATSVDAHPTKRASSSRASKGKLAPARVKSGKVEMEKALNDNPMKSASDMVEPRRSNRRIQPTSRVSFYN

SEQ ID NO: 153462 - protein, 1286 aa, Glycine max
  Coding DNA Sequence Number=SeqID_61777
  Gene Ontology: Mol. function=neuropeptide hormone activity; Cellular component=extracellular region; Biological process=neuropeptide signaling pathway
  Homolog annotation: Hit_ID=A7R1E9; Match level="QueryCoverage=88%, HitCoverage=96%, E-value=0.0, Identity=48%"; Hit description =Chromosome undetermined scaffold_349, whole genome shotgun sequence
MVWVLLHKTFTCYVVLSCILFWLAGYGLCSLNGIQNPPDYEGCASFERSYDLGSSDATVSDSSLGYGFPSPHNSYENVCPKSHSFCFPSILSGFSHKEKIVKEASPGESGSQYSSPFCTELPQHGRQTSNKSWSSEHGVFRLLNGGVVWCSLNTREEVDDVPPLQTEVGRKDDISSCGGSSLKQKTTSFWSTNSEVSKSNSFDGSVSPDVRIGPTILDWGQKYLYSSSSAFLTVTNTCNDSILNLYEPFSTDLQFYPCNFSDISLRPGESALICFVYFPRSLGLSSGSLILQTSSGGFIVEAKGYATESPFGIQPLSGMQISPGGRLSKNFSLFNPFDETLYVEEITAWISISSGNNSVEIEAICRRNDFQVVDTWLFPTIKDRLVVNSGQFGSLIVAIRPHRNWDIAPHGSETLMEMDILVGFEGKIFGAFCLHLLRHSQDTSDTIMVPIEAEVDSHSAHDTVGIFISATLEGLAMCDSGEIAIAISLRNDAPYVLSFVKVIEVSDTKLFRIKFKEGLLLFPGTVTQVGIVYCSHRHLDLHDFVPKVSTLRENCKLLILTNDSTSSLIEIPCEDILYICFEHQRKRHSSDQVEGKSKDTQFDNRKTGHMVRSMQLQPNVKALETRDVDEMVLANWKSQGTMGSMSVLKDREMLFSMIQVGSYVSKWITVKNPSQHSVVMQLILNSGEIINECRGLDDLLHPSSSSNLVLDEGATPKKYGFSVPENALTEAYVHPHDHVTLGPIIFYPSDRCGWSGSALIRNNLSGVEWIPLKGYGGLLSLVLRERSEHVDSVDFDLKMPKTLNFSLPYTLLHMKEITSTCSQHLVKELYAKNTGDLPLEVKSIRVSGRECGLDGFKILSCKGFALEPGESTKLLISYQTDFSAAVVHRDLEIILATGIFLLPMKASFPNDMLSSCKRSMYWMRLKKSLLGFVLVASLIFLIFCFIFPQTTALGFLDFSYKSDDNLVHTTLKSAEKTPMLHHDQGKSKLSISSEMNHLMEASSGKYSYGQGNPSEREISQHLTQKSENHEQTNHAWDIQSERKLSSSAVQCSDPMKASQLGYLTVKTGKEKGRRKKRKSLGAKLAALSEVSSSQSGNSTPSSPLSPTPSATPKCNWPTSPDVEQPPEAPSPMTQVAAQHSANDQASATAAESNILKPVFTQRCSNSKSSQVPHSASRSATSLPVQMPSATSPIPAITFPSRLGSKSTVDFHARAPGSQLHNQTAVQARETGLANEYTYDIWGDHFSGLHLLVPKNVASMKSSPVENNFDSFFVRGPQTLVTNSQEG

SEQ ID NO: 153463 - protein, 876 aa, Glycine max
  Coding DNA Sequence Number=SeqID_61778
  Gene Ontology: Mol. function=nucleotide binding; Cellular component =intracellular; Biological process=defense response
  Homolog annotation: Hit_ID=Q6YIA0; Match level="QueryCoverage=85%, HitCoverage=93%, E-value=1e-169, Identity=46%"; Hit description =Disease resistance protein-like protein MsR1
  Pfam annotation: Domain name=LRR_1; Domain location=664-684; Score =1.1; E_value=1.9e+02; Accession=PF00560.24; Description=Leucine Rich Repeat
  Pfam annotation: Domain name=LRR_1; Domain location=711-733; Score =6.2; E_value=22; Accession=PF00560.24; Description=Leucine Rich Repeat
  Pfam annotation: Domain name=LRR_1; Domain location=735-757; Score =11.2; E_value=2.6; Accession=PF00560.24; Description=Leucine Rich Repeat
  Pfam annotation: Domain name=LRR_1; Domain location=759-781; Score =11.1; E_value=2.7; Accession=PF00560.24; Description=Leucine Rich Repeat
  Pfam annotation: Domain name=LRR_1; Domain location=783-805; Score =11.7; E_value=2.1; Accession=PF00560.24; Description=Leucine Rich Repeat
  Pfam annotation: Domain name=LRR_1; Domain location=807-829; Score =9.8; E_value=4.7; Accession=PF00560.24; Description=Leucine Rich Repeat
  Pfam annotation: Domain name=NACHT; Domain location=182-329; Score= -33.0; E_value=0.022; Accession=PF05729.3; Description=NACHT domain
  Pfam annotation: Domain name=NB-ARC; Domain location=146-443; Score =78.8; E_value=1.8e-20; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=664-684::711 -733::735-757::759-781::783-805::807-829::182-329::146-443
MADLFSGGAVGAVMGELLKGAIATINKGRDFGPTLESNIETLNSLAPQVEEMKRYNKMLDRPIEEIARLESQMQAGEELVRKCSKFGRWRMLSFPYYQSKLKSNDANLKRHFSVNVPAENKRDLMEVVASVRQILEILSKKEDFRHSFHLRGLSGAPQEPECVGMDVPLSKLRIDLLKDGVSVLVLTGLGGSGKSTLAKKICWDPQVKGKFEGNIFFVTVSKTPNLKYIVETLFEHCGCPVPKFQSDEDAINRLGVLLRLVGKNPILLVLDDVWPSSEALVEKFKIDIPDYKILVTSRVSFPRFGTPCQLDKLDHDHAVALFCHFAQLNGKSSYMPDEKLVDEIVRGCKGSPLALKVTAGSLCQQPYEVWQNMKDRLQSQSILLESSSSDLLFRLQQSLDILEDKFKINEKVCFMDLGLFPEDQRIPVAALIDMWAELHNLDENGRNAMTIIHDLTIRNLINVIVTRKVAKDADMYYNNHFVMLHDLLRELSICQSKEKPFEQRERLIIDLNGDNRPEWWIGQDEQGVIGRMSSFFLRMLYRQKQLRVAARILSISTGDTYFGGGIATVLKMYGLIRNTPAMCHTSSSIIDVKYVASADETFTSDWCDMLPDEAEVLVLNLNSSQYSLPEFTEKMSKLRVLLVTNYGFHRSELNKFELLGSLFNLKRIRLEKVSVPSLCILKNLQKLSLHMCNTRQAFENCSIQISDAMPNLVEMSIDYCNDLVKLPDGMSNITPLKKLSITNCHRLSTLPQDIAKLENLEVLRLCSCSGLVEMPDSVKGLYKLSCLDISDCVSLSRLPDDIGELKKLEKLYLKGCSKLSEFPYSVVNFGNLEHEIYVICDEEIAALWENFPTMPKLKIEISTMEINLNWLPGVHS

SEQ ID NO: 153464 - protein, 272 aa, Glycine max
  Coding DNA Sequence Number=SeqID_61779
  Gene Ontology: Cellular component=endoplasmic reticulum
  Homolog annotation: Hit_ID=Q9ZTZ3; Match level="QueryCoverage=76%, HitCoverage=98%, E-value=1e-114, Identity=100%"; Hit description=24 kDa seed maturation protein
  Pfam annotation: Domain name=Reticulon; Domain location=86-269; Score= 124.3; E_value=3.6e-34; Accession=PF02453.8; Description=Reticulon
MEVPRMLQGFHVSSESYTCKSDTESPCWLSPKHHYIFENVSGFASKHLNIIYISSQSSSIMSSETKAETQTLTTPSYSSDVDNGIVKDVVLWRRKKINISVLVAATAAWVLMEVFEFNFLTLISWVAILGLASIFLYANMLRLLGKEPPNLLGLEVSEKTTTRIAHTVRAWIEEGIRWLFLVGAEKEWPVFVGAVAGLLSLSYLGSCMDLLTLVYMGTLVGMAVPLTYVKNEDKIKRFVEWLREKHKRYYQIIDEKTIQKIKSRIVKEKKTE

SEQ ID NO: 153465 - protein, 555 aa, Glycine max
  Coding DNA Sequence Number=SeqID_61780
  Gene Ontology: Mol. function=oxidoreductase activity; Cellular component=cellulose and pectin-containing cell wall; Biological process=electron transport
  Homolog annotation: Hit_ID=A7R3R4; Match level="QueryCoverage=93%, HitCoverage=96%, E-value=0.0, Identity=79%"; Hit description =Chromosome undetermined scaffold_560, whole genome shotgun sequence
  Pfam annotation: Domain name=Cu-oxidase; Domain location=175-311; Score=198.3; E_value=1.9e-56; Accession=PF00394.13; Description =Multicopper oxidase
  Pfam annotation: Domain name=Cu-oxidase_2; Domain location=393-533; Score=160.8; E_value=3.7e-45; Accession=PF07731.5; Description =Multicopper oxidase
  Pfam annotation: Domain name=Cu-oxidase_3; Domain location=49-165; Score=197.2; E_value=4.1e-56; Accession=PF07732.6; Description =Multicopper oxidase
  Pfam module annotation: Pfam domain module=Cu-oxidase::Cu-oxidase _2::Cu-oxidase_3; Domain location=175-311::393-533::49-165
MKKMQLLHTLASEKPPQEKREGVRKRESGTDPSGLSVQAEDAYKYYTWTVTYGTISPLGSPQQVILINGQFPGPRLDLVTNENVILNLINKLDEPFLLTWNGIKQRKNSWQDGVLGTNCPIPPNSNYTYKFQAKDQIGTYTYFPSTQLHKAAGGFGALNVYHRSVIPIPYPNPDGDFTLLVGDWYKTNHKTLRQTLESGKPLAFPDGLLINGQAHSTFTGNPGKTYMFRISNVGFSTSINFRIQGHTLKLVEVEGSHTVQNLYDSLDVHVGQSVAVLVTLNQPPKDYYIVASTRFTETPLTTTAVLHYANSFSSALGPVPAPPVDKYDFDWSMKQARTYRWNLTANAARPNPQGSFHYGKITPTKVIKLANSAPLINGKLRYAVNSVSYVNPDTPLKLADYFNIPGIFSVNLLQNSPSNGPGYIGTSVLQTSLHDFIEVIFQNNENTMQSWHLDGYDFWVIGHGFGQWTDASRKTYNLVDALTRHTTQVYPKSWTTILVSLDNQGMWNLRSAIWERQYLGQQFYLRVWDAQKSLANEYDIPNNVLLCGKAVGHHP

SEQ ID NO: 153466 - protein, 374 aa, Glycine max
  Coding DNA Sequence Number=SeqID_61781
  Gene Ontology: Mol. function=metal ion binding; Cellular component =cytoplasm; Biological process=regulation of transcription, DNA -dependent
  Homolog annotation: Hit_ID=A7R447; Match level="QueryCoverage=77%, HitCoverage=66%, E-value=3e-87, Identity=55%"; Hit description =Chromosome undetermined scaffold_618, whole genome shotgun sequence
MPALRKRNRLSEFDAISNHDTPHEQKKNMSEYELSREQRIRENRERMGKLGILDLSLTLKLNNKNKRSYSSHKPQTPPSLPNSSVPVRRSSRLQNVTPVSYSEVPPKKDEFKKNGRVVIEQGAKPEVYSEEHEKLLGNTDKPWTLFVDGVGKDGKRIYDSVHGKTCHQCRQKTLGYRTSCSQCNMVQGQFCGDCLYMRYGEHVLEALQNPTWLCPVCRGICNCSLCRQAKGWAPTGTLYKKISTLGYKSVAHYLIQTRRSEIDVKKNADPSNPVSAKRSLPFSDVDKSLEVNENHLESLKPLAESEGDDAEVSAKRLLFSDKQNQLEKVECSDTPKPLQLEKNECSGTKKPLASSSKPSSDSIAGRLRSRLKKP

SEQ ID NO: 153467 - protein, 397 aa, Glycine max
  Coding DNA Sequence Number=SeqID_61782
  Gene Ontology: Mol. function=signal transducer activity; Cellular component=nucleus; Biological process=G-protein coupled receptor protein signaling pathway
  Homolog annotation: Hit_ID=A7R2S0; Match level="QueryCoverage=100%, HitCoverage=46%, E-value=1e-164, Identity=70%"; Hit description =Chromosome undetermined scaffold_444, whole genome shotgun sequence
  Pfam annotation: Domain name=G-alpha; Domain location=1-355; Score =5.9; E_value=1.9e-19; Accession=PF00503.11; Description=G-protein alpha subunit
MPDYLEHGIVQKLLLVGGSGSGTSTIFKQAKILYKSVPFSEDEHENIKLTIQSNVYAYLGMLLEGRTSPKLDEKTVYSIGPRLKAFSDWLLKTMVSGKLDAIFPAATREYAPLIEELWNDAAIKATYERRSELEMLPSVASYFLERAVKILRTDYEPSDLDILYAEGVTSSNGVACVEFSFPQSASDETVDTTDLHDSLVRYQLIRVHARGLGENCKWLEMFEDVEMVIFCVSLTDYDQFSVDGNGCLTNKMILSRKFFETIVTHPTFEQMEFLLILNKFDLFEEKIEQVPLTKCEWFSDFHPIISRNRPNGNSNSINNNPSLGQLASHYIAVKFKRLYSSLTGRKLYVSPVKGLEPGSVDASLKYAKEILKWSEERPNFSLSEYSMYSTEASSFSH

SEQ ID NO: 153468 - protein, 765 aa, Glycine max
  Coding DNA Sequence Number=SeqID_61783
  Gene Ontology: Mol. function=binding
  Homolog annotation: Hit_ID=Q1KUQ4; Match level="QueryCoverage=100%, HitCoverage=49%, E-value=1e-177, Identity=79%"; Hit description =Putative uncharacterized protein
MKAGSAAKLIVDALLQRFLPLARRRIETAQAQDGQYLRPSDPAYEQVLDSLAMVARHTPVPLLEALLRWRERVVSQVEYPSLVDLRGLLLDLVAQLLGALSRISSSGLRLLLLGDSASVPFTVVQFAMAYNTKFSSVTERFFMELNTRRIDTSAARSETLSIINGMRYLKLGGGLNASASFVAKAHPINRQAHKRKSELHHALCNMLSNILAPLADAGKSQWPPSGVEPALTLWYEAVGRIRVQLMHWMDKQSKHIAVGYPLVTLLLCLGDPQIFHNNLSPHMDQLYKLLREGCQEAYGSVDDVWDIVAKGLGSMPLCKNAKNWGKNVVAKKNTEGGEARVRVFDGLYHFLGTKRFTCLLKVGKENQETWIKLHALRMEKDKNHRFMALDCLHRVLRFYLSVHAANQAPNRIWDNLDSVTSQLLAVLRKGLLTQDVQHDKLVEFCVTIAEHNLDFTMNHMILELLKQDNPSEAKVIGLRALLAIVMSPSNAVTKEKSQGYLFRSVLKCIPNLIEEVGRTDKITEIIPQHGISIDPGVREEAVQVLNRIVKYLPHRRFAVMKGMANFILRLPDEFPLLIQTSLGRLLELMRFWRSCLIDDRIQLEADVKSLGHETERFRKSSIQQSGEAIEFRASEIDAVGLIFLSSVDSQIRHTALELLRCVRALRNDIRDLKMHEQPNHTLKYEAEPIFIIDVLEEHGDEIVQNCYWDSGRPFDLKREPDAIPPEVTLQSIIFESPDKNRWARCLSELVKYAAELSPSSVQEAK

SEQ ID NO: 153469 - protein, 483 aa, Glycine max
  Coding DNA Sequence Number=SeqID_61784
  Gene Ontology: Mol. function=binding
  Homolog annotation: Hit_ID=A5BVF6; Match level="QueryCoverage=93%, HitCoverage=98%, E-value=7e-91, Identity=45%"; Hit description =Putative uncharacterized protein
  Pfam annotation: Domain name=TPR_1; Domain location=236-269; Score =16.9; E_value=0.05; Accession=PF00515.19; Description=Tetratricopepti de repeat
  Pfam annotation: Domain name=TPR_1; Domain location=67-100; Score =14.1; E_value=0.11; Accession=PF00515.19; Description=Tetratricopepti de repeat
  Pfam annotation: Domain name=TPR_2; Domain location=236-269; Score =17.8; E_value=0.042; Accession=PF07719.8; Description=Tetratricopepti de repeat
  Pfam annotation: Domain name=TPR_2; Domain location=67-100; Score =14.9; E_value=0.31; Accession=PF07719.8; Description=Tetratricopeptid e repeat
  Pfam module annotation: Pfam domain module=TPR_1::TPR_1::TPR_2::TPR _2; Domain location=236-269::67-100::236-269::67-100
MAEEAPASETSVTMPQPAEVITVDGTLTSSENDKSGISVDAAAHGGEKTVSNAEPSGSDPQKSLELANELMEKGNKAIKENDFGEAADNFSRALEIRVAHYGELAPECVHTYYKYGCALLYKAQEEADPLADVPKKEDGSQHGSNKDGSVKGSLNAESSTASISNNAGQDVTSNDQGGAVDDGSTKNDPEEDDEDSDAEDLAEADEDETDLDLAWKMLDIARAIAEKQSVNTIEQVDILSTLADVALEREDFETSLSDYQKALTILEQLVSSKPQEAIAYCQKATSVCKARLHRLTDEVKSCSDLTSASELAQDLPACPKSESNNSILDKQSEIETLKGLSSELEKKLEDLQQLVSNPKSILAEILGIAAAKVGNVKESSSATVSSSRLATANSSGGFDSPTISTAHTNGSGGVTHLGVVGRGVKRASNATPAEGSTPKKPALESTEDKGAMSGAKGVGQGPWPGPFQSSDVRTLLSCLVERK

SEQ ID NO: 153470 - protein, 574 aa, Glycine max
  Coding DNA Sequence Number=SeqID_61785
  Gene Ontology: Mol. function=protein binding
  Homolog annotation: Hit_ID=A7PV27; Match level="QueryCoverage=88%, HitCoverage=99%, E-value=0.0, Identity=71%"; Hit description =Chromosome chr4 scaffold_32, whole genome shotgun sequence
MRRVLLIAELCIENYNRRNMINKRKREEEKWLNPGGPSDAKILRPKSSKAWNCCESLSLMGDIRLTRVEQGQTKIRNVPIAVTPEGFWCCPTPVGFQKSLKPQNPLNKLKPSSPPPKPSSQKKAVSESQRKTVPSPSRLAVSDAQQCNDDPERPPTSTSVPAQRAPKKVAIEFGEPGTFDMKLLLLGKQGFCVKLSVHRDVLIEKSSFFADKLSEQSSLSCLQVDDCEDVEIYVETVGLMYCKEMKQQLMKQSVSRILRILKVAEFLGFSSCIQSCLEYLEAVPWNGKEEEEKVIATVLRLQGEGIGVNPVLKRVSPDISNAPKDTLSHIVELVLKSNEERGRREMKSIVLKLLRENNSLPSSSGSADLCNDMINKSCRRCMDSLLCLFNQVAEPGFSDNKEPVVKHIALEADNLSWLLEILVDKQAAEDFALMWANQQELAALHGKLPIVFRYHVSCISGRLYVGIGRGEVLPSKNTRQFLLQTWLQPLINDYNWLQHGCGSFDRKLVEEGIGRTILTLPLEDQQSILLSWVGSFLKTGDGCPNLQRAFEVWWRRTFIRPYVEGQTINVMPDT

SEQ ID NO: 153471 - protein, 497 aa, Glycine max
  Coding DNA Sequence Number=SeqID_61786
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=86%, HitCoverage=60%, E-value=1e-112, Identity=53%"; Hit description =Homeodomain protein
  Pfam annotation: Domain name=POX; Domain location=289-412; Score =225.8; E_value=9.8e-65; Accession=PF07526.2; Description=Associated with HOX
EELGLVVVVATCWQDDGFTMGIATPSHSRTVLELNTIGFLLDLVSILAILCPKIFNKESSASRMGIEEEEPVYETAGMLSEMFNFPPATELLEQQHATATFRAARQAGEWYGNRQQQQQISGINADSAAAMQLFLMNPQTRSPSPPQTHATPSSTLHMLLPNPSSNSSLQGFTGSAAGGSFGQFTWVPESAHQQGGVVEGQGLSLSLSSSLEAAKAEELRMGDSGFLYYNHQQGGGGGGGSSSSSAVQFQYKNNNNNHHQALHLQGAMGHDNNHQGHVGFGSSSLGVVNVLRNSKYAKAAQELLEEFCSVGRGQFKKSKFNRQNSNPNSNAGGGASPSSKDAPPPPPLSAADRIEHQRRKVDRRYNHYCEQMQMVVNSFDLMMGFGAAVPYTALAQKAMSRHFRCLKEAITAQLKQSCEVLGEKDGAGNSGGLTKGETPRLKMLEQSLRQQRAFHQMGMMEQEAWRPQRGLPERSVNILRAWLFEHFLHPYVIPSIA

SEQ ID NO: 153472 - protein, 166 aa, Glycine max
  Coding DNA Sequence Number=SeqID_61787
  Gene Ontology: Mol. function=transcription factor activity; Cellular component=nucleus; Biological process=regulation of transcription, DNA-dependent
  Homolog annotation: Hit_ID=A5JNJ5; Match level="QueryCoverage=78%, HitCoverage=78%, E-value=6e-26, Identity=42%"; Hit description =Dehydration-responsive element binding protein 6
MEEEDNQVHNLTEEKKKSENEEVSVESNDKKKKKRSSDGKHPTYREMAARAHDVAALTIKGTSAFLNFPELASHLPRPLTTSPKDIQAAAAKAAALNFEAQVEAQAQAQLSIPSSSSEVEFPDLLLDSSHSAGEFDYSAPWLVAEAEHLDLAFRLDDPPFPAWGSY

SEQ ID NO: 153473 - protein, 183 aa, Glycine max
  Coding DNA Sequence Number=SeqID_61788
MGNGNLEMSVEDQKATFNLFEVIKHPSDSKTCFKLEATEPEADLVGRHLNCESNNPFHYPLEAKASEGLNHSRRSTSSTSSNTSSSHLFYNRQAFFLLYLAGASSPDDAEPLSWPMPRHPELALAVHSPFYGAFADDARGFSIAGGDTFGVGNDDAAETRADGDYIADIITAHEAWDPGSPQN

SEQ ID NO: 153474 - protein, 1137 aa, Glycine max
  Coding DNA Sequence Number=SeqID_61789
  Homolog annotation: Hit_ID=A5C0S8; Match level="QueryCoverage=88%, HitCoverage=41%, E-value=1e-133, Identity=40%"; Hit description =Putative uncharacterized protein
  Pfam annotation: Domain name=TolA; Domain location=470-856; Score= -135.7; E_value=0.014; Accession=PF06519.2; Description=TolA protein
  Subcellular localization annotation: CTP_CleavageSite=43; ConfidenceScore=5.53e-01
MAANSGTKYVSVNLNKSYGQHSSARTPRPSAGAAAAPPSSRPRSSHKAGPKLSVPPPLNLPSLRKEHEQFDSLGSGGGPAGPGGSGSGPRPSSSGLGWTKPVAEDVSLPVVKPAAAAAAVPVSSAVLRGEDFPSLRATLVPVPGSNQKIQENQNSIQNLNLNLNQKQKHSLGDENVFIEEKNEGSLVTDQFSVPRRVNVAGGGDDGRGSRVVNPKYGGGVGRKQEEYFPGPLPLVRLNPRSDWADDERDTGHGLSREGRDHGFPKGEVFWDFDIPRVGGLPHKHEKRGLLRGNEVVKALNSEVEAYDRMGPEGNSWRSSNLSFPKDAGNERNGVGVRSSSGSKDVGKDSNKYVPSPFRDDDAGKRDFVRRDGQGGKQQPWNNVVEPYGDRHREQLNRNRADSVQSSVSRSAFSMGGKGLPVNDPLLNFGREKRALPKSEKGFLEDPFMKDFGGSSFDGRDLLGGLVGVVKKKKDVLKQTDFHDPVRESFEAELERVQRMQEQERQRIIEEQERALELARREEEERLRQAREQEERQRRLEEEAREAAWRAEQERIEALRKAEEQRLAREEEKQRMVLEEERRKQAAKQKLLELEQRIARRQAEASKSGSNAPVVVEEKMPAILNEKEASRATDVGDWEDSERMVDRILTSASSDSSSVNRALEMGSRSHFSRDLSSTFGDRGKPVNSWRRDGYENWNSSTFYPQDQENSHNSPRRDLSIGGKPFMRKDYNGGAGFVSSRPYYKGGISEPHLDEYAHVKPQRWNQSADGDNLSRNTEIDSDFHENYFERFGDGWTQGRSRGNPFPQFPERTYPNSESEGPYALGRSRYSVRQPRVLPPPSLGSVHRTYKNENEHPGPSAFLENEMHYNQATRSDSTLPTGYDNGNRGQPEVVDARQETTENEDHKVESTPRCDSQSSLSVSSPPSSPTHLSHDDLDDSGDSPTILTSEGSKNDPLTAPDNESIATPAGNENVVTPCAVSSGDDDEWTTENNEQFQEQEEYEDEDYQEEDEVHEGDDHAQLNQDFEDMHLQEKGLPHLMDNLVLGFDEGVQVGMPNEKFERTSKDEETTFVAQQASGISLEECVSYDNASDDDKALQPVNDTKVNLNSTSSVFQESEKPAQDLVIQPSNSLSPVVSESL

SEQ ID NO: 153475 - protein, 176 aa, Glycine max
  Coding DNA Sequence Number=SeqID_61790
  Subcellular localization annotation: CTP_CleavageSite=60; ConfidenceScore=5.38e-01
MRYGETSAWQWRFRRQSVKLHLSSRESFTSPRGASTRRGCRRRRCGRCDLTQQRRRHGLRMASGGELIDSTWRQGLSSRHCLYSKKPLGCGKTLIAKAIANETGADFIHIKIRDGKIKVLTPREARYAVQLSNKPLLDVCPSNGHKKVQAWDEPWRNGKIMRQSFKVLLGGYGADS

SEQ ID NO: 153476 - protein, 20 aa, Glycine max
  Coding DNA Sequence Number=SeqID_61791
MSSATFKVAVLGSGSSASFV

SEQ ID NO: 153477 - protein, 126 aa, Glycine max
  Coding DNA Sequence Number=SeqID_61792
MGLVLSHFKPWRFGAINACWSCLRMRRVQVHRIRFGYCGYWGSLKEGVFKEVEKKRLDCDAKVHKANILIIAHTCVLSMFYESSDQGNLRPRSIDPPSHSHHWWGTMMVVMEVMARVCLREKGGAW

SEQ ID NO: 153478 - protein, 252 aa, Glycine max
  Coding DNA Sequence Number=SeqID_61793
  Gene Ontology: Mol. function=triacylglycerol lipase activity; Cellular component=extracellular region; Biological process=lipid metabolic process
  Homolog annotation: Hit_ID=A7PLA6; Match level="QueryCoverage=94%, HitCoverage=48%, E-value=1e-81, Identity=61%"; Hit description =Chromosome chr7 scaffold_20, whole genome shotgun sequence
  Pfam annotation: Domain name=Lipase_3; Domain location=23-188; Score =146.9; E_value=5.7e-41; Accession=PF01764.16; Description=Lipase (class 3)
HQEKATTQAFIMLDKSEDQDTYVVAFRGTEPFDADAWSTDVDISWFEIPGVGRTHAGFMKALGLLLDFNKEELRWPKEIETNENRPRAYYSIRNLLRKHLNGNDRAKFIVTGHSLGGALAILFTAMLMMHDERLLLERLEGVYTFGQPRVGDENFANYMEKNLKYYGIKYFRFVYCNDIVPRLPFDDDIMKFEHFGTCLYYDRFYRGKKVKEEPNKNYFSWPWKGMMIQKKVNAFRELDYQLIAPRIMLMLP

SEQ ID NO: 153479 - protein, 738 aa, Glycine max
  Coding DNA Sequence Number=SeqID_61794
MAKRQNQTQTTQAKHDFRNNLPSASCEDGEVVHIVRPMLVFILTTEVCLKDKEPKVHIKHFLDIESLENAGYVIKAPLMLCGIHNFFENLEVVVLELICELWRTDKVYRNEVIGGYFVGKFLGISVKQIGETIPQAIGCKRKYGTLLSKANIFQQIVNKPIIQKQGSKDFLSNVHKFILYHLMKSTPFDFPQILFNCLPTKVMKDKSIAKDINHTIVLTKVFEARGVIRKFFFQETVYLVETLNTRDQRSLGSLQEAGFSSRLITGHKRPTSFGFIARSGYNFLVVITGHKGPTFLGDSGNLKRVAWGLDVGTGAETNDDEDGLVFTKKKVAPPSDETTTPQVKKVKLTPQTLPPPTQPRTSKREKKGAQRTKCSTDEQVIVTVVNDPQPAEILPIREQTSTKRKRVESTDDMDDEFQYQSSPSPIHLDHFEHQGPPVIDPNLTAEDIASPSSTNLEASSPEDIQAFIISSPAQECLQDSIQGFYPLGIHICPTITIKFLPDKVTLRLAPLDLRKKKGKVSPHTKPIPHLSPKDNITLRPIPYDWNKYFTRDTAKKTVTLKPDTKHIQSYAHGANLESSKDLQIQQLVDVLLEAAIRRAIVTAWARHPKLKEHPLSPNQNPWEKLEFEELFNNLQAYLGPQVDVVEPQLAELTSQPIAEDDSRNVVPSTGQPRRNHGKEFPLLMHGNKFAYQEHLGSFTQVLQRLCFVQYEYANATTTASNRPTPSATTSYFFHTHNF

SEQ ID NO: 153480 - protein, 69 aa, Glycine max
  Coding DNA Sequence Number=SeqID_61795
MLSSVERKNVFVPYNLAVSGSGYAQHMGRDSLMCVNFMMGCECRDEGLLFHTKKQQQPMCLSNHIRLCK

SEQ ID NO: 153481 - protein, 102 aa, Glycine max
  Coding DNA Sequence Number=SeqID_61796
  Gene Ontology: Mol. function=nucleic acid binding; Cellular component= nucleus; Biological process=mRNA processing
  Homolog annotation: Hit_ID=A7QYP7; Match level="QueryCoverage=61%, HitCoverage=11%, E-value=7e-25, Identity=80%"; Hit description =Chromosome undetermined scaffold_252, whole genome shotgun sequence
  Pfam annotation: Domain name=DUF382; Domain location=29-102; Score =19.8; E_value=2.7e-07; Accession=PF04037.4; Description=Domain of unknown function (DUF382)
MPTNLQNFCYKSNTPPKMKDTNKKDGLEENAATNKKVWDAIASYPKLLVFLKSYRNNIPIPRHWCQKRKFVQGRRGIEKPPFQLPDFIAATGIKKISQIMSF

SEQ ID NO: 153482 - protein, 444 aa, Glycine max
  Coding DNA Sequence Number=SeqID_61797
  Gene Ontology: Mol. function=cysteine-type peptidase activity; Biological process=lipid metabolic process
  Homolog annotation: Hit_ID=A7PLA8; Match level="QueryCoverage=84%, HitCoverage=76%, E-value=1e-119, Identity=55%"; Hit description =Chromosome chr7 scaffold_20, whole genome shotgun sequence
  Pfam annotation: Domain name=Lipase_3; Domain location=208-357; Score= 87.9; E_value=3.1e-23; Accession=PF01764.16; Description=Lipase (class 3)
MATDCNCNKGFADSYMLLKPEDASFFDLFRVLFKGNLSQRNFVESHADDDALDESLGHRWLIVISILAQKLLQLVAKPLSLFGSCVEFLLNLVALNGGVFSIVLNFLGGKLVLPNPESENYLSFIGNLDIRAKLEDAVQREDSKYYPALSMMASKACYNNAAYLKTTVEDYWKMEFVGFYNCLNEYQGKTTTQVLIALDKHEDRHTYVVAFRGTEAFDADAWCTDLDISWYGIPGVGRMHGGFMKALGLKQNVGWPKEIGEQDENLPPLAYYVIRDILRKGLSENDKANFIVTGHSLGGALAILFGTILCLHDETLLLERLEGIYTFGQPRVGDEAYANYTRQKFKEHYIRLPYDDKEMMFKHFGTCLFFNRRYELEEHRCCSDRFQRRVSFGPDVVSEIYKDGWKMHPLLLLKISTSGLRTPVIVEGRYKDGSWNDRRCWRTL

SEQ ID NO: 153483 - protein, 76 aa, Glycine max
  Coding DNA Sequence Number=SeqID_61798
MATDQTRLQNMMKKKNKAFKEYAQRWKGVAAQAVSLLNLCKGKQKISQAGEERHKRIQAVSPSVLLAKGEENEKDE

SEQ ID NO: 153484 - protein, 108 aa, Glycine max
  Coding DNA Sequence Number=SeqID_61799
MTPTHDDLLYYNGRWNMSRQGDFVGYLFTRKNPKRFDIPSRCSIHRLKYVIKQVAPQGIPPYTLTNLCNAAFYLCMGWATALPDNDNVHSTTTPMVVKDNGLVKKPVT

SEQ ID NO: 153485 - protein, 218 aa, Glycine max
  Coding DNA Sequence Number=SeqID_61800
  Homolog annotation: Hit_ID=Q5XM22; Match level="QueryCoverage=45%, HitCoverage=70%, E-value=9e-07, Identity=33%"; Hit description =Resistance-like protein HAAS-2
MMPPSDEGLPHLPDRPIATEELNEEQQQPPIEEGVIDVEGFPGGPHDTLVLRDFENHVALRVCNGDKRPKLKLSSYGRKMTKFGRVLLDALRDLTQSRTYAWGTTTLVHKHDNLNEASKSRTRLFAGYISLLQCWIYEHFSSIGSTIDADDYDERRPHACRWTSGKALPVSTYGRRLDRLTLDVMGPLDSHSPTGEGCTMVWVHLDHYATSYCTFGLR

SEQ ID NO: 153486 - protein, 163 aa, Glycine max
  Coding DNA Sequence Number=SeqID_61801
MDNDKTITVAVISGATTAQTAKATARRRMDLNRGRRGKGDDPVKTQQAEKPGSQGLESGTIDRVKCLINVKIPKSDTMLDARGIGEAQTATESAKNGSGKPSGKGTVNNLDPSYLKKKSKLQVGCMLGNSISRNHTKEGSELLVIKYNTHKEVERIWESYQRR

SEQ ID NO: 153487 - protein, 154 aa, Glycine max
  Coding DNA Sequence Number=SeqID_61802
MHLHRRQVQLQDLRCPFFREAEEESSHLFFHCVFIQPIWWESMSWLNLQSAFPLGPKQNFLQHIFIQAEGLRIKRWRYWWMASGLKIRLKTWNQEQFGDTFKKVTKLESDLNKLEENSMHRQLTEQEKLERKQLQESLWVAAQAHESLLRQKSR

SEQ ID NO: 153488 - protein, 129 aa, Glycine max
  Coding DNA Sequence Number=SeqID_61803
  Pfam annotation: Domain name=Pox_A_type_inc; Domain location=74-96; Score=11.8; E_value=1.6; Accession=PF04508.3; Description=Viral A -type inclusion protein repeat
  Pfam annotation: Domain name=Pox_A_type_inc; Domain location=97-119; Score=5.1; E_value=15; Accession=PF04508.3; Description=Viral A-type inclusion protein repeat
  Pfam module annotation: Pfam domain module=Pox_A_type_inc::Pox_A_type_ inc; Domain location=74-96::97-119
SLEVVVFNQQTKAGEPQSGEGDEEAIDEGAFGRNGGGEGESPNKELVEKAVEVKKEVEEVLKSTKLKIVGVMERSVEDLKGKIKELESKIAQGSNSEDMEKIKEKIERLREDLESSSKDVYVKQLSVKS

SEQ ID NO: 153489 - protein, 23 aa, Glycine max
  Coding DNA Sequence Number=SeqID_61804
MTVQRSNLGVVPMAHLVVPQVFR

SEQ ID NO: 153490 - protein, 304 aa, Glycine max
  Coding DNA Sequence Number=SeqID_61805
  Gene Ontology: Mol. function=oxidoreductase activity, acting on the CH-NH2 group of donors, NAD or NADP as acceptor; Cellular component =chloroplast; Biological process=nitrogen compound metabolic process
  Homolog annotation: Hit_ID=Q93WZ8; Match level="QueryCoverage=14%, HitCoverage=1%, E-value=2e-12, Identity=84%"; Hit description=NADH glutamate synthase precursor
  Pfam annotation: Domain name=GATase_2; Domain location=216-304; Score= -88.5; E_value=0.071; Accession=PF00310.12; Description=Glutamine amidotransferases class-II
MKEVVSIGRNWKEKGQANGGAEGYAFCPCNGCNNRTRGFRGEKGEGWLQNLHYGFNLILIMELLVVVAIDAGGEGWPSWLSKVAGEAINGLTPRRADTFEKIDKAVSELCHNIEGNINVGSFSRLIYDMMLVWERPSYYDEEDTMENVAKEKEERKITLNTTQEQDDIPLFFSHVNVSMSTVRVVTDALEMMVRMMHRGACGCDCEANTGDGAGMCEVLAAAAVKPTLEMKQGCVVTDALEMMVRMMHRGACGCGYEANTGDGAGIMVALPHQFYKEDVYPRWAANSHYTLVPIPEGQQLDGSR

SEQ ID NO: 153491 - protein, 110 aa, Glycine max
  Coding DNA Sequence Number=SeqID_61806
  Gene Ontology: Mol. function=oxidoreductase activity; Cellular component=chloroplast
  Homolog annotation: Hit_ID=A9PEL1; Match level="QueryCoverage=38%, HitCoverage=15%, E-value=6e-13, Identity=83%"; Hit description =Putative uncharacterized protein
MSNLIEQLYDHSIIKTNHALSSSKETIHLSMLKPLISKEEHEALVCLCGSQVCWGSYLNLSGEEAFQKFLHLAWIQTDRKLGGLGDLNYPLISDATKFILKSYGVLIPDQ

SEQ ID NO: 153492 - protein, 62 aa, Glycine max
  Coding DNA Sequence Number=SeqID_61807
MPLCHCCSCCHCAATVVALSLSIIIIMVRTKSSGRALGRVIGRALGREVNRDADDAPSGEGP

SEQ ID NO: 153493 - protein, 356 aa, Glycine max
  Coding DNA Sequence Number=SeqID_61808
  Gene Ontology: Mol. function=protein-tyrosine kinase activity; Cellular component=MHC class I protein complex; Biological process =protein amino acid phosphorylation
  Homolog annotation: Hit_ID=A7NTX9; Match level="QueryCoverage=44%, HitCoverage=100%, E-value=1e-56, Identity=66%"; Hit description =Chromosome chr18 scaffold_1, whole genome shotgun sequence
  Pfam annotation: Domain name=Hin1; Domain location=131-267; Score =21.9; E_value=2.3e-05; Accession=PF07320.4; Description=Harpin -induced protein 1 (Hin1)
  Subcellular localization annotation: CTP_CleavageSite=25; ConfidenceScore=5.58e-01
MAMLAKTDSEVSSLTQSSPTRSPRRAVAHWAPRPTPTPTPPWAITRASPPPRASLARARAAPRATTARARGGPGRTSSMPSRRRASSMLTTMPVASLVAAISQHLSSASSSSSPHSPSFSGVLVAPKSPPFLSSITFDQFVIQAGADMSGVATSLVSMNSSVKMTFRNTATFFGVHVTSTPVDLNYYQLTLATGTMPKFYQSRKSQRSVRVMVIGSHIPLYGGGANLNSVNGKPVEPVPLTLSVMVRSRAYVLGKLVKPKFYKKIECSIVMDPKKMGKAISLVKKCTYQVRLARERVWQEAFTILRILIHEQPPIVEEEFGLSGLNMDGPITRARSKRLQKEFGERLNSIVEKRKE

SEQ ID NO: 153494 - protein, 55 aa, Glycine max
  Coding DNA Sequence Number=SeqID_61809
MTNGNRRYMGIPVTTHHQKRKTLDEASLLSSKSETQHDHRSTSTSYVSHRLGYRA

SEQ ID NO: 153495 - protein, 82 aa, Glycine max
  Coding DNA Sequence Number=SeqID_61810
MKSVVLEDKLKACQRSKRSLTEQLSKTEKNMLIIIGQYKEKVNQVASHGQMLEDEQAKVSALQIEREARERVIELLHGEAMK

SEQ ID NO: 153496 - protein, 31 aa, Glycine max
  Coding DNA Sequence Number=SeqID_61811
MPISGKELWRQQEEQLLQRYLGYINTLVGDC

SEQ ID NO: 153497 - protein, 162 aa, Glycine max
  Coding DNA Sequence Number=SeqID_61812
MAPRKRKATSLVSQAGYDRSKFVSQEAWDHYSDNVLVRNILPERNVKLYINEFDDFRRELIRRNWHKQLTNVTEGSIDVAIMKEFYTNLYVPDDKSPKNVRVRGHLIKFDVDSLNTFLETPVVVEQGESLPSYSRFVRLRPDPQELTARLCILGRGFVLMSR

SEQ ID NO: 153498 - protein, 37 aa, Glycine max
  Coding DNA Sequence Number=SeqID_61813
MAMAPKKLPAKRDRKATTGKGSSAAPQLEIEFDGHRF

SEQ ID NO: 153499 - protein, 89 aa, Glycine max
  Coding DNA Sequence Number=SeqID_61814
MERTAYLNKSYEKVCIGYLDKINIQKSLSYEKARIAHTIKKKAFYIGSNELSTSVTTRGGNTVSLNTDIGWRTVFEGRPFYIGCVAQPM

SEQ ID NO: 153500 - protein, 68 aa, Glycine max
  Coding DNA Sequence Number=SeqID_61815
MKKQHCNGGLRSTYMKLLCSDYHLMEACLWGFYGGWICEFQWGPLMVIFHHGDAAEDKGKEVRGGAIH

SEQ ID NO: 153501 - protein, 66 aa, Glycine max
  Coding DNA Sequence Number=SeqID_61816
MLLPIYCNEDAGDSGVMRAVRASLVQTKDQAECFDDAKVSHASQSLKALYKTKKLKIFKMDDQDSL

SEQ ID NO: 153502 - protein, 112 aa, Glycine max
  Coding DNA Sequence Number=SeqID_61817
  Subcellular localization annotation: CTP_CleavageSite=56; ConfidenceScore=5.37e-01
MIVTESKSMFYSNYKAINVSNSNDYSALSILTFHSPQVRLKKDSLTSTSRLAPFSRLARVSEFLLSAKLALSLEGDKQLAEQADDALSACLHGRFPSRFLLSAKRVDVSLSG

SEQ ID NO: 153503 - protein, 88 aa, Glycine max
  Coding DNA Sequence Number=SeqID_61818
  Gene Ontology: Mol. function=histone-lysine N-methyltransferase activity; Cellular component=nucleus; Biological process=chromatin modification
  Homolog annotation: Hit_ID=O23372; Match level="QueryCoverage=63%, HitCoverage=2%, E-value=8e-21, Identity=80%"; Hit description =Probable histone-lysine N-methyltransferase ATXR3
MANYASRICHSCQPNCEAKVTVVDGQYQIDIYSLREIQHGEEITFDYNCVTKVCSISMHLQTEIMIVTESKSMFYSNYKAINVSKLKY

SEQ ID NO: 153504 - protein, 356 aa, Glycine max
  Coding DNA Sequence Number=SeqID_61819
  Gene Ontology: Mol. function=diaminobutyrate-2-oxoglutarate transaminase activity; Cellular component=cytoplasm; Biological process=biosynthetic process
  Homolog annotation: Hit_ID=A8GEI0; Match level="QueryCoverage=85%, HitCoverage=65%, E-value=1e-156, Identity=90%"; Hit description=2,4 -diaminobutyrate 4-transaminase
  Pfam annotation: Domain name=Aminotran_3; Domain location=96-356; Score=253.6; E_value=4.2e-73; Accession=PF00202.12; Description =Aminotransferase class-III
MASLARMALVKRRMRALSDDRPRNVRYSPLFTLVVDQWRTRRILQRYHAWRDMMTDKVRIDTLVANSLNGNNETYLARQAEFESNVRSYPRKLPLAIAKAQGVWITDVENNQYLDCLAGAGTLALGHNHPDVLQSIQNVITSGLPLHTLDLTTPLKDRFSDYLLSLLPGEGKEYCLQFCGPSGADAVEAALKLAKKHTGRSGVISFSGGYHGMTHGALSVTGNLSPKAAINGMMPEVQFMPYPHEYRCPLGIGGEAGVKALTYYFDNLINDVESGVRKPAAVILEAVQGEGGVNPAPAEWLQRIRKVTQEHGILLIIDEVQAGFARTGKLFAFEHAGIEPDIIVMSKAVGGGLPLA

SEQ ID NO: 153505 - protein, 314 aa, Glycine max
  Coding DNA Sequence Number=SeqID_61820
  Gene Ontology: Mol. function=isomerase activity
  Homolog annotation: Hit_ID=A8GGQ3; Match level="QueryCoverage=100%, HitCoverage=100%, E-value=1e-141, Identity=78%"; Hit description =Xylose isomerase domain protein TIM barrel
  Pfam annotation: Domain name=AP_endonuc_2; Domain location=19-237; Score=107.3; E_value=4.7e-29; Accession=PF01261.15; Description=AP endonuclease family 2
MKLSFCTDRLGQLPFEQMLDPAAGAGGVRRGNDPPGGWSPAPHLDADDLLANPAKRRQLLQALASRGMEIAALNVSGNPLDPGELGQRHQRQTDNTLELAGLLGVKKIVMMSGLPPASPHDTIPNWITYTVSWPPTVKNCLDYQWNEVAIPYWQALVARAKACGVERFALENFSAMLVWNPETLFRLREAVGPMVGLNLDPSHLIWMGADPIAVARALGPAIHHVHGKDVRLERGVVEVNGLLETKPIDDVARRAWNYVAVGCGRDLQWWKAFFSVVRMMGYNDWVSLEMEDLTMSVDAGIVSSVQALQQSISQ

SEQ ID NO: 153506 - protein, 134 aa, Glycine max
  Coding DNA Sequence Number=SeqID_61821
  Gene Ontology: Mol. function=oxidoreductase activity, acting on single donors with incorporation of molecular oxygen, incorporation of two atoms of oxygen
  Homolog annotation: Hit_ID=Q0K3L8; Match level="QueryCoverage=91%, HitCoverage=98%, E-value=2e-51, Identity=77%"; Hit description =Glyoxalase/Bleomycin resistance protein/Dioxygenase superfamily
  Pfam annotation: Domain name=Glyoxalase; Domain location=10-127; Score=16.7; E_value=0.0028; Accession=PF00903.16; Description =GlyoxalaseBleomycin resistance proteinDioxygenase superfamily
MGTHPRSLPMFDHVKFGVSDFALSKAFFLNALAPLGVKIVAEGEPGYGVELCHDRGNVSLCLFQTDEKPAHLHLAFAASSREQVDAFYHAALNAGGKDNGAPGLRPNYHAHYYAAFVIGPDDHNIEAVCHNPMS

SEQ ID NO: 153507 - protein, 119 aa, Glycine max
  Coding DNA Sequence Number=SeqID_61822
  Gene Ontology: Mol. function=DNA binding; Cellular component =intracellular; Biological process=regulation of transcription, DNA -dependent
  Homolog annotation: Hit_ID=Q65IT0; Match level="QueryCoverage=89%, HitCoverage=91%, E-value=2e-38, Identity=67%"; Hit description=YdzF
  Pfam annotation: Domain name=DUF24; Domain location=25-117; Score =137.9; E_value=2.8e-38; Accession=PF01638.8; Description =Transcriptional regulator
  Pfam annotation: Domain name=PadR; Domain location=24-102; Score= -16.2; E_value=0.076; Accession=PF03551.5; Description=Transcriptional regulator PadR-like family
  Pfam module annotation: Pfam domain module=DUF24::PadR; Domain location=25-117::24-102
MTAESHCSPTGISLEDTGYGYTLSVINGKYKMIILYWLALYKPVLRFNELQRCIGTISYKTLSSTLKELEKDRLVVRKEYPQIPPKVEYSLSERGRSLIPVIDMMCNWGEQHRPEQPVP

SEQ ID NO: 153508 - protein, 144 aa, Glycine max
  Coding DNA Sequence Number=SeqID_61823
  Homolog annotation: Hit_ID=A7PHV0; Match level="QueryCoverage=69%, HitCoverage=31%, E-value=7e-09, Identity=35%"; Hit description =Chromosome chr13 scaffold_17, whole genome shotgun sequence
MCSATDYKTKSIGGMCILLQLWAWERCPTLAPKRTPSQIENIPLGHRWLRRGNQHIGNDDVKVFCRKLDIMKRHKFVWEPYPSTVISLLPPVCLVGTLAWRKTKMFVDPENAKMATLAEVAETLQYMVSPQGRNTWTVDDLVPY

SEQ ID NO: 153509 - protein, 123 aa, Glycine max
  Coding DNA Sequence Number=SeqID_61824
MELLRLHQHEENDKKKKGIALKVSSSIQEESDQDNDPDDDDDLSLFVRRFNKFLKKKMEKSEKKNHSEKKLKKAYITWDENDMESSEDSENEEINLCLMAKSYESDEEKRTWHINLLLQEKLQ

SEQ ID NO: 153510 - protein, 78 aa, Glycine max
  Coding DNA Sequence Number=SeqID_61825
  Subcellular localization annotation: CTP_CleavageSite=33; ConfidenceScore=5.54e-01
MVSGASATSVTFRGSNWEASSSTFLKNGFRGFRGFRNTSVKFPKTLGKHIPLNIGEREEKKDENQIRKQFRKASVTFP

SEQ ID NO: 153511 - protein, 41 aa, Glycine max
  Coding DNA Sequence Number=SeqID_61826
MPAGIGLFDSDRIKTELICNAYAKTHAGRAQYDIFTEHKQR

SEQ ID NO: 153512 - protein, 39 aa, Glycine max
  Coding DNA Sequence Number=SeqID_61827
MRKRRVLDFKKKVVEEKGTDGKKNDERGENNQEKEKQIM

SEQ ID NO: 153513 - protein, 209 aa, Glycine max
  Coding DNA Sequence Number=SeqID_61828
  Subcellular localization annotation: CTP_CleavageSite=59; ConfidenceScore=5.27e-01
WKDPVDRSVLPTNLFRSPMNCVFVHVSSTFEFGAMRRDCLVQFSILNPFSEPMNCVFVHASSTFEFGAMRTMRSDCLVQFSILNLFRSPMNCVFVHVSSTFEFGAMRSDCLVQFSILNLFRSPMNCIFVHVSSTFEFGAMRSDCLVQFSILNLFRSPMNCVFVHVSSTFEFGAMRSDCLVQFSILNLFRSPMNCIFVHVSSTFEFGAMR

SEQ ID NO: 153514 - protein, 96 aa, Glycine max
  Coding DNA Sequence Number=SeqID_61829
ETHEIPHRNLADFEPCLGYATEGQAVGGIPLQNTLKGPLHFAVGRAPPAMAEKGKLDHIEERLKDIEGGEDYAFANLEELFLVPEHGHSQVQGAGL

SEQ ID NO: 153515 - protein, 276 aa, Glycine max
  Coding DNA Sequence Number=SeqID_61830
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=100%, HitCoverage=100%, E-value=1e-143, Identity=90%"; Hit description =Beta-lactamase TEM precursor
  Pfam annotation: Domain name=Beta-lactamase; Domain location=31-270; Score=171.3; E_value=2.5e-48; Accession=PF00144.15; Description=Beta- lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAALGPDGKPSRIVVIYTTGSQATMDERNRQIAEIGASLIKHW

SEQ ID NO: 153516 - protein, 141 aa, Glycine max
  Coding DNA Sequence Number=SeqID_61831
MGDIEEVQEQMKANMEALKDQVASMMEVMLSMKRMMESNAAIVAAASTVAKADPTHPSAINQANQPAQDMVGQGGAVLGSTGGSHLGYNRNAYPYDLPLNYTPPTMHMPNENVNHVVPVTFEGQQPQPIGGTREEPRKRAQ

SEQ ID NO: 153517 - protein, 49 aa, Glycine max
  Coding DNA Sequence Number=SeqID_61832
MGEDSWSLVRTNLLKELGKFLYECMKLFGGKERFEELRMSLLVDGLTKV

SEQ ID NO: 153518 - protein, 177 aa, Glycine max
  Coding DNA Sequence Number=SeqID_61833
  Homolog annotation: Hit_ID=Q9AVH2; Match level="QueryCoverage=36%, HitCoverage=40%, E-value=1e-19, Identity=52%"; Hit description =Putative senescence-associated protein
TRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRKSRTSKGSKSNVAMNAWLPQASYPYVPPQPNSPPDNVFRPDRPAEADLGSKKRGSAPLPIHGI

SEQ ID NO: 153519 - protein, 149 aa, Glycine max
  Coding DNA Sequence Number=SeqID_61834
MTTLVSTCQSDLGSPNDVVRITVRCLRILPDSWVMIAKGGVVDKREALAPTHPPFVMRNSDLCADNCKVSLHATELLGHDSKRQVWAISPWVKVCGELGFWLKACRMAGHDICQGVGLASGSGIKGMSHIISMTHVTTYPSAGGRRVTR

SEQ ID NO: 153520 - protein, 68 aa, Glycine max
  Coding DNA Sequence Number=SeqID_61835
  Homolog annotation: Hit_ID=A5C809; Match level="QueryCoverage=77%, HitCoverage=14%, E-value=4e-08, Identity=50%"; Hit description =Putative uncharacterized protein
MNGIFISQSKYCKELINRFGMENAKHMATFMSTACYLDKDEIGQSIDIKKYRDIKQIPKNLTLVQLKE

SEQ ID NO: 153521 - protein, 120 aa, Glycine max
  Coding DNA Sequence Number=SeqID_61836
MPRRRNAPSRLRADRAWPGHVSQCFTSAGMVSEEEVAAIGEEFPQDPPNFVYEGRVFEDPNDEGLTIDFDRDVSQTINEEEEEDVLSPELERLIAQEEREMKPHQEETELVNLGTGEGKK

SEQ ID NO: 153522 - protein, 103 aa, Glycine max
  Coding DNA Sequence Number=SeqID_61837
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=28%, E-value=2e-10, Identity=100%"; Hit description=LacZ protein
MVFVSPSTSEWQYFQPGSTLFFLVALAVAALDDAHPPFASWRNSEEARTDRPSQQLRSLNGEWDAPCSGALSAAGVVVTRSVTATLASADVRRCFCRYAPPRQ

SEQ ID NO: 153523 - protein, 162 aa, Glycine max
  Coding DNA Sequence Number=SeqID_61838
QGAPFEGTIVDDWKFDYSSHDAHRMVCNYQAEMTASEEDLILMWVFLTDHQIDWAHLVQYRMHKALRANAPLPYPQLVTLFLLKRSFAIGAGAVTSFGYLKDRNALMTKVLSELRGLRSYVGERFDSLDNRFAGMDIRLTQLEEDVGYIRQSFDLPPPPPPS

SEQ ID NO: 153524 - protein, 133 aa, Glycine max
  Coding DNA Sequence Number=SeqID_61839
KASVDEVKDADAPVPVPTAEVSLVGQALHTFLAWPTHLIKSLSHQVVVSPPKPPPKPDPEVDDPLYLMTLTIAELFLRPYQGLDDAPQPKSKAPARRIVVKCNRQKGTTECGYYVMHWMSTIILGTFTNNCEA

SEQ ID NO: 153525 - protein, 237 aa, Glycine max
  Coding DNA Sequence Number=SeqID_61840
MRGAPTKESLSPFLAWESPLRKDKELRGICNGIIGGYHEWLKIHTRGLDWLSKLKIINEENFEAPEEDEEVRALKTELGNARLAKEKFKLVTTDVRKECAGLREENAATARALEQETKRARKEEHGRDKFCGALWGSNSELKLRREERDQSRAHSMVLKEELELKVQKELVSAFMRDKDQHARGRVIDSLHQEATIWMDRFALTLNGSQELPRLLAKAKAMADTYSAPEEIHGLLSY

SEQ ID NO: 153526 - protein, 46 aa, Glycine max
  Coding DNA Sequence Number=SeqID_61841
MESEEDEDVGLPPELERIIAQEDREMRPHQEETELVDLGTDSGKKE

SEQ ID NO: 153527 - protein, 88 aa, Glycine max
  Coding DNA Sequence Number=SeqID_61842
MAAEWRRKRERRRHFKEKMSLEEAHHHRRPWIRAWRKKEMNERRGREEHEIVCSKRALKSKLWFNPLIQDKFQDSPLSVHRRHEACKA

SEQ ID NO: 153528 - protein, 198 aa, Glycine max
  Coding DNA Sequence Number=SeqID_61843
NPLMKKILGLQAPMELASIINEENFEAPEEDEEVRALKTELGKARLANEKFKLVATDVRKECAGNSELKLQREERDQSRAHSMVLKEELAAFSRSKRNLSQHLCETETNMLAIVSKYREELNLATTHEHKVADEYAQVYAEKEARGRVIPLHQEATMWMDRFALTLSGSQELPRLLAKAKAMADTYSSPEEIHRLFSY

SEQ ID NO: 153529 - protein, 164 aa, Glycine max
  Coding DNA Sequence Number=SeqID_61844
  Homolog annotation: Hit_ID=A5AIK9; Match level="QueryCoverage=78%, HitCoverage=8%, E-value=6e-12, Identity=34%"; Hit description =Putative uncharacterized protein
MTRGNPGDLQPFDPEIDRTFHKLVRHSVHPVHFEHYVEGDSEYSDFEHSTTNFHTENMAQPPPCERTLREMAAPNFTYESLCIQYPDERVPYVLKTGLIHLLPKFYGLAGEDPHKHLKEFHIVCSTMKPLDVQEDHIFLKAFPHSLEGVAKDWLYYLAPRSIVS

SEQ ID NO: 153530 - protein, 69 aa, Glycine max
  Coding DNA Sequence Number=SeqID_61845
MGVQIATRPTWALQKIPPEGCCFWRKQPCSPGRAELTWASWINGSGMEKEEREETPLQGEDESRRSSPP

SEQ ID NO: 153531 - protein, 73 aa, Glycine max
  Coding DNA Sequence Number=SeqID_61846
RSTAVDLIPIDLEINATYRRRNSERIKFFWQDLEAAATPEEEPQSSEASSSFPIAGNSHIKSVEDTIMDEEPR

SEQ ID NO: 153532 - protein, 131 aa, Glycine max
  Coding DNA Sequence Number=SeqID_61847
SGCLLVDPNGHNVGLCTIDFQVFCLCPILLGCDSLCCLNVVLLGCCGSLGGLMGTRGWWVYACIVDVENLLCTIARPPPSTTCDGVKLPAFIVDHRVVPGDMSWGSGDLGDVRLENEVRKLRKPLVIDYQG

SEQ ID NO: 153533 - protein, 157 aa, Glycine max
  Coding DNA Sequence Number=SeqID_61848
MASKKRKAPATPSHVRYDRSRFTSPEAWERYTDIIVPRKLLPERNVVIYHTEFDKFMEELERRRWDEELTSFEEGNIDVAIGETLSAYSRFALLRPNPQELAAKLCIPGRGFELNADGQPLKILKKNMTTLAQTWSVLSYSNLIPTSHTSDITLDRA

SEQ ID NO: 153534 - protein, 91 aa, Glycine max
  Coding DNA Sequence Number=SeqID_61849
MAKFDPDIVLEFYANAWPIEEGVRDMRSWMPLSSSWVTRYCWRKARSTSSVRRGIGPMGLTRRPLPSCYAPQGRISPGSLQGGGCGSCAPA

SEQ ID NO: 153535 - protein, 90 aa, Glycine max
  Coding DNA Sequence Number=SeqID_61850
  Homolog annotation: Hit_ID=A5C0F5; Match level="QueryCoverage=63%, HitCoverage=8%, E-value=4e-08, Identity=40%"; Hit description =Putative uncharacterized protein
WLRRGNQHIGNDDLIVFRRKLDIMKRHEFLWEPHTTTVMSTLPPICLVGSVAWYAVVPLICFHVVECPNPIECCDNLECNNLFRSLLRNH

SEQ ID NO: 153536 - protein, 248 aa, Glycine max
  Coding DNA Sequence Number=SeqID_61851
  Gene Ontology: Mol. function=2-methylcitrate dehydratase activity; Biological process=propionate catabolic process
  Homolog annotation: Hit_ID=Q3KCA6; Match level="QueryCoverage=64%, HitCoverage=35%, E-value=9e-39, Identity=52%"; Hit description =MmgE/PrpD
MTCGSLLPARWPRTGRRSRITMPIIRQRCLPGSAEANMDTTLDRLADFIAATRFAQLPEPLVAQAKRHLLDTLGAALAGCDSPIWRECRALVAEEGGSTVAQLWGCAQQASPRQAAWLNGVAAHMYELDDTGGCDHSGAVVLPALLAALPLATQPVDGRAFLTAMVVGYDIGRRVMSLRGSAHNGAGWHSTASCGVRIAGESAETRRPPNTAAAARSVPRRHRQQLALCLTLDNVADVRQVAALLATR

SEQ ID NO: 153537 - protein, 86 aa, Glycine max
  Coding DNA Sequence Number=SeqID_61852
MAIIVNAEACGYVSMNYYQYIDVVYTNEHILKAYSAQWWPLGNEAAIPPSDDAWTLILDPTTIRAKGWPKSTRIMNEMDWLEPSDH

SEQ ID NO: 153538 - protein, 60 aa, Glycine max
  Coding DNA Sequence Number=SeqID_61853
MYSGRGPVATDQGRLEVDDKRGEEQHICMQTADDEGHERPKAFGDIFHQGRNSPNAPIPL

SEQ ID NO: 153539 - protein, 57 aa, Glycine max
  Coding DNA Sequence Number=SeqID_61854
ENDRSHPAQVVAAQIRTLLFKHEGCTGLSTNHLDVTLTSSVGPECVELISIVQRAIS

SEQ ID NO: 153540 - protein, 118 aa, Glycine max
  Coding DNA Sequence Number=SeqID_61855
MERSMIDAASGGALGDMTPAEARNLIEKMASNSQQFSAKNDAIVIRGVHEVATNSSSSAETKKLEASLPTPVQKCGNPCLLFTTSGRRCSGPCSFDTVLEPYSALLPGNDLAFTLLRN

SEQ ID NO: 153541 - protein, 53 aa, Glycine max
  Coding DNA Sequence Number=SeqID_61856
MGYKKGEACHPARPGELSLPRRARLLPPEATAFWRKDLEGPSGPDCYLHPPFY

SEQ ID NO: 153542 - protein, 116 aa, Glycine max
  Coding DNA Sequence Number=SeqID_61857
MVGYAPSSFADLVFASERIKVGLERGKSNHPTLMNTKTRANEEGENEGETHAVTAIPIQPSFPPTQQCHYSANNIPSPYPPSSYPQRSSLNQPQNPPTTQPMLNTTFSTNQNTNQK

SEQ ID NO: 153543 - protein, 179 aa, Glycine max
  Coding DNA Sequence Number=SeqID_61858
MRQLGYPMRGAPTEESLSPFLVRDLGAQSLKVIQRVHKAWRSPLRKDKELRGIQNGVIGGYHGWLRVHTRGLDWLSKLKVINEENFEAPEEDEEVRALKLELGKARLAKEKFKSAATHIRKECTELQEENAATAKALNKKLKGPARKNMAERNSGGHCGVATMSSSSKERKETGHGCMA

SEQ ID NO: 153544 - protein, 218 aa, Glycine max
  Coding DNA Sequence Number=SeqID_61859
MFVDPENAKTATLGEVAEALQYMVSPQGRKTCTFDDLVPYVEKITILSEEQERVTEPVSHGPASERQFPPQQFHMLQSSIETQGIDRRRDTVEAEEYSQQMAERGHGMYYTPQTFAEYPTQMYQYPFQGHETDTSATQQSFGGFAETQAHFSWPTMTPSQQYHGPIPTPNAPLGTQWNVPGQIPNTGDLFGVDLRHAFSAEADEEEAGRHRGSGRPYR

SEQ ID NO: 153545 - protein, 217 aa, Glycine max
  Coding DNA Sequence Number=SeqID_61860
MGDQEETQEQMKADMSALKEQMASMMEAMLGMRQLMEKNAATAAAVSSAAEADPTLLATAHHLPSNIVGRGRDTLGHDGSPHLGYNRAAYPYGLSPNYSPPVLQEDAGHIASPGLEREPPQQPEEGHKDPQDYAQRDVEFYPPIPEGPAPSTLPQPNIATQPIVLPKEGPSPATEERRKLDLLEERLRVVEGFGDYPFADMTDLSLVPDVVIPPKFK

SEQ ID NO: 153546 - protein, 304 aa, Glycine max
  Coding DNA Sequence Number=SeqID_61861
  Homolog annotation: Hit_ID=Q2HW90; Match level="QueryCoverage=53%, HitCoverage=40%, E-value=2e-12, Identity=29%"; Hit description =Putative uncharacterized protein
MAKIQGPEEGKTYSNIYKEEWTQPWPMCLEIYPKVHENPRVFFSSSSPIFLESSIQYLWGRIASLFPNLDGLVDLASVNAFLAYHHGKESPIVAVLANAYDTFDRRCEKSGTRIVYCTTALYERGAGVLSLCEGFSNVTLMGTRGCINYNPILAIRQLGYPMRGAPSEETIMPFIARGFSDPNARMFQKVRKAWSVVQRKDKELRGSINGIVGGYHKWLKARTQEITWLPKLKISSEEETETPEESEEVQAMKVELERVQAVKEKFKKMAIKVRKECDELRDVNMATTKALEQKTKRAQKEEWG

SEQ ID NO: 153547 - protein, 167 aa, Glycine max
  Coding DNA Sequence Number=SeqID_61862
  Gene Ontology: Mol. function=nucleic acid binding
  Homolog annotation: Hit_ID=A5AZ88; Match level="QueryCoverage=99%, HitCoverage=13%, E-value=4e-11, Identity=34%"; Hit description =Putative uncharacterized protein
MIDAANGGALGDMTPVEARNLIEKIASNSQQFSARNDAIVLREVHDVATDSSSSSENKKLEGKLDALGNLVTQLAINQKYANALVIVARVCGLCSSADHHTDLCPSLQQSGVNEQPEAYVVNIYNRHPQQQNQRLQNNYDLSSNRYNPGWRNHSNLRWANPPQQQQQ

SEQ ID NO: 153548 - protein, 41 aa, Glycine max
  Coding DNA Sequence Number=SeqID_61863
MMMTTNMMSEMKMRTRWIRRYTMTMVDIMMISRFQESFNIR

SEQ ID NO: 153549 - protein, 29 aa, Glycine max
  Coding DNA Sequence Number=SeqID_61864
MGAKYLEVVKRGSHPNNGWSPDKIRIKGK

SEQ ID NO: 153550 - protein, 68 aa, Glycine max
  Coding DNA Sequence Number=SeqID_61865
  Homolog annotation: Hit_ID=A2Q4W5; Match level="QueryCoverage=100%, HitCoverage=44%, E-value=5e-09, Identity=44%"; Hit description =Reverse transcriptase-beet retrotransposon, putative
MNILSYNIRGLGRGIKWASIRRLVGKHKIDLLCLQETKRDSLDKALCQTLWGQSDFELEWVPAVNTAG

SEQ ID NO: 153551 - protein, 56 aa, Glycine max
  Coding DNA Sequence Number=SeqID_61866
MNTHSNLAYFYHRAHRKRFPADFRREEKEKTDFRQEEKEKSKCKVFERASCEMPTF

SEQ ID NO: 153552 - protein, 126 aa, Glycine max
  Coding DNA Sequence Number=SeqID_61867
MEMSNLASKLKAHKLELGEDLLVFLMLVLQMYTTQVNNISMLNGTNFKGKKAVEIVRLYGFGFDTENGTIHFHCWKPPMRSVSEPFMGVKAKLLSKNEIGWRRVDSGYYLHKYKGNAGLPMEPTAK

SEQ ID NO: 153553 - protein, 81 aa, Glycine max
  Coding DNA Sequence Number=SeqID_61868
MKLQMLFLFMMRLNIRSEIGFKASCRLRMLSLFMMRLNIRSEIGLITSCKCSQNTCNDIEYLQNFILKESKKLKRGRKRFV

SEQ ID NO: 153554 - protein, 63 aa, Glycine max
  Coding DNA Sequence Number=SeqID_61869
VGEKTSIWQTDELRRSKPTPVDEARAAEKTRETENRRIYGKYWEQTELFKKETFFQGKTLYNF

SEQ ID NO: 153555 - protein, 48 aa, Glycine max
  Coding DNA Sequence Number=SeqID_61870
MVKYRAKSKTGMNRGARGRVRMDARPVINRSMSRVWLRTIKKRYREVA

SEQ ID NO: 153556 - protein, 74 aa, Glycine max
  Coding DNA Sequence Number=SeqID_61871
  Homolog annotation: Hit_ID=A2Q1D6; Match level="QueryCoverage=85%, HitCoverage=12%, E-value=2e-09, Identity=44%"; Hit description =Ovarian tumour, otubain, related
DLEMQHPMKLLEHDQYIHWHIIKDEDVVRDIFWCHLDAVNTYKTNRYRLPLLDFVGVTPTGMTFSAGLHMWSVN

SEQ ID NO: 153557 - protein, 70 aa, Glycine max
  Coding DNA Sequence Number=SeqID_61872
ARGVVSYSVTFEHLSPVINLAYIRKNCWNLDDRAVSIQGARRARARPAELPSTFVAPTPASTSAALSVPA

SEQ ID NO: 153558 - protein, 313 aa, Glycine max
  Coding DNA Sequence Number=SeqID_61873
TPTHGYSKPVQLNIFIDGLRPHSKQLLDASAGGKIKLKTPEEAMELIENMAASDQAILRDRSYVPTKRSLLELGTQDATLAQNKLLTRQIEALTETLSKLPQQLQAPTGYFSRSKLYGRTKSRISGLQPGELIWIPPRGSRIQSWATRIQSRKELHARFRVEESGKPVQGAEESTTVPTAIPATPSQQVLQDGGKPQISPTRIPLSSLFKGISSMVFQAKIHMLTLPHTLKYATLRGKTMVALFQGQQLMNLGRSGGKVFKEILPRVEDRRRENGDFLLPPISRMESLSEALDRFHGLFTKDTDTRDIASRDN

SEQ ID NO: 153559 - protein, 181 aa, Glycine max
  Coding DNA Sequence Number=SeqID_61874
  Gene Ontology: Mol. function=protein binding
  Homolog annotation: Hit_ID=UPI00006A2264; Match level="QueryCoverage =71%, HitCoverage=26%, E-value=3e-10, Identity=30%"; Hit description =UPI00006A2264 related cluster
MSLPTEDSMPSPSEDCTSSSLEGYTPSPSEDYTSLAFRGLRVLLSRTTRSLSPFEDCTPPDKRAASPRLQKASRTSPSEDYMSSPSEGCTPSPSEDYTSSPSEGYTPSPSKDYTSLPSEDYTSSPSQDYMSLPSEDSTSSSSEDCTSSSSKDCTSSSLEGYTLLPSEDCMSSPSEDYTPSP

SEQ ID NO: 153560 - protein, 101 aa, Glycine max
  Coding DNA Sequence Number=SeqID_61875
MPAPHLPDLNHIRATISFDNLFSIVLRYGHATTPHDKPWENRDMALFEMGPESYGTAMVTCKCQPAAFALWTTTKLGVFRWDRPWDPSITFENHGLEPQHL

SEQ ID NO: 153561 - protein, 117 aa, Glycine max
  Coding DNA Sequence Number=SeqID_61876
METNAVAVAATRAVAKVNPMPPSDLKPNESSNLRYATEGQGPQYHPQPHPLHSTAIKNPHAMAEMGKVDHLKERLRAIEGGKDYAFANLEKLFLVPNMVIPKFKVSDFDKYKGTTLP

SEQ ID NO: 153562 - protein, 149 aa, Glycine max
  Coding DNA Sequence Number=SeqID_61877
YAPLGTLWTQISPTGPGIPRTDHRTLPAQGDAPQAAGAPPPPHQADQAGAFDIEQYLRHLVRQQAANHRAHVRTHDCLYQMSLSMQSQGSTSFSCPTPDQFRAEVAWPGDWPEAQAGEAPPEAPGDGEEAHEDEEMADLLDFLGGSGDT

SEQ ID NO: 153563 - protein, 89 aa, Glycine max
  Coding DNA Sequence Number=SeqID_61878
MANHIIHSRDSGGITLKISSNKDQGGPSNRPQQQGPSLYDRTTKLEETLAQFMQVSMSNHKSTESAIKNLEVQVGQLAKQLADRPSCSF

SEQ ID NO: 153564 - protein, 87 aa, Glycine max
  Coding DNA Sequence Number=SeqID_61879
MVEREMLTMMVDTLAVFYYEKLVGYMPSSFADFVFVGERIEVGLKRGKFDYVSSTSTHAKRVRATGAKRKEGDTHAITSAPAWVKPL

SEQ ID NO: 153565 - protein, 120 aa, Glycine max
  Coding DNA Sequence Number=SeqID_61880
  Gene Ontology: Mol. function=nucleoside-triphosphatase activity; Cellular component=chloroplast
  Homolog annotation: Hit_ID=Q2PMM5; Match level="QueryCoverage=79%, HitCoverage=4%, E-value=4e-49, Identity=98%"; Hit description =Protein ycf2
MYLQNTVSIHPRIISFHRNEDSKYHTLINQREIQQLKERSILCWDPSFLQTERTEIESERFPKILSGYSSMCRLFMEREKQMNNHLLPQEIEEFLGNPARATRSFFLDRWSETSSEFESY

SEQ ID NO: 153566 - protein, 53 aa, Glycine max
  Coding DNA Sequence Number=SeqID_61881
MVKARQKGGKRGRWLPPRSPRRAGLLPPEGTAFCWNTLEGPSGLSCYLHTPVY

SEQ ID NO: 153567 - protein, 96 aa, Glycine max
  Coding DNA Sequence Number=SeqID_61882
MDWWLKDKGFQNLVKLEWVLKQKIKFIKQRIRQWSISQGHISTRKVLNLKRELNALEDGLTNRILSQDEVKIKKSLQEQLWNAAYAVEYMLRQKAR

SEQ ID NO: 153568 - protein, 169 aa, Glycine max
  Coding DNA Sequence Number=SeqID_61883
  Pfam annotation: Domain name=Transposase_23; Domain location=96-166; Score=15.1; E_value=2.7e-05; Accession=PF03017.5; Description =TNP1ENSPM transposase
DSFEEQATQGSFVLHGRQDVLAGAIGRPEHPGRVRAAGAADPADQGLARGVHHRESDEASQASFNQLQSQMQSQGLAVPPEPLVGPSGPQRNDPEMGDSDRCGLYIEADPARLVAMGRVYEGSTLVHNTPLLPGQVKVSVEEVKDADAPVPVPTDEVSLVGQALHTFLA

SEQ ID NO: 153569 - protein, 130 aa, Glycine max
  Coding DNA Sequence Number=SeqID_61884
  Subcellular localization annotation: CTP_CleavageSite=49; ConfidenceScore=5.61e-01
KLSTNTPPPPTTSDSSASTSAVKWKRKASRLRLLSTRPPGVERPVVHVDPATGKADGPHKKKLRTYLGIVARDKVDITYENWKEFKSDLTRKWALAADQDGVEDTVCEKYGISKEKWAQFCQTRRDPSWE

SEQ ID NO: 153570 - protein, 64 aa, Glycine max
  Coding DNA Sequence Number=SeqID_61885
MTVLKVALSSVPIYCFRITMANSHKSRRRILCGVEKIHPQIKSHLIIRRSITTIMKLTLKASEL

SEQ ID NO: 153571 - protein, 102 aa, Glycine max
  Coding DNA Sequence Number=SeqID_61886
CFMHSEAEALEHTKKRDTGHQSVSLENKTGDSSVLKIGDSVKVVIKQDMKGRNHKYGFNNNKREKIKNKRVVDDETGNKHQLYEVIRIPSKRKYRCLNYRKM

SEQ ID NO: 153572 - protein, 42 aa, Glycine max
  Coding DNA Sequence Number=SeqID_61887
MADALTTLVSMFQLTPHGDLPYIEFRCRGRPTHYCLVEKQWD

SEQ ID NO: 153573 - protein, 81 aa, Glycine max
  Coding DNA Sequence Number=SeqID_61888
MEIYTPREKEEEATDVNSFSAKRSCVRASGPTSPTRERQGERKSGGGAKPPRLNKDIPVKGRQKRDVAKRRFRGKGRCDSP

SEQ ID NO: 153574 - protein, 31 aa, Glycine max
  Coding DNA Sequence Number=SeqID_61889
HELLRLADGLLSQRIGLASGSESELPQNLPN

SEQ ID NO: 153575 - protein, 166 aa, Glycine max
  Coding DNA Sequence Number=SeqID_61890
  Homolog annotation: Hit_ID=Q6WAY6; Match level="QueryCoverage=97%, HitCoverage=27%, E-value=6e-10, Identity=28%"; Hit description =Putative uncharacterized protein
MRGCINYNPVLAIRQLGYLMKGTPSEETIMPFIARGFNKANMKILQKIRKAWNKVGRKDKKLRGRSNGVLGGYHKWLKSRTQGITWLKKLKGLNGKEAEVLEKSEEVQALKAELEKTKVAKEKLKVVVTRVRKECDRLKDINMFVAEALEQEMKKARKEEWSRNKF

SEQ ID NO: 153576 - protein, 153 aa, Glycine max
  Coding DNA Sequence Number=SeqID_61891
SSFADLVFCGERIEVGLKRGKFDYVSSTSANAKRVGTTGAKRKEGDAHAVTSAPAWVKPPQTSHGTHQYAQHHPSFSAHARNSSNSAPMQPKAPVQREAPQVPTPTTTHPAGNSNTMRNFPPRPIQEFTPLPMTYEDLLPSLIANQLAIIIPG

SEQ ID NO: 153577 - protein, 220 aa, Glycine max
  Coding DNA Sequence Number=SeqID_61892
MRGAPTEESLSPFLAWRSPLRKDKELRGIRNGVVGGYHGWLRIHTRGLGWLSKLKVVDEEKFEAPEEDEEVRALKLELGKARLAKEKFKSAATHIRKECTELQEENAATARPLEQETKRARKEEHGREKFRGALWGSNNELKLRREERDRSWVHGMILKEELVACARSKRSLAQHLEATEQSMLAIIGQYKEELNQSMAHEQKPVEDFAQVYAEKEARGR

SEQ ID NO: 153578 - protein, 53 aa, Glycine max
  Coding DNA Sequence Number=SeqID_61893
MAEINQGTDASGARVTTDRSLPLPGAKQAENVAARLRIVGLFYIHRDSMKDLK

SEQ ID NO: 153579 - protein, 63 aa, Glycine max
  Coding DNA Sequence Number=SeqID_61894
  Subcellular localization annotation: CTP_CleavageSite=27; ConfidenceScore=5.02e-01
RFLQKAVASGGSTLLAWASWAAAPPLFCINRGGTEALPKRFRKEFREGFDRSSFVLHRSLIFN

SEQ ID NO: 153580 - protein, 87 aa, Glycine max
  Coding DNA Sequence Number=SeqID_61895
  Gene Ontology: Cellular component=membrane
  Homolog annotation: Hit_ID=A8GH46; Match level="QueryCoverage=100%, HitCoverage=28%, E-value=3e-40, Identity=90%"; Hit description =Putative uncharacterized protein precursor
MNMLFPLLAVLIWSINAVVSKLSATAIDPAAISLYRWLLALIALTPFVLPGVLRNWAQVRANWWKLMILGLLGMVLYQSLAYYAAHS

SEQ ID NO: 153581 - protein, 109 aa, Glycine max
  Coding DNA Sequence Number=SeqID_61896
MARIRGLGRVIGRVIGKDRQDDHDDVSERRRPTASARRQRVHQMTQDVPSEDAPDMAEDAPEMTVDVHGADSAEGSHAYDAEGFPGGSRDPSVLTSFADRVAHAVWSGQ

SEQ ID NO: 153582 - protein, 91 aa, Glycine max
  Coding DNA Sequence Number=SeqID_61897
MGRFHWDHITQHLVIISPNDLSSFTGSGVYPDLSGGFGSGVYPDLSSFTGSGVYPDLSSFTGSGVIQIFVACIKRSAPTQVHIIWYQSFGS

SEQ ID NO: 153583 - protein, 236 aa, Glycine max
  Coding DNA Sequence Number=SeqID_61898
MVWYRRKTKMFVDPNNANTTALGEVVETLQYMVSPQGSNTWTVNDLVPYVDKLAIISEEQERIIEPVSHGPASEREFPAQEFHILQSSVETRGIGIRREPVEAEQYSQQMMECGHGICISIPFAGHHTDISETSHSFGSVAETQPHFSWPTMTPSQQHDAPMATPNTSFAPQWNVPGAIPDMGDLLGVDLRQEFSAEGEQAEAGRQRGDRRNFNRQARRWDQPCGTSSRHHGHHND

SEQ ID NO: 153584 - protein, 44 aa, Glycine max
  Coding DNA Sequence Number=SeqID_61899
MAAQLIRDRVEMECLEGAWETLEGNTRCTCTDASAHGGVDNSLD

SEQ ID NO: 153585 - protein, 61 aa, Glycine max
  Coding DNA Sequence Number=SeqID_61900
MVYNNGFTRDSPQISASPHQLDFAPCASRSYNAQWNAPGLLHDKHTLCSSRILRKMEVEET

SEQ ID NO: 153586 - protein, 15 aa, Glycine max
  Coding DNA Sequence Number=SeqID_61901
MEALEKFKCSLIFKR

SEQ ID NO: 153587 - protein, 250 aa, Glycine max
  Coding DNA Sequence Number=SeqID_61902
  Gene Ontology: Mol. function=transposase activity; Biological process= transposition, DNA-mediated
  Homolog annotation: Hit_ID=Q8GYR6; Match level="QueryCoverage=72%, HitCoverage=62%, E-value=5e-14, Identity=26%"; Hit description =Putative uncharacterized protein At4g02550/T10P11_16
MTDKRKVLGKNNEETRSYFTWNLEMERVLADVLRDQRNLGNKGDGGWKRSALNAAAAMLSTSFNVNVTSDNVKNRIKLWRSWYGIVSDILGQSGFDWDGTKHMITVENENAWNEYCTIGFDFFFVFQSHKSAKLFRFKVLQNWDDIVDLCAKDRATGHGAETAMDADEAMSRETNEVEFIGLGATAIDLEEPSSNTKGKRQCSTSSSTHPHKKKMGEKEGIAASLDKMANSFNRMVEKMDGKVDDEDIQE

SEQ ID NO: 153588 - protein, 99 aa, Glycine max
  Coding DNA Sequence Number=SeqID_61903
MEANMEAMKEQMAAMMEAMMSVKKIMEANAIAIAATSVVAKGSTGGPHDVQIQNEHAFPPYGLPLNYTPPNVAYTPNKNVNNSTPIPIESQQPQTDHAH

SEQ ID NO: 153589 - protein, 108 aa, Glycine max
  Coding DNA Sequence Number=SeqID_61904
  Subcellular localization annotation: CTP_CleavageSite=34; ConfidenceScore=5.63e-01
MATLPSSPPFPPPTGAASHSLSTLKRTRKATRLRSLATRQLGQRDPWSMWILLLGKRMAEFDIHEASDVRTRKKILQTVGEQWRQFKSNLTSKWALTVDKDNVNDTVC

SEQ ID NO: 153590 - protein, 65 aa, Glycine max
  Coding DNA Sequence Number=SeqID_61905
MENWRTALCNNFAGSGLEGHMSSARAINYLGSEKSGEWRIGEQRYAITSRGSRLEGGGHMNSARQ

SEQ ID NO: 153591 - protein, 84 aa, Glycine max
  Coding DNA Sequence Number=SeqID_61906
MKNTKNHTSWQKNQYPGKKNEREVCLLFWLKIYSIIGAYVIPFLVPKFQLKITVKTSAKARGNWKKDWCHPLKNLSQEARGQPP

SEQ ID NO: 153592 - protein, 48 aa, Glycine max
  Coding DNA Sequence Number=SeqID_61907
EKEPVTYTDAVKDSRWRDAMKSEIHALETNGTWTTTQIAFRKESTCYK

SEQ ID NO: 153593 - protein, 64 aa, Glycine max
  Coding DNA Sequence Number=SeqID_61908
MKKQQWKRSGRQRKIGERRRHPVRNKPWKKELPPQDEPWIRSLERMLQWRKRKRERKREGGARN

SEQ ID NO: 153594 - protein, 147 aa, Glycine max
  Coding DNA Sequence Number=SeqID_61909
MAPRKLASKRSRKDKAAEGTSSAPEYDNHRFRSAEHQQRFEAIKGWSFHRERRFQLRDDEYTDFQEEIVRQRWASLVTPMAKFDPDIVLEFYANAWPIQEGVRDMRSWVRGQWIPFDADALSQFLGYPLVLEEGQECEYGQRRNQAD

SEQ ID NO: 153595 - protein, 152 aa, Glycine max
  Coding DNA Sequence Number=SeqID_61910
MAPTRHPLDPDKSNRALGFSALITGLCQSFRVPVAPSKVIRPPITRAFIEKYCTQRQSQGDAPQAADAPPPHQAGPAGSFDTEQYLRHLVRQQVANHRAHVQTHDCLYQLRLSLQSQGFTSFPCPTPDQFKAEVAWPGDWPEARAGVARGIL

SEQ ID NO: 153596 - protein, 102 aa, Glycine max
  Coding DNA Sequence Number=SeqID_61911
MTADARDLAEDVADMTKDVPDLAEETPEMRADIQGADGAEGSDADDAEGFPGGPHDPSVLTSFADHVAHAVWSGQERPNLKLVSHGRKVTLIGRPVLEIEGL

SEQ ID NO: 153597 - protein, 106 aa, Glycine max
  Coding DNA Sequence Number=SeqID_61912
MNQELARLGEHPLHEKYKKEGGVKLHSPQKLPPTLKNEGGCGNHEFSGPKSPFLAFLVPFGIVVHSQQGVVGNGLRPKLCSEMFGHAILPPFPCYSCLNMRPPSTR

SEQ ID NO: 153598 - protein, 126 aa, Glycine max
  Coding DNA Sequence Number=SeqID_61913
MVAHIPDPRVDPSQYRDLVYYWCSEKRQDELKKKMIEAESSQNLQSTQDSTNWKNDIYLKVKGHEKRGRVRCLGKLPHQASSSQSSYANNRIQKLENLLENLVVVLKVHFAEDPQINQVLEAIDQE

SEQ ID NO: 153599 - protein, 31 aa, Glycine max
  Coding DNA Sequence Number=SeqID_61914
MEKFTSNHYAWLQTRGWRCMNENATHGAPKT

SEQ ID NO: 153600 - protein, 72 aa, Glycine max
  Coding DNA Sequence Number=SeqID_61915
GYIYLSLTENKRGYISCGSILVEGTSTRFKENKGGLHDYIAVYDSGLQRLDAGGDLSSSEKSAVKELKGGIL

SEQ ID NO: 153601 - protein, 147 aa, Glycine max
  Coding DNA Sequence Number=SeqID_61916
  Pfam annotation: Domain name=G-patch; Domain location=4-45; Score =15.7; E_value=0.0024; Accession=PF01585.14; Description=G-patch domain
MAVMVARVMLGNGYELGMGLGKDNGGRTSLVNTRGNREKFGLGYKPTQADIRKGVAGRKSGSQGSRLGREVEGGPPSHISRSFISAGLGHWWLGDQTEGEEDEDLGLPPELEKIVAHEDQEMGPHQEEATLVDLGTGSGKKEVKIGM

SEQ ID NO: 153602 - protein, 141 aa, Glycine max
  Coding DNA Sequence Number=SeqID_61917
MGIAPTKTPSGPEEVQQGPGVSSSGIMPTRHLVDPKKANRVLELPALNTGLCQFKGVLVAPSKVLRPSTNQAFIKKYCAPRQAQGETPHQHWDGRQRETDAPPSPLEFTSAHPQKGLSIAYTTWPTHRRPSPKPKDAPSCS

SEQ ID NO: 153603 - protein, 82 aa, Glycine max
  Coding DNA Sequence Number=SeqID_61918
MGLRNKSGEWRIALGKSLSRGSRLIGGGCMKRQSIHGATNKSGEWRIALGNHFVWLQTHCGGCMHDNQFMGLRIKAENGELH

SEQ ID NO: 153604 - protein, 195 aa, Glycine max
  Coding DNA Sequence Number=SeqID_61919
  Subcellular localization annotation: CTP_CleavageSite=30; ConfidenceScore=5.78e-01
IMGSPPASTPPPPPPPPPPPPPPPPTSDASASPSVVKRTRKASRLLSLATRPPGAERPVVHVDPATGKVDGGHHLRELEGGAYCSEGPDLGGYSEFDIPELLTVGGKGNLTRKWTLAADQDGVEDTICDKYDISKEKWAQFCQTRRDPSWEDVRIKAQAIQKQNTAPQVLSRGGYDYLEQKLLAEKIKKKLQEAA

SEQ ID NO: 153605 - protein, 57 aa, Glycine max
  Coding DNA Sequence Number=SeqID_61920
LGKKISVALLGGCATRGAISAKDPFVDANVDDPGVGSKEYVHKRIGRKSLTTIQIMR

SEQ ID NO: 153606 - protein, 121 aa, Glycine max
  Coding DNA Sequence Number=SeqID_61921
  Homolog annotation: Hit_ID=Q6UUI4; Match level="QueryCoverage=88%, HitCoverage=15%, E-value=1e-09, Identity=36%"; Hit description =Putative retrotransposon gag protein
  Pfam annotation: Domain name=Retrotrans_gag; Domain location=16-97; Score=15.2; E_value=0.0018; Accession=PF03732.8; Description =Retrotransposon gag protein
MKPPDVQRKHRCIFLKAFPHSLEGVAKDWLYYLAQRSITSWDDLKRVFLEKIFPASRTTAIRKDISGLSNMERSMIDVASGGALGDMTPAEARNLIEKMASNSQQFSARNDAIVIRGVHAP

SEQ ID NO: 153607 - protein, 88 aa, Glycine max
  Coding DNA Sequence Number=SeqID_61922
MSRASSSSAFVLPGNTQDVEFCLFLMRPHFLVLMGDYLLQLRGKSHIFVLFTLRLTRFLLEIDGRVPGISTFEGFIIGSGVLSVKGIL

SEQ ID NO: 153608 - protein, 66 aa, Glycine max
  Coding DNA Sequence Number=SeqID_61923
  Subcellular localization annotation: CTP_CleavageSite=41; ConfidenceScore=5.30e-01
MHPRIQSILLGMMHAPDSTLRCNVVRTNNQIPGNSLSVSTRHSHLGNQAEFVETTQSCTVTTPPLR

SEQ ID NO: 153609 - protein, 55 aa, Glycine max
  Coding DNA Sequence Number=SeqID_61924
VTTDKWMNITDIGYVIASSNCHPQAKLWPNPYISKMQHYKSFVMFKRDYVDINDD

SEQ ID NO: 153610 - protein, 99 aa, Glycine max
  Coding DNA Sequence Number=SeqID_61925
MGVQIAPRPILAPPEDFLQKGGCFWRKQPCSPRRAKLALGELGGNHLPYFAINRGGNEEGRAEALPKRFRNVFREESRKSLNRSSTFFIRSSSFFDLQR

SEQ ID NO: 153611 - protein, 100 aa, Glycine max
  Coding DNA Sequence Number=SeqID_61926
MAPTRHPLDPDKSNRALGFSALITGLCQSFGVPVAPTKVIRPPITRAFIEKYCTQRQAQGDAPQAADAPPPHQAGLAGSFDTEQYLRHLVRQQVANHRAH

SEQ ID NO: 153612 - protein, 178 aa, Glycine max
  Coding DNA Sequence Number=SeqID_61927
MIRGGTLRLSAPPLPFRHSRVRWQAETKFGHSAHMIRGDTLRDQVWSFCTHDTRRYLTVIRPPLPFRHSRVRWQAETKFGHSAHMIRGDTLWLSAPFAIQRPAGPMTSRDQVWSFCTHDTRRYLMVIPPFCYQTERLIGNAGAGTGLLHLFFLWEQQVICMWSFYGHPRLSSNREGRN

SEQ ID NO: 153613 - protein, 69 aa, Glycine max
  Coding DNA Sequence Number=SeqID_61928
MTDRDIDEDMTKSKGKDPLEGLGGPMTRARARKAKDALQQVLSILFEYKPKFQGEKSKVVSCIMAQMED

SEQ ID NO: 153614 - protein, 96 aa, Glycine max
  Coding DNA Sequence Number=SeqID_61929
DEPVVSTTEVVGASVEAAVYADESMAGGDVHDIGADTPADTGAQAAEDEPKGFPGGPRDPSVLTKYANHVAGSVWMGEELPELKLTSHGRKVHSLG

SEQ ID NO: 153615 - protein, 32 aa, Glycine max
  Coding DNA Sequence Number=SeqID_61930
MSNLGSKEDSFPSKKYTTGAQVATTWKPIYRQ

SEQ ID NO: 153616 - protein, 47 aa, Glycine max
  Coding DNA Sequence Number=SeqID_61931
MYQSHTGFWLKACRTAGHDTCQDLASGSGINGMSPHYSHDTHATNDD

SEQ ID NO: 153617 - protein, 94 aa, Glycine max
  Coding DNA Sequence Number=SeqID_61932
MKHPSEDHSIFRVEILDQIVDDYMFDFDYLHGVVPLDVNFLESECTNHVAGSTYTSDLLYEVQAEEPFSSCPTLVPPTVQPPPTPELKPLPANL

SEQ ID NO: 153618 - protein, 165 aa, Glycine max
  Coding DNA Sequence Number=SeqID_61933
  Gene Ontology: Mol. function=protein binding; Biological process =defense response to fungus
  Homolog annotation: Hit_ID=Q9M636; Match level="QueryCoverage=75%, HitCoverage=88%, E-value=6e-46, Identity=68%"; Hit description =Putative uncharacterized protein
  Pfam annotation: Domain name=LRRNT_2; Domain location=35-74; Score =56.7; E_value=8.2e-14; Accession=PF08263.3; Description=Leucine rich repeat N-terminal domain
MAVLFATHVLLLILSTATTLHFSASKAAKLNMTCSEKERNALLTFKHGLADPSNRLSSWSDKSDCCTWPGVHCNNTGQVMEINLDTPETSQTCKHLNLGYNYALQIDNLNWISRLSSLEYLDLSGSDLHKQGTNSTNNIKPSEHKKSRPAEQPAQWATSRFIRPA

SEQ ID NO: 153619 - protein, 51 aa, Glycine max
  Coding DNA Sequence Number=SeqID_61934
MDPKRIKVIPEWLTPPSVKERIHEFQEPLDLRSNPFQGGGNDVILPPKGIG

SEQ ID NO: 153620 - protein, 118 aa, Glycine max
  Coding DNA Sequence Number=SeqID_61935
MPLQTRPVTQRRPREARYNGPDHTWASEQDEAVLRGDVTAGLRLVLNEAKGVPTHFVFVKPATAAKGAERRVASLPSPQHGDKPAFRKAAAVPREATQAQKSPCPAITSSSSSISPSI

SEQ ID NO: 153621 - protein, 123 aa, Glycine max
  Coding DNA Sequence Number=SeqID_61936
MADRWMQFSDYVALVGQISVPEDPPRVLPVQQYDTFVEPDVPQQPKATTTHDEPDIDVHLPRHAVDGYEAIATKLERLLNLRILTEGTKAYTVAEECLSIARSYIGQPTIGHRSRRRRCMNDH

SEQ ID NO: 153622 - protein, 28 aa, Glycine max
  Coding DNA Sequence Number=SeqID_61937
TSGSPGLQEFDVVILNAVANTCIVGVQL

SEQ ID NO: 153623 - protein, 43 aa, Glycine max
  Coding DNA Sequence Number=SeqID_61938
MYRFRIGSKIPLATYTLGVVAKYLDVLEIPECARMQFLVAKVL

SEQ ID NO: 153624 - protein, 114 aa, Glycine max
  Coding DNA Sequence Number=SeqID_61939
  Homolog annotation: Hit_ID=Q9AVH2; Match level="QueryCoverage=79%, HitCoverage=34%, E-value=1e-37, Identity=78%"; Hit description =Putative senescence-associated protein
MGGGAWPFLVGGAICLVNSVNERDLSLLNSYVEGKTNLSHDGLNPAHVPYWWVNNPTLGEFCFTMIGRADIEGSKSNVAMNAWLPQASYPCGNFSDTSSFKFRRTKGLIGHAFT

SEQ ID NO: 153625 - protein, 171 aa, Glycine max
  Coding DNA Sequence Number=SeqID_61940
MMPPTTKTYCICPQAVTVGASAAEELHEEQQEAPIEDPPIDERPKLKLSFHGRKMAKFERSAPEIEGLVASSGQSPLIACSLDTGDRRLMDETFDMLLELLEVSATEERAETIQFHGSYVRLSWLQDVYETKIEACHWIIASGRYAGGAVALVYMYDNFNDASKSTERQLA

SEQ ID NO: 153626 - protein, 46 aa, Glycine max
  Coding DNA Sequence Number=SeqID_61941
GGDEILPRRRPITRAMARRLQEDWARDVREGPRVLMSIKLDFGSMD

SEQ ID NO: 153627 - protein, 65 aa, Glycine max
  Coding DNA Sequence Number=SeqID_61942
MKTSARSKRLLKANFRTDNETEGLKARPVHHQHHRKNSLACQHQILLKLYAHRHLAMITRCTVTD

SEQ ID NO: 153628 - protein, 57 aa, Glycine max
  Coding DNA Sequence Number=SeqID_61943
MKKQQWKRRCIGRQRRRGERRRHPLGNKPWKKELHHQDEPWIRSLEGCFNEGKERGR

SEQ ID NO: 153629 - protein, 37 aa, Glycine max
  Coding DNA Sequence Number=SeqID_61944
MEKNEETTMEEKLLCSDYHLMDACLWSFYGGWIFELQ

SEQ ID NO: 153630 - protein, 116 aa, Glycine max
  Coding DNA Sequence Number=SeqID_61945
  Homolog annotation: Hit_ID=Q6UUN3; Match level="QueryCoverage=41%, HitCoverage=4%, E-value=4e-07, Identity=56%"; Hit description =Putative gag-pol polyprotein
MVGLLAASLAFAPLGLTGRARRGQNERVPPLPPPPPTLQELMAQQNEILRQLAQRQPPPQHYGGGDHQRHPAAATYQEFLSTQPPLFTRAEDPLDADVWLRVVESKFPLLHGVCSE

SEQ ID NO: 153631 - protein, 173 aa, Glycine max
  Coding DNA Sequence Number=SeqID_61946
MPLWWEFYSWVKEVRALHSNPMENFLQHCSLAASRNSNRRRKVWWIAATRSIWNLRNDMIFNNQPFVISKLVDNSIFLTWSWLRGWEKDFNEILYHIFLVVPLFIQHICVASARLQGKRWQWWWFALTYSIWKHRNNIIFSNTTLFSLRCIKSLTNNSNLSSSWEVIRRNGGN

SEQ ID NO: 153632 - protein, 78 aa, Glycine max
  Coding DNA Sequence Number=SeqID_61947
MQQVWCGDAKPIKTARLVEPMGISTSQVERFLNGPIKEEVYVEQPPGPFKIVRYLTYYKLLRRIYRGSSKPQEHGMNA

SEQ ID NO: 153633 - protein, 81 aa, Glycine max
  Coding DNA Sequence Number=SeqID_61948
MIIEESIHVAFDETNPIRPRKETLDDITDSLEDMHIHEEKHKGKGNGNDEDFQIEKLKQVYGLPREWMNFKIYHPLENHQK

SEQ ID NO: 153634 - protein, 71 aa, Glycine max
  Coding DNA Sequence Number=SeqID_61949
MMTTKDDDKKLKRIKEHPSQVKSKNIPSQENQEQVKSFKNQEEFKTQEESLQIKNQDSRFKILRIKIKIQE

SEQ ID NO: 153635 - protein, 135 aa, Glycine max
  Coding DNA Sequence Number=SeqID_61950
MGRVNLESNVRMIVLWVEKIEILRVRKVKFGVSGNWSLKTCRKAWAEQMRKMSDKCERKEPFLGQGLGLVGSNLSEIGYKQARIRNLPNYAAKTVKLCSRFYQLCRKNGCAALVTGKLRGVDGDPVLKGTRIRAT

SEQ ID NO: 153636 - protein, 46 aa, Glycine max
  Coding DNA Sequence Number=SeqID_61951
MNKCLGSSSSMDSFASWKMNGSGMEKEGIEEMPLQGEDVSRRCLSP

SEQ ID NO: 153637 - protein, 156 aa, Glycine max
  Coding DNA Sequence Number=SeqID_61952
  Gene Ontology: Mol. function=chitin binding; Cellular component =extracellular region; Biological process=chitin metabolic process
  Homolog annotation: Hit_ID=UPI00006A17C9; Match level="QueryCoverage =83%, HitCoverage=100%, E-value=1e-13, Identity=31%"; Hit description= UPI00006A17C9 related cluster
  Subcellular localization annotation: CTP_CleavageSite=30; ConfidenceScore=5.52e-01
MCSPLKVRTCSPLKARTCSPFKARTCSPLKAKAYSPLEARTCSLQKARTSSPLKTRTCSPLKARACSPLRPGHARTCSPLKARTCNHLKARTCSPLKARMSSPLKVRTCSPWKVRMCCLLKARACSPLSYPNFVRGPLLDDVRPFFGPREVLGTHH

SEQ ID NO: 153638 - protein, 116 aa, Glycine max
  Coding DNA Sequence Number=SeqID_61953
MMITKDDDKGDDKKLKDQSKNNSRYILCDTSRGYIYLGLTENKRGYISCGSVLVEGTSTRFKENKGGPTLMKGVTFCRSACHANLSTWTLYMKKEHTFNAIINCLNDLNSSDEELE

SEQ ID NO: 153639 - protein, 154 aa, Glycine max
  Coding DNA Sequence Number=SeqID_61954
MVIQVNCPLLSTTLRYRIEGLLYFKPCRVNIIDADDVQTSLFLIFLKFFNNLRTKCSSKEFDFDVLMMPYDRDDLMPYENVLLKFNSRQKFKNTRYNIKKIYSVLGREFQIEIAKGLAKKFKQKCLFQEIYSLWNSQAGCLGTGRRHKGVAEPV

SEQ ID NO: 153640 - protein, 49 aa, Glycine max
  Coding DNA Sequence Number=SeqID_61955
MERSHNFKNGKRSQEVSPTLKCYKCNQPEKEINLLSKDYESDENITQED

SEQ ID NO: 153641 - protein, 406 aa, Glycine max
  Coding DNA Sequence Number=SeqID_61956
  Homolog annotation: Hit_ID=Q2HW90; Match level="QueryCoverage=99%, HitCoverage=84%, E-value=9e-92, Identity=44%"; Hit description =Putative uncharacterized protein
LVPTLEEYSYLVGLPVPDKIPFHGFEPTPKPSDIAAALHLKTSIIQANLTSKGGLQGLPTHFLYQQASIFAEAASTLAFHSVLALLIYGLLLFPNIDNFIDINAIKILLTKNPVPTLLADTYHSIHDRTQAGRGTISCCAPLLYLWFTSHLPQSRAFKTNDDKLSWPHRIMTLDPSDIVWYQAASDVGEIIVSCGEYPNVPLLGMRGGISYNPLLARRQFGYPIKTKPNNLALTNEFYLNHGDHSNKKERFAQAWSAIRRLSRSQLGKKSDHVHESYTQWVIDRTKSFGLPYHLPRYLSSTIPPSSLPIPFDTKEEFHEQLTKERQEKETWKRRCQELERENETLKGKIAQQSRELFIQNQRMIEKDDLLRRKDALLHQDARRKRRFMDLFSRTHSDSEDPSTPGV

SEQ ID NO: 153642 - protein, 158 aa, Glycine max
  Coding DNA Sequence Number=SeqID_61957
MRMLITPLLCSLRADNLIIYMSLNPWGRHMKYPTRELADFEPCLGYATEGQAVGGIPLQNTLEGPQYHPQPHPLHSTPGKNPHAMAEMGELDHLEERLRAIKGGEDYAFANLEELFLVPNIITPPKFKVLDFDKYKGDYLPQEPSKDVFLEDEGIRKR

SEQ ID NO: 153643 - protein, 79 aa, Glycine max
  Coding DNA Sequence Number=SeqID_61958
MMITKDDDKGDDKKLKDQSKNNSNKNQEEFKTQEESLESRIKIQGSTSQESRSRFKTQDSRIKRRLNQDKYENFFSKIE

SEQ ID NO: 153644 - protein, 225 aa, Glycine max
  Coding DNA Sequence Number=SeqID_61959
MVIDQSLFFSLTNLPSQGAPFEGTIVDDWKFNYSSHDARRMVYNDQAEMTGRLLAGSLTFDNRIMHYIIVRILLPQSSNLAQASEEDLILMWAFLTGRQIDWAHFVRYRMHKALRANAPLPYPHLITLFLLTSFGYRKDRNGQWLKKDALPPQDERTPSPPPQRDDSALMNEVLSELRGLRSYVGDHFDSLDTRFADMGIRLTQLEEDVGYIRQSFDLPPPPPPS

SEQ ID NO: 153645 - protein, 144 aa, Glycine max
  Coding DNA Sequence Number=SeqID_61960
MRSWVRGHWIPFDADAISQFLGDPLILEEDQQCQFSQRRSQADDFDEEAIAQLLCIPGQDFARTAAGRQVRIMRTNMTTLTQIWMILLLSNALPSDHNSDLPLPKCQLVYAILIRMSVHVAQEWRLLGMLWTQRSPIGPWGFWL

SEQ ID NO: 153646 - protein, 79 aa, Glycine max
  Coding DNA Sequence Number=SeqID_61961
MGKERIKRILRLCRFEFFDKGEGRHKRIQAVSPLFFWKREKRDTKRIQALKAQVEKDEGPSGEGQSPRVEKDEGPSGEG

SEQ ID NO: 153647 - protein, 121 aa, Glycine max
  Coding DNA Sequence Number=SeqID_61962
MYPLLFSVNNPSRCTLYLYHKGCTLQCVKTKILGGEKGDTKEFRRLVLCSFGKGRRETQKEFKRLVLGEFFLAEGEENEKMNSTSFHGLENQKTLESFWYKEEEEVQRDSRLVKDCMKCSR

SEQ ID NO: 153648 - protein, 112 aa, Glycine max
  Coding DNA Sequence Number=SeqID_61963
RIQGTNRLRILCLNTLEGTSFVAQVEGTSTWVVILRTREGTSLVDQFKRRVHPLGCSKRTREGTSLVDLWLVKDFTRLKEISRTIGCLGTRCRHEFRPNQYKSCVCLLPYTL

SEQ ID NO: 153649 - protein, 193 aa, Glycine max
  Coding DNA Sequence Number=SeqID_61964
  Homolog annotation: Hit_ID=A5AWV0; Match level="QueryCoverage=78%, HitCoverage=10%, E-value=3e-13, Identity=30%"; Hit description =Putative uncharacterized protein
  Pfam annotation: Domain name=Peptidase_C48; Domain location=3-193; Score=-23.9; E_value=0.012; Accession=PF02902.10; Description=Ulp1 protease family, C-terminal catalytic domain
MSQHISVTVVDSIYHRHLTNTSMRVGNSHIYGFLEPQSIQRSGQSQFESESYIKTWMQSSKRDVYLGAYLNGGHWQMVVILPKEHLIVWFCSLHNRPDNYLKGIINSALKGLDDAPHSKSKAPARWIVVKCNRQKGSTECGYYVMHWMSTIILGTFRNIWEAYFNDPRPLELERFKALRIQWTHYYLRVRDQT

SEQ ID NO: 153650 - protein, 215 aa, Glycine max
  Coding DNA Sequence Number=SeqID_61965
  Homolog annotation: Hit_ID=Q2HTA0; Match level="QueryCoverage=85%, HitCoverage=28%, E-value=2e-21, Identity=35%"; Hit description=IMP dehydrogenase/GMP reductase, related
MTERYAWGVTALVHMYDQLNDASMSHNRQLDGYITLLWIATKKTVKSIHTPAYRERLDRLRIPDVCWIPYGEHRSVRDFHVRSCYFGLLRWGPVAVYYRPERVMRQFGYTHTIPAPPVDSWVSYDDIHDRWMHYSDHIVPAGEVCIVSGQCSSDYMYWFFRISHPFMTLGHTLDPLPHGHAPQPRVVPQVSQTNIPHVPEPGASSTSAEEPRHAV

SEQ ID NO: 153651 - protein, 185 aa, Glycine max
  Coding DNA Sequence Number=SeqID_61966
MYRLSELGIEMRSVFTRRSQWSSQPSGSAQLSSRETFISKSEAKTISEINNLCEEFVCVTVGTIMRVVMDNHSWCYAACIQCHKKTDVYTEPFVCPCGKHNDLAVLRYRVEVMINYKDDSTKFLLWDRECTELIGQSADEVNTLKIEDGDLDLNASPKALDKLLGHLLALQSQKSSRSIKKFCCF

SEQ ID NO: 153652 - protein, 114 aa, Glycine max
  Coding DNA Sequence Number=SeqID_61967
  Subcellular localization annotation: CTP_CleavageSite=38; ConfidenceScore=5.19e-01
MCLSGKESMLMKFSHNRSTGSNKDRRKSLKVYQSHTVRGEKVASAQDFVSNQRERTTLGRGKGLTFSPWVKVYDKLGFWLKAYRTAGHDICQGLASGSGIKGMSYIISMIHMQQ

SEQ ID NO: 153653 - protein, 80 aa, Glycine max
  Coding DNA Sequence Number=SeqID_61968
MQWREKRVRIHDNDSKVLRVVARRWWRRIFIVVLSSSWTLRTLIAPSRGGLAGRFIPRKALSRKLALAADKADPVGYAIT

SEQ ID NO: 153654 - protein, 337 aa, Glycine max
  Coding DNA Sequence Number=SeqID_61969
  Gene Ontology: Mol. function=oxidoreductase activity; Cellular component=extracellular region; Biological process=response to oxidative stress
  Homolog annotation: Hit_ID=A7QE60; Match level="QueryCoverage=92%, HitCoverage=90%, E-value=1e-116, Identity=67%"; Hit description =Chromosome chr4 scaffold_83, whole genome shotgun sequence
  Pfam annotation: Domain name=peroxidase; Domain location=40-300; Score=412.5; E_value=6.4e-121; Accession=PF00141.14; Description =Peroxidase
MVNSMSFLLLLSLLAFAPLCLCNLNPQFYDNSCPQAQQIAKSILTSYFVIQPGYAAQILRLHFHDCFVMVSPYDLPTELVGCDGSLLLDSSESIVSEKESDPNRDSARGFIVIDAIKLAIERACPSTVSCADILTIAARDSVVLTGGPSWEVPLGRRDSRDASISGSNNNIPAPNSIFPTLQTKFEQQGLNLTDLVTLSGAHTLGVARCTNFRQRLYNQSGNGQPDPTLDQNYAAFLRVTCPRTTLGDQNPFFLDYATPLKFDNSYFKNLMENKGLLNSDQILFTMNQESAELVRLYAERNDLFFEQFSKSMIKMGNISPLTNSSGEIRQNCRRVNA

SEQ ID NO: 153655 - protein, 88 aa, Glycine max
  Coding DNA Sequence Number=SeqID_61970
DFVLKGRSGGLGKKPSADYWRKLKYSEWTPLIGVMGSFVTLKQPHMEHGIDSGSGRKFQFISHDPNVFENVIRPTKVAVKFGITLIAS

SEQ ID NO: 153656 - protein, 40 aa, Glycine max
  Coding DNA Sequence Number=SeqID_61971
MNLVPELIPFRIRSDTPSRERKRKLGRTKNKKLFMAMAGG

SEQ ID NO: 153657 - protein, 205 aa, Glycine max
  Coding DNA Sequence Number=SeqID_61972
VCENALALGVFEKDPKIMRGPGVRHQGGHFIRESGEESTIYKAVLKRSIWILEEIIAIKESFNLLFPIRIIVGKKFGDIGESDASKGFGWLMGVWNEGVVVGHGRQGWGTTSLIEEIGNGEEGVKEDNGVWCNGGVWQSNDVLKLVQWWVITLQEDVEGRDVTGWEAGLTDAEFKMGGAVFKCPFAEEEAQVLVKIPVVEEAKVI

SEQ ID NO: 153658 - protein, 70 aa, Glycine max
  Coding DNA Sequence Number=SeqID_61973
MAPPPLALSLGMCHVLLMEPVKRKALGLQCCRVQQVRVAAMQGQQVRGEGRVIGYCEFHKGGAIPSSNLL

SEQ ID NO: 153659 - protein, 48 aa, Glycine max
  Coding DNA Sequence Number=SeqID_61974
MTTTAARTTIEGLSLRCITTVHLGGEVVELIISKGRGGAKNKVVARLL

SEQ ID NO: 153660 - protein, 785 aa, Glycine max
  Coding DNA Sequence Number=SeqID_61975
  Gene Ontology: Mol. function=methyltransferase activity; Cellular component=cytoplasm; Biological process=fatty acid biosynthetic process
  Homolog annotation: Hit_ID=A9PF83; Match level="QueryCoverage=44%, HitCoverage=97%, E-value=1e-123, Identity=61%"; Hit description =Putative uncharacterized protein
  Pfam annotation: Domain name=Methyltransf_7; Domain location=28-347; Score=552.1; E_value=6.1e-163; Accession=PF03492.6; Description=SAM dependent carboxyl methyltransferase
  Pfam annotation: Domain name=TIM-br_sig_trns; Domain location=476 -782; Score=540.2; E_value=2.3e-159; Accession=PF09370.1; Description= TIM-barrel signal transduction protei
  Pfam annotation: Domain name=UPF0261; Domain location=266-463; Score=- 223.6; E_value=0.00098; Accession=PF06792.2; Description =Uncharacterised protein family (UPF02
  Pfam module annotation: Pfam domain module=Methyltransf_7::TIM-br_sig_ trns::UPF0261; Domain location=28-347::476-782::266-463
MEVAKVLHMNGGVGDASYANNSFVQPLREEAIKSLYCGTLPRRLAMADLGCSSGQHALIVVSDFIKTVEKLCLELNHKSPEYKVFFNDLPGNDFNNIFKSLDSFKQKLCEEMESGIGPCYFFGAPGSFYGRIFSNQSVHFIHSSYSLQWLSKVPECIDNNKSNIYLGRTSPSNVVRAYYEQYQRDFSLFLKCRAEELVEGGRMILTIMGRRSDDPSSKDGCYIWEIMATALNDMVLQGIIKEEQLDTFNIPFYTPSPSEVKLEVLKEGSFAINCLEVSVVHWSAWDEWSVLDFESESGYNLTQSMRAVAESMLVSHFGEAIIDELFSRYQEILADRMSKEKTKFINKSSECLGGVIGVGGSGGTSLLSSPFASLPIGVGGRAMENLVREGFIQGVFDISTTEVADYIVGGVMACESSRFDAVIENKVPLVLSVGALDMPYPHHINDLEFANALVDAFLEINEKTSKDSTQQQVASPESVEQFHEDNVSNASSIATIVYTPSEFPEARRGAGAWTGISAKFEEAGGVDLIVLYNSGRFRMAGRGSLAGLLPFSDANAVVLDMANEVLPDVQGKGPMAKAESNLGLGHHHNLLVVKKVPVLAGVCATGLFRRMDYFLKQVESTGFSGLQNFPTVGLFDGNFRLNLEETGMGYSLEVEMIQKAHKMGLFTTPYAFNQYEAIEMAKVGADIIVAHMGLTTTGSIGAKTSVSLKESVVHVQAIADAAHRINPGVIVLCHGGPISGPKEAAFVLKRTKGVHGFYGASSMERLPVEQAITNTVKQYKSISIH

SEQ ID NO: 153661 - protein, 92 aa, Glycine max
  Coding DNA Sequence Number=SeqID_61976
MVLELLVSSTLELPPKSDKSLELSFRVENLNAPELLSSSTLLCEAQCSNAITEVGETVVSDASLETLASGVIHALRFGGEEWGATGGGVVDR

SEQ ID NO: 153662 - protein, 97 aa, Glycine max
  Coding DNA Sequence Number=SeqID_61977
MAFDGVVVEGCTLANQDGTSRALPITQREVASQYCWGTRATFETDYCRAFFLRSCPCLYQVVRYQTWCNSPQGSQIRNILAVKIYDHVVLPRSNMKL

SEQ ID NO: 153663 - protein, 80 aa, Glycine max
  Coding DNA Sequence Number=SeqID_61978
MKEDLKKLRDMNKDGINFQANVIKSVEDEDDVFLAKDERLRDVGHFENQWRIDHFKLGNGGKMMVEGIGSVRVKLHNGVI

SEQ ID NO: 153664 - protein, 56 aa, Glycine max
  Coding DNA Sequence Number=SeqID_61979
MSAQLRSLTLSRPRGLENLPLQQWLGWVKGCGRVVVVGDNCGGGRQVSLPITWPRI

SEQ ID NO: 153665 - protein, 112 aa, Glycine max
  Coding DNA Sequence Number=SeqID_61980
  Gene Ontology: Mol. function=G-protein coupled photoreceptor activity; Cellular component=membrane; Biological process=regulation of transcription, DNA-dependent
  Homolog annotation: Hit_ID=P42499; Match level="QueryCoverage=97%, HitCoverage=11%, E-value=5e-31, Identity=59%"; Hit description =Phytochrome B
  Pfam annotation: Domain name=PAS_2; Domain location=2-112; Score =89.4; E_value=1.1e-23; Accession=PF08446.2; Description=PAS fold
MAYLVKIQRGGFIQPFGSMIAVDEPSFRILGYSDNDRDMLCITPQSVPSLDDKNDTTFALSTDVRALFTHSSALLLKKAFSVISFPHFQGVSNPLCKVWHPLRTGEVLYLPC

SEQ ID NO: 153666 - protein, 191 aa, Glycine max
  Coding DNA Sequence Number=SeqID_61981
  Gene Ontology: Mol. function=nucleic acid binding
  Homolog annotation: Hit_ID=Q2QUM8; Match level="QueryCoverage=92%, HitCoverage=54%, E-value=4e-10, Identity=24%"; Hit description =Retrotransposon protein, putative, Ty1-copia subclass
MELYQLKMMMGGDLHDNINKFNQLVNQFLNVNDKLSNEEQTLLLLTSLPRSFKALVQMLFVERSTLNLDEVITAIKENERMMRTENIDDEHHAIAMNDNVQVRCKQMKENLKKLRDMNKDGANSQANVIKSVEDEDDVLDTLKIDGEFAHFKLGNGEKMKAEGIGSVRMKLHDGYKYVGSKWGCKVYKGRY

SEQ ID NO: 153667 - protein, 129 aa, Glycine max
  Coding DNA Sequence Number=SeqID_61982
MPMLDQFYPCIHHSIENFVDVKVDGNSRYRTIVALLGMCEDSWSLVYNQLLKELAKWPDEYINLLGGINKFEELKSLEAMKGAYDRQIKQRGYIIKGDGHFSYRKMKTPSFLMSSLCKSLYKSLIASVQ

SEQ ID NO: 153668 - protein, 68 aa, Glycine max
  Coding DNA Sequence Number=SeqID_61983
MKRQGSQMVISCLVWVWLGNLLDKSPSEMQMIDVVGVQKGCPRTWCKEGWGDDVESSAFRCNGGCKNW

SEQ ID NO: 153669 - protein, 81 aa, Glycine max
  Coding DNA Sequence Number=SeqID_61984
  Gene Ontology: Mol. function=1-(5-phosphoribosyl)-5-[(5 -phosphoribosylamino)methylideneamino]imidazole-4-carboxamide isomerase activity; Cellular component=chloroplast; Biological process=amino acid biosynthetic process
  Homolog annotation: Hit_ID=A7PPD3; Match level="QueryCoverage=74%, HitCoverage=20%, E-value=1e-20, Identity=80%"; Hit description =Chromosome chr8 scaffold_23, whole genome shotgun sequence
MVNDETVRRSLPSIQCAVQFRPCIDIHKGKVKQIVGSTLQDLKGSDPVTNFESDKSAAEYAMLYKQDGLTGGRSFQQSFCP

SEQ ID NO: 153670 - protein, 1076 aa, Glycine max
  Coding DNA Sequence Number=SeqID_61985
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=95%, HitCoverage=93%, E-value=0.0, Identity=61%"; Hit description =Functional candidate resistance protein KR1
  Pfam annotation: Domain name=LRR_1; Domain location=560-585; Score =2.3; E_value=1.1e+02; Accession=PF00560.24; Description=Leucine Rich Repeat
  Pfam annotation: Domain name=LRR_1; Domain location=631-652; Score =12.1; E_value=1.8; Accession=PF00560.24; Description=Leucine Rich Repeat
  Pfam annotation: Domain name=LRR_1; Domain location=654-676; Score =8.7; E_value=7.4; Accession=PF00560.24; Description=Leucine Rich Repeat
  Pfam annotation: Domain name=LRR_1; Domain location=678-699; Score =8.3; E_value=9; Accession=PF00560.24; Description=Leucine Rich Repeat
  Pfam annotation: Domain name=LRR_1; Domain location=700-722; Score =6.4; E_value=20; Accession=PF00560.24; Description=Leucine Rich Repeat
  Pfam annotation: Domain name=LRR_1; Domain location=724-745; Score =11.7; E_value=2.1; Accession=PF00560.24; Description=Leucine Rich Repeat
  Pfam annotation: Domain name=LRR_1; Domain location=829-850; Score =4.3; E_value=48; Accession=PF00560.24; Description=Leucine Rich Repeat
  Pfam annotation: Domain name=LRR_1; Domain location=852-877; Score =7.1; E_value=15; Accession=PF00560.24; Description=Leucine Rich Repeat
  Pfam annotation: Domain name=NACHT; Domain location=211-362; Score =1.6; E_value=4.4e-05; Accession=PF05729.3; Description=NACHT domain
  Pfam annotation: Domain name=NB-ARC; Domain location=168-462; Score =158.5; E_value=1.8e-44; Accession=PF00931.13; Description=NB-ARC domain
  Pfam annotation: Domain name=TIR; Domain location=10-145; Score =131.1; E_value=3.2e-36; Accession=PF01582.11; Description=TIR domain
  Pfam module annotation: Pfam domain module=LRR_1::LRR_1::LRR_1::LRR _1::LRR_1::LRR_1::LRR_1::LRR_1::NACHT::NB-ARC::TIR; Domain location =560-585::631-652::654-676::678-699::700-722::724-745::829-850::852 -877::211-362::168-462::10-145
MALRSFSYDVFLSFRGEDTRYGFTGNLYNVLRERGIHTFIDDEELQKGDEITTALEEAIEKSKIFIIVLSENYAYSSFCLNELTHILNFTEGKNDPLVLPVFYKVNPSYVRHHRGSYGEALANHEKKLNSNNMEKLETWKMALRQVSNISGHHLQHDGNKYEYKFIKEIVESVSSKFNRDHLDVPNVLVGLESPVRQVKSLLDVGRDDVVHMVGIHGLAGVGKTTLAVAVYNSIADHFESSCFLENVRETTNKKGLEDLQSAFLSKTAGEIKLTNWREGITIIKCKLKQKKVLLILDDVDEHKQLQAIIGSPDWFGRGSRVIITTRDEHLLALHNVKITYKVRELNEKHALQLLTHKAFELEKEVDPSYHDILNRAITYASGLPLALEVIGSNLLEKSIEEWESALDGYERIPDKKIYDILKVSYDALNEDEKNIFLDIACCFKAYKLEELQDILYAHYGHCMKYHIGVLVKKSLINIHGSWDYKVMRLHDLIEDMGKEIVRRESPTNPGKRSRLWSHEDINQVLQENKGTSKIEIICMNFSSFGEEVEWDGDAFKKMKNLKTLIIKSDCFSEGPKHLPNTLRVLEWWRCPSQDWPHNFNPKQLAICKLPDSSFTSVGLAPLFEKASRLVNLTSLILDECDSLTEIPDVSCLSNLENLSFRKCRNLFTIHHSVGLLEKLKILDAECCPELKSFPPLKLTSLERFELWYCVSLESFPEILGKMENITQLCLYECPITKLPPSFRNLTRLRSLSLGHHHQTEQLMDFDAATLISNICMMPELDGISADNLQWRLLPEDVLKLTSVVCSSVQSLTLKLSDELLPLFLSCFVNVIDLELSGSEFTVIPECIKECRFLSTLTLDRCDRLQEIRGIPPNLKTFSAMDSPALTSSSISMLLNQELHEAGDTDFSLPRVQIPQWFEHKNPGRPIRFWFRNDFPAIVACIAKSDFQGVFDYPDLSVFINGREHKHYGRTPVLEKPCTVLFHLLIEDDLDVSLLENEWNRAEIVCYGSWDECGIHVLKELSSMEDIRFTDPFRKEKFVVQRLRFGKKQRQSIIERGIKLRSGMVSRLIKDNSIYST

SEQ ID NO: 153671 - protein, 35 aa, Glycine max
  Coding DNA Sequence Number=SeqID_61986
MSDQNNGDMDETQTGMDIDYLFKDPTIDDSDDYDE

SEQ ID NO: 153672 - protein, 851 aa, Glycine max
  Coding DNA Sequence Number=SeqID_61987
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=99%, HitCoverage=80%, E-value=0.0, Identity=56%"; Hit description =Functional candidate resistance protein KR1
  Pfam annotation: Domain name=LRR_1; Domain location=408-433; Score =0.8; E_value=2.2e+02; Accession=PF00560.24; Description=Leucine Rich Repeat
  Pfam annotation: Domain name=LRR_1; Domain location=435-456; Score =12.9; E_value=1.2; Accession=PF00560.24; Description=Leucine Rich Repeat
  Pfam annotation: Domain name=LRR_1; Domain location=458-480; Score =6.7; E_value=18; Accession=PF00560.24; Description=Leucine Rich Repeat
  Pfam annotation: Domain name=LRR_1; Domain location=482-503; Score =8.4; E_value=8.4; Accession=PF00560.24; Description=Leucine Rich Repeat
  Pfam annotation: Domain name=LRR_1; Domain location=504-526; Score =12.1; E_value=1.7; Accession=PF00560.24; Description=Leucine Rich Repeat
  Pfam annotation: Domain name=LRR_1; Domain location=528-549; Score =13.1; E_value=1; Accession=PF00560.24; Description=Leucine Rich Repeat
  Pfam annotation: Domain name=LRR_1; Domain location=609-632; Score =0.4; E_value=2.5e+02; Accession=PF00560.24; Description=Leucine Rich Repeat
  Pfam annotation: Domain name=LRR_1; Domain location=634-655; Score =6.2; E_value=22; Accession=PF00560.24; Description=Leucine Rich Repeat
  Pfam annotation: Domain name=LRR_1; Domain location=657-682; Score =8.1; E_value=9.6; Accession=PF00560.24; Description=Leucine Rich Repeat
  Pfam annotation: Domain name=MotA_activ; Domain location=263-359; Score=-9.9; E_value=0.099; Accession=PF09114.1; Description =Transcription factor MotA, activation
  Pfam annotation: Domain name=NACHT; Domain location=57-210; Score= -7.4; E_value=0.00022; Accession=PF05729.3; Description=NACHT domain
  Pfam annotation: Domain name=NB-ARC; Domain location=18-310; Score =147.2; E_value=4.5e-41; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::MotA_activ::NACHT::NB-ARC; Domain location=408-433::435-456::458-480::482-503::504-526::528 -549::609-632::634-655:...
  Pfam module annotation: Domain location=:657-682::263-359::57-210::18- 310
MDMRNKYEYKFIKEIVESVSSKFNHALLQVPDVLVGLESPVLEVKSLLDVGSDDVVHMVGIHGLGGVGKTTLAVAVYNSIAGHFEASCFLENVRETSNKKGLQHLQSILLSKTVGEKKIKLTNWREGIPIIKHKLKQKKVLLILDDVDEHKHLQAIIGSPDWFGCGSRVIITTRNEHLLALHNVKITYKVRELNEKHALQLLTQKAFELEKEVDSSYNDILNRALIYASGLPLALEVIGSNLFGKSIKEWESALNGYERIPDKSIYMILKVSYDALNEDEKSIFLDIACCFKDYELGELQDILYAHYGRCMKYHIGVLVKKSLINIHGSWDYKVMRLHDLIEDMGKEIVRRESPTEPGKRSRLWSHEDINQVLQENKGTSKIEIICMNFSSFGEEVEWDGDAFKKMKNLKTLIIKSDCFTKGPKYLPNTLRRFVNLTILNLDKCDSLTEIPDVSCLSKLEKLSFARCRNLFTIHYSVGLLEKLKILYAGGCPELKSFPPLKLTSLEQFELSGCHNLESFPEILGKMENITVLDLDECRIKEFRPSFRNLTRLQELYLGQETYRLRGFDAATFISNICMMPELARVEATQLQWRLLPDDVLKLSSVVCSSMQHLEFIGCDLSDELLWLFLSCFVNVKNLNLSASKFTVIPECIKDCRFLTTLTLDYCDRLQEIRGIPPNLKYFSALGCLALTSSSISMLQNQELHEVGDTFFILPSGKIPGWFECHSRGPSIFFWFRNKLPAIVVCFVKEDFLNFTSDLVLSVIINGHEHQHKPLFGGFFFESPCTALFHLQMKDNLDEALLENEWNLAEIVYGDLCDENGIHVLKKQSSVDDIRFIDPCRKKKLNDDLISS

SEQ ID NO: 153673 - protein, 285 aa, Glycine max
  Coding DNA Sequence Number=SeqID_61988
  Gene Ontology: Mol. function=methyltransferase activity; Cellular component=cellular_component; Biological process=metabolic process
  Homolog annotation: Hit_ID=A2Q3H3; Match level="QueryCoverage=31%, HitCoverage=28%, E-value=1e-31, Identity=77%"; Hit description =Peptidase, cysteine peptidase active site
VGGAGARASKKPCLNYVVASFVDVCHRASRIVQIQATVSKRALELIALPDDRIPKLLLDIGCGTGLNGETISENGHHWIGLDISASMPNVVVEREVEGDLLLGDMGLKAAAAIGGGTKLPQPPPTQPTTREFQQQQHGREQTVRGREQEATTVGTKEEKAGFGLPPYCSFSPGLGIHPGVMDGAISISVVRTLNKFSCIALAGVYTEYLIYGFSEGGLDDIRKDLGFAQKKADSQVRWSLLNTVLRRYQAARGKVVEALSTGKSVGSYIDIIENSIDVSDLLLKL

SEQ ID NO: 153674 - protein, 272 aa, Glycine max
  Coding DNA Sequence Number=SeqID_61989
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=A7Q401; Match level="QueryCoverage=33%, HitCoverage=31%, E-value=3e-37, Identity=84%"; Hit description =Chromosome chr13 scaffold_48, whole genome shotgun sequence
  Pfam annotation: Domain name=Kinesin; Domain location=36-178; Score= -161.9; E_value=0.00015; Accession=PF00225.14; Description=Kinesin motor domain
MVKTRDTAASMTNVIEEQGNMALSNAQEERILVSIRIRPLNKREKARHDTRTTAMWNHDHSQWIPMPLVRNKYQNARQTSSGKTHTMSGITEYVERDIYEYIEKHKDIEFVNFVDLVGSECASQAMTAGIRLREGSHINHSLLSLETLIRKLSIPLRSYNVGYCMVCEANLKILEGVTDIDLVVNLKLQEEALLAKCLGRRICNQCGGNFNIASISIKGENGRPGMVMAPLLPPAHCMSKLITRSDDTKAVVKERLRIYNEKEQMISVRIAD

SEQ ID NO: 153675 - protein, 146 aa, Glycine max
  Coding DNA Sequence Number=SeqID_61990
  Gene Ontology: Cellular component=integral to membrane
  Homolog annotation: Hit_ID=A7P6V1; Match level="QueryCoverage=81%, HitCoverage=18%, E-value=1e-41, Identity=71%"; Hit description =Chromosome chr9 scaffold_7, whole genome shotgun sequence
  Pfam annotation: Domain name=DUF590; Domain location=1-142; Score =95.8; E_value=1.3e-25; Accession=PF04547.3; Description=Protein of unknown function, DUF590
MFEKRPKTDIVLTCFADFLELALQFGMILMFACAFPPAFAFAAVNNLMEIRTDALKLLVILRRHVPRAAATVGVWLNIFQFLILMSICTNCAILAWLYDEEGKWKIEPGLATILIMEHVLLLTKFGFSRFFPEVIVLLPKSTKHSP

SEQ ID NO: 153676 - protein, 338 aa, Glycine max
  Coding DNA Sequence Number=SeqID_61991
  Gene Ontology: Mol. function=transmembrane receptor activity; Cellular component=intrinsic to membrane; Biological process=innate immune response
  Homolog annotation: Hit_ID=Q9FXZ2; Match level="QueryCoverage=83%, HitCoverage=64%, E-value=1e-132, Identity=85%"; Hit description =Resistance protein LM12
  Pfam annotation: Domain name=TIR; Domain location=22-138; Score=47.1; E_value=6.1e-11; Accession=PF01582.11; Description=TIR domain
  Subcellular localization annotation: CTP_CleavageSite=31; ConfidenceScore=5.09e-01
MCSLASEGKILVMVSLAISTMFTGKGEFTPSLMTTSSRKGTKSITTALEEAIEKSKIFIIVLSENYASSSFCLNELTHILNFTKEKNDVLVLPVFHKVNPSDVRHHRGSFGEALANHEKKLNSNNTEKLQTWKMALHQVSNISGYHFQDDGNKYEYKFIKEIVEWVSSKVNRDHLHVSDVLVRLESPMLEVKLLLDVGRDDVIHMVGIHGLDEVGKRSLAVAVYNSIGGHFEASFFLGNVRGTSNEINGLEDLQSIILSKTVGEIKLTNWREGIHIIKRKLKGKKVLLILDDVDEQTQLQAIIGSLDWFGSGTRVIITTRDEHLLLSWKKKLIQVIMC

SEQ ID NO: 153677 - protein, 958 aa, Glycine max
  Coding DNA Sequence Number=SeqID_61992
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=95%, HitCoverage=81%, E-value=0.0, Identity=64%"; Hit description =Functional candidate resistance protein KR1
  Pfam annotation: Domain name=ABC_tran; Domain location=225-359; Score= -61.3; E_value=0.081; Accession=PF00005.18; Description=ABC transporter
  Pfam annotation: Domain name=LRR_1; Domain location=574-599; Score =2.0; E_value=1.3e+02; Accession=PF00560.24; Description=Leucine Rich Repeat
  Pfam annotation: Domain name=LRR_1; Domain location=645-666; Score =12.1; E_value=1.8; Accession=PF00560.24; Description=Leucine Rich Repeat
  Pfam annotation: Domain name=LRR_1; Domain location=668-690; Score =12.0; E_value=1.8; Accession=PF00560.24; Description=Leucine Rich Repeat
  Pfam annotation: Domain name=LRR_1; Domain location=692-713; Score =8.1; E_value=9.9; Accession=PF00560.24; Description=Leucine Rich Repeat
  Pfam annotation: Domain name=LRR_1; Domain location=714-736; Score =11.3; E_value=2.4; Accession=PF00560.24; Description=Leucine Rich Repeat
  Pfam annotation: Domain name=LRR_1; Domain location=738-759; Score =12.6; E_value=1.4; Accession=PF00560.24; Description=Leucine Rich Repeat
  Pfam annotation: Domain name=LRR_1; Domain location=841-862; Score =7.9; E_value=11; Accession=PF00560.24; Description=Leucine Rich Repeat
  Pfam annotation: Domain name=LRR_1; Domain location=864-889; Score =8.3; E_value=8.8; Accession=PF00560.24; Description=Leucine Rich Repeat
  Pfam annotation: Domain name=NACHT; Domain location=225-378; Score= -2.9; E_value=0.0001; Accession=PF05729.3; Description=NACHT domain
  Pfam annotation: Domain name=NB-ARC; Domain location=186-478; Score =150.1; E_value=6.1e-42; Accession=PF00931.13; Description=NB-ARC domain
  Pfam annotation: Domain name=TIR; Domain location=24-159; Score =134.7; E_value=2.6e-37; Accession=PF01582.11; Description=TIR domain
  Pfam module annotation: Pfam domain module=ABC_tran::LRR_1::LRR _1::LRR_1::LRR_1::LRR_1::LRR_1::LRR_1::LRR_1::NACHT::NB-ARC::TIR; Domain location=225-359::574-599::645-666::668-690::692-713::714 -736::738-759::841-862::...
  Pfam module annotation: Domain location=864-889::225-378::186-478::24- 159
METENSHKPLFKILMAVRSFSYDVFLSFRGEDTRYCFTGNLYNVLRERGIHTFIDDDELQKGDQITSALQEAIEKSKIFIIVLSENYASSSFCLNELTHILNFTKGKNDLLVLPVFYIVDPSDVRHHRGSFGEALANHEKKLNSTNMENLETWKIALHQVSNISGYHFQHDGDKYEYKFIKEIVELVSNKFNRDLLHVSDALVGLESPVLEVKSLMDVGSDDVVQMVGIHGLGGVGKTTLAVAVYNSIADHFEASCFLENVRETSNKKGLQHLQSILLSKTVGEKKIKLTNWREGIHIIKRKLKEKKVLLILDDVDEQKQLQAIIGSPDWFGGGSRVIITTRDEHLLALHNVKITYKVRELNEKHALQLLSQKAFELEKEVDPSYHDILNRAVAYASGLPLALEVIGSNLFEKSIEEWESALNGYERIPDKSIYMILKVSYDALNEDEKSIFLDIACCFKDYELGELQDILYAHYGRCMKYHIGVLVKKSLINIHWWGKLMRLHDLIEDMGKEIVRRESPTEPGKRSRLWSHEDINQVLHENKGTRKIEIICMNSSSFGEEVEWDGDAFKKMKNLKTLIIKSDCFSKGPKHLPNTLRVLEWWRCPSQDWPHNFNPKQLAICKLPDSSFTSLGLAPLFEKASRLVNLTSLILDECDSLTEIPDVSCLSNLENLSFRGCPNLFTIHHSVGLLEKLKILDAEFCPELKSFPPLKLTSLEWLELSYCFSLESFPEILGKMENITELHLIECPITKLPPSFRNLTRLQVLRLGPETAPLMDFDAATLISNICMMPELYDISASSLQWKLLPDDVLKLTSVVCSSIQSLSLELSDELLPLFLSCFVNVRNLNLSWSKFTVIPECIKECRFLTTLTLDYCDRLQEIRGIPPNLKEFSALGCLALTSSSIGMILNQELHEVDFSLPILKIPEWFECQSREPWRIFDYHSYVCEDSWDECGIHVLKE

SEQ ID NO: 153678 - protein, 93 aa, Glycine max
  Coding DNA Sequence Number=SeqID_61993
MHWECENFPTCFWGRYISNDSSSIDILLKIESDVGKNRSIPAIKIWLNFILNLRVITIRAVMILKSSSDTVRTFVDVFEQIFNGCTLITPFHI

SEQ ID NO: 153679 - protein, 683 aa, Glycine max
  Coding DNA Sequence Number=SeqID_61994
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=90%, HitCoverage=68%, E-value=1e-83, Identity=50%"; Hit description =Functional candidate resistance protein KR1
  Pfam annotation: Domain name=LRR_1; Domain location=263-284; Score =9.7; E_value=4.9; Accession=PF00560.24; Description=Leucine Rich Repeat
  Pfam annotation: Domain name=LRR_1; Domain location=286-308; Score =1.5; E_value=1.6e+02; Accession=PF00560.24; Description=Leucine Rich Repeat
  Pfam annotation: Domain name=LRR_1; Domain location=310-331; Score =9.5; E_value=5.2; Accession=PF00560.24; Description=Leucine Rich Repeat
  Pfam annotation: Domain name=LRR_1; Domain location=332-354; Score =16.1; E_value=0.13; Accession=PF00560.24; Description=Leucine Rich Repeat
  Pfam annotation: Domain name=LRR_1; Domain location=356-377; Score =4.1; E_value=53; Accession=PF00560.24; Description=Leucine Rich Repeat
  Pfam annotation: Domain name=LRR_1; Domain location=471-492; Score =4.1; E_value=53; Accession=PF00560.24; Description=Leucine Rich Repeat
  Pfam annotation: Domain name=NACHT; Domain location=1-152; Score= -28.6; E_value=0.01; Accession=PF05729.3; Description=NACHT domain
  Pfam annotation: Domain name=NB-ARC; Domain location=1-257; Score =25.7; E_value=6.5e-12; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=263-284::286 -308::310-331::332-354::356-377::471-492::1-152::1-257
MVGIHGLGGVGKTTLVVTVYNFIAGHFEASCFLGNAKRTSNTIDGLEKLQNNLLSKMVGEIKFTNWREGITIIKRKLKQKKILLILDDVDKHKQLQAITDSPDWFGRGSRVIITTRDENLLVLHNVKITYKVREFNKIHALLLLTHKAFELEKEVDPRYCYFLNRAVTYASDLPLALEIIGSNLFGKSIEESESALNGFERIPDNNIYEILKVSYDALNEDEKKDMDKEIVRRESATEPAEQSRLWSREDIKKVLQENKRLVNLTSLILDECDSLTEISDVSCLSNLEILSFRERRNLFRIHHSVGLLEKLKILDAEGCPELKSFPPLKLTSLESLDLSYCSNLESFPEILGKMENITRLHLIGFSIRKLPPSFRNLTRLKVLYVGTETTPLMDFDVATLISNICMMSELFEIAANSLQWRLWPDDACLQWRLWPDDFLKLTSLLNSSIEFLCHGDLSDELLRLFLSCFVNVINLELKGSKLTVIPECIKECRFLSTPKLNGCDRLQEIRGIPPNLKRFSAIACPDLTSSSISMLLNQELHEAGDTYFSLPIVKIPEWFECQSREPSIFFWFRNEFPAITVCIVESHFKEYSNDLVLSVIINKKHKHKQREIFDSVILILILLEREKFVVQRLGLGKKQRLVGSEVVETQFVEQQQHMGFFLTRVELGTITCNVSLLRQSIIG

SEQ ID NO: 153680 - protein, 62 aa, Glycine max
  Coding DNA Sequence Number=SeqID_61995
MLGFNTAVGFYEALYIGGVIYGHSVMAVLDSLIVMDAAIQIFAFCVLPYIEVYSNVLYMEDS

SEQ ID NO: 153681 - protein, 31 aa, Glycine max
  Coding DNA Sequence Number=SeqID_61996
MLLFDQIGMGVEEEGGVIYGKDHCLELVLLG

SEQ ID NO: 153682 - protein, 183 aa, Glycine max
  Coding DNA Sequence Number=SeqID_61997
  Homolog annotation: Hit_ID=A5AZ88; Match level="QueryCoverage=54%, HitCoverage=9%, E-value=6e-08, Identity=34%"; Hit description =Putative uncharacterized protein
MKISSFHQFPDECLNETLNRFHGLLWKTPTHGFSKLFQLNIFIDGLQPHSKQLLDASIGGKIKLMTPEEAMKLIENMAANDHVILRDPEPNPQEETTRLEELLVQFMQETRSHQNSTDAPLRNLEVELAKLVAERPTETFAVNTEMKPKEECKVFPGCMSFMASLAKRRKCKEDVFYVTFMSP

SEQ ID NO: 153683 - protein, 491 aa, Glycine max
  Coding DNA Sequence Number=SeqID_61998
  Gene Ontology: Mol. function=transmembrane receptor activity; Cellular component=intrinsic to membrane; Biological process=innate immune response
  Homolog annotation: Hit_ID=Q9FXZ2; Match level="QueryCoverage=84%, HitCoverage=95%, E-value=0.0, Identity=100%"; Hit description =Resistance protein LM12
  Pfam annotation: Domain name=NACHT; Domain location=211-363; Score= -1.0; E_value=7.1e-05; Accession=PF05729.3; Description=NACHT domain
  Pfam annotation: Domain name=NB-ARC; Domain location=172-464; Score =78.4; E_value=2.4e-20; Accession=PF00931.13; Description=NB-ARC domain
  Pfam annotation: Domain name=TIR; Domain location=10-145; Score =128.2; E_value=2.4e-35; Accession=PF01582.11; Description=TIR domain
  Pfam module annotation: Pfam domain module=NACHT::NB-ARC::TIR; Domain location=211-363::172-464::10-145
MALRSFSYDVFLSFRGEDTRYGFTGYLYNVLRERGIHTFIDDDEPQEGDEITTALEAAIEKSKIFIIVLSENYASSSFCLNSLTHILNFTKENNDVLVLPVFYRVNPSDVRHHRGSFGEALANHEKKSNSNNMEKLETWKMALHQVSNISGHHFQHDGNKYEYKFIKEIVESVSNKFNHDHLHVSDVLVGLESPVLEVKSLLDVGRDDVVHMVGIHGLAGVGKTTLAIAVYNSIAGHFEASCFLENVKRTSNTINGLEKLQSFLLSKTAGEIKLTNWREGIPIIKRKLKQKKVLLILDDVDEDKQLQALIGSPDWFGLGSRIIITTRDEHLLALHNVKITYKVRELNEKHALQLLTQKAFELEKGIDPSYHDILNRAVTYASGLPFVLEVIGSNLFGKSIEEWKSALDGYERIPHKKIYAYLNLILHPCDLEQPNTSGSPINVLLVTIAVNDLMIALPIPPVSFKILKSFFTSAPYNISIQTLMLHDTYKP

SEQ ID NO: 153684 - protein, 511 aa, Glycine max
  Coding DNA Sequence Number=SeqID_61999
  Gene Ontology: Mol. function=heat shock protein binding; Cellular component=cytoplasm; Biological process=chloroplast accumulation movement
  Homolog annotation: Hit_ID=A7PUS2; Match level="QueryCoverage=53%, HitCoverage=96%, E-value=3e-69, Identity=53%"; Hit description =Chromosome chr4 scaffold_32, whole genome shotgun sequence
  Pfam annotation: Domain name=TolA; Domain location=83-415; Score= -149.7; E_value=0.054; Accession=PF06519.2; Description=TolA protein
MVNKHQRVHGGYFFATHSTTIFRLQIEDNLDEELSKSEWNRTEIVAVGKKQRLVGSEVVETHFVEQQQHMGFLSHMWNWALALDNRGKGASEMSQGEAEHSGKVACTATNFNGDEHSFSCEQTCTEKTKTAPQMKFDAQSGERKIGERGNTKQHLNVAINPEESRDQMSSSQGDYRRNTIADEPAAVQEMLRGSEEKESWKKMEEEMERERERQKDKMAVDSAMLEAEREKEKEKDRMAVDKATLEARDRTYVDARERAERAAFEREPTEARQRALAEARERLEKACTKARDKTYADKAAAEARLKAEQTAVERATTEARECAMDKVKETGLFILSKIYWIHIVRTLAPSRIPNIHIPQFMVYCPLLEASSFTERLEREGESAQRCRARLERYCRTAERAAKALEEKNMRDLVAQKEQAERNRLAETLDTEVRRWSSGKEGNLRALLSTLLYILGPDSGWQPIPLTDVITSAAVKKTYRKATLCVHPDKLQQRGASIQHKYICEKVFDLLK

SEQ ID NO: 153685 - protein, 281 aa, Glycine max
  Coding DNA Sequence Number=SeqID_62000
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=80%, HitCoverage=7%, E-value=9e-20, Identity=31%"; Hit description=CTV.20
MTKSLSNPQLTLLWNFMMLSDNFSIDKEPQQRWFFQNFKGTNRQQIQDKFYEFVERVKINILFFDWFHAYTIIEDIDYPWKQDIIGDPTTNVITNWQLKDDELIQADLPPATQYQLPNIKDSSNKPVMAIPFKMKDINEEVTYRDIRSLMEQANYTNKYLQVLGKTLKTKISKQKTIEEASTSIPIEKPLFKPFKISDKAKKKIRELRKNKSLIEGVGDNNSEILHKISSLLKVIPETPQTSDNTSKIVTRSSSRLVNVINEDSDQNSNNTTETENSKKAI

SEQ ID NO: 153686 - protein, 886 aa, Glycine max
  Coding DNA Sequence Number=SeqID_62001
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=88%, HitCoverage=69%, E-value=0.0, Identity=60%"; Hit description =Functional candidate resistance protein KR1
  Pfam annotation: Domain name=LRR_1; Domain location=409-434; Score =3.2; E_value=78; Accession=PF00560.24; Description=Leucine Rich Repeat
  Pfam annotation: Domain name=LRR_1; Domain location=480-501; Score =12.4; E_value=1.6; Accession=PF00560.24; Description=Leucine Rich Repeat
  Pfam annotation: Domain name=LRR_1; Domain location=503-525; Score =7.0; E_value=15; Accession=PF00560.24; Description=Leucine Rich Repeat
  Pfam annotation: Domain name=LRR_1; Domain location=527-548; Score =9.4; E_value=5.5; Accession=PF00560.24; Description=Leucine Rich Repeat
  Pfam annotation: Domain name=LRR_1; Domain location=549-571; Score =8.6; E_value=7.8; Accession=PF00560.24; Description=Leucine Rich Repeat
  Pfam annotation: Domain name=LRR_1; Domain location=573-594; Score =4.1; E_value=52; Accession=PF00560.24; Description=Leucine Rich Repeat
  Pfam annotation: Domain name=LRR_1; Domain location=674-695; Score =7.6; E_value=12; Accession=PF00560.24; Description=Leucine Rich Repeat
  Pfam annotation: Domain name=LRR_1; Domain location=697-722; Score =8.0; E_value=9.9; Accession=PF00560.24; Description=Leucine Rich Repeat
  Pfam annotation: Domain name=NACHT; Domain location=57-210; Score= -11.3; E_value=0.00045; Accession=PF05729.3; Description=NACHT domain
  Pfam annotation: Domain name=NB-ARC; Domain location=18-310; Score =141.9; E_value=1.7e-39; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::NACHT::NB-ARC; Domain location=409 -434::480-501::503-525::527-548::549-571::573-594::674-695::697 -722::57-210::18-310
MDMRDKYEYKFIKEIVELVSSKFNRDLLYVSDVLVGLESPVLAVKSLLDVGSDDVVHMVGIHGLGGVGKTTLAVAVYNSIARHFEASYFLENVRETSNKKGLQHLQSILLSKIVRDKKIKLTNWREGTHIIKHKLKQKKVLLILDDVNEHIQLQAIIGSPDWFGRGSRVIITTRDEHLLALHNVKKTYMLRELNKKYALQLLIQKAFELEKEVDPSYHDILNRAVTYASGLPLALEVIGSNLFGKSIEEWESALNGYERIPDKSIYMILKVSYDALNEDEKNIFLDIACCFKEYKLGELQDILYAHYGRCMKYHIGVLVKKSLINIHECSWDSKVMRLHDLIEDMGKEIVRRESPTEPGKRSRLWSHEDINLVLQENKGTSKIEIICMNFSSFGEEVEWDGNAFKKMKNLKTLIIQSDCFSKGPRHLPNTLRVLEWWRCPSQEWPRNFNPKQLAICKLPHSSFTSLGLAPLFNKASRLVNLTRLTLDECDSLTEIPDVSGLSNLENLSFASCWNLFTIHHSVGLLEKLKTLNAEGCPELKSFPPLKLTSLEMFQLSYCSSLESFPEILGKMENITQLSWTDCAITKLPPSFRNLTRLQLLVVENLTEFDFDAATLISNICMMPELNQIDAVGLQWRLLLDDVLKLTSVVCSSVQSLTLELSDELLQLFLSCFVNVKKLNLSWSKFTVIPECIKECRFLTTLTLNYCNCLREIRGIPPNLKTFSAIDSPALNSSSISMLLNQELHEARDTDFSLPRVKIPEWFECQSRGPPICFWFRNEFPAITVCIVQPHLNMSKSLSVIINNKPEYRLYVRICGMNAESMYGKSKVAWRIFDSVILVEKEKFVVQRLRLGKKQRLVGSEVVETQYVEQQQHMGFFSHVWMKEESS

SEQ ID NO: 153687 - protein, 54 aa, Glycine max
  Coding DNA Sequence Number=SeqID_62002
  Homolog annotation: Hit_ID=Q4PL90; Match level="QueryCoverage=55%, HitCoverage=24%, E-value=5e-07, Identity=73%"; Hit description =Putative uncharacterized protein
MALGSTYGDINLKRNPTKKKKKTTARPEFARYHEYLKEGDMWDLNSNKPVMYYK

SEQ ID NO: 153688 - protein, 67 aa, Glycine max
  Coding DNA Sequence Number=SeqID_62003
MSLRTLFLLPHQALIPEIKGTFMTLWITILEGEGCMTYDLPLMFDPSPLISSDSDINTWALISIYVP

SEQ ID NO: 153689 - protein, 35 aa, Glycine max
  Coding DNA Sequence Number=SeqID_62004
MTPSQQHDAPMATPNSPLAPQWNVSEAIPDMGDLL

SEQ ID NO: 153690 - protein, 122 aa, Glycine max
  Coding DNA Sequence Number=SeqID_62005
MKIIHYDVCDDVRMCHMVDLIFALDDQDFFCRDVSPLLLAQSQQKTPHSAIKNEDVFSQHHRTNVRLQTYQCDDLRTDIDTSVKDTKKMLLACNTFHGHAPQFVGKILAVQQPPFACQNPEF

SEQ ID NO: 153691 - protein, 139 aa, Glycine max
  Coding DNA Sequence Number=SeqID_62006
ALRANAPLPYPHLITLFLRHFQIPLDDEPFVQVKRSFAIGAGALTSFGYRKDRNGQWLKKDALPPHDERTPSPPPQREDSALLNEVLTELRVLRSYVGEFFDSLDTRFADMNIRLTQVEEDVSFIRTCFDPPPPPPSSS

SEQ ID NO: 153692 - protein, 37 aa, Glycine max
  Coding DNA Sequence Number=SeqID_62007
  Gene Ontology: Mol. function=aspartic-type endopeptidase activity; Biological process=RNA-dependent DNA replication
  Homolog annotation: Hit_ID=Q6WAY3; Match level="QueryCoverage=100%, HitCoverage=2%, E-value=4e-09, Identity=60%"; Hit description =Gag/pol polyprotein
MDPVKYIFEKPALTGRIARWQAVKGSALADYLAQQPL

SEQ ID NO: 153693 - protein, 71 aa, Glycine max
  Coding DNA Sequence Number=SeqID_62008
MGGSSSKIMILDFPTTREKANVVADALKPEIFTCCDYDEFGAEIDRGVPRSESSNRGATQELICGNVADYQ

SEQ ID NO: 153694 - protein, 81 aa, Glycine max
  Coding DNA Sequence Number=SeqID_62009
MYPPLELIHKRCTLSCSQSNPSRCTLYLYHKGCTLQCVKTKISGGRRETQKEFRQLVLGEFFLAKGEGVGSSGLRIIKKGG

SEQ ID NO: 153695 - protein, 85 aa, Glycine max
  Coding DNA Sequence Number=SeqID_62010
  Homolog annotation: Hit_ID=A5B3J2; Match level="QueryCoverage=88%, HitCoverage=16%, E-value=5e-07, Identity=38%"; Hit description =Putative uncharacterized protein
MAEDQPRRVTLEDYSSSTVPQFITIIARPEVQAHNITYPHSLIKLIQGNLFHGLLNEEDPYAHLATYIEICNTVKIAGVPEDAVR

SEQ ID NO: 153696 - protein, 84 aa, Glycine max
  Coding DNA Sequence Number=SeqID_62011
MNIEESIHVTFDESNVILSRKNMLDDIADSLEHMNIDEQDSKGHDKGNNEDSQEEVKSNNDFQENGKLQEIIPSTTLLVISQKG

SEQ ID NO: 153697 - protein, 91 aa, Glycine max
  Coding DNA Sequence Number=SeqID_62012
  Subcellular localization annotation: CTP_CleavageSite=32; ConfidenceScore=5.78e-01
MASPPASPPPPPPSPPPSDTSASPSTVKRTRKASRLRSLSTRPPGAERPVVHVDPATGNGPHRKKLRTYLGIVARDKVDVTYENWKEVSTA

SEQ ID NO: 153698 - protein, 122 aa, Glycine max
  Coding DNA Sequence Number=SeqID_62013
MRILFFYRPRFKKSKVVFQWGLLSWEPNLDIWGETNLGVKVSISGRASILFHKACVTMMIRKQRAKLVMATARWALKHPVYGIVILRLGIYTNRPNVSKTKFLNEKFYAFPEFQQTLLTTTK

SEQ ID NO: 153699 - protein, 297 aa, Glycine max
  Coding DNA Sequence Number=SeqID_62014
  Homolog annotation: Hit_ID=Q84VH5; Match level="QueryCoverage=100%, HitCoverage=46%, E-value=1e-104, Identity=67%"; Hit description =Envelope-like protein
MASSPKETSASGSPAVPSSPHQEQPEFNIQPIQIIPGQASVPEKLVPRRQQGVKIAENPSPATSPREVDTEMDKKIRSIMFQHLPPRMFLCRMLRKDVPTSSAPNAEVLSSSSKERSTEEDDQAAEETPAPRAPEPAPGDLIDLEEVESDEEPIANKLAPGIAERLQSRKGKTPIKRSGRIKTMAQKKSTLITPTTSRRSKVAIPSKKRKEISSSDSDDDVELDVPDIKRTKTSGKKVPGNVPDAPLDNISFHSIGNAERWKFVYQRRLALERELGRAALDCKEIMDLITAAGLLKT

SEQ ID NO: 153700 - protein, 84 aa, Glycine max
  Coding DNA Sequence Number=SeqID_62015
YILCGTSRGYIYLGVVILRTREGTSLVDQFKWRVHPLGYSKRTREGTSLVDLWHVKDFTKLKEISRTGWLLGDWTQARIMAELV

SEQ ID NO: 153701 - protein, 159 aa, Glycine max
  Coding DNA Sequence Number=SeqID_62016
  Homolog annotation: Hit_ID=P75676; Match level="QueryCoverage=95%, HitCoverage=99%, E-value=9e-60, Identity=69%"; Hit description =Uncharacterized protein yafX
  Pfam annotation: Domain name=Antirestrict; Domain location=63-159; Score=198.8; E_value=1.4e-56; Accession=PF03230.4; Description =Antirestriction protein
MNNTLKQTRSVAGSLTSPQSDTYGIVCTLVPDEQRIVFWPQHFGNIPQWITLEPHIFAWMEHFCEGYTGGIWQFYTLSNGGAFMVPETNDNDEKWMLFNNMNGNSAEMSADAAGVAVCLIAYSHHACRTECNAMTEHYYRLRDYALVHAECHAIMRIID

SEQ ID NO: 153702 - protein, 180 aa, Glycine max
  Coding DNA Sequence Number=SeqID_62017
MYPSLFSSKPQWMYPPLELIHKRYVPSTCTTKDVPSNVLRQRSRAVKPLILSEWGYKRILRRLFCIREREESKEFSDCVILNSLTREKGDTKEFRRLVLCSFGKGRRETQKEFRRLVLGEFFLAKGEENEKMNSTTFQGLENQKTSESFWYKEEEEEVQRDSRLVKDCKRLIGKYSRLNE

SEQ ID NO: 153703 - protein, 83 aa, Glycine max
  Coding DNA Sequence Number=SeqID_62018
MFIIFNSALKGLDDTPQPKSKAAARWIVVKCNRQKGSTECGYYVMHWMSTIILGSFRNNWKVPIGAREIKGASHPVGMILSPT

SEQ ID NO: 153704 - protein, 136 aa, Glycine max
  Coding DNA Sequence Number=SeqID_62019
  Gene Ontology: Mol. function=chlorophyll binding; Cellular component =integral to membrane; Biological process=photosynthetic electron transport
  Homolog annotation: Hit_ID=Q2MI75; Match level="QueryCoverage=74%, HitCoverage=26%, E-value=3e-48, Identity=70%"; Hit description =Photosystem II P680 chlorophyll A apoprotein
LYGPGIWVSDPYGLTGRIQSVNPAWGVEGFDPFVPGGVASHHIAAGTLGILAAFVVAGTMWYGSATTPIELFGPTRYQWDQGYFQQEIYRRVGAGLAENQSSMDNGDGIAVDGDGIVRADVSFFEGQNLNIGVDKV

SEQ ID NO: 153705 - protein, 116 aa, Glycine max
  Coding DNA Sequence Number=SeqID_62020
MYPPLELIHKRCALSCSLSTTQVDIPSTCTTKDGYKRILRRLVLRTLLYKGMRRIKRILRLCRFEFFDKGEGRHKRIQAVSPSFFWKREKRDTKRIQAVSPWRILFGKGRRDDKNE

SEQ ID NO: 153706 - protein, 77 aa, Glycine max
  Coding DNA Sequence Number=SeqID_62021
  Gene Ontology: Mol. function=catalytic activity; Cellular component =cellular_component; Biological process=metabolic process
  Homolog annotation: Hit_ID=Q9MB42; Match level="QueryCoverage=71%, HitCoverage=7%, E-value=2e-16, Identity=76%"; Hit description=Beta -amyrin synthase
LLNPTEFLGNIVVEHDYAECTGSAIQALVLFKKLYPRHRETEIKNSIANAVHGMEVGEFATFMALGHFTALPLGFKF

SEQ ID NO: 153707 - protein, 133 aa, Glycine max
  Coding DNA Sequence Number=SeqID_62022
  Homolog annotation: Hit_ID=UPI00016621D1; Match level="QueryCoverage =86%, HitCoverage=33%, E-value=8e-07, Identity=32%"; Hit description =UPI00016621D1 related cluster
MRGTVHEPQYPGLQRTTLLANRGLHALTLRGLCVLTFRGLHVLTFRGLHALAIRGLRVLTFRGLHALAIRGLHVLTFRGLHALAIRGLHVLTFVGLHALTFRGLHVLANRRLHALTFRGLHVLAHRGVARPHL

SEQ ID NO: 153708 - protein, 109 aa, Glycine max
  Coding DNA Sequence Number=SeqID_62023
KGERDPLVKVVWGSASGEDATWEREGQMRDAYPTLFDTGHKFPLYKPNVNLEQLFRKHILFLSSFLTHKNPNRATRGRALESTRDATIANREYLSDYIEVRDELLTLEN

SEQ ID NO: 153709 - protein, 59 aa, Glycine max
  Coding DNA Sequence Number=SeqID_62024
EWEESKEFSDCVVLNSLTREKGEENEKMNSTSFQGLENQKTLESFWYKEEEEVQRDSRL

SEQ ID NO: 153710 - protein, 115 aa, Glycine max
  Coding DNA Sequence Number=SeqID_62025
MTRGNPGNLQPFDPEIDRTFHRLVRHSVHPDHSVHFEHSEYSIASDSEYSDFEHSTTNFYTENMAQPPPRERTRREMVAPDFTYESLCIQYPDEAVPYVLKTGLIHLLPKLDGLA

SEQ ID NO: 153711 - protein, 58 aa, Glycine max
  Coding DNA Sequence Number=SeqID_62026
MSVKNLVERLGVHDMTNYTLVSQLKGALKPGVFAPKAYTPKSPSGPLPPDSGPTQKTF

SEQ ID NO: 153712 - protein, 47 aa, Glycine max
  Coding DNA Sequence Number=SeqID_62027
AYPLSPPSSIPLSFIFQEAKESIDEEDPRPTSSNGAYIMCYQEHLHL

SEQ ID NO: 153713 - protein, 32 aa, Glycine max
  Coding DNA Sequence Number=SeqID_62028
ILEHKGRVVPVWFRLCKRSFTKRVENLKLEDW

SEQ ID NO: 153714 - protein, 72 aa, Glycine max
  Coding DNA Sequence Number=SeqID_62029
MARTKKTGQMTSEVAKEIANKILEEQASQSSFVTHGHRDVLAIAIRQPEHPGCVRAVGPTPRTSRTSSSMAP

SEQ ID NO: 153715 - protein, 277 aa, Glycine max
  Coding DNA Sequence Number=SeqID_62030
  Gene Ontology: Mol. function=transporter activity; Cellular component= membrane; Biological process=transport
  Homolog annotation: Hit_ID=A4VLI6; Match level="QueryCoverage=100%, HitCoverage=57%, E-value=1e-51, Identity=40%"; Hit description =Probable outer membrane lipoprotein
  Pfam annotation: Domain name=OEP; Domain location=1-145; Score=41.3; E_value=3.4e-09; Accession=PF02321.9; Description=Outer membrane efflux protein
  Pfam annotation: Domain name=OEP; Domain location=170-276; Score=3.0; E_value=0.007; Accession=PF02321.9; Description=Outer membrane efflux protein
  Pfam module annotation: Pfam domain module=OEP::OEP; Domain location =1-145::170-276
ASRAKRSTNAIRVGSSPILETYNLGLNASWEPDLWGRIRKQIESGEASLQAASADVEVAKLSIVANLLQAYFQLRVLDTQLVLLDDTLKALQRSQQLTLNRYRAGVASKTDVNQADALHKNTQVVATDTRLQRAQTEHAIALLLGKAPAEVTIPAHPYQMQAPLALPAIPASLPAALLERRPDIAAAEYRVAAANADIGVAKTAFFPSLNLTAGLGYQSNAFSNLIASPSRVWSIGPLIALNVFDGGLRKAQTQSAIASYDATVAQYRQTVLSAFQE

SEQ ID NO: 153716 - protein, 79 aa, Glycine max
  Coding DNA Sequence Number=SeqID_62031
MDSAKHMSTPMSTNCYLDKDESGQSIDIKQYREKVQVELVNLLDRLLSHGIVRNKTVLLYLLLKRSISLPVVVVHRFYG

SEQ ID NO: 153717 - protein, 29 aa, Glycine max
  Coding DNA Sequence Number=SeqID_62032
MVWWAAGKRKSFQRRKEKNENEAKRRHLT

SEQ ID NO: 153718 - protein, 35 aa, Glycine max
  Coding DNA Sequence Number=SeqID_62033
MEGTSTWFFKENKGGHGLWPNQYKSSVGLLLPYTL

SEQ ID NO: 153719 - protein, 266 aa, Glycine max
  Coding DNA Sequence Number=SeqID_62034
  Gene Ontology: Mol. function=sequence-specific DNA binding; Biological process=regulation of transcription, DNA-dependent
  Homolog annotation: Hit_ID=A6TCD5; Match level="QueryCoverage=100%, HitCoverage=80%, E-value=4e-88, Identity=67%"; Hit description =Putative uncharacterized protein yfgA
  Pfam annotation: Domain name=HTH_3; Domain location=19-71; Score =30.3; E_value=7.1e-06; Accession=PF01381.13; Description=Helix-turn -helix
MNTEATHDQHEALSTGVRLRNAREQLGLSQQAVAERLCLKVSTVRDIEEDKAPADLASTFLRGYIRSYARLVHIPEEELLPMMAKQAPIRAAKVAPMQSFSLGKRRKKRDGWLMSFTWLILFVVIGLSGAWWWQDHKAQQEEITSMADQSTSDLNSSDSGSQSIPLDTSSANNAPDTTAANTNSAPVDTSTAPAPSAPAATPAPVDNNAVVAPSQANVDTSAAAPAAPAPTSALPTDQANAATTASAQDLVMNFSADCWLEVSDAT

SEQ ID NO: 153720 - protein, 371 aa, Glycine max
  Coding DNA Sequence Number=SeqID_62035
  Gene Ontology: Mol. function=endopeptidase inhibitor activity; Cellular component=plasma membrane; Biological process=metabolic process
  Homolog annotation: Hit_ID=A4WD98; Match level="QueryCoverage=100%, HitCoverage=24%, E-value=1e-177, Identity=81%"; Hit description =Alpha-2-macroglobulin domain protein precursor
MAQAWTEDDFGSSESKVIVAAPVITELNTPRFLASGDTSRLTLDLTNLTDQPQTLNVALNATGKLTLEGAQPQPVRLATSFRARPLPRSRRAGKSVVRPAFPAQDGELPGAMLNPGESWTAPGQHINGFSPATLQGQLLLSGKPPLNLARYIRELQAYPYGCLEQTTSGLFPSLYTNAAQLKALGIKGDTDDKRRTAIDIGISRLLQMQRDDGGFALWDKNGPEEYWLTAYVTDFLVRAGEQGYSVPADAVNNANSRLLRYLQDPGMMSIRYSDDTQASKFAVQAYAALVLARQQKAPLGALREIWDRHDQAASGLPLMQLGMALKLMGDAPRSQEALDLALKTPRNDSKTWMADYGSTLRDNALMLSLLE

SEQ ID NO: 153721 - protein, 150 aa, Glycine max
  Coding DNA Sequence Number=SeqID_62036
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=98%, HitCoverage=21%, E-value=1e-61, Identity=67%"; Hit description =Lipoxygenase-4
MDQFLRPDLAYFKAQAEIWDAIKSRVEEYVSFYYKSDKELQKDPELQAWWKELVEVGHGDLKDKPWWQKMQTRQLLAGDSCLRKGSPEYDALAKNPEKEFLKTITSKKETLIDLTVIEILSRHTSHEFYLGQRDGGDYWTSDAGPLEAFK

SEQ ID NO: 153722 - protein, 191 aa, Glycine max
  Coding DNA Sequence Number=SeqID_62037
  Homolog annotation: Hit_ID=UPI0000ECC274; Match level="QueryCoverage =30%, HitCoverage=88%, E-value=1e-17, Identity=66%"; Hit description =UPI0000ECC274 related cluster
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTRISRARYVGGATEFLKWWPNYGYTRRTVFGICALLKP

SEQ ID NO: 153723 - protein, 66 aa, Glycine max
  Coding DNA Sequence Number=SeqID_62038
MAAEHAKAEAAGGGQRRACGGSCINESANARGEAVCVLGALPLPRSLTRCARSFGCGERYQLTQRR

SEQ ID NO: 153724 - protein, 66 aa, Glycine max
  Coding DNA Sequence Number=SeqID_62039
MSLLSLIFVFSLLLSKPLLFSRSPPNLSQKNDDLGLIHRWIVVKFEHHVRNPIPSILTVGNFDITS

SEQ ID NO: 153725 - protein, 141 aa, Glycine max
  Coding DNA Sequence Number=SeqID_62040
  Homolog annotation: Hit_ID=A5BP71; Match level="QueryCoverage=53%, HitCoverage=19%, E-value=8e-13, Identity=49%"; Hit description =Putative uncharacterized protein
  Pfam annotation: Domain name=zf-CCHC; Domain location=114-131; Score =18.2; E_value=0.0027; Accession=PF00098.14; Description=Zinc knuckle
MKGKYIVQSLLKNLEKIKNKLVRTSFACMTSTPQACGYVSLNYYQYIDVVYINEHILKAYSPQWWPLGNEAAIPPSNDAWTLIPDPTTIRAKGRPKSTRIRNEMDWVEPSDHRKKCSRCGAEGHNRRRCPMQSERGSCSNH

SEQ ID NO: 153726 - protein, 111 aa, Glycine max
  Coding DNA Sequence Number=SeqID_62041
DPEELPPEPVGDVLDFLEGDEDPLPEVDSPEEVMSASEADSTEDSGPGEMAISGGSSSYLRSLPQHIGGYILCGTSREYIYLGLTENKRGYISCGSVLVEGTSTRFKENKG

SEQ ID NO: 153727 - protein, 105 aa, Glycine max
  Coding DNA Sequence Number=SeqID_62042
MAGAGGGGDEYHQLDGAQRLLLDAMNAQMQRLLDRTNEEVYGRLEALENQANQHARRNIDGNRGNNGGNDGPRQNRVEGVKLNVPPFKGRSDPDAYLDWEMKTEH

SEQ ID NO: 153728 - protein, 38 aa, Glycine max
  Coding DNA Sequence Number=SeqID_62043
MPAECSYPTMPGPLPYLKKEKKWGYEAWERMREVSDTT

SEQ ID NO: 153729 - protein, 109 aa, Glycine max
  Coding DNA Sequence Number=SeqID_62044
MGLRKKWRMKNWRTALHNNFAGLQTRWWRTHEQRLGNKFMGLRKKWRMENWRTALRNNFAGLQTRSVEDTCTAVGNKFIGLRKKWRMENWRTALRNNFAVTPDSKVEDT

SEQ ID NO: 153730 - protein, 56 aa, Glycine max
  Coding DNA Sequence Number=SeqID_62045
MQSSQGKGPITRTMSKRLQEDWARAAEEGPRVLMNLRVGYPRNIGFFSPCIFGHLD

SEQ ID NO: 153731 - protein, 84 aa, Glycine max
  Coding DNA Sequence Number=SeqID_62046
  Subcellular localization annotation: CTP_CleavageSite=30; ConfidenceScore=5.32e-01
MYSLLFSIITTQVDVPSTCTTKDVPSNVLRQSSQAVSPSKLCEGDTKDISGGRRETQKEFRRLVLGEFFLAKGEENEKMNNTSF

SEQ ID NO: 153732 - protein, 91 aa, Glycine max
  Coding DNA Sequence Number=SeqID_62047
  Subcellular localization annotation: CTP_CleavageSite=84; ConfidenceScore=5.26e-01
MVTTAAIQHSLQRMTGILAARLEAQSSRSPIQGLGRTSPGNRLGNAASMTRFADQIDNAKSSWLRSGASIKMTPPISAASSYINATHAERT

SEQ ID NO: 153733 - protein, 202 aa, Glycine max
  Coding DNA Sequence Number=SeqID_62048
  Homolog annotation: Hit_ID=Q84VH6; Match level="QueryCoverage=29%, HitCoverage=3%, E-value=2e-08, Identity=55%"; Hit description=Gag -pol polyprotein
MHSLGDLNLLKIQVIQIVKSLLMSLLYPIENYASKVRREILQQEALGNSKEESIATIGLQRRHSRNLKMKEEELLGKKLERSREDLGLIIKSSGRITMTEFVPAKNSTGATMTTLVSTRIMERSRKRAKERIWRCHYVKKETSGKEVNTRKGQMKSPVTAKEFNAMDVKAMGTSKPNVPLIPRSRGKDFLYVGLMIQRVNKK

SEQ ID NO: 153734 - protein, 88 aa, Glycine max
  Coding DNA Sequence Number=SeqID_62049
MVHLLWISSSGGYIHLVVQREQGRVHPLWIFACKGLYKVEKKSQGPQVAWGLDVGTSCCRTNMQSGFQSKPFDVEMRDSLEDMIHDLG

SEQ ID NO: 153735 - protein, 136 aa, Glycine max
  Coding DNA Sequence Number=SeqID_62050
RIQGTNRLRILCPNTLEGTSFVAQVEGTSTWVVILRTREGTSLVDQFKWWIHPLGYSKRTREGTSLVDLWLVKDFTRLKEISRTIGCLGTECRHGLLPNQYRSNLKSFQDHDEDQANLCLMKKSHENNKEGSVRKK

SEQ ID NO: 153736 - protein, 147 aa, Glycine max
  Coding DNA Sequence Number=SeqID_62051
MEEYAVESFSTLQEISSKQSRKDHQSITDTIRPTKKANVKKAKINKNSAPPPPSPPRVEKNGSKKANMSGDQNIPPPPPPASTSFIQAEFPQGINEFRNKVAKNFNGSVFKGDEGRLQSNVFISINAEGTVEKVVADGKNKLFNDES

SEQ ID NO: 153737 - protein, 112 aa, Glycine max
  Coding DNA Sequence Number=SeqID_62052
MSSPSKDYTSSPSEGYMPSPSEDYISSPSEGCTPSPSEDYTGQQILSLKGLHVLAFRWLHVLDFRGLHVLAFRELHVLAFRGLHALAFRGLHVLAFRGLHICAFGGLKVLCL

SEQ ID NO: 153738 - protein, 82 aa, Glycine max
  Coding DNA Sequence Number=SeqID_62053
MYLEGVKARVVLFGNRDERAKRASHSSLLVNASDEPAKCVCALSLTCPAKCHYASMASKKRKAPSTPTQARFDRSRFTSQEA

SEQ ID NO: 153739 - protein, 116 aa, Glycine max
  Coding DNA Sequence Number=SeqID_62054
MERVTITGKPKCKIFIEANRLKHLGSHRSGPYVPTMVAGNTTIEKPREEWFEEERRLVQYNLKAKNIITSALGMDEYFRVSKLMKTNESIQDMQKRFTHIVNHLASLGRTFQKKIS

SEQ ID NO: 153740 - protein, 266 aa, Glycine max
  Coding DNA Sequence Number=SeqID_62055
  Gene Ontology: Mol. function=voltage-gated chloride channel activity; Cellular component=integral to membrane; Biological process=chloride transport
  Homolog annotation: Hit_ID=A6T4V9; Match level="QueryCoverage=90%, HitCoverage=50%, E-value=1e-105, Identity=81%"; Hit description =H(+)/Cl(-) exchange transporter clcA
  Pfam annotation: Domain name=Voltage_CLC; Domain location=1-235; Score=42.2; E_value=1.1e-13; Accession=PF00654.11; Description =Voltage gated chloride channel
MRPQFRYNLISIKAVFTGVIMSSIVFRILNGEGAIIEVGKLSNAPVNTLWLYLVLGMIFGCFGPLFNTLVLRTQDMFQRLHGGNIKKWVLIGGLIGGLCGLLGLMQPTAVGGGFSLIPIAAAGNFSVGLLLFIFIARVITTLLCFSSGAPGGIFAPMLALGTLLGTAFGMAAIPLFPSYHLDAGTFAIAGMGALLAASVRAPLTGIVLVLEMTDNYQLILPMIITCLGATLLAQFLGAYPGETEGRRGGESAAGTPGEYLNDLPGY

SEQ ID NO: 153741 - protein, 162 aa, Glycine max
  Coding DNA Sequence Number=SeqID_62056
  Homolog annotation: Hit_ID=Q2AA09; Match level="QueryCoverage=96%, HitCoverage=49%, E-value=1e-07, Identity=28%"; Hit description =Retrotransposon gag protein
MERSMIDAASGGALGDITPAEARNLIEKMASNSQQFSARNDAIVIRGVHEVATNSSSSSETKKLEGKLDALVNLVIQLAMNKKSAPIARLCGLCSSADHHTDLCPSGQQSEAIEQPKAYVANIYNRPPQPQQQNQPQQNNYDLSSNRYNPEWRNHPNVGSSR

SEQ ID NO: 153742 - protein, 51 aa, Glycine max
  Coding DNA Sequence Number=SeqID_62057
PYNAQRGHPEGFSVTKHTLRSSLFFSEKRKVDGALVGGMAFVDNWAVGKEK

SEQ ID NO: 153743 - protein, 89 aa, Glycine max
  Coding DNA Sequence Number=SeqID_62058
MAAEWRRKQRERRSHFKEKMSQEEAHHHRRPWIRAWRKKELNEGRGREEHEMLCSKRAMKSEIWFSPLIQDQVQDSPLSVLRCHEACKA

SEQ ID NO: 153744 - protein, 259 aa, Glycine max
  Coding DNA Sequence Number=SeqID_62059
  Homolog annotation: Hit_ID=Q84VH5; Match level="QueryCoverage=100%, HitCoverage=37%, E-value=1e-107, Identity=79%"; Hit description =Envelope-like protein
  Subcellular localization annotation: CTP_CleavageSite=21; ConfidenceScore=5.27e-01
MATAPKETSAPGSSSVPSSPSSTKAPSHQERPEFNIQPIQMIPGSAPVPEKLVPKRQQGVKISENPSPATSPREVDPEMDKKIRSIVSSILKNASVPDADEDVPTSSTPNVSVPDADKDVPTSSTPNAEVPSSSSKEESTEEEDQATEKTPAPRAPEPAPGDLIDLEEVESDEEPFANRLAPGIAERLQSRKGKTPITRSGRIKTMAQKKSTPITSTTSRWSKVAIPSKKRKEISSSDSDYGVELDVPDIKRAKKSGKK

SEQ ID NO: 153745 - protein, 76 aa, Glycine max
  Coding DNA Sequence Number=SeqID_62060
MAAEWRWMRERRRHFKEKMSLEEAHHHRRSWIRAWRKKEMNEGRGREDHEILCSKRALKSEPTNPRSSPRFSTKCA

SEQ ID NO: 153746 - protein, 125 aa, Glycine max
  Coding DNA Sequence Number=SeqID_62061
RDDSRGTPSPGPRESHLTDLSFLGARSAGVCVCREDEEAGRTGAPWSSPPSRRFSGLLTTSRAANRSRRRNPNTSPDHSIGRSDGRLPGPVGQGYRLVEYISVARVRPRTSKGITDLLLPQTSVA

SEQ ID NO: 153747 - protein, 256 aa, Glycine max
  Coding DNA Sequence Number=SeqID_62062
  Pfam annotation: Domain name=Transposase_23; Domain location=143-205; Score=-2.5; E_value=0.0022; Accession=PF03017.5; Description =TNP1ENSPM transposase
MARTKKTEEMTTEAAKEIAEKINSFEEQATQGLFVPHGHQDVQAAAIGCPEHPGRVRAAGAGVTIKQYFGSAPRTSRSASSLSPDELQQLTQQIRDQLEESITEKVTRQVMASFSQLQSQMQSHGPPEPLWLVLVPPILGCGFYIEADPARLVSVGRVYEGSTLVHNTPLLPDQVKVSADEVKDADAPVPIPTDDVSLVGQALHTFLAWPTHLVKSLSHQVAVSPPKPPLKPDPKVDDPLYLMTLTIPELFLRPYQ

SEQ ID NO: 153748 - protein, 99 aa, Glycine max
  Coding DNA Sequence Number=SeqID_62063
MKKQQWKRSRRQRRRGERRHHPLGNKPWKKELHHQDEPWIRSLEGCFNGGKERGREREMGGSTKLKEKKRERSGTLKYVSQDSHSSKLPQVLHMLLFID

SEQ ID NO: 153749 - protein, 85 aa, Glycine max
  Coding DNA Sequence Number=SeqID_62064
  Homolog annotation: Hit_ID=Q8RV60; Match level="QueryCoverage=92%, HitCoverage=8%, E-value=7e-09, Identity=35%"; Hit description =Putative uncharacterized protein At2g05640
MVESERLSYIRNNQKKLRVDKFCSLQQSLDDGSRRCLNKVMWASQIWFITLTCNPNWPKIHRLLNLLNLKAADRPDIISSLQTKV

SEQ ID NO: 153750 - protein, 69 aa, Glycine max
  Coding DNA Sequence Number=SeqID_62065
MSLATLFGKLQEHEMKLLRLRQHEENDKKKKGIALKASSSIQEESDKENDLDDDDDLSLFVKRFNKFLK

SEQ ID NO: 153751 - protein, 122 aa, Glycine max
  Coding DNA Sequence Number=SeqID_62066
MVEREMITMMVDTLPVFYYEKLNRGRVEKREKFDYVSSTSANAKRIGATGAKRKEGDAHAVSSTPAWVKPPQTPHGTHQYAQHHPSFSTHTGNASSSAPVQPKAPTQREAPQVPTPNTTRPA

SEQ ID NO: 153752 - protein, 89 aa, Glycine max
  Coding DNA Sequence Number=SeqID_62067
MVAITLAKVHQPPFLRENDSNATCACHGEAPGRSIEHCRALKRKVQGLIDMGWLKFEENRVIFNFHRKWVLAIGLFAQATCAPEFGLPR

SEQ ID NO: 153753 - protein, 173 aa, Glycine max
  Coding DNA Sequence Number=SeqID_62068
NSIEHVYRWAETTNQAVVVPFVVVLMNPAIVFLWKNKHRKLVTWEINKGKDTTKEDSQVSSKVPTISKDNGDHTLRTTKLEETLAQFMQVTMSNHKSTELALKNIEIQVGQLAKQLAEKSSDRFWANTEKNPKEECKAVVTRSWKLVAAEDEDVVALKEQVALKDTTVKKKNK

SEQ ID NO: 153754 - protein, 93 aa, Glycine max
  Coding DNA Sequence Number=SeqID_62069
  Homolog annotation: Hit_ID=A5AYU6; Match level="QueryCoverage=58%, HitCoverage=9%, E-value=3e-09, Identity=51%"; Hit description =Putative uncharacterized protein
MEKSEKKNINEKKLKKAYITWDENDLESSEDSENEEINLCLMAKSYESDEEEPLWKKWYIDSGCSKHMTRDESKFTHISPKKSGHVTYGDNNK

SEQ ID NO: 153755 - protein, 42 aa, Glycine max
  Coding DNA Sequence Number=SeqID_62070
MATLVVSNSTSPVEDADEAFQKSFEALNGGCNFLYFIIAFNN

SEQ ID NO: 153756 - protein, 53 aa, Glycine max
  Coding DNA Sequence Number=SeqID_62071
MSQEEVHTIGSQNKSLKVGEDESRERERRSTEFCASNEPTNPRSIPRFSTKCA

SEQ ID NO: 153757 - protein, 101 aa, Glycine max
  Coding DNA Sequence Number=SeqID_62072
MALACDFCRETTYGTIRFRIGSKIPLAIYTLGRGSKILGCIRNTRMCTYAIFDSQSALSMHVCKFSKGNACDVGSKYALEVHISDLGNGPEEACLKEVQEG

SEQ ID NO: 153758 - protein, 182 aa, Glycine max
  Coding DNA Sequence Number=SeqID_62073
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MVAILPKENLVVWFYSLHNRPNNYLKGIINSALKGLDDIPQPKSKAGARWIVVKELSGIIKKRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 153759 - protein, 159 aa, Glycine max
  Coding DNA Sequence Number=SeqID_62074
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIAYILCGTSSAYIYLGCYTENKRGYISCGSVQVERTSTWLFKENKG

SEQ ID NO: 153760 - protein, 72 aa, Glycine max
  Coding DNA Sequence Number=SeqID_62075
  Subcellular localization annotation: CTP_CleavageSite=49; ConfidenceScore=5.04e-01
MMGDASKFTHISPKKSAHVTYGDNNKDPSSRLATKCCVWRTIAKPAYWLSEEVKNNTLPNRLIHLKLREIDY

SEQ ID NO: 153761 - protein, 89 aa, Glycine max
  Coding DNA Sequence Number=SeqID_62076
MARTHIPVEAKIDSPQISASPHQLDLAPYASGPYNAQRNSPGLLHDKHTLRSSRFFGEMEVEEPGLGLWLSLNHRVDMGASHHRTPELG

SEQ ID NO: 153762 - protein, 145 aa, Glycine max
  Coding DNA Sequence Number=SeqID_62077
  Homolog annotation: Hit_ID=A5BUY0; Match level="QueryCoverage=66%, HitCoverage=22%, E-value=7e-12, Identity=38%"; Hit description =Putative uncharacterized protein
IHSKKRNRLEHKRLHDLVFVKYNQQLRQRYNARDEINPISLNDIDASRVGEYRMYTRRKKQKTTSVVAAQTSKKHAMVVGSSSRKQKEVQENDEDLDFEENINLESEEEEIMVNFEASDGEEGEGDAPLPYDNNEDDYVGIGEDD

SEQ ID NO: 153763 - protein, 180 aa, Glycine max
  Coding DNA Sequence Number=SeqID_62078
VACAKHCPLGLSVIRCDTHKAKPVLLTKPLYTDNILSRNILPERNVKLYHTEFDEFKVELERHNHNLHKRLANLQDGSTNVALVKEFYANLYTIEDQAPKQAREIEARLCIPYKEFVLNAEGQPWKLLRKDLMTLAQTWSVFSYSNLAPTSHTSDLNMDRARLVYGLVTNMDMNIRALIS

SEQ ID NO: 153764 - protein, 176 aa, Glycine max
  Coding DNA Sequence Number=SeqID_62079
MKRKSTASRPVTQYDTRRFQSLEAWNRYTDNILSWNILLERNVQIYHTEFDEFKVKLERHNLHKRLTNLQDGNIDMVVVKEFYANLYTPEDQAPKQAKVRGHLIKIDADSLHEFLQTLVVLEEGESLPTYSRFCRLRSNPQEIEARLCISRKGFVLNVEGQPWKLLRKDLTILAQT

SEQ ID NO: 153765 - protein, 121 aa, Glycine max
  Coding DNA Sequence Number=SeqID_62080
MPPEELEQLTQQIRDQLEESITKKVTQQLMLSFNQMQSQLQSQIQSHGLARPLEPEVGPSTARVSTKGSCVDPSPTDPETGDSDKCRLYIEDNPSRLVALGRVYEGSTMVHTSLCCMAKSR

SEQ ID NO: 153766 - protein, 116 aa, Glycine max
  Coding DNA Sequence Number=SeqID_62081
MPYANLLPSLISNQMAFKHKVQSLIDVGWLTFQEDSPNVRTNPLASHGGSTVNAVEEWEPQGLKQMGDVITYRRFILEAQCEFGMICLDGDQGDFCLMHSGASHDVETCPMAEELL

SEQ ID NO: 153767 - protein, 89 aa, Glycine max
  Coding DNA Sequence Number=SeqID_62082
  Subcellular localization annotation: CTP_CleavageSite=55; ConfidenceScore=5.76e-01
MGSPPVSTPPPPPSPPPHPTSDASASPSVVKQARKASCLRSLSTRPPGAERPVVHADPATGKADGPHRKKLRTYLGIVARDKVDITYEN

SEQ ID NO: 153768 - protein, 54 aa, Glycine max
  Coding DNA Sequence Number=SeqID_62083
MTNANCPQESLHSVSKENLRQILTSTVVCIAYYILDIQEYGILVWVVKEKSLPL

SEQ ID NO: 153769 - protein, 100 aa, Glycine max
  Coding DNA Sequence Number=SeqID_62084
FTSDSPQISATLHQLDLAPYASGLYNAQWNAPGPLHDKHMFHSRRILEKMKVEEPWLGLWQPLNLSSDVWHSSCGRQVSYPNFVWGPLFDGMQPLLDRFE

SEQ ID NO: 153770 - protein, 45 aa, Glycine max
  Coding DNA Sequence Number=SeqID_62085
  Homolog annotation: Hit_ID=A5BH39; Match level="QueryCoverage=100%, HitCoverage=20%, E-value=1e-08, Identity=50%"; Hit description =Putative uncharacterized protein
MDVKTTFLNGDLEDEVFMKQPEGFSSSNDDILLTAYDPGLLHEVK

SEQ ID NO: 153771 - protein, 90 aa, Glycine max
  Coding DNA Sequence Number=SeqID_62086
MPPKFDHIVVAIEESKNLEELSLKELQGSLESHEKKMMTFEQVLLMVTTQIEGASDNCWYLDTVLKEFGRSLIKTKDGGQSCITDVLFVP

SEQ ID NO: 153772 - protein, 129 aa, Glycine max
  Coding DNA Sequence Number=SeqID_62087
AVESLQRFRYRGLRIRPVGKIEVDIVGIEAAQGVVYRLLDPGFAESLMAGKAEIGADFGEDFDLIAHAGTRLQPAANNGFGFAALVALCPAGINIRRIDSVKAVVNKSIKKGKTGFFINGPAKDVTAKH

SEQ ID NO: 153773 - protein, 212 aa, Glycine max
  Coding DNA Sequence Number=SeqID_62088
  Gene Ontology: Mol. function=transcription factor activity; Cellular component=membrane; Biological process=regulation of transcription, DNA-dependent
  Homolog annotation: Hit_ID=A4WDN0; Match level="QueryCoverage=100%, HitCoverage=68%, E-value=1e-102, Identity=88%"; Hit description =Transcriptional regulator, LysR family precursor
  Pfam annotation: Domain name=HTH_1; Domain location=7-66; Score=61.1; E_value=3.8e-15; Accession=PF00126.18; Description=Bacterial regulatory helix-turn-helix protein, lysR family
MNSIFTEENLLAFTTAARFGSFSKAADELGLTTSAISYTIKRMEAGLDVVLFTRNTRSIELTESGYYLFRKATDLLNDFHAIKRSIDTISQGIEARVRICINQLLYTPRHTARLLQVLKKQFPTCQITVTTEVYNGVWDSIINNQANIAIGAPDTLLDGGGIDYTEIGAIRWVFAIAPDHPLAFMPEPISESQLRLYPNIMVEDTASTINKK

SEQ ID NO: 153774 - protein, 92 aa, Glycine max
  Coding DNA Sequence Number=SeqID_62089
MSQKNNDLGLIHRWIVVKFEHHVRNHIPRILTVWNCKNMEREKGIAPRQYLWRLQSLLCLTDVWELYRSNRSKNWRNLRESLEMPLSLSGDT

SEQ ID NO: 153775 - protein, 118 aa, Glycine max
  Coding DNA Sequence Number=SeqID_62090
MSEIERFGGLGMEERRKEEGAAHGLLENVIFIEQDAWRRQPTGNRLHEYYNRLQAICSSVIDYSIHVYDQEGYHSQIIVASSIKSVHNNCRQKYIALQQWIRQHCFVSYYAMRQERIQ

SEQ ID NO: 153776 - protein, 124 aa, Glycine max
  Coding DNA Sequence Number=SeqID_62091
  Homolog annotation: Hit_ID=Q2A9E0; Match level="QueryCoverage=96%, HitCoverage=8%, E-value=3e-10, Identity=32%"; Hit description =Putative uncharacterized protein
MDNHEHANHRDTAQARIKNKGIRQHKVNDEAQNIDCCVSVSSPENQNYMSSANDPAINREGYSGLGDQLMQCSHCNANMWYDERVSKDKRTTNPRFSLCCGNDKVELPLLQNPPKYLYQLLYDH

SEQ ID NO: 153777 - protein, 185 aa, Glycine max
  Coding DNA Sequence Number=SeqID_62092
MTTLTQIWMTLLLSNIQPSDHNSDLPLPKCQLVYAILTRMSIHVAQLIADAIYLFVGMAPTKHPLDPDKSNRALGFPALITGLCLSFGVPVAPSKVIRPPITRAFIEKYCTQRQAQRDAPQVADSPPPHQAGPAGSFDTEQYLRHLVRQQAANHRAHVQTHDCLYQMSLSLQSQGFTSFPCPTPD

SEQ ID NO: 153778 - protein, 275 aa, Glycine max
  Coding DNA Sequence Number=SeqID_62093
MRGAPTEESLSPFLVRNLGAQSLKVIQRVHKAWRSPLRKDKELRGIRNGVIGGYHGWLRIHTRGLDWLSKLKVIGEEDFEAPEEDEEVRALKLELGKARLAKEKFKSAATHIRKECTELQEENVATARALEQETKRARKEEYGREKFRGALWGSNNELKLRREERDRSRVHDMILKEELVACARSKRSLAQHLEATKQSMLAIIGQYKEELNQSVAHEQKLVEDFAQVYAEKEARGRVIDALHQEATMWMDRFALTLNGSQDLPRLLAKAKAMAE

SEQ ID NO: 153779 - protein, 76 aa, Glycine max
  Coding DNA Sequence Number=SeqID_62094
MAQGLCCYLSLQEMKQATKNFDESNVIGVGGFGKVYKGVIDNGFKVSIKRPDPQSRSCYYTLERIFWDQEFNFHFI

SEQ ID NO: 153780 - protein, 203 aa, Glycine max
  Coding DNA Sequence Number=SeqID_62095
MASRKRKSIGTRPTSQYDTRRFSSLDAWTRYTDNVLGRNILPERKVELYHTELDDFKVELERRNFHRRLTNFANGSIDLALVKEFYANLYSSEDRPPKQSRVRGHLVKIDVDSLNIFLETPVVLAEGETLPAYSRYYRCGVSFYTPCRNVPFCGRAKAKLTGALSKGGKMHGVATNAYLWKMSEKQKKTGRNENSKFGSCIYA

SEQ ID NO: 153781 - protein, 131 aa, Glycine max
  Coding DNA Sequence Number=SeqID_62096
  Gene Ontology: Mol. function=protein serine/threonine kinase activity; Cellular component=integral to membrane; Biological process=protein amino acid phosphorylation
  Homolog annotation: Hit_ID=Q9LKZ6; Match level="QueryCoverage=83%, HitCoverage=14%, E-value=4e-28, Identity=52%"; Hit description =Receptor-like protein kinase 1
MALKKKHSRVMANLTLLSKMSQYAYTLKVDEKSNVYNFGVVLLKLVIGRKLVGELGDGVDIVQWAVERPTMCKVVQILTELPKPPSSKQGDLTIIESSLSLSNSLESPTTASKEPKDQHHPQLPPTDLLSI

SEQ ID NO: 153782 - protein, 47 aa, Glycine max; identical to SEQ ID NO: 140068
  Coding DNA Sequence Number=SeqID_62097

SEQ ID NO: 153783 - protein, 172 aa, Glycine max
  Coding DNA Sequence Number=SeqID_62098
MHHSHTSMLFTTILEVRTVIIVIKRKERALQCPYRTCARARVMGEIEEVQEQMKANMEAMKEKMTTMMEAMMSIKKIMEVNVAVVVATSTIAEVDPTSPFGLNQINHPTSDMVGQGGKELGSTGDPHFVQVQNKQAFPPYGLPPNYTPPNVVHTPDENVNNSTPILIESQQP

SEQ ID NO: 153784 - protein, 37 aa, Glycine max
  Coding DNA Sequence Number=SeqID_62099
MYVPELNSIRGKEVNIDNERLEKGDYSEVKGITTAQV

SEQ ID NO: 153785 - protein, 37 aa, Glycine max
  Coding DNA Sequence Number=SeqID_62100
MKMLLIPHDMNGSGMEKEKREETPLQGEDESRRSSPP

SEQ ID NO: 153786 - protein, 217 aa, Glycine max
  Coding DNA Sequence Number=SeqID_62101
  Homolog annotation: Hit_ID=Q6WAY6; Match level="QueryCoverage=90%, HitCoverage=31%, E-value=3e-22, Identity=37%"; Hit description =Putative uncharacterized protein
MVGVLRKCLEEKARILAGRGKWAPFIDILALLIFGGVLFPNVDGLVDLAAINAFLAFHDYKESPVVAILADLYDTFDRRCEKSSTRIVFCTPALYVWLASHLFRQEVIHACPLESHRSCTEKREASWDRLLASKEGVSVNWFPRWKERRTGVLISCGGFPNVPLIGTRGCISYNLVLVIRQLAYPMRGAPLEEELAPIIARGFNNTNVEALQKVCKA

SEQ ID NO: 153787 - protein, 82 aa, Glycine max
  Coding DNA Sequence Number=SeqID_62102
MQCRPQLNGISFSNIGQQQNQMLALLGKWRWDMLQQSNKLWSKIMHSKYGGWRSLVEGSRRNNESDEFYPPRWHYLEGGMRG

SEQ ID NO: 153788 - protein, 131 aa, Glycine max
  Coding DNA Sequence Number=SeqID_62103
MYCRKTGAYAKDEELLIHFFQEGLTGVAVTWIGYNYRTYAKRGHESFKEYTQRWKDLVAQVAPPMTKREMIIMMVDTFVEAKLHGESKVLAISSKTNQRKTQVNQEQFKSSRYNQEEFKPQEESLESRIKI

SEQ ID NO: 153789 - protein, 190 aa, Glycine max
  Coding DNA Sequence Number=SeqID_62104
  Homolog annotation: Hit_ID=Q84VH5; Match level="QueryCoverage=86%, HitCoverage=32%, E-value=7e-63, Identity=63%"; Hit description =Envelope-like protein
KVFVRGKCVRFSPAVINKYLGRPTEGVVDIAVSEHQTAKEITTKQGKLSVKYAILHRIGTANWVPHQSYFHCCHSQHPNILNNIDSVKKRESPLSLHYKLFEGIHVPDIVSTSGKAATSGAVSKDDLIAELKDTCKVLEATIKANTEKKMELERLIKRLSDNGIDDGEAVEEEEDAAEDTESDDDSDATP

SEQ ID NO: 153790 - protein, 469 aa, Glycine max
  Coding DNA Sequence Number=SeqID_62105
  Gene Ontology: Mol. function=CTP synthase activity; Cellular component=cellular_component; Biological process=pyrimidine nucleotide biosynthetic process
  Homolog annotation: Hit_ID=Q8L6Z9; Match level="QueryCoverage=99%, HitCoverage=83%, E-value=0.0, Identity=80%"; Hit description=CTP synthase-like protein
  Pfam annotation: Domain name=CTP_synth_N; Domain location=1-284; Score=672.9; E_value=2.6e-199; Accession=PF06418.5; Description=CTP synthase N-terminus
  Pfam annotation: Domain name=GATase; Domain location=308-468; Score =32.5; E_value=3.3e-08; Accession=PF00117.19; Description=Glutamine amidotransferase class-I
  Pfam module annotation: Pfam domain module=CTP_synth_N::GATase; Domain location=1-284::308-468
MKYVLISGGVVSGLGKGVTASSIGVVLKACGLRVTSIKIDPYLNIDAGTMSPFEHGEVFVLDDGGEVDLDLGNYERFLDVTLTKDNNITTGKIYQSVLEKERKGDYLGKTVQVVPHITDAIKDWIETVAVIPVDGKEGPADVCVIELGGTVGDIESMPFIEALRQLSFQVGPDNFCLIHVSLIPVLGVVGEQKTKPTQHSVRELRALGLTPHLLTSRSAEPLLESTKEKLSKFCHVPVENILNIHDVPNIWHIPLLLRNQNAHHSILQQLNLLSQATPPDLQQWTEMAETYDNLTESVRIAMVGKYVGLTDSYLSVVKALLHACVARSFKPSIDWIAASDLEDDSEKSTPEAHAAAWKTLKSADCVLVPGGFGDRGVRGMMLAAKYARENSVPYLGICLGMQISVIEFARSVLGWERANSVEFDAQTPNPVVIFMPEGSRTHMGSTMRLGSRRTLLQTSDCITSKLYVM

SEQ ID NO: 153791 - protein, 147 aa, Glycine max
  Coding DNA Sequence Number=SeqID_62106
  Homolog annotation: Hit_ID=O22262; Match level="QueryCoverage=59%, HitCoverage=82%, E-value=1e-12, Identity=44%"; Hit description =Putative uncharacterized protein At2g47480
MSTEKGNADISDNSVQPPSSENNLEKWHFGRALAYRAVYGSNHRKSRGNASKISPSRLSKRRVEIVSGKSYGCSQSYMAAIPSEVTRASHSGAATAAKPWSFGGPESRRRKRIAKYKVYAVEGKVKATLRDGIRWIKHTCSRIVHGY

SEQ ID NO: 153792 - protein, 49 aa, Glycine max
  Coding DNA Sequence Number=SeqID_62107
MTKYSSQVDDKSKYDNIVMELFVVSRVLGKPSRQPPKAPFLYPTVTVCV

SEQ ID NO: 153793 - protein, 302 aa, Glycine max
  Coding DNA Sequence Number=SeqID_62108
  Gene Ontology: Mol. function=oxidoreductase activity; Cellular component=cytoplasm; Biological process=response to red or far red light
  Homolog annotation: Hit_ID=Q4W8C0; Match level="QueryCoverage=93%, HitCoverage=79%, E-value=1e-130, Identity=82%"; Hit description =Gibberellin 2-oxidase
  Pfam annotation: Domain name=2OG-FeII_Oxy; Domain location=171-281; Score=36.3; E_value=1.1e-07; Accession=PF03171.11; Description=2OG -Fe(II) oxygenase superfamily
MVAPCPTSMMVRTKKTKAMGVPTIDLSMERSKLSELVVKACEEYGFFKVVNHSVQKEVIARLEEEGKEFFSKTSSEKRQAGPANPFGYGCRNIGPNGDMGHLEYLLLHTNPLSISERSKTIANDPTKFSCAVNDYIEAVKELTCEVLDMVEEGLWVQDKFSLSKLIRDVHSDSLLRINQYPPVSLKGTKNWDTSKLEAHQLQSQNNNNNNNNIGFGEHSDPQILTIMRSNNVDGLQISTHDGLWIPVPPDPNEFFVMVGDALQGVDEHNKGQNVNDVLCSTTAELVDHSTAEDGDTPQSKSL

SEQ ID NO: 153794 - protein, 57 aa, Glycine max
  Coding DNA Sequence Number=SeqID_62109
MVELEENAVFNISMTCAFYISGHRCLMRCFNNQIWNGIADDVTLLTSLLCAFTTYVT

SEQ ID NO: 153795 - protein, 392 aa, Glycine max
  Coding DNA Sequence Number=SeqID_62110
  Gene Ontology: Mol. function=protein serine/threonine kinase activity; Cellular component=beta-catenin destruction complex; Biological process=protein amino acid phosphorylation
  Homolog annotation: Hit_ID=P51139; Match level="QueryCoverage=100%, HitCoverage=99%, E-value=0.0, Identity=84%"; Hit description =Glycogen synthase kinase-3 homolog MsK-3
  Pfam annotation: Domain name=Pkinase; Domain location=73-340; Score =296.6; E_value=5e-86; Accession=PF00069.16; Description=Protein kinase domain
  Pfam annotation: Domain name=Pkinase_Tyr; Domain location=73-340; Score=12.1; E_value=3.9e-13; Accession=PF07714.8; Description =Protein tyrosine kinase
  Pfam module annotation: Pfam domain module=Pkinase::Pkinase_Tyr; Domain location=73-340::73-340
MASAGVAPASGVRDVNANSVAVERLPDEMNGMKIRDEREMEATVVDGNGTETGHIIVTTIGGKNGQPKQTISYMAERVVGNGSFGVVFQAKCLETGETVAIKKVLQDKRYKNRELQTMRLLDHPNVVTLKHCFFSTTEKDELYLNLVLEYVPETVHRVIRHYNKMNQRMPLIYVKLYFYQICRALAYIHNCIGVSHRDIKPQNLLVNPHTHQLKICDFGSAKVLVKGEPNISYICSRYYRAPELIFGATEYTTAIDIWSAGCVLGELMLGQPLFPGESGVDQLVEIIKIFIIVPLLSFHTSEEIFHKRLPPEAVDLVSRLLQYSPNLRCTALEALVHPFFDELRDPNTRLPNGRYLPPLFNFRANELKGVPPGMLVKLIPSHARKQCALFAS

SEQ ID NO: 153796 - protein, 282 aa, Glycine max
  Coding DNA Sequence Number=SeqID_62111
  Gene Ontology: Mol. function=oxidoreductase activity; Cellular component=extracellular region; Biological process=response to oxidative stress
  Homolog annotation: Hit_ID=A7PRK2; Match level="QueryCoverage=53%, HitCoverage=47%, E-value=6e-51, Identity=67%"; Hit description =Chromosome chr14 scaffold_27, whole genome shotgun sequence
  Pfam annotation: Domain name=peroxidase; Domain location=1-142; Score= 69.2; E_value=1.4e-17; Accession=PF00141.14; Description=Peroxidase
LDRRDGRVSNRDEASQLPRPTINTQQLISNFEQKGLSADEMVTLSGAHSIGVSHCSSFSDRLYSFNATFPQDPSMDTKFATSLKSKCPPRSDNTVELDASSPNRLDNNYYTMLNNHRGLLTSDQTLLTSPSTRPMVLTNAKHGSTWARKFAKAMWNYAPTIRGHSLRLNKQHHEHGIGIRVVRFCVFWHCWFGLPGCHMGALDARRGLPKQIGNLGREPSGGSTRQYWSGRECGSERQSHRSGEEHPPVMDQLLARTAPFVPLDHAFPFLCGHGRFATIGCS

SEQ ID NO: 153797 - protein, 1120 aa, Glycine max
  Coding DNA Sequence Number=SeqID_62112
  Gene Ontology: Mol. function=metal ion binding; Cellular component =nucleus; Biological process=regulation of transcription, DNA -dependent
  Homolog annotation: Hit_ID=A4PU47; Match level="QueryCoverage=67%, HitCoverage=94%, E-value=0.0, Identity=73%"; Hit description=Ankyrin
  Pfam annotation: Domain name=MAP1_LC3; Domain location=1037-1116; Score=83.3; E_value=7.9e-22; Accession=PF02991.7; Description =Microtubule associated protein 1A1B, light chain 3
  Pfam annotation: Domain name=SBP; Domain location=158-236; Score =177.4; E_value=3.7e-50; Accession=PF03110.5; Description=SBP domain
  Pfam module annotation: Pfam domain module=MAP1_LC3::SBP; Domain location=1037-1116::158-236
MEARFGAEAYHFCGVGASSDLRGVGKRSSEWDLNDWRWDGDLFIASRLNPVVPADGVGVGRQFFPTGSGTGILVAGGPSNSSSTSEEVDPRDPKGNKEGDKKRRVIVLEDDGLNEEGGTLSLKLGGHASAVVDREVASWDGTNGKKSRVSGSTSNRAVCQVEDCSADLSKAKDYHRRHKVCEMHSKASRALVGNAMQRFCQQCSRFHLLQEFDEGKRSCRRRLAGHNKRRRKTNHEAVPNGIETCMEEIISFLKFLFHFMLKNLVWVVVENSAMAEQEPPGRSSSWLEESKENDLRSDQTTDQDLLTHILRSLASQNGEQGSKNIANLLREPENLLREDGSSRKSEMMSTLFSNGSQGSPTDTRQHETVSIAKMQQQVMHAHDARAADQQITSSIKPSMSNSPPAYSEARDSTAGQIKMNNFDLNDIYIDSDDGMEDLERLPVSTNLVTSSLDYPWAQQDSHQSSPPQTSGNSDSASAQSPSSFSGEAQSRTDRIVFKLFGKEPNDFPLVLRAQILDWLSHSPTDMESYIRPGCIVLTIYLRQAEALWEELCYDLTSSLNRLLDVSDDTFWRNGWVHIRVQHQMAFIFNGQVVIDTSLPFRSNNYSKILTVSPIAAPASKRAQFSVKGVNLIRPATRMLFEYIYTFVELAWYMTIKPSLRLMCALEGKYLVCEDAHMSMDQSSKEPDELQCVQFSCSVPVMNGRGFIEIEDQGLSSSFFPFIVVEEDVCSEICTLEPLLELSETDPDIEGTGKIKAKNQAMDFIHEMGWLLHRSQLKLRMVQLNSSEDLFPLKRFKWLIEFSMDHDWCAAVRKLLNLLLDGTVNTGDHPSLYLALSEMGLLHKAVRRNSKQLVECLLRYVPENISDKLGPEDKALVDGENQTFLFRPDVVGPAGLTPLHIAAGKDGSEDVLDALTNDPCMVGIEAWKNARDSTGSTPEDYARLRGHYAYIHLVQKKINKRQGAAHVVVEIPSNTTESNTNEKQNELSTTFEIGKAEVIRGQGHCKLCDKRISCRTAVGRSLVYRPAMLSMVAIAAVCVCVALLFKSSPEVIVERYAKCDLPELEKKKLSLPPGKALFVFVKNTLPQTANMMDSVYRSFKDEDGFLYMYYSTEKTFGSYIM

SEQ ID NO: 153798 - protein, 142 aa, Glycine max
  Coding DNA Sequence Number=SeqID_62113
  Gene Ontology: Mol. function=RNA polymerase II transcription factor activity; Cellular component=transcription factor complex; Biological process=transcription initiation
  Homolog annotation: Hit_ID=A2WPH2; Match level="QueryCoverage=78%, HitCoverage=65%, E-value=5e-39, Identity=74%"; Hit description =Putative uncharacterized protein
  Pfam annotation: Domain name=TFIID-18kDa; Domain location=29-125; Score=129.0; E_value=1.3e-35; Accession=PF02269.7; Description =Transcription initiation factor IID, 18kD
  Subcellular localization annotation: CTP_CleavageSite=23; ConfidenceScore=5.25e-01
MSNSSAGTSSKPRTASSQPSETSSKRKRGVFQKELQHMMYGFGDDPNPLPESVALMEDIVVEYVTELVHKAQDIGSQRGKLSVEDFLYLIRKIHYILQDSPKLNRCTELLSMNEELKQARKVFESDEEKLRKVFEVDDSVEG

SEQ ID NO: 153799 - protein, 476 aa, Glycine max
  Coding DNA Sequence Number=SeqID_62114
  Gene Ontology: Mol. function=heat shock protein binding
  Homolog annotation: Hit_ID=A7Q0L2; Match level="QueryCoverage=100%, HitCoverage=88%, E-value=0.0, Identity=67%"; Hit description =Chromosome chr7 scaffold_42, whole genome shotgun sequence
  Pfam annotation: Domain name=DnaJ; Domain location=324-402; Score =6.4; E_value=0.001; Accession=PF00226.22; Description=DnaJ domain
  Pfam annotation: Domain name=TPR_1; Domain location=205-238; Score =22.8; E_value=0.0013; Accession=PF00515.19; Description =Tetratricopeptide repeat
  Pfam annotation: Domain name=TPR_2; Domain location=205-238; Score =20.1; E_value=0.0081; Accession=PF07719.8; Description =Tetratricopeptide repeat
  Pfam module annotation: Pfam domain module=DnaJ::TPR_1::TPR_2; Domain location=324-402::205-238::205-238
LELRARCLLYLRRFKDVADMLQDYIPSLRMANNDDSGSSVSSDSSLSREGVKLLPSSDSDQSFKCFSVSDLNKKVMAGLCKTCNNEGYWRYLVLGKACCHLGLMEDAMVLLQTGKRLATAAFRRESVCWSDDSFSLSNPLFSGDTPTTPPPESEAVTQLLAHIKLLLRRRAAALAAIDAGLHSEAIRHFSKILEGRRGAPQGFLAECYMHRASANRSAGRIADSIADCNRTLALDPTSIQALETRASLFESIRCFPDSLHDLEHLKLLYNTILRDRKLAGPTWKQLRHHNNLRYREIPGKLCALTVKTQELKQRIASGDTGNVDYYSLIGLRRGCGRSELQRAHLLLCLKHKPDKATCFVERCELADELDLDSIKERGKMSALLLYRLLQKGYTNVMGTIMDEEAAEKQRKKVLEAQVLMSNENLEDKKCNVSSPSTANPSVYQGVFCRDIAVVGNLLSQSGFNRSIPVKYEALSC

SEQ ID NO: 153800 - protein, 110 aa, Glycine max
  Coding DNA Sequence Number=SeqID_62115
  Subcellular localization annotation: CTP_CleavageSite=13; ConfidenceScore=5.20e-01
MASEWRPASRAARAAARRRRRSFMWARSWVTASDSRSGARGGVVGVGVSPEKRELEREKLSSDQHTLSRRNAAVARRLPVWRRTIASSIRPRWQHAFPRTKYLLVNRIEN

SEQ ID NO: 153801 - protein, 146 aa, Glycine max
  Coding DNA Sequence Number=SeqID_62116
  Homolog annotation: Hit_ID=A5CB11; Match level="QueryCoverage=36%, HitCoverage=9%, E-value=7e-09, Identity=49%"; Hit description =Putative uncharacterized protein
MQNKQVIRRCDLAIAKWFIDASIPFNAANSAYFQPMIDDLCSMSPRYKAPSMHCCRWDPQLHKNLHASGYWLKPACRFNEEEFEQHMTTTTGLLDVIERYAHRDSPLNLDDDDEEAQGNPMENMNLNESNVDHGVTMGDCFEFFNE

SEQ ID NO: 153802 - protein, 720 aa, Glycine max
  Coding DNA Sequence Number=SeqID_62117
  Gene Ontology: Mol. function=molecular_function; Cellular component =integral to membrane; Biological process=biological_process
  Homolog annotation: Hit_ID=A7Q0M7; Match level="QueryCoverage=99%, HitCoverage=99%, E-value=0.0, Identity=65%"; Hit description =Chromosome chr7 scaffold_42, whole genome shotgun sequence
  Pfam annotation: Domain name=Dor1; Domain location=40-405; Score= -116.3; E_value=0.012; Accession=PF04124.3; Description=Dor1-like family
  Pfam annotation: Domain name=Vps51; Domain location=43-129; Score =106.2; E_value=1e-28; Accession=PF08700.2; Description=Vps51Vps67
  Pfam module annotation: Pfam domain module=Dor1::Vps51; Domain location=40-405::43-129
MVGEEVVPMDDKAKRMRDLLSSFYSPDPSISNNTSKHASLDDINSTSFDPDQYMNILAHKSNLEGLLQRHVEMAAEIKNLDTDLQMLVYENYNKFISATDTIKRMKSNISGMETNMEQLLEKIMSVQSRSDSVNTSLFDKREHIEKLHRTCNLLRKVQFIYDLPDRLSKCIKSEAYADAVRFYIGAMPIFKVVAYGDSSFRDCKQASEEAIAVVVKNLQGKLFSDSESIQVRADAAVLLKQLDFPVNNLKAKLFEKLEQSITDIRLNPEEINNPSGDRSTHEAAIHEFVEAVCAFRVIFPDSEEQLVKVAEDLVTKNFVIAEEYVKTRISPEDLLGVLHSLLQILKKEGAEQCTLDVVLDASTKAVLQGGLNVLLDFRKILDDDSGILVRLRELIIDWVQEGLQEFFRQLEDQFLLFSGRNHSSIQVHGLAEGTQGDKAFAGLVLVLAQLSAFIEQTVIPKVTEAREIAASFSGGSVRGYESGPAFVPGEICRKFRSAGEKFLHLYINMRNQRVSLLLKKRFTTPNWVKHKEPREVHMFVDLFLQELEIIVNEVKQILPQGRRKHHRTDSNGSSASSRSNPLREEKLVRSNTQRARSQLLETHLAKLFKQKVEIFTKVEYTQESVVTTLVKLGLKSFQEFVRLQTFNRSGFQQIQLDIQFVRIPLREIVEDEAAIDFLLDEVIVATAERCLDPIPLEPPILDKLIRAKLAKTEEQNTISS

SEQ ID NO: 153803 - protein, 179 aa, Glycine max
  Coding DNA Sequence Number=SeqID_62118
  Homolog annotation: Hit_ID=Q9LZQ3; Match level="QueryCoverage=88%, HitCoverage=43%, E-value=3e-53, Identity=60%"; Hit description =Putative uncharacterized protein T12C14_70
  Pfam annotation: Domain name=EB_dh; Domain location=1-109; Score= -55.8; E_value=0.04; Accession=PF09459.1; Description=Ethylbenzene dehydrogenase
MTWNVVGSKLYYRLTIFLLSANDSSAQNDWKGAWWHSSFTVHSGFVEDESPYADNGKKGTYFFEFSRPLRTMDHLQQDVQFNIGGSSKMSVAFWYPVDGQPWHGSGHYSIYCDWVPIDISVGNSLSGKSVDAASSSSWNVASAFSVILSVAALCVSVFVSYRVFSPKSVSFTPIENNNL

SEQ ID NO: 153804 - protein, 60 aa, Glycine max
  Coding DNA Sequence Number=SeqID_62119
MDFDELFDLNGVLIQTQVTKRRNMKIMSEKKSIHVTDGEIGREPKKPNTYYQMCDCGGNS

SEQ ID NO: 153805 - protein, 419 aa, Glycine max
  Coding DNA Sequence Number=SeqID_62120
  Gene Ontology: Mol. function=sterol carrier activity; Biological process=metabolic process
  Homolog annotation: Hit_ID=A6TEH6; Match level="QueryCoverage=37%, HitCoverage=100%, E-value=2e-49, Identity=62%"; Hit description =Putative uncharacterized protein yhbT
  Pfam annotation: Domain name=Acetyltransf_1; Domain location=342-418; Score=21.6; E_value=0.003; Accession=PF00583.15; Description =Acetyltransferase (GNAT) family
  Pfam annotation: Domain name=SCP2; Domain location=174-269; Score =51.6; E_value=2.7e-12; Accession=PF02036.8; Description=SCP-2 sterol transfer family
  Pfam module annotation: Pfam domain module=Acetyltransf_1::SCP2; Domain location=342-418::174-269
MHRLPKANTSSGTGVTFNLRVAAGGVLQRGDIGQNQRIGTVLCGDVNGALPAVKAVRMGEGVDRHVQFTPVLMQEARGFCQFLIGKIEASKVAGVGVIFTGRRTPRQRRAPPPISAQAVKAGLPGRNGEFSHRHGAISLIPVEAKADGWPEFLALPVSLTPFAVKKTVLQQLLNWQFRHALAEGELDFLQGRYLGIEIADVNLRWITTLQDGRLTVSRDAEADVWFRGEANDLLLIAARKADPDMLFFQRRLVIEGDTELGLEVKNLMDAIELDAMPTPLRTGLLQLAAFVEAGMTQDAKAAEARAGISCIDSLLKRSFATAAEAELVQQLREDGLLTLGVVATDDEGQVLGYAAFSPVTLQGEDRNWVALAPLAVDASVRSQGIAKQLVYEGLDSLNEFSYSAVVVLGDPQFYNSARL

SEQ ID NO: 153806 - protein, 299 aa, Glycine max
  Coding DNA Sequence Number=SeqID_62121
  Gene Ontology: Mol. function=beta-N-acetylhexosaminidase activity; Cellular component=cell outer membrane; Biological process =carbohydrate metabolic process
  Homolog annotation: Hit_ID=A4W600; Match level="QueryCoverage=97%, HitCoverage=36%, E-value=2e-95, Identity=59%"; Hit description=Beta -N-acetylhexosaminidase precursor
  Pfam annotation: Domain name=Glyco_hydro_20; Domain location=163-299; Score=-77.7; E_value=1.2e-07; Accession=PF00728.13; Description =Glycosyl hydrolase family 20, catalytic domain
  Pfam annotation: Domain name=Glyco_hydro_20b; Domain location=37-161; Score=34.0; E_value=5.3e-07; Accession=PF02838.6; Description =Glycosyl hydrolase family 20, domain 2
  Pfam module annotation: Pfam domain module=Glyco_hydro_20::Glyco _hydro_20b; Domain location=163-299::37-161
MPTMLLPRTLLAVLCSLTFSTQAAPAGDLPLMPWPQQVTQPAGDGAFTLTPQFSLHITGDHLEGAEARWRARIARQTGWALLPASPASDRPAIQIRIADAVDPLPQPDSDESYRLEVSSSGVLLQAPTRFGAMRGMETLLQLIANTASGTQIPFVTTDDRPRFPWRGVLIDPVRHFLPLETLKRQIDGIAAARMNVFHWHLTDDQGWRFASSHYPQLQQQASDGLFYSQQQMRELVHYATQRGVRVVPEIDLPGHASALAVAMPELMSAPGPYAMERGWGVFNPCSIPAMKRCFALLIR

SEQ ID NO: 153807 - protein, 207 aa, Glycine max
  Coding DNA Sequence Number=SeqID_62122
  Gene Ontology: Mol. function=transition metal ion binding; Biological process=tRNA processing
  Homolog annotation: Hit_ID=A4W618; Match level="QueryCoverage=44%, HitCoverage=65%, E-value=6e-26, Identity=61%"; Hit description =Putative uncharacterized protein
  Pfam annotation: Domain name=DUF1260; Domain location=9-115; Score =156.6; E_value=6.9e-44; Accession=PF06877.2; Description=Protein of unknown function (DUF1260)
  Pfam annotation: Domain name=MiaE; Domain location=136-207; Score= -67.6; E_value=2.2e-07; Accession=PF06175.2; Description=tRNA -(MS[2]IO[6]A)-hydroxylase (MiaE)
  Pfam module annotation: Pfam domain module=DUF1260::MiaE; Domain location=9-115::136-207
MAYEALLEEQREETRLIIEELLEDGSDPDALYTIEHHLSCNNFDSLEKAAVDAFKLGYEVTEPEELELEDGSTVMCVDILSESALKPELIDAQVEQLVNLVGKYNVDYDGWGTYFEDPDAEDEDDGEEIDDEDDDDPIHQFLQCRTPQAWIDEARKPENLTLLLTDHMVCELKAAQTAVWLIRKYVADKPSGDAILAWLQPYEDFIF

SEQ ID NO: 153808 - protein, 73 aa, Glycine max
  Coding DNA Sequence Number=SeqID_62123
MSAITLRSGKQCQGPQPATSSSSANEPAQLHSTPEKDDDKNLKKKQHILLPFPLRAIFNKKMERGGEGDLRNI

SEQ ID NO: 153809 - protein, 89 aa, Glycine max
  Coding DNA Sequence Number=SeqID_62124
MVAIIPAKVPQPPFFRGYDSNTMCAHHGGAPGHSIEHCMTLKLTMLKWMNLTSLSLSSFHIHIFDYSTFTGMWVQAIGLFAQVTCALEF

SEQ ID NO: 153810 - protein, 110 aa, Glycine max
  Coding DNA Sequence Number=SeqID_62125
LRGKEIPLVKVVWGSASGEDATWELEGQIGDAYPTLFDTGHKFPLYKPNVNLEQLFGKHILFLSSFLTHKNPNKAIRGGALESTRDATIANREYLSDYIEVRDELLTLRD

SEQ ID NO: 153811 - protein, 122 aa, Glycine max
  Coding DNA Sequence Number=SeqID_62126
  Gene Ontology: Mol. function=nucleic acid binding
  Homolog annotation: Hit_ID=A5C7C5; Match level="QueryCoverage=92%, HitCoverage=15%, E-value=4e-18, Identity=37%"; Hit description =Putative uncharacterized protein
  Pfam annotation: Domain name=zf-CCHC; Domain location=8-25; Score =28.5; E_value=2.5e-05; Accession=PF00098.14; Description=Zinc knuckle
AEDSSSTPKCYECNQPGHLRVDCPIFKKRIEKSEKKVVNEKKEKNAYITWDDNDMDSSEDLENEIVNLSLMAKSYESDEEVSLKKSWYIYSGCSKHMTGDASKFTHISPNKSGHVTYGDNNK

SEQ ID NO: 153812 - protein, 125 aa, Glycine max
  Coding DNA Sequence Number=SeqID_62127
  Homolog annotation: Hit_ID=A5AEB7; Match level="QueryCoverage=97%, HitCoverage=14%, E-value=4e-17, Identity=39%"; Hit description =Putative uncharacterized protein
MKFPSLRLTNVKGVHEYIMQMRDISARLKKLEVDMFESFLEEERLVMGMSESALLITACGKNKTSKSQANKKGNGKIPPQDYIKKGMKNLRKPVRSKQRILSGNKLGSPMEAIETCILTLSSDLF

SEQ ID NO: 153813 - protein, 87 aa, Glycine max
  Coding DNA Sequence Number=SeqID_62128
MVAISLAEVHQPPFLQEYDSNATCACHGEAPGRSIEHCRALKRKIFNFHRKWVQAIGLFAQATCAPDLDFQDRSSEITRLARLVGMP

SEQ ID NO: 153814 - protein, 125 aa, Glycine max
  Coding DNA Sequence Number=SeqID_62129
MASRKRKSTASRPQEPYDTTRFISEGAWEKYAQNVHSWNILPERNVRVRGKLIKFDTESLNMFLDTPVVLEPGECYATYTRFYSTHPDPQELASKLCILGRSFVLNDEGAPWKLLRKDLTTLAQT

SEQ ID NO: 153815 - protein, 127 aa, Glycine max
  Coding DNA Sequence Number=SeqID_62130
MICGSNVDISGRLLVGSFIFECRIMHYILYRVLLPHSTNLAQATEEDLILMWALQTGRQIDWAHLVRNCMHKALRANAPLPYPHLVTLFLKHFKVPFTNEPSIKVKRSFTIGVVVVASFGYKKDLDG

SEQ ID NO: 153816 - protein, 85 aa, Glycine max
  Coding DNA Sequence Number=SeqID_62131
AANHRAHVQTHDSLYQLSLSLQSQGFASFPCPTPDQFRVEVTWPGDWPEAQAREAPAEAPGEADEAREDEEMTDLLDFLGGSRAT

SEQ ID NO: 153817 - protein, 138 aa, Glycine max
  Coding DNA Sequence Number=SeqID_62132
MLCNDHADMIGRLLAGSFTFECRIMHYIICQILLPKSTNLAQVSEEDIILLWALQTCHQIDWAHLVRYRMHKTLRANAPCHIPILLPFFFSISMSLWMMNLLSKLNGLFPLKDMDGQWVRKQDLPPPIPDEHTPSPPP

SEQ ID NO: 153818 - protein, 114 aa, Glycine max
  Coding DNA Sequence Number=SeqID_62133
MLEWFSPLAWWRMKLKQILDIERQRGIPKDHIGNLNANDSQIHIEIYVPDPEFQKAEDLADDNSALEKDLEYYNAQLMEELLHRKRYPYHHPVYGSLTQSEVQHYNLSLSTRSD

SEQ ID NO: 153819 - protein, 151 aa, Glycine max
  Coding DNA Sequence Number=SeqID_62134
MERSMIDAASGGALGDMTPAEARNLIEKMASNSQQFSARNDVIVIRGVHEVATNSSSSGETKKFEGKLDALVNLTLWFMLLCRPHTDLCPSVQQSEAIEQPEAYVVNIYNRPPQPQQQNQPQQNNYDLSSNRYNPESRNHPNLRWLNPSQQ

SEQ ID NO: 153820 - protein, 110 aa, Glycine max
  Coding DNA Sequence Number=SeqID_62135
MTCLSKDNPIRRHSYGCFVGSPMCPESIIKPGKIDCNNINEIREERMQTQFYTGSATTRAYVQYSSNPLEISTIFVKSITKSEPHRDNPSLVFRNPLQQETHNLLTNLIE

SEQ ID NO: 153821 - protein, 175 aa, Glycine max
  Coding DNA Sequence Number=SeqID_62136
  Homolog annotation: Hit_ID=A5AZ30; Match level="QueryCoverage=69%, HitCoverage=70%, E-value=3e-12, Identity=36%"; Hit description =Putative uncharacterized protein
MTRGNPFDLQPFDRLVRHHFVPFEHPEHSVIGESEHFVVDNFEHPDFEHYSFEHSDFEHFENMAQPPPRERTLKEMAAPDFTYESLCIQYHDKDVPYVLKTGLIHLHPKFHGLADEDPHKHLKEFHIVCFTMKPPDVQEDHIFLKAFPHSLEGVAKDWLYYLAPRSIMNWDDLKR

SEQ ID NO: 153822 - protein, 87 aa, Glycine max
  Coding DNA Sequence Number=SeqID_62137
MVIDYMLKIQIQNIFQQLFLNPVFCLVRFFFDIIKIMYTYIHKSDLTRKWALAADQDGVEDTVYEKYGINKEKWAQFCQTRRDPSWE

SEQ ID NO: 153823 - protein, 180 aa, Glycine max
  Coding DNA Sequence Number=SeqID_62138
MTSRDQVWSFCTLVSSRGGGPDDTRRYLTVIRTLLSSRGGGPDDKQRPSLVILHPCIIQRRGPDDTRRYLTVIRTLLSSRGGGPDDKQRPKAAGPMIRGDTLRLFAPFCHPEAAGPMTSRDQVWSFCTLVSSRGGGPDDTRRYLTVIRTLLSSRGGGPDDKQRPSLVILHPCIIQRRRAR

SEQ ID NO: 153824 - protein, 74 aa, Glycine max
  Coding DNA Sequence Number=SeqID_62139
YDKGDDKKLKGQSKNEFKIESRTLQDSRGKFISRIKIQEIKISRIKIQEIKIQDSRIKRKLNQDKYEKVFSKFE

SEQ ID NO: 153825 - protein, 101 aa, Glycine max
  Coding DNA Sequence Number=SeqID_62140
MNLLPSAVHVSSTHESGAPRIHCLALFSNSPILHSYSETHEFHCLALFMCPPPRVWSPANSLPSAVRQFSILTLIRRPMNSLPSAVHVSSTIKSGAPRIHS

SEQ ID NO: 153826 - protein, 113 aa, Glycine max
  Coding DNA Sequence Number=SeqID_62141
MLQNLTDYVIIPFLHSGTLRNFADCALTLPFNFRHVTELHGLCYNAFLLASGMSRNFTNCLMMGAKYLKMVKQKLHATKQRSPDEIRTTSPDIASLIRQQFLLNSILKPLSQS

SEQ ID NO: 153827 - protein, 139 aa, Glycine max
  Coding DNA Sequence Number=SeqID_62142
  Subcellular localization annotation: CTP_CleavageSite=71; ConfidenceScore=5.15e-01
MLCSVASKCWAKLLLDLEQAANSSFKTMPCTRDWSLSSLRSLSSLLLPNKAPWNLSRPCSSLRALLVSRLRALAVAAFSSRNSAHSFWMFVATNLNFSLASLAFPSSVFRAWHSSSSSGASKFSSLIIFNLESQSNPRV

SEQ ID NO: 153828 - protein, 210 aa, Glycine max
  Coding DNA Sequence Number=SeqID_62143
  Gene Ontology: Mol. function=DNA-directed RNA polymerase activity; Cellular component=intrinsic to membrane; Biological process=innate immune response
  Homolog annotation: Hit_ID=Q19PJ3; Match level="QueryCoverage=80%, HitCoverage=10%, E-value=2e-42, Identity=51%"; Hit description=TIR -NBS-LRR type disease resistance protein
  Pfam annotation: Domain name=TIR; Domain location=33-170; Score =165.4; E_value=1.6e-46; Accession=PF01582.11; Description=TIR domain
MSSSSSYDYDLHDDDEMDFLRDRYKEDNINYDVFLSFRGEDTRASFTSHLYTALHNLGIFVFKDDETLPRGNKISPSLRLAIEESRLSVVIFSRNYAESRWCLKELQKIMECHRTTGQVVVPVFYDVDPSEVRHQTGHFGKAFRNLENKLLKGEEEEEELQRWWKTLAEAAGISGLSVVRNCNGQSEILDKIDLLVEHWRETLCDVAGIL

SEQ ID NO: 153829 - protein, 168 aa, Glycine max
  Coding DNA Sequence Number=SeqID_62144
  Subcellular localization annotation: CTP_CleavageSite=34; ConfidenceScore=5.67e-01
PRPRRPAAAVLITGGPLPFSLPPSFSLRPPSSTRCVAVACARCLPPPTHPLGTASIASPSPPWNRRPPPPSAPDAAALLRPAEDRPPPPLCSVRSATGAHMPAGHPALSPSLPNGVHPSATLSLLSLLSSPGPRIDPVAAPFVLEVVVEVPRGAEQGQWHPSLIILNL

SEQ ID NO: 153830 - protein, 122 aa, Glycine max
  Coding DNA Sequence Number=SeqID_62145
MVACRLQRDRGCLMHTWLRVHLEHRGPSWEDSQEGSDYTSSARGVVSYSLTFERLSPIINLAYIRKNYWNPEDVTVSIRGARRARARPAELPSTSAAPTPASTSTALSVLVQTDSQCFEAML

SEQ ID NO: 153831 - protein, 82 aa, Glycine max
  Coding DNA Sequence Number=SeqID_62146
MVAITLAKVHQPPFLREYDSNATCVCHGEAPGRSIEHCRALKRKDLQVQAIGQATCAPEFGLPRPFNQRLLVLHVGGVAVKQ

SEQ ID NO: 153832 - protein, 16 aa, Glycine max
  Coding DNA Sequence Number=SeqID_62147
SGTLKQVAWGLDLGTR

SEQ ID NO: 153833 - protein, 97 aa, Glycine max
  Coding DNA Sequence Number=SeqID_62148
MIMRSQDIYSSQDEATTSPSSSESEEAKGEESSEEFYPHEEGQPLMVKEECKEVSASSKRNNQHKNTEKGVPTNPKRIKVIPDWPTPPSIKGNLGLP

SEQ ID NO: 153834 - protein, 78 aa, Glycine max
  Coding DNA Sequence Number=SeqID_62149
MRSFNGDFPPWRCNGRKRKRGEGRHHPLGNKPWKKEFHHQECALDKKLEDDALMEEKKEREKEREGSTKLKEEKRERS

SEQ ID NO: 153835 - protein, 148 aa, Glycine max
  Coding DNA Sequence Number=SeqID_62150
  Homolog annotation: Hit_ID=A5BGM4; Match level="QueryCoverage=65%, HitCoverage=7%, E-value=2e-10, Identity=32%"; Hit description =Putative uncharacterized protein
MNAYGDKQSDLGIIDKVLRTLTPRFDHIVVAIEQGQNLEEMKIEELQGILEAQEMRLNERNSQRSAEQAMQAQTTKGNNYDGGKNKKERESGRTISGRGQVKAPAILKIITRMKKQIRKMNAKVKGFQEMQMRLNWHKMKILTLIRCY

SEQ ID NO: 153836 - protein, 58 aa, Glycine max
  Coding DNA Sequence Number=SeqID_62151
MASSNGNFPASMPILKGKNYDDWCAQMKKIRSADTAKKAWDTLEKSYAGDSKLKKVKL

SEQ ID NO: 153837 - protein, 78 aa, Glycine max
  Coding DNA Sequence Number=SeqID_62152
MENCTNQSLGLAPKWWVGDAGKKTQFVGLRKRGRDWRIAASSPHAWLLTRGWSMNENAIHGAPKKGREWRIALSNHYA

SEQ ID NO: 153838 - protein, 117 aa, Glycine max
  Coding DNA Sequence Number=SeqID_62153
MIIIKTSKSFASTGRGGEFQLNGVKKGKKDRKQKKAYIAWEDNASTSSNSSSDEVANVCLMAKSIDNSSTIEGIEVNPELGEVLEAFNEIHEEAQRLGVLNKSDLKLHITKFGFNSK

SEQ ID NO: 153839 - protein, 206 aa, Glycine max
  Coding DNA Sequence Number=SeqID_62154
  Homolog annotation: Hit_ID=Q6WAY6; Match level="QueryCoverage=69%, HitCoverage=23%, E-value=8e-15, Identity=33%"; Hit description =Putative uncharacterized protein
MVAAQLAQASQVASSRSNSLLEESSGGPKKFHKLPNDGAKHLTRTKKRCEKNSARIVCCLPALCVWLVSHLFQQDTRHPCPLQSYRSCAGKGRIDWDQHLAGIGGNAINWFPRWKEGKEGVLFSCGDYPNVPLIGTRGCINYNPALAIRQLGYPMRGAPMEGSLSPFLVKDLGTQGLKVIQRTHKAWRSLLRKDKELRGIRNGVIG

SEQ ID NO: 153840 - protein, 80 aa, Glycine max
  Coding DNA Sequence Number=SeqID_62155
MMTKVMTKSSNINQRTTQNNSRVQDKNQEEFKTQEEILESRIKIQGSRPQESRSRFKTQNSRIKRRLNQDKYENFFSKIE

SEQ ID NO: 153841 - protein, 174 aa, Glycine max
  Coding DNA Sequence Number=SeqID_62156
  Homolog annotation: Hit_ID=Q0ZCD6; Match level="QueryCoverage=95%, HitCoverage=21%, E-value=9e-07, Identity=25%"; Hit description =Integrase
KNNYDLSSNSYNPCWRNHPNLRWTSPPQQQQSVPHFQNDADPSKPYVPLPIQQHQSQQRQQATEAPPQPSLEELVRQMTIQNMQFQQETRASIQSLTNQMGQMATQLNQAQSQNSDKLPSQTVQNLKNVSAITLRSGNQIQVPPPVAAPTPEPIKLHSTPEKEDEIVALKRNLP

SEQ ID NO: 153842 - protein, 102 aa, Glycine max
  Coding DNA Sequence Number=SeqID_62157
MAVQLIHDHVVMECLEGVWETLEGNERCRFRDTIRLTANLLVHPEEPARTLQQPVECESLFQDSLKTKPCLKTKCFQDMQGSGNRLPGSVIDYQKTGLRNSC

SEQ ID NO: 153843 - protein, 63 aa, Glycine max
  Coding DNA Sequence Number=SeqID_62158
MWERAIGQFAQVTYAPEFGTSKTVQSEITRLARWWGCRKTKRSELSRIGCWTNGLSYLKKKGG

SEQ ID NO: 153844 - protein, 99 aa, Glycine max
  Coding DNA Sequence Number=SeqID_62159
  Homolog annotation: Hit_ID=A5BEV8; Match level="QueryCoverage=86%, HitCoverage=13%, E-value=8e-08, Identity=34%"; Hit description =Putative uncharacterized protein
MVKPRNILLALKDHNVNSCTTIKQIYNARSAYRSSIRGSDTKMQHLMKLLERDQYIHWHRLKDEDVIVPTKQTGMTFSAGFAYLEGEHVSHRQECQGKM

SEQ ID NO: 153845 - protein, 139 aa, Glycine max
  Coding DNA Sequence Number=SeqID_62160
MSRFTRDSPQISAIPFQLDLAPYTSEPYNAQWNAPGLLRDKHTLRSSRILGEMEVDEPRLGLSRCKIHFLVGVLVYAKGGVCHWKCSRNGSHSTGFSFILTLFICRSFLIRPSRMTKFASFQTHIDPFTGKDQIRKALK

SEQ ID NO: 153846 - protein, 77 aa, Glycine max
  Coding DNA Sequence Number=SeqID_62161
  Subcellular localization annotation: CTP_CleavageSite=34; ConfidenceScore=5.24e-01
MEGANTFLKRKYNSRTWKYSFMTGFLRFFRRFPQINVGGDSAHLSSFGKRTCEPRLARPQKGRLRQLATPLGTVFVS

SEQ ID NO: 153847 - protein, 96 aa, Glycine max
  Coding DNA Sequence Number=SeqID_62162
MAAAECMTRGNPSDLQPFDPEIDRTFHRLVTHHLVPFEHPEHSVIGDFEHYSFEHSDFEHSENMAHPPPHERTLRELAAPDFTYESLCIQYLVEDF

SEQ ID NO: 153848 - protein, 85 aa, Glycine max
  Coding DNA Sequence Number=SeqID_62163
MYPPRELIHKRCTLSCTTKDVSSNVLRQRILKREREESKEFLDCVLLNSLEKGEGRHKRIQAVSPSFFWKREKRDTKRIQAISPC

SEQ ID NO: 153849 - protein, 94 aa, Glycine max
  Coding DNA Sequence Number=SeqID_62164
MFSQHLIFLFVEKKEGNEQQFEERLRKKLALEEGRIFAANEQGLDDAPQPKSKAPARWIVVKCNRQNGTTECGYYVMHWMSTIILGSFRNNWEA

SEQ ID NO: 153850 - protein, 127 aa, Glycine max
  Coding DNA Sequence Number=SeqID_62165
MYKDNWTQPWPMGSEIYPKVHENPRAFFSSSSPIFLEPLAHGSIDWSLPREDCINMLIIINQYKDKVNLAASHGQMLEDEQAKVLALHIEREAKERVIELLHGEAMKWMNRFDLTLNESQELPRVVI

SEQ ID NO: 153851 - protein, 166 aa, Glycine max
  Coding DNA Sequence Number=SeqID_62166
  Gene Ontology: Mol. function=protein binding; Cellular component =mitochondrion; Biological process=defense response to fungus
  Homolog annotation: Hit_ID=Q949G8; Match level="QueryCoverage=98%, HitCoverage=15%, E-value=1e-38, Identity=52%"; Hit description =HcrVf2 protein
  Pfam annotation: Domain name=LRRNT_2; Domain location=5-45; Score =51.1; E_value=3.9e-12; Accession=PF08263.3; Description=Leucine rich repeat N-terminal domain
  Pfam annotation: Domain name=LRR_1; Domain location=119-141; Score =5.8; E_value=26; Accession=PF00560.24; Description=Leucine Rich Repeat
  Pfam annotation: Domain name=LRR_1; Domain location=143-162; Score =2.8; E_value=92; Accession=PF00560.24; Description=Leucine Rich Repeat
  Pfam annotation: Domain name=LRR_1; Domain location=94-117; Score =9.3; E_value=5.9; Accession=PF00560.24; Description=Leucine Rich Repeat
  Pfam module annotation: Pfam domain module=LRRNT_2::LRR_1::LRR_1::LRR_ 1; Domain location=5-45::119-141::143-162::94-117
ESVCIPSERETLLKFKNNLNDPSNRLWSWNHNHTNCCHWYGVLCHNVTSHLLQLHLNSSPSTAFYRYYDGYDWEGYRGFQFGGEISPCLADLKHLNYLDLSANDFEGMAIPSFLGTMTSLTHLDLSYTGFIWKIPFQIGNLSNLVYLDLGSDFLEPLFAENLEWVS

SEQ ID NO: 153852 - protein, 40 aa, Glycine max
  Coding DNA Sequence Number=SeqID_62167
MTYCNRLQVLVIDYRPNKPSGCLFMCNRLHWMVIDYQSLS

SEQ ID NO: 153853 - protein, 107 aa, Glycine max
  Coding DNA Sequence Number=SeqID_62168
MDAPGLEHYNFEHSDSEHSDFEHSENMAQPPPRERTLREMAAPDFTYESLCIQYPDEDVPYVLKTGLIHLLPKFHGLAGINETLGLIRILVVDLKRANKAALTLVNF

SEQ ID NO: 153854 - protein, 109 aa, Glycine max
  Coding DNA Sequence Number=SeqID_62169
MTRGNPSDLQLFDPEIDRTFHRLVRHHLVPFEHPEHSDIGDFEHYNFEHSDFVHSENMAQPPPRERTLGEMAAPDFTYESLCIQYPDEDVPYVLKTGMIHLLRKFHGLA

SEQ ID NO: 153855 - protein, 56 aa, Glycine max
  Coding DNA Sequence Number=SeqID_62170
MTRVMSKMMATATKSISLKPLGRDGTARRHLVEEILIVVPRYAVKPLATEKLCSLS

SEQ ID NO: 153856 - protein, 74 aa, Glycine max
  Coding DNA Sequence Number=SeqID_62171
ARLTSALSKGGKMRGVATNIYLWKTSGKSKETGQNENSKFGSCIYVDKSGAFAPTYPPSKRKSDIRSSSLCVNQ

SEQ ID NO: 153857 - protein, 66 aa, Glycine max
  Coding DNA Sequence Number=SeqID_62172
MKFMNDWLLASRRLLGINVEAKLHGESKVIQRDDDKGGDKKLKDQSRKIQEFKIRIKKNSRLKKKI

SEQ ID NO: 153858 - protein, 170 aa, Glycine max
  Coding DNA Sequence Number=SeqID_62173
LQGKVAEEPQLFVVSGVVAIVVVAAGLVEERMVCLGQQYSENKVGMIPPPRIEPVAGEVIIVLLWLILLRRLRRSIEDVLPHKLQAVQLLQIAAHKGKGLCGGSAEEHKPQSLATDEFVATSCTPLMTIASLLALNCWEFEVIFSIKFLASAGVMSLRAPPLAASIILLS

SEQ ID NO: 153859 - protein, 24 aa, Glycine max
  Coding DNA Sequence Number=SeqID_62174
MKKECPKYATWRVKKGLPMESTAK

SEQ ID NO: 153860 - protein, 149 aa, Glycine max
  Coding DNA Sequence Number=SeqID_62175
MYPPLFSLKPSTRTDPQEMYPLLFLVKPKEREESKEFSDCVVLNSLTRKKEDTKEFRRLVLCSFGKGRRETQKEFRRLVLGEFFLAKGEENEKMNSTSFQGLENQKTSESFWYKEEEEVQRESRLVKGCKKLIGKVFKILEMQNKALLL

SEQ ID NO: 153861 - protein, 51 aa, Glycine max
  Coding DNA Sequence Number=SeqID_62176
MKKLKLLDRQIMARSSPRIKRKLFAFPLLILIRVGLDDRKEPEGASFVYAD

SEQ ID NO: 153862 - protein, 162 aa, Glycine max
  Coding DNA Sequence Number=SeqID_62177
SEETIKKIKVKVKGVNSLPRELRIIVNFDDQGQAIGEAQALLAGFLGTLAADCKLFPMDYDRWSGPSGVPKAYFDDCFETILKPQFYFKINEAGAKRYCKLSMGRKWAANRQSLWNEFNDPTKTRDEIIKNVPIGIDKDQWARFVHDRHKPSTLVQLDCFNY

SEQ ID NO: 153863 - protein, 32 aa, Glycine max
  Coding DNA Sequence Number=SeqID_62178
TCKRNLQDSGTLKRVAWGLDVGAGSGRISINQ

SEQ ID NO: 153864 - protein, 278 aa, Glycine max
  Coding DNA Sequence Number=SeqID_62179
MMLGRVLHRRHVDHEAVAHIVLRHAFPGFVDVLDVDHLHIADDAVLGTEVHHFLGLGHAADRRAGQVLAAEDHAATGQRRVQFGQYADQAHGRLALEQAHVRVGVMADRDGVEQEVEAAGVRLHLRGIARDQYLIGAQALGIGTLFRGGGDHHHVRAQCLGELHAHVAEATQTDHANLLARADLPVAQRRPGGDAGAQQRGGRLQVEGVGYLHHEALLDHHVVGIAAVGRCAAFAFTAVVGPGRAFGAVLLQVVLAGVAVAARVDHAVHAGVVADLEA

SEQ ID NO: 153865 - protein, 64 aa, Glycine max
  Coding DNA Sequence Number=SeqID_62180
  Gene Ontology: Mol. function=structural constituent of ribosome; Cellular component=ribonucleoprotein complex; Biological process =translation
  Homolog annotation: Hit_ID=Q2PMT2; Match level="QueryCoverage=56%, HitCoverage=15%, E-value=9e-12, Identity=97%"; Hit description =Chloroplast 30S ribosomal protein S2
MARSFIKGQSSVEEKEFILATVLENGILKMSPYISAKRKGIHITNLIRTARVLSEACDLVFDAA

SEQ ID NO: 153866 - protein, 51 aa, Glycine max
  Coding DNA Sequence Number=SeqID_62181
MFVGIAGLGRFLDGHWIESQPGGQTQKEVEDFLVWLWKSQSGSFAYTSSSP

SEQ ID NO: 153867 - protein, 47 aa, Glycine max
  Coding DNA Sequence Number=SeqID_62182
PYNAQRNAPGLLRDKHTLRSSRILGEMEVDEPWVMFVIGSAVDRLCG

SEQ ID NO: 153868 - protein, 76 aa, Glycine max
  Coding DNA Sequence Number=SeqID_62183
MEVSQQALLRVCEARLTCALSKGGKMRGVATNVYLWKTSAKPKETDQNENSKFRSCRQKRGSCSYVPSIEEEIRPT

SEQ ID NO: 153869 - protein, 110 aa, Glycine max
  Coding DNA Sequence Number=SeqID_62184
WMYPPLELIHREMYPTLVLSQTQVDVPSTCTTKDVPSNVLRQRSQAVKPLILCEWGYKRILRREKGDTKEFRRLVLRSFGKGRRETQKEFRKLQKAFGTKKKKKFKEIEG

SEQ ID NO: 153870 - protein, 226 aa, Glycine max
  Coding DNA Sequence Number=SeqID_62185
  Gene Ontology: Mol. function=transcription activator activity; Cellular component=cytoplasm; Biological process=regulation of transcription, DNA-dependent
  Homolog annotation: Hit_ID=Q57P35; Match level="QueryCoverage=97%, HitCoverage=66%, E-value=1e-61, Identity=54%"; Hit description =Putative transcriptional regulators, LysR family
  Pfam annotation: Domain name=HTH_1; Domain location=11-70; Score =64.5; E_value=3.6e-16; Accession=PF00126.18; Description=Bacterial regulatory helix-turn-helix protein, lysR family
  Subcellular localization annotation: CTP_CleavageSite=58; ConfidenceScore=5.03e-01
MTSRFSQRIRLRHLHAFVATAQQGTLVRAAQQLGLTQPALSKTLNELESLAGERLFSRSRQGAELTAAGTRFLQDASRVLDALNVLGRTLASDSEALPAPLHIGALPTTLVSLVAPVVVGLQQQSPGWRMQVTTLANDALMMAVRSGQLTLGIGRMSDPSRMEGLNFELLYHETLRLVVAPHHPLLHSDVSLAEALSWPLVLSPRGTVPRQNAEALIVSHGLAVPE

SEQ ID NO: 153871 - protein, 91 aa, Glycine max
  Coding DNA Sequence Number=SeqID_62186
  Gene Ontology: Mol. function=hydrogen ion transmembrane transporter activity; Cellular component=proton-transporting two-sector ATPase complex; Biological process=plasma membrane ATP synthesis coupled proton transport
  Homolog annotation: Hit_ID=A7Y7P3; Match level="QueryCoverage=71%, HitCoverage=31%, E-value=6e-27, Identity=93%"; Hit description =Putative ATP synthase CFi alpha subunit
  Pfam annotation: Domain name=ATP-synt_ab_C; Domain location=1-84; Score=67.3; E_value=5.2e-17; Accession=PF00306.18; Description=ATP synthase alphabeta chain, C terminal domain
QFAELEAFAQFVSDLDKATQNQLARGQRLRELLKQSQSAPLTVEEQIITIYTGTNGYLDSLEIGQTFTGEAEVLLKEAIQEQMELFLLQEQ

SEQ ID NO: 153872 - protein, 43 aa, Glycine max
  Coding DNA Sequence Number=SeqID_62187
MKVEGIGSMKMKLHDALKRNHDSKVRKKMKFFNVMEVLGDTSV

SEQ ID NO: 153873 - protein, 78 aa, Glycine max
  Coding DNA Sequence Number=SeqID_62188
MRSFNGDFPPWRYSGRQRRRGEGRHHPLGNKPLKKELHHQECALDKKLEDDALMEEKKEREKERGGSTKLKEEKRKRS

SEQ ID NO: 153874 - protein, 107 aa, Glycine max
  Coding DNA Sequence Number=SeqID_62189
MMITKDDDKGNDKKLKDQSKNNSSESKINQRTTQVNQEEFKTQEESYESRIKIQGSRSQKSRSRFKTQDSRIKRRLNQDKYEKVFLKNSIAHGFSQKHVYQRVFTLW

SEQ ID NO: 153875 - protein, 160 aa, Glycine max
  Coding DNA Sequence Number=SeqID_62190
MAVVNAVESDRPRRSKPLRDVATLGGLSLRPYKRERMIDQGRLEVDSEGREEQHICMQSTDGSVVVKPKPLVIYFTKGKASQKPGHPLAAKPVPFPYQNSHAVPWRYTPPRGKEEEVTDVSSLSAKVTNITGPSGVTRSGRVFAPPDLPVQPANVKGKAK

SEQ ID NO: 153876 - protein, 162 aa, Glycine max
  Coding DNA Sequence Number=SeqID_62191
  Homolog annotation: Hit_ID=UPI00006A2D9E; Match level="QueryCoverage =92%, HitCoverage=86%, E-value=1e-08, Identity=17%"; Hit description =UPI00006A2D9E related cluster
MSKSCGFGMTGPLDESISCFLIRVDPWVLVPIAFRGLHILAFRGLHVLTLRGLHVLAFRGLHVLTNRGLHALTLRGLHVLTFVGLHALTFRGLHVLANRGLHALTFRGLHILANRGLHALTLRGLHALTSRGLYILALRGLHALTFRGLRVLIFSVLHIRTL

SEQ ID NO: 153877 - protein, 149 aa, Glycine max
  Coding DNA Sequence Number=SeqID_62192
  Homolog annotation: Hit_ID=A5ZQM3; Match level="QueryCoverage=58%, HitCoverage=96%, E-value=3e-21, Identity=57%"; Hit description =Putative uncharacterized protein
  Subcellular localization annotation: CTP_CleavageSite=36; ConfidenceScore=5.01e-01
ASQKVTEACKGFLGPDGDWPSSAKAEGSLTARPTRRAGTKVGLSDPTADLPQELTSTGRFGTSMSALRHLGAVVCSKGWAVRPLKRYVSWVQNVVRQFGPYPDREGRTSGVPVIVPTVNAGASGSTAETAMGSLPQRGWSERSFENSRE

SEQ ID NO: 153878 - protein, 146 aa, Glycine max
  Coding DNA Sequence Number=SeqID_62193
  Subcellular localization annotation: CTP_CleavageSite=31; ConfidenceScore=5.20e-01
MAEPSKKRKGSSSRSQQHSKAQDIPIPSSISSSSLFSSEEQRIRYTNLFSSHSITDPKFIDMDFFSDESFECIQAFQNSNLIPFMSLKLPVYSELEKAFCRNLPFGGRATRGFTGASSMGGRCAESPPTFIRGKRQKNWKAMVYEL

SEQ ID NO: 153879 - protein, 234 aa, Glycine max
  Coding DNA Sequence Number=SeqID_62194
MWLKGVKTPVVLSRNRDERAKRACALSLFIATVKILDFQMNALSRPCRTKRMASKKRKAPSTPTQARFDRSRFTSQEARERYTDIVVPRKLLPERNVVVYYTEFDEFKEELERRHWDEKMTDFSDSSIYIAIVKEFYANLYDPEDKSPKQTPVVLEEGENLCTYSKFALLRPDPQKLATKLFIPGRGFKLNADGQPLKILMKNMTILAQTWSVLSFSNLIPTSHTSDVTLDRAK

SEQ ID NO: 153880 - protein, 67 aa, Glycine max
  Coding DNA Sequence Number=SeqID_62195
MVFLTRHEESIKRVHLLGLLTKNKRGYISCGSVLVEGTSTKFKENKGGYIPCGSLLVKEFYKVEKKS

SEQ ID NO: 153881 - protein, 88 aa, Glycine max
  Coding DNA Sequence Number=SeqID_62196
MWEEVVEKFLKKYFPESKTAEGKAAISSFHQFPNESLSEAWERFWGCTICGGAHESSNCIPLEEQTQEVSYMGNQQRQGYNQGGFSGF

SEQ ID NO: 153882 - protein, 275 aa, Glycine max
  Coding DNA Sequence Number=SeqID_62197
  Homolog annotation: Hit_ID=Q84VH5; Match level="QueryCoverage=100%, HitCoverage=43%, E-value=1e-101, Identity=67%"; Hit description =Envelope-like protein
MDKKIRSIVSNILKNASVPDADEDVPTSSTPNASVPDVEKDVPTSSAPNAEVLSSSSKERSIEEDDQAAEETPAPRAPEPAPERLQSRKGKTPIKRSGRIKTMAQKKSTPITPTTSRRSKVAIPSKKRKEISSSDSDDDVELDVPDIKRTKTSGKKVPGNVPDAPLDNISFHSIGNAERWKFVYQRRLALERELGRAALDCKEIMDLITAAGPLKTVTKLGDCHESLVREFIVNIPSDITNRKSDEYQRVFVRGKCVRFSPAVINKYLGRPTDGV

SEQ ID NO: 153883 - protein, 156 aa, Glycine max
  Coding DNA Sequence Number=SeqID_62198
  Homolog annotation: Hit_ID=P55737; Match level="QueryCoverage=52%, HitCoverage=11%, E-value=2e-08, Identity=41%"; Hit description=Heat shock protein 81-2
VEDVDEEKEKEEKKKKKIKEVSHECSLVNKHKPIWMRKPEEMTKEEYSAIMNSSSISLIRSMTKEEYSAKIHLLFTEISSLPTFFLMPAGRQEYLILDGKFMRNRQRIIENTDPEYVIRGALLAESDVHGLGVVLFELLTGKRPTFRVRGRWRHPY

SEQ ID NO: 153884 - protein, 83 aa, Glycine max
  Coding DNA Sequence Number=SeqID_62199
MSGFTRNSPQISASPYQLDFTLYASGSYNAQWNAPGLLHDKHTLHSSRILRKVEVDEPWLGLWLPLNYQVVFVIGSAVDRLCG

SEQ ID NO: 153885 - protein, 60 aa, Glycine max
  Coding DNA Sequence Number=SeqID_62200
MVAITPAKVHQPPFFRGYGSHTTCAYHGGAPGHSIEHCRALKRKDLQVYAVIVNHRYNAE

SEQ ID NO: 153886 - protein, 60 aa, Glycine max
  Coding DNA Sequence Number=SeqID_62201
  Gene Ontology: Mol. function=glutamate synthase (NADPH) activity; Cellular component=chloroplast; Biological process=nitrogen compound metabolic process
  Homolog annotation: Hit_ID=P09831; Match level="QueryCoverage=100%, HitCoverage=3%, E-value=4e-30, Identity=98%"; Hit description =Glutamate synthase [NADPH] large chain precursor
  Pfam annotation: Domain name=GATase_2; Domain location=1-60; Score= -87.4; E_value=0.058; Accession=PF00310.12; Description=Glutamine amidotransferases class-II
MDIVRAMRLLVPPAWQNNPDMDPELRAFFDFNSMHMEPWDGPAGIVMSDGRFAACNLDRN

SEQ ID NO: 153887 - protein, 179 aa, Glycine max
  Coding DNA Sequence Number=SeqID_62202
  Gene Ontology: Mol. function=iron-sulfur cluster binding; Cellular component=phosphopyruvate hydratase complex; Biological process =metabolic process
  Homolog annotation: Hit_ID=A8GJZ7; Match level="QueryCoverage=100%, HitCoverage=57%, E-value=1e-82, Identity=83%"; Hit description =Conserved hypothetical radical SAM protein
MQLPQLVNMFGADLQRRHGEKIHKLTLHGGFSCPNRDGTLGRGGCTFCNVASFADEAMQRQSIAEQLAQQAARVDRARRYLAYFQAYTSTYAEVELLASMYRQALAQSDMVGLCVGTRPDCVPSAALDLLTGYREEGYEVWLELGLQTAHDKTLKRINRGHDFRCYQQTAQRARQRGLK

SEQ ID NO: 153888 - protein, 80 aa, Glycine max
  Coding DNA Sequence Number=SeqID_62203
  Homolog annotation: Hit_ID=Q8LK27; Match level="QueryCoverage=77%, HitCoverage=5%, E-value=8e-08, Identity=46%"; Hit description =Putative AP endonuclease/reverse transcriptase
MDSFYGHFKGQRGLRQGDPLSPYLFVLCLEYFSRNMSSLKDDANFKFHSNCADVMPLCSLAFQDYWPDLGMEQEVFILCR

SEQ ID NO: 153889 - protein, 51 aa, Glycine max
  Coding DNA Sequence Number=SeqID_62204
MTLRQHGLSLGSSSSMDSFASWKINGSGMEKEEREETPLQGEDESRRSSPP

SEQ ID NO: 153890 - protein, 98 aa, Glycine max
  Coding DNA Sequence Number=SeqID_62205
MSGFACDSPQISASSHQLDLAPYASESYNAQWNAPGLLRDKHTLRSSRILREMEFDEPWLGLWLPLNYHLAIPKACRQMETSSGASSAFLGTKSSFVG

SEQ ID NO: 153891 - protein, 200 aa, Glycine max
  Coding DNA Sequence Number=SeqID_62206
SEDRPPKQSRVRGHLVKIDADSLNTFLEIPVVLAEGETLPAYSRYCRKDLTTLAQVWSVLSYSNLSPTSHTSDLIADRARLIFGLVSRLDMNIGALISGQMTSIAQSNTSRLGFPALITALYRARGVVSDSLTFERLSLVINLAYIRKNYWNPDDLTVSIRGARRARARPAELPSTSAASTPASTSVSPFCPNSDKFSAL

SEQ ID NO: 153892 - protein, 418 aa, Glycine max
  Coding DNA Sequence Number=SeqID_62207
  Homolog annotation: Hit_ID=A0GQM3; Match level="QueryCoverage=54%, HitCoverage=57%, E-value=6e-35, Identity=38%"; Hit description =Putative uncharacterized protein
  Subcellular localization annotation: CTP_CleavageSite=33; ConfidenceScore=5.12e-01
MLTKCASSRVRKLVAKIIRFGSNTNSVSQPTISATMAFCRRLRIRFIRQHHLPVWHPADRHFLVQRVVKIRIVLIKELADGEQLAVLQFDGGFQRHAFVVAFAHIADQVFVAAVVIDLLDAQIFRSQQHMQPIAGFDRERAVNITLAAFDASPYLRRLRAADHFCIKHVDFANEARHKQVRGLFVDLARRAVLLDAPVAHYHDAIGHGQRFFLIVRDKHKRDAQLALQCFQLVLHLAAQFVIQRGERLIKQQHFGPVDHCARNRHALLLATGELVRPARGKAFQLHHRQRLVDALRQLCRRGFLHAQAKRDVFKHRHVRKQGVALKHGIDMAMLGGRFSDVALIQMDTSAVGVFQPGDQAQNRGLTAAGGAKQGDKFAMTDGQVEIRDDGFAIESFTDARKRNQRLLRACLRHFSHSV

SEQ ID NO: 153893 - protein, 348 aa, Glycine max
  Coding DNA Sequence Number=SeqID_62208
  Gene Ontology: Mol. function=NAD-dependent histone deacetylase activity; Cellular component=chromatin silencing complex; Biological process=regulation of transcription, DNA-dependent
  Homolog annotation: Hit_ID=P75960; Match level="QueryCoverage=73%, HitCoverage=91%, E-value=1e-113, Identity=78%"; Hit description=NAD -dependent deacetylase
  Pfam annotation: Domain name=Glyco_transf_28; Domain location=210 -333; Score=-13.7; E_value=0.044; Accession=PF03033.11; Description =Glycosyltransferase family 28 N-terminal domain
  Pfam annotation: Domain name=SIR2; Domain location=50-223; Score =278.2; E_value=1.7e-80; Accession=PF02146.8; Description=Sir2 family
  Pfam module annotation: Pfam domain module=Glyco_transf_28::SIR2; Domain location=210-333::50-223
MRQPRRRLRLARYKKNRRKVHQRFRQRIFERDRQVELAAHPQPHVVVLTGAGISAESGIRTFRAEDGLWEEHRVEDVATPEGFRRDPALVQGFYNARRRQLQQPEIQPNAAHKALAELEQVLGDNFLLVTQNIDNLHERAGSQRVLHMHGELLKVRCEHSGQVLAWTEDVGPDDRCTCCQFPSRLRPHVVWFGEMPLGMEEIYQALEQADLFIAIGTSGHVYPAAGFVHEAKLQGAHTVELNLAPSQVGNEFAEAHYGLASEVVPEFVHTFLRGLLNPARMNPLPMPNPARMNPLPLGEGRVRARPHRIPTSEPHRPAFSFWNSVSYCTLAAPTSFCHSPFLITSAGG

SEQ ID NO: 153894 - protein, 399 aa, Glycine max
  Coding DNA Sequence Number=SeqID_62209
  Gene Ontology: Mol. function=G-protein coupled receptor activity; Cellular component=1-2nm peptidoglycan-based cell wall; Biological process=transport
  Homolog annotation: Hit_ID=A7MFT8; Match level="QueryCoverage=100%, HitCoverage=100%, E-value=1e-170, Identity=77%"; Hit description =Putative uncharacterized protein
  Pfam annotation: Domain name=FtsX; Domain location=219-392; Score =167.0; E_value=4.9e-47; Accession=PF02687.12; Description=Predicted permease
MYQPVALFIGLRYMRGRASDRFGRFVSWLSTIGITLGVLALVTVLSVMNGFERELEGNILGLMPQALVTSDTGSINPQQMRAQDLKLQGVTRIAPLTTADVVLQSARNVSVGVMLGINPDEPDPLTPYLVNTQQSVLQPGQYKVILGELLASQLGVKRGDQLRLMVPSVSQFTPVGRVPSQRIFTVAGTYAANSEVDGYQILVNQQDASRVMRYPLGNITGWRLWLDKPLNVDALSQQPLPQGLTWKDWRERKGDLFQAVRMEKNMMGLLLSLIIAVAAFNIITSLGLLIMEKQAEVAILQTQGLTRRQIVAVFMVQGASAGIIGALLGTLLGVLLASQLNNLMPVIGLFLDGAALPVDINVWQVITIALVSMAVALLSTLYPSWRAAAVQPAEALRYE

SEQ ID NO: 153895 - protein, 632 aa, Glycine max
  Coding DNA Sequence Number=SeqID_62210
  Gene Ontology: Mol. function=ATP-dependent helicase activity; Cellular component=phycobilisome; Biological process=regulation of transcription, DNA-dependent
  Homolog annotation: Hit_ID=A7MFT9; Match level="QueryCoverage=100%, HitCoverage=57%, E-value=0.0, Identity=81%"; Hit description =Putative uncharacterized protein
  Pfam annotation: Domain name=CarD_TRCF; Domain location=320-394; Score=75.7; E_value=1.6e-19; Accession=PF02559.7; Description=CarD -likeTRCF domain
  Pfam annotation: Domain name=DEAD; Domain location=423-587; Score =156.1; E_value=9.4e-44; Accession=PF00270.20; Description=DEADDEAH box helicase
  Pfam annotation: Domain name=ResIII; Domain location=419-581; Score =21.7; E_value=7.3e-07; Accession=PF04851.6; Description=Type III restriction enzyme, res subunit
  Pfam module annotation: Pfam domain module=CarD_TRCF::DEAD::ResIII; Domain location=320-394::423-587::419-581
MEHGEYATRGALLDLFPMGSDQPYRIDFFDDEIDSLRLFDVDSQRTLEAVSAINLLPAHEFPTDKAAIELFRSRWRETFDVRREPEHVYQQVSKGTLPAGIEYWQPLFFEQELPTLFSYLPASTLVLNSGDLHASAERFWQDAHARYENRRIDPMRPLLEPATLWLRPDALLSELKNWPRMQLSAETLPEKAANSNLGYQPLPELTVQAQAKAPLDLLRQFLEQFTGQVIFSVESEGRRESLQELLSRIKLRPQPIDRFEQADEQPYSLMIGASERGFIDTQRQRALICESDLLGERVSRRRQDNRRTINPDVLIRNLAELHPGQPVVHLEHGVGRYIGLTTLEAGGIVADRYAGGADENAPLHKLGSDAWSRARQKAAEKVRDVAAELLDIYAQRAAKAGFAFKHDREQYQLFCEGFPFETTPDQAQAINAVLSDMCQPLAMDRLVCGDVGFGKTEVAMRAAFLAVENGKQVAVLVPTTLLAQQHYDNFRDRFANWPVRIEMLSRFRSAKEQAQVLEQASEGKIDILIGTHKLLMSDLKWRDLGLLIVDEEHRFGVRHKERIKAMRADVDILTLTATPIPRTLNMAMSGMRDLSIIATPPARRLAVKTFVREYDSLVVREAILREVLRGGQ

SEQ ID NO: 153896 - protein, 189 aa, Glycine max
  Coding DNA Sequence Number=SeqID_62211
  Gene Ontology: Cellular component=outer membrane
  Homolog annotation: Hit_ID=P0AB36; Match level="QueryCoverage=90%, HitCoverage=95%, E-value=5e-62, Identity=66%"; Hit description =Uncharacterized protein ycfJ
  Pfam annotation: Domain name=Rick_17kDa_Anti; Domain location=74-117; Score=58.0; E_value=3.3e-14; Accession=PF05433.6; Description =Rickettsia 17 kDa surface antigen
EDIPVNKSMLAGIGIGVAAALGVAAVASMDVFDRGPQYAQVLSATPIKESIKQPRQECRNVTLTHRRPVQDENRIAGSVLGAVAGGVIGHQFGGGRGRDIATVAGALAGGYGGNQVQGALQDRDTYTTSEQRCKTVYDKQEKMLGYDVTYKIGDQQGKIRMENDPGTRIPLDRNGYRTVRSSASHSAAA

SEQ ID NO: 153897 - protein, 35 aa, Glycine max
  Coding DNA Sequence Number=SeqID_62212
MIILGYLPGWGSNMDSRNRSRYLGTDASGDGVTID

SEQ ID NO: 153898 - protein, 116 aa, Glycine max
  Coding DNA Sequence Number=SeqID_62213
  Homolog annotation: Hit_ID=A5BKY7; Match level="QueryCoverage=81%, HitCoverage=24%, E-value=2e-11, Identity=35%"; Hit description =Putative uncharacterized protein
  Pfam annotation: Domain name=zf-CCHC; Domain location=98-115; Score =16.0; E_value=0.0058; Accession=PF00098.14; Description=Zinc knuckle
MNHLQSLMKVAQLMLRYISGGRWERSNRLNVMFIKTKISTRIRGSIDQHEKEEESLVMETGESALLTTAYGKNKATKSQANHKGNGKIPPQVDIKKVAKCFFCKKKEHMKKNCLRF

SEQ ID NO: 153899 - protein, 76 aa, Glycine max
  Coding DNA Sequence Number=SeqID_62214
MAAEWRRKRERRRHFKDKMSLEEAHHHRRPWIRAWRKKEMNEGRGREEHEILCSKRALKSEPTNPRSIPRFSTKCA

SEQ ID NO: 153900 - protein, 111 aa, Glycine max
  Coding DNA Sequence Number=SeqID_62215
MDSSSHSPFRGLGNHSLSLKVPLQRTLADGGHPAQGTPSCLCYQKGLDDAPQPKSKASARWIVVKMSTIILGTLRNNWEAYFNDPRPLEPERLKALRIQWAQFYLRVGDQT

SEQ ID NO: 153901 - protein, 131 aa, Glycine max
  Coding DNA Sequence Number=SeqID_62216
METCLGVEELLQRMIDQGRLEVGSEGKEEQHICMQSTDGSSVAKPKPLVIYFTKSAASQKPGHPLVAKPVPFPYQNSHAVPWRYTPPREKEEEATHVSSLSAKVTNITGLSGVTRSGRVFAPPDLPVQPAD

SEQ ID NO: 153902 - protein, 96 aa, Glycine max
  Coding DNA Sequence Number=SeqID_62217
  Homolog annotation: Hit_ID=A5BMX7; Match level="QueryCoverage=71%, HitCoverage=8%, E-value=4e-08, Identity=37%"; Hit description =Putative uncharacterized protein
RVHLLGLLTENKRGYISCGSVLVEGTSTRFKENKGGLFQDHDEDQVNLCLMTKSDENNKEDSVRKKWYIDSGCSKYMTSDVSKFTTISPKKSGHVT

SEQ ID NO: 153903 - protein, 76 aa, Glycine max
  Coding DNA Sequence Number=SeqID_62218
  Gene Ontology: Mol. function=nucleic acid binding; Biological process= DNA integration
  Homolog annotation: Hit_ID=A5B994; Match level="QueryCoverage=77%, HitCoverage=12%, E-value=6e-10, Identity=49%"; Hit description =Putative uncharacterized protein
MRKVAYVLNTDIPVVPEDAEKEKYDTEEAGTKKYVVSRYLKYQMTDDKSVESQSHEIQKIAHDIISEGMALDEQFQ

SEQ ID NO: 153904 - protein, 118 aa, Glycine max
  Coding DNA Sequence Number=SeqID_62219
MDTLEPYTGAMKASSKPRGQIRSSHPIGSLLRKTTIGTSKPYTGVMRVIVHDPQANLGADQKFSPIDVFEQKKGDKPWNLYGLIKRQTAPLLSLQNGQVTKSNRTYTLREFPERFAKR

SEQ ID NO: 153905 - protein, 115 aa, Glycine max
  Coding DNA Sequence Number=SeqID_62220
  Subcellular localization annotation: CTP_CleavageSite=37; ConfidenceScore=5.28e-01
MDMNLGSLIAAAPNPAPSTSAPSTSALPPPPAAPVLPAQEPQQDQVDNILEASEPTPPEPFIFETDPVIVQEDVAVLEPSPQPEPESSALVLDLRLSQDPSSAPALDLNEHAQDH

SEQ ID NO: 153906 - protein, 167 aa, Glycine max
  Coding DNA Sequence Number=SeqID_62221
HVTCTLVSSRGGGPDDTRRYLTVIRTLLSSRGGGPDDKQRPKAADPMTSRDQVWSFCTLVSSRGGGPDDTQRPKTKFGHSAPLYHPEAAGPMIRGDTLRLFAPFCHPEAAGPMTSRDQTPGNNKSFTCGNFMIARDSRQPRGAKLVSYTDFRGPLLDDMRPFFGPCE

SEQ ID NO: 153907 - protein, 37 aa, Glycine max
  Coding DNA Sequence Number=SeqID_62222
MKMLLIPHDMNDIGMEKKERKEMSLQGEDESRRSSPP

SEQ ID NO: 153908 - protein, 90 aa, Glycine max
  Coding DNA Sequence Number=SeqID_62223
  Homolog annotation: Hit_ID=A5AGH3; Match level="QueryCoverage=51%, HitCoverage=3%, E-value=2e-07, Identity=65%"; Hit description =Putative uncharacterized protein
NLQDSGTLKRVAWGLDVGTRETKRFLTKNFEMKDLREASFVLGIKILRDRSQGILSDEDKARNKGKEPLEGLGGPMARARTKKVKEALQQ

SEQ ID NO: 153909 - protein, 107 aa, Glycine max
  Coding DNA Sequence Number=SeqID_62224
EWEESKEFLDCVVLNSLTREKGDTKEFRRLVLCSFGKGRRETQKEFRRLVLGGFFLTKGEENEKMNSTSFEGLENQKTSESFWYKEEEDVQRYSKRFKACKGLYKID

SEQ ID NO: 153910 - protein, 70 aa, Glycine max
  Coding DNA Sequence Number=SeqID_62225
MALKKLSTKRSRKDATEEGSSVSLEFDSHRFWSAEHQQRFEAIKGWSFHRERFPQPIVGRPADFGGGPAM

SEQ ID NO: 153911 - protein, 42 aa, Glycine max
  Coding DNA Sequence Number=SeqID_62226
RLKKARERTAFSVFFLENVMNSLSEHAALSEHAALSEFIDIH

SEQ ID NO: 153912 - protein, 119 aa, Glycine max
  Coding DNA Sequence Number=SeqID_62227
VPLQRTLADGGHPAQGTPSCLPKSKAPARWIVVKCNRQKGSTECGYYVMHWMSTIILGTFRNNWEAYFNDPRPLEAKRLKALRVQWAQFYLRVRDQAYDLGTLSLALVYFGLTFLTFSM

SEQ ID NO: 153913 - protein, 90 aa, Glycine max
  Coding DNA Sequence Number=SeqID_62228
SCDDLELVFEGAENRWMTMKNLMLEDTGTQRSDRIEKCSQERKLRAHSRYLLEDPNGKIMDKCLLKLKTKFREDPTINEGCEAFLTRQLM

SEQ ID NO: 153914 - protein, 85 aa, Glycine max
  Coding DNA Sequence Number=SeqID_62229
MLCVIDYNDLGTSFVVQVEGTSTWVVVTKNKRGYISCGSVLVEGTSTRLFKENKGEYIPCGSLLVKEFTRLKRNLKNRRSLGDWM

SEQ ID NO: 153915 - protein, 186 aa, Glycine max
  Coding DNA Sequence Number=SeqID_62230
  Subcellular localization annotation: CTP_CleavageSite=59; ConfidenceScore=5.35e-01
TVRQFAILNLIRRPMNSLPSAVHVSSTIESGAPRIDCLTLFTNSPLSTFIRRRMNSLPSVVHVSSTIESGAPRIDCLALFANSPLSNLIRRPMNSLPSAVHVSSTIDAVHASSTIESGAPQIDCLALFANSPFSNLIRRPMNSLPSAVHVSSTIDAVHMSSVIKHGTSGDWEIWFFVIFRIGSFAK

SEQ ID NO: 153916 - protein, 93 aa, Glycine max
  Coding DNA Sequence Number=SeqID_62231
MIEHEEQGIKVNSPNKKIKEAKEHHLDEDALIPHDVAPCGASRPWIFFINGVLCFLNIMEEEWRRKKDDWRCQFKEKMSPEEDHHHRKPQIRA

SEQ ID NO: 153917 - protein, 49 aa, Glycine max
  Coding DNA Sequence Number=SeqID_62232
NLQDSGTLKRVAWGLDVGTRAIMKLSSKLESGGHMNSPKQEHSCGSGKG

SEQ ID NO: 153918 - protein, 163 aa, Glycine max
  Coding DNA Sequence Number=SeqID_62233
  Pfam annotation: Domain name=Transposase_23; Domain location=78-148; Score=-3.0; E_value=0.0025; Accession=PF03017.5; Description =TNP1ENSPM transposase
MCSVQDSLDKKASQGSFIPHGRQDIQTAVIWRPEHPGRVRAVGASGLALPPEPEVGPSGPRVSTKESCVAPSRNDPGTGDSNKCGLYIEENPSCLVALGRLYEGSTTVHNIPLLHDQVKVGVEEVKDAETLVLVPIDKVTLVGQALNTFLAWPTHLVKRLSEQ

SEQ ID NO: 153919 - protein, 160 aa, Glycine max
  Coding DNA Sequence Number=SeqID_62234
  Homolog annotation: Hit_ID=A7QQC6; Match level="QueryCoverage=78%, HitCoverage=18%, E-value=2e-16, Identity=40%"; Hit description =Chromosome undetermined scaffold_142, whole genome shotgun sequence
MDIDYAIRKDEPPAITDESSPTDVVLYKRWERSNRLSVMFIKTKISARIRANIKKVAKYFFCKKKGYMKKNCPIFQKWLEKKDTLFELFYNSKCVGNGILSGGLYLLGLQNYATYSSMHVQIGIKRLGHTSIERIKGLVKDGVPNTSILLTLRLVSIALR

SEQ ID NO: 153920 - protein, 39 aa, Glycine max
  Coding DNA Sequence Number=SeqID_62235
MEEKRGGGFGCAAALISTNKPTGNRLQDVVIDYRLPVHV

SEQ ID NO: 153921 - protein, 62 aa, Glycine max
  Coding DNA Sequence Number=SeqID_62236
MKNGETIYELQTRFTHIVNHLLGLGKTYEDAPCGAYRPWIFFINGVLYFLKINGSGMEKEEG

SEQ ID NO: 153922 - protein, 116 aa, Glycine max
  Coding DNA Sequence Number=SeqID_62237
MIGSFQQQQQMSVLELYVEKDVAGGSIFHAANSVTSCGHNVSHHESELPRNISNLHDDEDDDDDDYLASVTFYHITTFVKTMKQCTDIALEPVSIVHPTEGVPGIQNPFWNNALHL

SEQ ID NO: 153923 - protein, 140 aa, Glycine max
  Coding DNA Sequence Number=SeqID_62238
MWVSRERFPAYFRREEKEKSDFRQEDDKEKREGKLLPLVAGPPQGEEHFNWSGIFETQLEDLVENGAFDLPFTVSSSLANPFSLTSKTFLSLLSPCHDTAVCDLSPSSPCQHQSLRVIIGAVEPTTGSRVGVRHCCHEIE

SEQ ID NO: 153924 - protein, 17 aa, Glycine max
  Coding DNA Sequence Number=SeqID_62239
RTREPRLARPQKGTLRQ

SEQ ID NO: 153925 - protein, 162 aa, Glycine max
  Coding DNA Sequence Number=SeqID_62240
MEKSDKTNFKEKKEKKVYITWEDNDLDSSSDLENEIINLGLMAKDYESGEELAISTLITIGSSYIGLIVLKSFVVKAVAPPPTKPLAMVFITHPGWSRVLSSLSLEQLWLLRLFDWPACSQSLPHLNSGTTFLCQVATIAECTAYNMALVAADPSSRHLEPC

SEQ ID NO: 153926 - protein, 111 aa, Glycine max
  Coding DNA Sequence Number=SeqID_62241
MTNYLRYLLFSLTKIQGTNRLKILCLNTLEGTSFVVQVEGISTWVITENKRGYISCGSVQVEGTSNWLFKENKGGYIPCGSLLVRDFTRLLEISRTGGCLGTGRRHGLWLN

SEQ ID NO: 153927 - protein, 229 aa, Glycine max
  Coding DNA Sequence Number=SeqID_62242
  Gene Ontology: Mol. function=diacylglycerol kinase activity; Cellular component=nucleus; Biological process=activation of protein kinase C
  Homolog annotation: Hit_ID=A7QUQ9; Match level="QueryCoverage=95%, HitCoverage=26%, E-value=2e-94, Identity=73%"; Hit description =Chromosome chr1 scaffold_180, whole genome shotgun sequence
KGRAHFKSMLQDYGIEPCIEHYTCMVWLLGRSGQFDEAVKLIGEIPFQPSVMVWRALLGACVIHKNLDLGKVCAQRVLEMEPQDDATHVLLSNMYATAKRWDNVAYVRKNMKKKKVKKEPGLSWVENQGVVHYFTVGDTSHPNIKLIFAMLEWLYKKTRDAGYVPDCSVVLLDVEDDEKERLLWMHSERLALAFGLIQIPSGCSIRIIKNLRICVDCHAVFAPVVTTGN

SEQ ID NO: 153928 - protein, 133 aa, Glycine max
  Coding DNA Sequence Number=SeqID_62243
MADEENNWIAKFQFRIASDLPVVVVLNKEFASTIDLRSYHAGICCTEIERECLFEAGSNQQSECCGSYNHDANFSDSKYCNNFSACRFNIEFHSSNLSLPPVSTHFNFPLPAQDVDRSDLTSLLFNPVKIFTD

SEQ ID NO: 153929 - protein, 102 aa, Glycine max
  Coding DNA Sequence Number=SeqID_62244
MGEGEVEEEGWWVCVEAKLHDESILIQRCFDDNKDDDKGDDKKLKGQSKNEFKMFKIESRILQDSRGKLISRIKLPRIKIKIQESREGLIKISMKRFFSKIE

SEQ ID NO: 153930 - protein, 270 aa, Glycine max
  Coding DNA Sequence Number=SeqID_62245
  Gene Ontology: Mol. function=transcription regulator activity; Cellular component=integral to membrane
  Homolog annotation: Hit_ID=A7Q5W0; Match level="QueryCoverage=60%, HitCoverage=43%, E-value=3e-51, Identity=62%"; Hit description =Chromosome chr14 scaffold_54, whole genome shotgun sequence
  Pfam annotation: Domain name=DUF573; Domain location=122-219; Score =166.3; E_value=8.2e-47; Accession=PF04504.5; Description=Protein of unknown function, DUF573
MSLTSVCIFFMSCKEVIVTGLVCKYSSGTYHWAQTSRKSDDESQEDEEYEEDDDKENVPSPSTALVVTIIVPSSSVSNGGGNTPILKPTATIVLTDSSDPKWRCLELIEEKKPPPSLDDSQRLLQRLWTDEDEIKLLQGFLDYTLQRGSSHHNDTTLFYDQIKSKLQLNFNKNQLVEKIRRLKKKYRNVLNKICSDKEFSFKSTHDQATFEISRKIWSNVTPVVDNSLDDDEINPNRSPNPNLNFSPVILKNETIFKNSTEKKTPKHSRR

SEQ ID NO: 153931 - protein, 51 aa, Glycine max
  Coding DNA Sequence Number=SeqID_62246
MGYLTECDKARKNRTPTNEVHITLKQEVANFLTSMLTRNDVESAGYYIGAG

SEQ ID NO: 153932 - protein, 428 aa, Glycine max
  Coding DNA Sequence Number=SeqID_62247
MASQSSRDQTDIENCFDRALAGFYSAIGKNLESLQPASELFLVKCKFQLCASCLKRSNQSQLVGKFSSTKRVILAIVDPALIVVSKRASALIARKSSVLKPPTQDILTATIRRPEHPGRVHAAGAVADPTYQGPTRGVDHRKSDSATHGIVQPDAVPISVPDAISGTCTASGASGNDPETGDLDWCGLYIEENPALSVALGRVYVGSTVVHNTPLLPGQVKVGNSHLPCLADTFGQIFITTAVSLAKPPQKLDLEVDDPLYLMTLTVPELFLRRYQVTWDATVFGVFNPDFPLYIKHKDLSEIAHGGQCLSISVSGQSQFETKSYIKSWMQSSKHDVYLGAYLNGGHWQMVVIVPKEHLVVWFCSLHNRSYNYLKGIINSALKGLDDAPQPKSKAPARWIVVKYFNDPRPLEPERLKALRIQWAQYYL

SEQ ID NO: 153933 - protein, 218 aa, Glycine max
  Coding DNA Sequence Number=SeqID_62248
  Subcellular localization annotation: CTP_CleavageSite=30; ConfidenceScore=5.31e-01
MQTASQAGGSFANEFANRTGDSATAAAPPSCTTAAPCPPASCLRAYYLAVSLRNSPVKLAVPYAWPYRCCKERFLQNDQTRQWYWRFGCCLHACHVKNNPIVQNVSKEPHLGKYFLKVPRMGKFAGEGTMTVMLVATTVAMVAFTILVVMVVMVATMVMLVAATVVMVAITVLVVVVAVVDGHGGCCSGGHGRFGENDHDNDDGHGDDRFEIFYDGIN

SEQ ID NO: 153934 - protein, 52 aa, Glycine max
  Coding DNA Sequence Number=SeqID_62249
MVRMLGSGLRAWCSNFTTIQRLGGLREKVRVLGEERKNEIARQRRLRSQFEN

SEQ ID NO: 153935 - protein, 157 aa, Glycine max
  Coding DNA Sequence Number=SeqID_62250
ASEKPVLRLKIQQPTRQFDWRFPKPGEDSLVVVAISSCKQLATHGGGFHATWELQTKLATSSGELMGKFAFPRHHYSGNNDDYIGGNGDGHGGNHIVGGCGDDLDWGLGLCYNKCVIVSVEFVYNVYLILVDGYSLPRRRLRNTVSWSLSLPEFVSL

SEQ ID NO: 153936 - protein, 285 aa, Glycine max
  Coding DNA Sequence Number=SeqID_62251
  Gene Ontology: Mol. function=ribonuclease H activity; Biological process=RNA-dependent DNA replication
  Homolog annotation: Hit_ID=Q9ZQG1; Match level="QueryCoverage=98%, HitCoverage=27%, E-value=2e-09, Identity=23%"; Hit description =Putative non-LTR retroelement reverse transcriptase
MEDRGWEKSKGVEGQMYFGEELLVAKLIDVDTRRWDMKMSLSRDGRYYVKSGYKIAMKSKPDVVASSSRILGDWWKKLWKIRTQPRCSQFVCKVCPDIIPIRQNLMRRGMMLDPNCPRCGEKVEYATHALLTCGKFMRMGNKEVMAKIFEFLYIVWRCKNLLVFEQKFVPLPQIFACAEALHVKEWKKSQKEDKVDLRWCPHKGVAQEMGIQRVVYETDCLDLIKEWKKESREYCTYLSALVKGCKSMLRNMAKVYFCHGPRSYNSATDQLARCIFQLLNKVWLG

SEQ ID NO: 153937 - protein, 148 aa, Glycine max
  Coding DNA Sequence Number=SeqID_62252
  Gene Ontology: Mol. function=protein transporter activity; Cellular component=clathrin adaptor complex; Biological process=intracellular protein transport
  Homolog annotation: Hit_ID=Q10LA0; Match level="QueryCoverage=76%, HitCoverage=14%, E-value=4e-46, Identity=78%"; Hit description =Adapter-related protein complex 1 beta 1 subunit, putative, expressed
MVAANVVAELAEVQENSCSPIFEISSHRLSKLLSALNECTEYKAADTREAENIVERVTPRLQHANCAVVLSVVKIILLQMELITSTDVVQNLCKKMAPPLVTLLSAEPKIQYVNLIVQRRPTILAHEINELLQALICGIGYLEQPVLT

SEQ ID NO: 153938 - protein, 64 aa, Glycine max
  Coding DNA Sequence Number=SeqID_62253
MERGGFGDGFGADIENPIPDPEPEFGYRGKSDPDPDPGQLRSSPSKSGRAPRVRAPRVRAPLPL

SEQ ID NO: 153939 - protein, 74 aa, Glycine max
  Coding DNA Sequence Number=SeqID_62254
MGNVTGKEIRSGSKSSTQHMRLKCGNMKPEVPPPQKRGYSSRYNHVIESSEFGIASIILAKVFPNNPIENMENY

SEQ ID NO: 153940 - protein, 67 aa, Glycine max
  Coding DNA Sequence Number=SeqID_62255
MKNKKVAVAGVSLSETYALSEQHPLSEALSSLSELGEFGRESAKHARTQHAISSPSESFVSSGAQRA

SEQ ID NO: 153941 - protein, 163 aa, Glycine max
  Coding DNA Sequence Number=SeqID_62256
  Subcellular localization annotation: CTP_CleavageSite=89; ConfidenceScore=5.64e-01
MITFPGTRKARARGPEASTTAPSSSTPSAHSAPAPPPSPLVPAPSSTSMQSSDVLVPMLQSLHHGLCLVMQSIHGLAQHRPIISMEEFKAQMAWPGVQPSPLRGVLEVSEKEDGAANTDYAADMATTQSTWDPWPAAAQDIPQPAQDAPSSPQDEPIAAQEEP

SEQ ID NO: 153942 - protein, 40 aa, Glycine max
  Coding DNA Sequence Number=SeqID_62257
MEMAPRTLSAKRARKDAVGEGSSAAPLVDVEFDGHRFRSE

SEQ ID NO: 153943 - protein, 141 aa, Glycine max
  Coding DNA Sequence Number=SeqID_62258
MARTKKSGQMTSEATKEIAYKIRSRPHREALSPMDGRPKHPGRVRVAGFGELVLPPEPEVGPSVAHINIKENCVDPLGNDLDTDEPEKCGLYVKKNPPCLVAIGRLYEGSTTILNIPLANDQVKVGVEKVRDADAHIPVPT

SEQ ID NO: 153944 - protein, 265 aa, Glycine max
  Coding DNA Sequence Number=SeqID_62259
  Homolog annotation: Hit_ID=Q2HTA0; Match level="QueryCoverage=54%, HitCoverage=22%, E-value=4e-13, Identity=33%"; Hit description=IMP dehydrogenase/GMP reductase, related
  Pfam annotation: Domain name=DUF1723; Domain location=123-172; Score =37.4; E_value=5.2e-08; Accession=PF08330.1; Description=Protein of unknown function (DUF1723)
MIMMPPAVKAHHIYFARRHRKQACVVEDPPTAAEDSNEEQQQPPIEEVVTDVKGFPSRPHDTSILRDFENHIALRVWNREERPELNLSYHGRKMDKFGRPTPEIESLVTVSELSSSIACSLYTGDRGLMSTFVERWHKETSIFHLPVREVTITLDDKASLIHFPIVGAFHSFEQLHVNDVVDMLVELLKVSAVEARAETIQCHYSALMFNYRGYETCIRRKSRIFFINGFICFLEDEWQQNGERKRERRHHFKEKMSLEEAHYHR

SEQ ID NO: 153945 - protein, 336 aa, Glycine max
  Coding DNA Sequence Number=SeqID_62260
  Gene Ontology: Mol. function=ATPase activity, coupled to transmembrane movement of substances; Cellular component=integral to membrane; Biological process=transport
  Homolog annotation: Hit_ID=A7QXY6; Match level="QueryCoverage=17%, HitCoverage=8%, E-value=6e-17, Identity=72%"; Hit description =Chromosome undetermined scaffold_235, whole genome shotgun sequence
MNRRHFYNYLPEKALYDTHSKTVIENRLRICAGHKDYDGLCPLTFKSAQRKNPNNAFSNPSCEVLRPLHNPSTKGKMWDLVARDRWVIFDAFSALIVATVRSLFFLFFFAHFVFLEGGGQSCYGDFDTAFLDSIHLHSTEYGPCCFSPEYAVVGSVVRGFGNMKVKRMRETLYSSLLLQCPYCRIYHFLTMKQYEWWLEKLVDISLQQSAAYGVWNFSFNILYHSTQVITVLFGGMSILVGHITAEKLRRSWSNKAPKSITLSFNCPSYKKLSITLKASSGTSLKVTSEDMLSFGVILQSISFLNIPFSSLNNYWITYLCMDLVHTANSYVLFILA

SEQ ID NO: 153946 - protein, 175 aa, Glycine max
  Coding DNA Sequence Number=SeqID_62261
MQQPIFGCPSQPQNIHGITLKGKQDENWRQLFAPMISQWNNQVEFRVGLLSFNSNYMVWNTWTVDDLVPYVEKITILSEEQERVTEPVSHGPASERQFPAQEFHILQSSVETQGIGRRREVVEAEEYSQQMVDRGHGMYYMPPTFSQYPFEGHHTDTSASEHSFGGVVETHPHFS

SEQ ID NO: 153947 - protein, 33 aa, Glycine max
  Coding DNA Sequence Number=SeqID_62262
MAIALQASNELLLSVLVARCYRGIGSAADILGM

SEQ ID NO: 153948 - protein, 193 aa, Glycine max
  Coding DNA Sequence Number=SeqID_62263
MASYGGELLLEEGSYNSGTDLEARLVYGLVMKMDMNIEALIYKQISLIAQSNSLRLGFPALITALCKAQGVTSDSLTYESLSRSLRSELRAFHVYVVESAPRPTPDYAELAGCGPAVTSYERGGVSAEAQEPQPDQEDDSSEATPIPPEPFIFEDDPVTTEGTQQESPVGTPALDLNEEAMDQDPPLPQDQDH

SEQ ID NO: 153949 - protein, 142 aa, Glycine max
  Coding DNA Sequence Number=SeqID_62264
MEKHGIKISIVKTIQFNEIRIPSQTHTEDQRQTLLVKREEKAHQNIVELEVASVLLDDNHGGGALALEGDALGLHGGGLIECVRAKRNSVGRRKKRRQNLGDGDLNGGVVPTRVGEEVTEHCNIVNEGIGSVRSSVECAQKP

SEQ ID NO: 153950 - protein, 43 aa, Glycine max
  Coding DNA Sequence Number=SeqID_62265
MKEKELKYLGNGDANSHVCKCVNLVHLLVLRVQYAAQGFIPLN

SEQ ID NO: 153951 - protein, 177 aa, Glycine max
  Coding DNA Sequence Number=SeqID_62266
  Gene Ontology: Mol. function=protein serine/threonine kinase activity; Cellular component=cytoplasm; Biological process=protein amino acid phosphorylation
  Homolog annotation: Hit_ID=A7PH48; Match level="QueryCoverage=33%, HitCoverage=10%, E-value=6e-24, Identity=91%"; Hit description =Chromosome chr17 scaffold_16, whole genome shotgun sequence
MDREPSTQPISKLKFEFERMKLTKDDVRELIYGEILEYHPQMLQEYLCGGDQTSFMYPSLKLQRVGLGSLHITSSLFEAKRKIEKGQGSFGTGFSYTSDASDIRQTNPHDGDMCKGHQSSPSNQDRAPYERMLDNKVEFGSPNKRSSGFFNSALVLGRFTVLACKNNSKFLLTDFLD

SEQ ID NO: 153952 - protein, 167 aa, Glycine max
  Coding DNA Sequence Number=SeqID_62267
MMIRLIKTKIRKEQWTFEQREEVPLKRGDLGSERRKEKSKPGTRNREKFWGQTQVDVPSTCTTKDVSSNVLRQRSQAVKPLILCEWGYKRILRREKGDTKEFRRLVLGEFFLAKGEENEKMNSTSFQGLENQKTSESFWYKEEEEVQRDSKLVKDCNEMIGKVFKIE

SEQ ID NO: 153953 - protein, 21 aa, Glycine max
  Coding DNA Sequence Number=SeqID_62268
MELWWPTEGGAVIADEKGRKV

SEQ ID NO: 153954 - protein, 66 aa, Glycine max
  Coding DNA Sequence Number=SeqID_62269
MSSKVIVMRILKLAKYRLKTYQCNPCGVYPDLSSFTGSGVIQFSVACIKRFAPSQDHIIWYQSFGS

SEQ ID NO: 153955 - protein, 108 aa, Glycine max
  Coding DNA Sequence Number=SeqID_62270
MSRFATIVAEEWLIGIILGRWMLSSMLDPWGVLATVGGIAHIAVLILKVFANRLQNCTCVCGTAKTREKKESHEDSTSRGFNLFSVSLTFENSIGTVGGITGGISGNL

SEQ ID NO: 153956 - protein, 65 aa, Glycine max
  Coding DNA Sequence Number=SeqID_62271
MEKICNRNLKRWLLIKIVTIKLATKCENTTDSECKWGVSFRRAGANGRDRSWSVAEVRALNRKWE

SEQ ID NO: 153957 - protein, 162 aa, Glycine max
  Coding DNA Sequence Number=SeqID_62272
  Homolog annotation: Hit_ID=A5AG09; Match level="QueryCoverage=67%, HitCoverage=10%, E-value=1e-08, Identity=26%"; Hit description =Putative uncharacterized protein
MDPISIKLGDDNYSIWKAEALGKIKKCNLEKFITMTNLGGKPPVFSEEYKSWEEQDQVLYWWLLDSLHPEFLIQMERCDNALELWMEIEVYFLEKEIEELGEKHKSLIEKHLKLKQRLWRLDEECLEISNENEALEEELVKEHGPESVADILSMKHGTAGSA

SEQ ID NO: 153958 - protein, 86 aa, Glycine max
  Coding DNA Sequence Number=SeqID_62273
MIQITGQLSLNLDPDPGRWSECERDKSRPFVCKSDSLGKLDSNLGFLISYSMVERSHGSLNDALCLQWSHGRGLQWCPQGLSNGAS

SEQ ID NO: 153959 - protein, 161 aa, Glycine max
  Coding DNA Sequence Number=SeqID_62274
MRGRGCHRSNILPSNNWSIKMKALHGEHDVWEMVENAIRSHKMRLHYPKHKRRLLRIQERDTRKLSSSSIKHYMMMHSRRILMQHPLKRHGISFKPFTKEKTKRRKKVKEMKEVNEAEVDVEVMAKDRLDVATVDEVQISSITVTRKEKAQQENVEEVIQA

SEQ ID NO: 153960 - protein, 182 aa, Glycine max
  Coding DNA Sequence Number=SeqID_62275
MGKGMVGSRMEGYGATFRLFVEHCVGNFIVGWGMETMASSSLSVFLPIKEKYDEFAPTNLESLEVLLVQDVSGTALVDKDPGHHEVQYNDEDNHRVVLVDRIDALEVPVHKGDRRETSLWVPVLLEVVTRAAMANVFDGLSLPLFFCLLLGSCAAPLDVLQGPAVFVVSKVLPGVARWVPPG

SEQ ID NO: 153961 - protein, 57 aa, Glycine max
  Coding DNA Sequence Number=SeqID_62276
MAIPLLHKNAISRKKLATNVFQLLLAIEIAAKRLLSLIDIEFVTQAYMVAKLRQRPN

SEQ ID NO: 153962 - protein, 151 aa, Glycine max
  Coding DNA Sequence Number=SeqID_62277
  Pfam annotation: Domain name=zf-CCHC; Domain location=80-97; Score =29.8; E_value=9.8e-06; Accession=PF00098.14; Description=Zinc knuckle
EHEMELQRINQNEENDKKKRSITLKASSSMQEEKEEEDSDDEEYFSFFVKKFQKFIKKRRIDRRQNFNNGRKSQDDSQVLRCYKCNQIGHIKVNCPSNEEWPEKSEKKRFDERRTKKAYIAWDDNDSSDGSEKEINILTKDYETDENISQG

SEQ ID NO: 153963 - protein, 131 aa, Glycine max
  Coding DNA Sequence Number=SeqID_62278
AVAKVNPMPPSDLNQMNHPTSGMVGKDLGSTSGPHYAQIQNKHAFPPYGLHPNYTPPNVAYTPKEDVNNSTPTLIESQQPQSDHAHVSQPMGETHGMPHHNLADFEPCLGYATEGKGSGPLKEVKIMPLLT

SEQ ID NO: 153964 - protein, 124 aa, Glycine max
  Coding DNA Sequence Number=SeqID_62279
MGTNQNGKRFYQVKVKGLDVTSLKELERLMGPLQRQAFRKVYGKILDLTVAEVFTEAVVSLAQYYDQPKPYLFSGFLPSLSKIAAVIGDSAKELGRMKQIRNGIVGLPQKYLEGKARDMASHYK

SEQ ID NO: 153965 - protein, 153 aa, Glycine max
  Coding DNA Sequence Number=SeqID_62280
MVGYTPSSFADLDFAGRRIKAGLKRGKFNHPTWTNEKTGANEEGENEGEAHAVTAIPIQPSFPPTQQCHYSANNKPSPYPPPSYPQRPSLNQPQTITPTKVHQPPFLREYDSNATCACHGEALGRSIEHCRALKRKVQSLIDAGWLKFKENHV

SEQ ID NO: 153966 - protein, 146 aa, Glycine max
  Coding DNA Sequence Number=SeqID_62281
  Subcellular localization annotation: CTP_CleavageSite=45; ConfidenceScore=5.33e-01
PMNSLPSAVHVSSTNESGAPRIHCLAVRQFSILNLIRRPMNSLPSAVHVSTNESGAPRIHCLALPMNSLPNAVRQFYILNFILRPMNSLPSAVDVSSTIESGAPRIHCLALPANSLPSAIRQFCILNLIRRAMNSLPSAVHVTPPT

SEQ ID NO: 153967 - protein, 48 aa, Glycine max
  Coding DNA Sequence Number=SeqID_62282
HLLCDGIKKNYTTWIWHGEVTDMQSGSQSKPFDVEMGDHLEDMIHDLG

SEQ ID NO: 153968 - protein, 34 aa, Glycine max
  Coding DNA Sequence Number=SeqID_62283
TSQDFTYCAQRMPSISKRPIKGCMSSSNNLRTKL

SEQ ID NO: 153969 - protein, 348 aa, Glycine max
  Coding DNA Sequence Number=SeqID_62284
  Gene Ontology: Mol. function=2,3-bisphosphoglycerate-independent phosphoglycerate mutase activity; Cellular component=cytoplasm; Biological process=glucose catabolic process
  Homolog annotation: Hit_ID=Q1GZ82; Match level="QueryCoverage=99%, HitCoverage=67%, E-value=1e-130, Identity=65%"; Hit description=2,3 -bisphosphoglycerate-independent phosphoglycerate mutase
  Pfam annotation: Domain name=Metalloenzyme; Domain location=239-347; Score=138.7; E_value=1.6e-38; Accession=PF01676.9; Description =Metalloenzyme superfamily
  Pfam annotation: Domain name=iPGM_N; Domain location=1-229; Score =240.1; E_value=5e-69; Accession=PF06415.4; Description=BPG -independent PGAM N-terminus (iPGM_N)
  Pfam module annotation: Pfam domain module=Metalloenzyme::iPGM_N; Domain location=239-347::1-229
MAKQQGLSKVYVHAFLDGRDTPPKSAQPYLQALEDHLNSLGVGKVASVGGRFFGMDRDKRWERVSVAYELLVNGTSDYVAPDSLTALQQAYARDESDEFVKCTAIRAAEEAPVRMEDGDCLVFMNFRSDRARQLTDALLNQQFTGFARSRIPHFSHYFTLTQYDKNQTLAEPIFAPYTVPNTFGEYVSKLGLKQLRIAETEKYPHVTFFFNGGEETVFDGEDRILVPSPKVATYDLQPEMSAPEVTDKLVVAIESGQYQAVICNYANGDMVGHTGNLQAAIKAVETLDTCIGRVVAAAQKMGAEVIITADHGNAESMFDHASDQAHTQHTTNLVPFIYIGRPASISAG

SEQ ID NO: 153970 - protein, 79 aa, Glycine max
  Coding DNA Sequence Number=SeqID_62285
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=P56760; Match level="QueryCoverage=77%, HitCoverage=100%, E-value=4e-10, Identity=53%"; Hit description=ATP synthase C chain
  Pfam annotation: Domain name=ATP-synt_C; Domain location=26-75; Score= 38.8; E_value=1.9e-08; Accession=PF00137.12; Description=ATP synthase subunit C
MYVGRDEKINLEVTRKIIMNPIISAASVIAAGLAVGLASIGPGVGQGTAAGQAVEGIARQPEAEGKIRALALLFANPFV

SEQ ID NO: 153971 - protein, 69 aa, Glycine max
  Coding DNA Sequence Number=SeqID_62286
MSLSMQSQGFTSFPCPTSDQFRAEVAWPGDWLEARAGEAPAEAPDEADEAREDEEMADLLNFLGGSGPT

SEQ ID NO: 153972 - protein, 139 aa, Glycine max
  Coding DNA Sequence Number=SeqID_62287
  Subcellular localization annotation: CTP_CleavageSite=53; ConfidenceScore=5.15e-01
MICVIDYMVMKTKVCYIFSFSSLFAKREFNRTNRLRILCSSPNTLEGTSFVVQVEENKGGYIPCGSLLVKDFTRLKEISRTGGCLGTGCRHGCRNLPFGGRAMRDSRVSLPRKEYARSRHQRLFEENVGKIGKDVVYKF

SEQ ID NO: 153973 - protein, 106 aa, Glycine max
  Coding DNA Sequence Number=SeqID_62288
MVIDQSLFYDLTQLSSEGIPFEGTLDDDWKFDFSMHDARRLVCTNQADMTERLLAGSLALESRILHYLIVCILLPRSSNLAQVSEEDLIVVWAFHTGRQIDWAHLV

SEQ ID NO: 153974 - protein, 109 aa, Glycine max
  Coding DNA Sequence Number=SeqID_62289
IALKASAVMQEEEEEEEEEEEEESDDEEDFSLFVKKFHKFIKNRRMERSHNFNNGKRSQEKNEKKSYKERRSKKAYIAWDDNDSSDCSKKEINLLSKDYESDENISQED

SEQ ID NO: 153975 - protein, 127 aa, Glycine max
  Coding DNA Sequence Number=SeqID_62290
MKLCFETSSESEEAKGEESSREIYPQEEGQPLMVKEECKEVSVSSKRLAKKERHFEIKTNIKKTSPLRQPPHFLLCKKTLVSIATPLRLEFIPQVKELLDEGLVRKSLNPCALLVPKIGIIRHRGIL

SEQ ID NO: 153976 - protein, 107 aa, Glycine max
  Coding DNA Sequence Number=SeqID_62291
MDEIELEVANTGLRNVYIFHAEVVGQYDASSIGACRPRIFFINGFLCFLEDEWQRNGERERERRRHFKEKMSLEEAHHHRRPWIRAWRKKEMNEGRGREEHEILCSK

SEQ ID NO: 153977 - protein, 172 aa, Glycine max
  Coding DNA Sequence Number=SeqID_62292
MVGYTPSSFADLHFASERIKAGLKRGKFNHPTWTNEKTGANEEVRKPVEFTPIPVSYADLLPYLLDNSMVAITLAEVHQPPFLQEYDSNATCACRGEAPGRSIEHCRALKRKVQGLIDMGWLKFEENRVIFNFHRKWVQAIGLFAQVTCALEFGLLRSFNQRLLVLHVDGGA

SEQ ID NO: 153978 - protein, 127 aa, Glycine max
  Coding DNA Sequence Number=SeqID_62293
  Homolog annotation: Hit_ID=A5BGH9; Match level="QueryCoverage=88%, HitCoverage=22%, E-value=1e-10, Identity=34%"; Hit description =Putative uncharacterized protein
MVGNFEHPNFEHYSFEHSDFEHSENMIQPPPRERTLREMATPDFTYESLCIQYPDEDVPYVLKTGLIHLLPKFQGLAGEDPHKHLKEFHIVCSTMKPPDVQEDHIFLNAFSHSLEGVAKDWLYYLAP

SEQ ID NO: 153979 - protein, 54 aa, Glycine max
  Coding DNA Sequence Number=SeqID_62294
ALKGLDDAPQPKSKAPARWIVVKYFNNPRPLKLERLKALRIQWAQYFLRVRDQT

SEQ ID NO: 153980 - protein, 96 aa, Glycine max
  Coding DNA Sequence Number=SeqID_62295
MEVSVGLCHRDIGITPTRHPVDPEKYNRALGFPALVMGLCQSCQVPVPPARSRHHDIGIAPARHPEDPKKSNRVLGFPALIMGLFQFYGVPVAPDK

SEQ ID NO: 153981 - protein, 148 aa, Glycine max
  Coding DNA Sequence Number=SeqID_62296
MSLPSEDYMSSPSEDYTSSPSEGYMPSPLEDHKSSPSEDYTSSPSEGCTPSPSKDYTFSPLEDFTSSPSEDYTSSPSEGCTPSPSEGCTPLPLEDYMFSSSEGCMPSPSGGCAPSPSKGNTSSTSEGYTPSPLEGYASSLSVGSISTP

SEQ ID NO: 153982 - protein, 74 aa, Glycine max
  Coding DNA Sequence Number=SeqID_62297
YILCGTSRGYIYLGLTENKKGYISCGPVLMEGTSTWLFKESKGGYIPCGSFLVNGFLQGWKRNLKDRRSLGDWM

SEQ ID NO: 153983 - protein, 92 aa, Glycine max
  Coding DNA Sequence Number=SeqID_62298
MDKVDIFVPHPLTNACLLIQLSPECGCKPLVCLLKQPALLSVDFQDRSIRDYSSCTLGGDVHVTSFYHAGKFVFLEKRVVKNRILDKWPQLS

SEQ ID NO: 153984 - protein, 71 aa, Glycine max
  Coding DNA Sequence Number=SeqID_62299
MKMLLIPHDASSIGASEWRKGERERRRHFKEKMSLEEAHHHRRPWIRAWRKKEMNEGRGRGREEQEILCSK

SEQ ID NO: 153985 - protein, 367 aa, Glycine max
  Coding DNA Sequence Number=SeqID_62300
  Gene Ontology: Mol. function=protein serine/threonine kinase activity; Cellular component=plasma membrane; Biological process =protein amino acid phosphorylation
  Homolog annotation: Hit_ID=A7Q4M5; Match level="QueryCoverage=97%, HitCoverage=41%, E-value=1e-122, Identity=62%"; Hit description =Chromosome chr10 scaffold_50, whole genome shotgun sequence
MGSGLGEGLFVVLILVMLSVTASTINAQPKSILLNCGSDSSVNVDGRRWVGDMATDNNVTLSSPSVLVSTSTSSDSPIYDPLYKTARIFNAPLNYTIKDVQGNYFVRFHFCPFETDDYNVNESSFGVVVNGLKLLSEFDVPGKISHKNMNLLNSGRNASSFFLVKEYILAVNGDMLLIEFVPTRSSFGFINAIEIVPVVGELFAGSVSRVGGSGGNLNLPGQGMETMYRLNVGGPEIQSNQDHDLWRTWEVDSGYMITENAGSGIKNSSNITYASMNDTWVAPLLVYETARAMSNTEVLDKRFNMSWKFEVDPGFDYLVRLHFCELVYDKANERIFRIYINNRTAADNVDVFVRAGGMNKSISPGLF

SEQ ID NO: 153986 - protein, 164 aa, Glycine max
  Coding DNA Sequence Number=SeqID_62301
FLKFLDDYEGDGPIRVLLTHGRIKEAQGSYPPSVSNSFKASKLIINQPVMEIQEFNERLAELGIEARSGFKSHGEGSTQLSGSIQLSSKESFFGKAEAKTIADINTISEEIVCVIVGTITRIVLDNHSWCYTACIRCHKKSDAEMAPFTCACGKYNKEVVLRSL

SEQ ID NO: 153987 - protein, 85 aa, Glycine max
  Coding DNA Sequence Number=SeqID_62302
MDEFKAELERRNFHKCLTNLADSSIDLALVKEFYANLYNPEGPSPKQVRIRGHLIRINVDSLNVFLETPVVVAVMTRLVATVSTL

SEQ ID NO: 153988 - protein, 42 aa, Glycine max
  Coding DNA Sequence Number=SeqID_62303
MVKSLKVGEDEWRERERRSTKFYASKEPTNPRSSPRFSTKWA

SEQ ID NO: 153989 - protein, 127 aa, Glycine max
  Coding DNA Sequence Number=SeqID_62304
  Subcellular localization annotation: CTP_CleavageSite=56; ConfidenceScore=5.14e-01
MHALHGWVKAQTLGIYLHNIPSFSVKSPEPLVQLNLCTLRPTQREAPQVPTPNTTRPAGNSNAIRNFPPRPFQEFTPLPMTYEDLLPSLIANQLAVVTPGKVFRPPFPSGMTLTRLASTMGVPQAFH

SEQ ID NO: 153990 - protein, 122 aa, Glycine max
  Coding DNA Sequence Number=SeqID_62305
MTRGNPSDLQPFDPEIDRTFHRLVRHHFVPFEHPEHFVIGESEHFVVGNFEHPDFEHYSFEHFDFEHSENMTQPPPSERTPREMAAPDFTYESLCIQYPDKDVLYVLKTGLIHLLPKFHGLT

SEQ ID NO: 153991 - protein, 312 aa, Glycine max
  Coding DNA Sequence Number=SeqID_62306
  Homolog annotation: Hit_ID=Q2HW90; Match level="QueryCoverage=93%, HitCoverage=57%, E-value=1e-40, Identity=35%"; Hit description =Putative uncharacterized protein
MGPLQRQAFRKVYGKILDLTTTEVFTEAVISLAQYYDQPLRCFTFGDFQMVPTIEEFEEILGCPLGGRKPYLFSGFLPSLSKIAAVVGDSAKEMDRMKQIRNDVVGLPRKYLEGKARDMASQEKWSPFADILALLIFGVVFFPNVDGLVDLAAIDAFLAYHHSKESPVVAILADLFDTFDWRCEKNSARIVCCLPALYVWLVSHLFQQDTRHPCPLQSYRSCAEKGRVDWDQHLARIGGSAISWFPRWKEGKEGVLFSCGDYPNVPLIGTRGCINYNPALAIRQLGYPMRGAPTEGSLSPFLVKDLGVQGLK

SEQ ID NO: 153992 - protein, 105 aa, Glycine max
  Coding DNA Sequence Number=SeqID_62307
MSRFTRDSPQISASPHQLDLAPYASEPYNAQWNAPGLLRDKHTLRSSRILREMELSRCKIHFLVDVFDFVVDLGIAFVDNWAVGKEKVCYWLSNDIVGLVGNLAV

SEQ ID NO: 153993 - protein, 143 aa, Glycine max
  Coding DNA Sequence Number=SeqID_62308
MPFRGLKNARKRAAFSTFFGKRDELAKRASCAKRAHQYSLYMSFRKRKCIGARPTAQYDTRRFHSFKAWTRYTDNVLGRHILVERKVEIYYTELDEFKAELERRNFHKHLTNLADNNIDLALVKEFYANLYSPEGPSPKQVRI

SEQ ID NO: 153994 - protein, 32 aa, Glycine max
  Coding DNA Sequence Number=SeqID_62309
NKEFEEAMNLEVVRLSTRYLLSYHLLDQVASE

SEQ ID NO: 153995 - protein, 94 aa, Glycine max
  Coding DNA Sequence Number=SeqID_62310
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=79%, HitCoverage=10%, E-value=5e-31, Identity=90%"; Hit description=DNA -directed RNA polymerase subunit beta'
MAVHVPLSLEAQAEARLLMFSHTNLLSPAIGDPISVPTQDMLIGLYILTSGNRRGIYSNRYNPRNWEILENLKKKEFEIIILPMMQLELINKKG

SEQ ID NO: 153996 - protein, 48 aa, Glycine max
  Coding DNA Sequence Number=SeqID_62311
FRAEVAWPGDWPEAPAEAPAEAPDEADEAHEDEEMTDLLDFLGGSRAT

SEQ ID NO: 153997 - protein, 97 aa, Glycine max
  Coding DNA Sequence Number=SeqID_62312
MIVDMLPVFYYGNGGLHTFKLCGFGLRRQKDQKGENEGETHAVTAIPIRPSVPPTQQCLYSVNNNPSPYPPPNYPQRPFLNQTTKPVYHTSNHEHHL

SEQ ID NO: 153998 - protein, 106 aa, Glycine max
  Coding DNA Sequence Number=SeqID_62313
GTSFVVQVEGTSTWVVVTENKRGYISCGSVLVEGTSTRLFKENKGGYIPCGSLLVKEFYKVEKKSQGPQPAGRLGTGFRHRLLSNQYKTLVFVFFFPTLFIFCYAL

SEQ ID NO: 153999 - protein, 178 aa, Glycine max
  Coding DNA Sequence Number=SeqID_62314
  Subcellular localization annotation: CTP_CleavageSite=80; ConfidenceScore=5.38e-01
MQSPSDLWSLRFLFNLVKSFTSKDPQGMYPPLFSLNNLMYVPSTKTDPQEMYPLLFSVTTTQVDVPSTCTTKDVPSNVLRQSSQAVSPLKLCEGGYKRYLRREKGDTKEFRRLVLRSFGKGRRETQKEFRRLVLDEFFLAKGDENKRYSTLLFSRFGKPENFRKLLQRKKKKKKFKKM

SEQ ID NO: 154000 - protein, 116 aa, Glycine max
  Coding DNA Sequence Number=SeqID_62315
MVIDQSLFFSLTHLPSQGAPFEGTIVDDWKFDYSSHDARRMVCNDQAEMTVTSFVYRKDRNGQWLKKDALPPQDERTPSPPPPCEDSALMNEVLSELRGLRSYVGDRFDSLDTRLP

SEQ ID NO: 154001 - protein, 125 aa, Glycine max
  Coding DNA Sequence Number=SeqID_62316
  Subcellular localization annotation: CTP_CleavageSite=57; ConfidenceScore=5.48e-01
MVRLLPLQDSLTSYTPSPSSMSIPVRPPDVAHTPSPPPIEARPSSSHVNARGPSLVPASTPSPSSIDACGPSPIPTSTPSPSSPMGNMPIDEAVVNLAMEDPSLNNCPMVTSKVEMDGNAIFYFN

SEQ ID NO: 154002 - protein, 249 aa, Glycine max
  Coding DNA Sequence Number=SeqID_62317
NGSKEASPKRVRKEATREGSNAAPQVDVEFDGHWRQWTQLAAPIAKYDPKIVMELYANAWPTEKGVRDKRSKRGNTTNSIRGGAKPRGSMRRPSVNSCVLRGRTSPEAWQGDGDHASQTPTRPEEVQQDTRVSSLDHGPLLVLWGAGEGPPAASRRYAAATSMHVTDQQATNLRGQVQLNESFYQYTLHQQSQDPSPFPWPTLEQFGATVAWPGDKPDFKARAGPAGAPGDEDGAQEDDDMADVMEYFL

SEQ ID NO: 154003 - protein, 213 aa, Glycine max
  Coding DNA Sequence Number=SeqID_62318
  Gene Ontology: Mol. function=protein dimerization activity
  Homolog annotation: Hit_ID=A5AW73; Match level="QueryCoverage=79%, HitCoverage=41%, E-value=4e-27, Identity=39%"; Hit description =Putative uncharacterized protein
MKILTELHLYKIGADHFGSDFAMAQRKTHSPRCERNWSVFEQIHSKKRNRLEHKRLHDLVFVKYNQQLKQRYNARDEIDPISLNDIDVCNEWLVEEMDQDDDNDLVFEDDDALNWATVYQASGVGECRMYTRRKKQKTTSVAAAQTSKKQAMVVGSSSRKQKAVQENDEDLDFEENIDLESEEEEIMINFEASDGEEGEGDDPLPYDNNEDDY

SEQ ID NO: 154004 - protein, 212 aa, Glycine max
  Coding DNA Sequence Number=SeqID_62319
  Homolog annotation: Hit_ID=Q84VH5; Match level="QueryCoverage=100%, HitCoverage=35%, E-value=1e-100, Identity=80%"; Hit description =Envelope-like protein
MDLIKAAGLLRTVTKLGDCYESLVREFIVNIPSDITNRKSDEYQKVFVRGKCIRFSPAVINKYLGRPTEGVVDIAVSEHQIAKEITAKQVQHWPKKGKPSAEKLSVKYAILHRIGTANWVPTNHTSTVATESFAVKLPIAFPTVLCGIMWSQHSNILNNIDSVKKRESPLSPAYQLFEGTHVPDIVSTSGKAAATGAVSKDALIAEPQDTCQ

SEQ ID NO: 154005 - protein, 142 aa, Glycine max
  Coding DNA Sequence Number=SeqID_62320
MTRNKKRLVVEEEDRVALDKQIVVNDGTEKKKEEEIEVEKENEEKEKVEKNKEGKEKSRSEKAGEKNKEKASNEDTEVPYPVVLSKKDKDRHLARFLDIFRKLYAFWGSFATNATLLEIFERYVDEEKQIHPPGESCCGRTS

SEQ ID NO: 154006 - protein, 282 aa, Glycine max
  Coding DNA Sequence Number=SeqID_62321
ATRPRLQRTACPLLSEDYMSSPSEDYTSSPSEGCTPSPSEDYTAAHPRLQRAAHPRLQRATCPRLLMAACPCLQRTTHPHLQRAARLHALAFRGLHALAFRGLHVPAFKGLHVLAFRGLHILAFRGLHALAFRGLHVLVFRGLHALAFRGLHVLTLKGQHILTFSGLHIHTLREFKGGQLCEHNQREAIVQPLCILGQDFTLATAKRRVWIMRTNMTTLTQIWMMLLLSNIPPGDHNADLPPRKDRARMTPSGPEEVQQDLGVSNSSYRPLTVLQGAHPHSK

SEQ ID NO: 154007 - protein, 66 aa, Glycine max
  Coding DNA Sequence Number=SeqID_62322
MKPKEDCKEERHGKHEKALSVILSLIATTSLAIMWKVLPEYTSFMASLTKRRKCKEDVFYVTFMPP

SEQ ID NO: 154008 - protein, 56 aa, Glycine max
  Coding DNA Sequence Number=SeqID_62323
MCQGKEFSGGEGKNQKNSQAVSPLNSLGKKEGRHKRIQTVSPSILLAKGEVNEEEE

SEQ ID NO: 154009 - protein, 40 aa, Glycine max
  Coding DNA Sequence Number=SeqID_62324
MAFVDNWVVGKEKGRYLSCQIPPPLGIFLEGFMLVFAHVL

SEQ ID NO: 154010 - protein, 72 aa, Glycine max
  Coding DNA Sequence Number=SeqID_62325
  Gene Ontology: Mol. function=aspartic-type endopeptidase activity; Biological process=DNA integration
  Homolog annotation: Hit_ID=A5AGE6; Match level="QueryCoverage=80%, HitCoverage=19%, E-value=5e-21, Identity=79%"; Hit description =Putative uncharacterized protein
MHVQTGIKRCNINENSSMLWHRRLGHISIERIKRLVKDGVLNTLDFADFKTCVDCIKDMDAPWSEIFYHLYR

SEQ ID NO: 154011 - protein, 91 aa, Glycine max
  Coding DNA Sequence Number=SeqID_62326
MYPILFSVTTTQVDVPSTYTTKGCTLQCVKTKFSGGEREESKEFSDCVILNSLKREKGDTKEFRRLVLRSFGKGRRETQKEFKRLVLGEFF

SEQ ID NO: 154012 - protein, 57 aa, Glycine max
  Coding DNA Sequence Number=SeqID_62327
KKGLRDRGSLVVEGFLNTREGLSPVWFKLCKMSLTKRVEKSQVGCLRTGRRHGKWLN

SEQ ID NO: 154013 - protein, 101 aa, Glycine max
  Coding DNA Sequence Number=SeqID_62328
  Subcellular localization annotation: CTP_CleavageSite=67; ConfidenceScore=5.10e-01
MLLNSNVIHVRVVMLVRMVPTRLFAAAQGKSCPGMHSRCVIASLSGCARTVGRPPISGGGPHMKLIVAFGTKRDNSCNLILSFANLSGNSLRVYILFDLVT

SEQ ID NO: 154014 - protein, 92 aa, Glycine max
  Coding DNA Sequence Number=SeqID_62329
  Homolog annotation: Hit_ID=Q2HW89; Match level="QueryCoverage=44%, HitCoverage=4%, E-value=4e-08, Identity=60%"; Hit description =Integrase, catalytic region; Ribonuclease H
GTSTWVVVTENKRGYISCGSVLVEGLYKVEKKSQGPQVAWGLDVGTGHLIQHGIEAMLPFEVKVPSLRILAKSGLEESEWAQTRFDQLNLIE

SEQ ID NO: 154015 - protein, 51 aa, Glycine max
  Coding DNA Sequence Number=SeqID_62330
  Subcellular localization annotation: CTP_CleavageSite=55; ConfidenceScore=5.37e-01
QREKGMKKMNSTSFQGLENQKNFGKLLAQSGRRRRRRRRRSSKRFKACKEL

SEQ ID NO: 154016 - protein, 149 aa, Glycine max
  Coding DNA Sequence Number=SeqID_62331
IDWAHLVRYRMHKALRANAPLPYSQLVTHFLCYFQIPLDDEPFVQVKRYFAIGAGAVTSFGYHKDRDGQWLKKDALPPQDERTPSPPPQRDDSSALMNEVLSELRGLRTYVGERCDSLDGRFEGMDTRITQLEEDVGYLRRCFDLPPPS

SEQ ID NO: 154017 - protein, 154 aa, Glycine max
  Coding DNA Sequence Number=SeqID_62332
  Subcellular localization annotation: CTP_CleavageSite=32; ConfidenceScore=5.19e-01
PANSLPSAVRQFSILNLIRRPMNSLPSIVHVSSTNEFGAPRIHCLALLANSLFSNLIRRPINSLPSAIHVASTNESGAPRIHCLTPANSLPSAASQFSILNFIRRPMNSLPSVVQVSSTIESGATRVHCLALLANSLFSNLIRRPMNSLPSAVH

SEQ ID NO: 154018 - protein, 103 aa, Glycine max
  Coding DNA Sequence Number=SeqID_62333
MKKKKIASYESRFDEEMSKIGRFGGKIDCNNINEIREERMQTQFYTGSATSRAYIQYSSNPLEISTIFVKSITKSEPHRDNPSLVFRNPLQQETHSLLTNLIE

SEQ ID NO: 154019 - protein, 121 aa, Glycine max
  Coding DNA Sequence Number=SeqID_62334
MLATGNRLLPSSNQLPESKTLWEWEESKEFSDCVVLNSLTREKGDTKEFRRLVLCSFGKGRRETQKEYRRLVLGEFFLEKGEENEKMNSTSFQGLENHKTSESFWYKEEEEVQRDSRLVKD

SEQ ID NO: 154020 - protein, 40 aa, Glycine max
  Coding DNA Sequence Number=SeqID_62335
FEKHVILWHHQNIQLDPLSTSMILEDKLKACQRSKKGLTE

SEQ ID NO: 154021 - protein, 65 aa, Glycine max
  Coding DNA Sequence Number=SeqID_62336
DSFEEQETQGSFVPHGRQDVLTTVIGRPEHPGCVRAAGAGVTIKQYFGSAPRTSRNSSSLPPEEL

SEQ ID NO: 154022 - protein, 105 aa, Glycine max
  Coding DNA Sequence Number=SeqID_62337
  Gene Ontology: Mol. function=protein binding; Biological process =xylan catabolic process
  Homolog annotation: Hit_ID=Q9SDM7; Match level="QueryCoverage=97%, HitCoverage=24%, E-value=2e-38, Identity=62%"; Hit description =Putative uncharacterized protein
  Pfam annotation: Domain name=LRR_1; Domain location=34-53; Score =10.8; E_value=3; Accession=PF00560.24; Description=Leucine Rich Repeat
  Pfam annotation: Domain name=LRR_1; Domain location=62-83; Score=5.8; E_value=26; Accession=PF00560.24; Description=Leucine Rich Repeat
  Pfam annotation: Domain name=LRR_1; Domain location=86-105; Score =9.6; E_value=5; Accession=PF00560.24; Description=Leucine Rich Repeat
  Pfam module annotation: Pfam domain module=LRR_1::LRR_1::LRR_1; Domain location=34-53::62-83::86-105
  Subcellular localization annotation: CTP_CleavageSite=53; ConfidenceScore=5.28e-01
MAKKGKVSVKVLTMSKAGIAGLGFQGTLPSVSANVEVLNVANNSISGTISPFLCGKENATNKLSVLDFSNNVLYGDLGHCWVHWQALVHLNLGSNNLSGVIPNSM

SEQ ID NO: 154023 - protein, 313 aa, Glycine max
  Coding DNA Sequence Number=SeqID_62338
  Homolog annotation: Hit_ID=Q2HW90; Match level="QueryCoverage=93%, HitCoverage=57%, E-value=2e-34, Identity=33%"; Hit description =Putative uncharacterized protein
MGPLQRQAFRKVYGKILDLTAAEVFTEAVVSLAQYYDQPLRCFTFGDFQMVPTIEEFEEILGCPLGGRKPYLVSGFLPSLSKIAAVVGDSEKELDCMKQTRNSVVGLPRKYLEGKARDMASQEKWGPFADILALLIFGVVLFPNVDGLVDLATIDAFLAYHHSKESPVVAILADLFNTFDRRCEKNNARIVCCFTHSLCVVDFTPIPTRHETPRVRFKSYRSCAEKGRVDWDQHLAGIGGSAISWFPRWKEGKEGVLFLGGDYPNVPLIGTRGCINYNPALAIRQLGYPMRGAPTEESLSPFLVRNLGAQNLK

SEQ ID NO: 154024 - protein, 512 aa, Glycine max
  Coding DNA Sequence Number=SeqID_62339
  Gene Ontology: Mol. function=transporter activity; Cellular component= periplasmic space; Biological process=transport
  Homolog annotation: Hit_ID=A8GC15; Match level="QueryCoverage=46%, HitCoverage=46%, E-value=1e-117, Identity=84%"; Hit description =Extracellular solute-binding protein family 5 precursor
  Pfam annotation: Domain name=ABC_tran; Domain location=1-163; Score =128.7; E_value=1.7e-35; Accession=PF00005.18; Description=ABC transporter
  Pfam annotation: Domain name=SBP_bac_5; Domain location=308-512; Score=28.8; E_value=2e-05; Accession=PF00496.13; Description =Bacterial extracellular solute-binding proteins, family 5
  Pfam annotation: Domain name=oligo_HPY; Domain location=166-233; Score=34.8; E_value=1.3e-07; Accession=PF08352.3; Description =Oligopeptidedipeptide transporter, C-ter
  Pfam module annotation: Pfam domain module=ABC_tran::SBP_bac_5::oligo_ HPY; Domain location=1-163::308-512::166-233
GGSITFDGQRIDALQGRALATLRRDIQFIFQDPYASLDPRLTVGFSIMEPLLVHRSMGRAQAEKRVAWLLERVGLLPEHAQRYPHEFSGGQRQRICIARALALNPKVVIADESVSALDVSIQAQIINLMLDLQREFGIAFLFISHDMAVVERISHRVAVMYLGQIVEMGPRQAVFEQPRHPYTKKLMAAVPVADPAHRHRERALMVDEIPSPIRPLGDEPEVAPLLEGAQDRDYRRTITMHHIMRKGVITAGLLSSALALPAWAAKDAVIAVASTFTTLDPYDANDTLSQAVAKSFYQGLFGFDKDMKLVNVLAESYQASSDGLTYTIKLRPGVKFQDGTDFNAEAVKVNLDRASNPDNHLKRYNLFKYIATTEVVDPSTVKITLKQPFSAFINNLAHPAAVMISPTALKKYGKDIGFHPVGTGPYTFDTWNQTDFVKVKKWSGYWKPGYPKLDSITWRPVVDNNTRAAMLQTGEASFAFPVPLEQAKLLQGNSKLDVVTTPSIMQRYISLN

SEQ ID NO: 154025 - protein, 106 aa, Glycine max
  Coding DNA Sequence Number=SeqID_62340
MSGFTRDSPQISASPHQLYLAPYASEPYNAQWNAPGLLRDKHTLRLNRILGKMEVDEPWLGLWLPLNYQVDMGASFFTAKFISWLVFWFMLKVVFVIGSAVGRLCG

SEQ ID NO: 154026 - protein, 75 aa, Glycine max
  Coding DNA Sequence Number=SeqID_62341
  Homolog annotation: Hit_ID=A2Q1R8; Match level="QueryCoverage=89%, HitCoverage=89%, E-value=3e-08, Identity=38%"; Hit description =Putative uncharacterized protein
MVRGQGWMVKLMCGNHNHELAKDKKTIIADMTKSMVKPRNIMLTLKEHNVNSCTTVKQIYNARSAYRSSIRGSDT

SEQ ID NO: 154027 - protein, 100 aa, Glycine max
  Coding DNA Sequence Number=SeqID_62342
MSFNKEDEESRCGGGEGVCSSGIGGGRSCLCTHWPSTSFRYPKEATTLAPIENKCLTLTKDGLSQFGDRFEEPLAKLNPPQRPKKDFWNVEAKLDKEYNA

SEQ ID NO: 154028 - protein, 67 aa, Glycine max
  Coding DNA Sequence Number=SeqID_62343
  Gene Ontology: Mol. function=catalytic activity; Cellular component =cellular_component; Biological process=metabolic process
  Homolog annotation: Hit_ID=Q9MB42; Match level="QueryCoverage=82%, HitCoverage=7%, E-value=4e-16, Identity=74%"; Hit description=Beta -amyrin synthase
LLNPTKFLGNIVVEHDYAECTGSAIQALVLFKKLYPRHRETEIKNSIANAVHGMEVGEFATFMALGG

SEQ ID NO: 154029 - protein, 280 aa, Glycine max
  Coding DNA Sequence Number=SeqID_62344
  Homolog annotation: Hit_ID=A5BUF0; Match level="QueryCoverage=80%, HitCoverage=60%, E-value=1e-11, Identity=25%"; Hit description =Putative uncharacterized protein
  Subcellular localization annotation: CTP_CleavageSite=38; ConfidenceScore=5.58e-01
MEESSKKRNGSSTSAAAHRTSRSGATGASPTPIPPSLSSSTLFSSNEQRIQYSSLFKSRQILDPKYLDLEFFDGKTFDCYQVFQNTSLIPFMSLKLPYYPELVRVFYSNLKIQDGTLISEVHGIPMIIDESLFFSLTQLPSQGAPFASTLVDEWKFDYFSHDARRMVCIDQADTAGRLLVGSLTFDCRIMHYIIVRILMPRSSNLAQASEEDFILMWAFLTGRPIDWAHLIRYHMHNTLRSGAHLPYPQLVTLLLRHFEIPLNFEPLVQVQRSFAIAASA

SEQ ID NO: 154030 - protein, 16 aa, Glycine max
  Coding DNA Sequence Number=SeqID_62345
VLLSGNQLPEDSNRFQ

SEQ ID NO: 154031 - protein, 24 aa, Glycine max
  Coding DNA Sequence Number=SeqID_62346
MEVVSPLRDCRDTHPEEAWSEKEA

SEQ ID NO: 154032 - protein, 57 aa, Glycine max
  Coding DNA Sequence Number=SeqID_62347
MEGTSFVVQVEVLVEGTSTRFKENKGGYIPCGSLLVKGFLQGWKRNLKDRRSLGDWM

SEQ ID NO: 154033 - protein, 80 aa, Glycine max
  Coding DNA Sequence Number=SeqID_62348
MVRNQLSSFKSYLELGLSPANTRSAKLDGCNLLLLIARTWPTIMVGHLFSLRVEQCRLSSVFECDREPYRNCTDIALGRQ

SEQ ID NO: 154034 - protein, 19 aa, Glycine max
  Coding DNA Sequence Number=SeqID_62349
DLCNRLQLLKFELKRLLTA

SEQ ID NO: 154035 - protein, 92 aa, Glycine max
  Coding DNA Sequence Number=SeqID_62350
MEAMKDQMTTMMEAMMSMRKMMEVNVVVSSLQVPPLRASILSHNMACLPTMHHPMLYMGMMRMLTTPLLYPSRAKQPSVWACACRLTHGGDA

SEQ ID NO: 154036 - protein, 104 aa, Glycine max
  Coding DNA Sequence Number=SeqID_62351
MAEMGKLDHLEERLRASEGGEDYAFANLEELFLVPNIITPPKFKVLDFDKYKGTTCPKNHLKIERINVGPKKGKFDHPTRTTEKTGANKEGEKEGETHVVTAIP

SEQ ID NO: 154037 - protein, 93 aa, Glycine max
  Coding DNA Sequence Number=SeqID_62352
  Subcellular localization annotation: CTP_CleavageSite=77; ConfidenceScore=5.35e-01
MLVRMIHTRLLAAARVKSCPGMHSRCVIASLSGCARTVGRPPISGSSPGTVERKPWPPTLKMRTRSPLKARACSPLQARMCSPLMPRTYGPLK

SEQ ID NO: 154038 - protein, 117 aa, Glycine max
  Coding DNA Sequence Number=SeqID_62353
  Homolog annotation: Hit_ID=A5AY60; Match level="QueryCoverage=84%, HitCoverage=6%, E-value=1e-09, Identity=36%"; Hit description =Putative uncharacterized protein
MAGIDLGPLIGGGDIRKVGDGSIVNFWKDKWLGAVSNLEQQFNQLFLISKQQTSSISNMGNMSHGHWCWDLKWRRNLFDHEQGAAVAFMETISNVHIQPHMKDTLSWTAESSGLYST

SEQ ID NO: 154039 - protein, 48 aa, Glycine max
  Coding DNA Sequence Number=SeqID_62354
EWRRKRERRCHFKEKMSLEEAHHHKRPWIRAWKKKEMNEGRGREEHRI

SEQ ID NO: 154040 - protein, 99 aa, Glycine max
  Coding DNA Sequence Number=SeqID_62355
PEHDSTQRLTSSSAPFVNRSLSPLTRRDLYRLLHPLSIAAEIPYGHPRLSSTEGNGFDGIRMINIQAQRRARFFSAGQGRSSAMAKGIVVVLLAGILAG

SEQ ID NO: 154041 - protein, 43 aa, Glycine max
  Coding DNA Sequence Number=SeqID_62356
MSHKELIKIFGMENSKHLATPMSTSCYLDKDESGQPVDAKQYR

SEQ ID NO: 154042 - protein, 78 aa, Glycine max
  Coding DNA Sequence Number=SeqID_62357
MDEEVGTGEEEGVGAFDGAEVEGASDLLPLAFLGPLKVTGDLVGDEVPHIHVHLHDDAINESGSVKSDIKSVGSGNKV

SEQ ID NO: 154043 - protein, 66 aa, Glycine max
  Coding DNA Sequence Number=SeqID_62358
MTQAEKKTCPALQWKALAEVEWALRPLECRPPGPTKAPGLQRPHLLPKEKAGLLARPPSVKTPPRS

SEQ ID NO: 154044 - protein, 98 aa, Glycine max
  Coding DNA Sequence Number=SeqID_62359
MVNLCLMAKNYESDKEVSLKKKWYIDSGCSKHMTGDSSKFTHISPKKSNPCGVYPDLSSFTGSGVYPDLSSFTGSGVIQKFYSLYQAIRPVRFTSYRV

SEQ ID NO: 154045 - protein, 72 aa, Glycine max
  Coding DNA Sequence Number=SeqID_62360
MAEINQSKTMTGHDWPRIFVSYFKFKLGETLTHEKGGDMVNVPLKKKKVAETAWESPNRCPNVIPSLETQTF

SEQ ID NO: 154046 - protein, 57 aa, Glycine max
  Coding DNA Sequence Number=SeqID_62361
MVVSFFLTHLLLEVASPIIFLPSPFYCHDLQEAKDSIDEEDPRPTSSNGVTPCGSIT

SEQ ID NO: 154047 - protein, 127 aa, Glycine max
  Coding DNA Sequence Number=SeqID_62362
RQVQGDAPQAADAPPPHQAGPAGLFDTEQYLRYLVRQQAANHWAHVQTHDCLYQMSLSLQSQGFTSFSCPTPDQFRAEVAWLGDWPEAQAGEAPVGAPAEAPDEADEAREDEEMTDLLDFLGGSGAT

SEQ ID NO: 154048 - protein, 76 aa, Glycine max
  Coding DNA Sequence Number=SeqID_62363
MRLTRRGRIILGHGQKSRRVDGRNQPRYLGTDANGGQGHDQPIVVPSQRWASGERRCKAAQYPLNSQYFITIVCFK

SEQ ID NO: 154049 - protein, 215 aa, Glycine max
  Coding DNA Sequence Number=SeqID_62364
MNLIIVNRKEHALRCPYRTYARARVMGEVEEVQEQMKADMEAMKVQMATMMEAMMSMKKIMEANAVAIAATRDVAKVNLMPPSDLNQMNHPTSGMVGKDLGSTDDPMMCKFKMSTPSRHMACLPTIHHPMWCTLPMRMSITPLPYSLRADKPKLIMHMSLKPWRRHMKFPTTIQPTPSLASDMPLKGKQLVIYPCKTLWRALSITNNYTLAFHSG

SEQ ID NO: 154050 - protein, 143 aa, Glycine max
  Coding DNA Sequence Number=SeqID_62365
  Subcellular localization annotation: CTP_CleavageSite=42; ConfidenceScore=5.04e-01
RVSDLSSFTGSGVYPDLSSFSGSGVYPDLSSFIGSGVYPDLSSFTGSGVNQKLYGLYQAICPVRFLGMDSLFEDTTITYVRCISFNNFECLRNWEIQTFDRLDFDFDVFDNLRAFFRLNDITFHSYCPKGPVKAVLYLSNSWI

SEQ ID NO: 154051 - protein, 56 aa, Glycine max
  Coding DNA Sequence Number=SeqID_62366
MLHPYEINIGLKEHSNCVTPKAYTPKSPSGPLPPNSGFLQWIPSQYSSPLKGLTIV

SEQ ID NO: 154052 - protein, 26 aa, Glycine max
  Coding DNA Sequence Number=SeqID_62367
MGSGRFQVSVPVPLYLSKSNTLNLGG

SEQ ID NO: 154053 - protein, 128 aa, Glycine max
  Coding DNA Sequence Number=SeqID_62368
MPLGGRIASECKVIFTRRQRRKNAEKEKRAEGLLEDVSNEEGENNKREEGDEEKEESKERGEKVLPTKTKSQLAREARRETPAAPVKDTPYPLVPSKKEREHYFARFIGIFKKLEITIPFGEALQQMP

SEQ ID NO: 154054 - protein, 65 aa, Glycine max
  Coding DNA Sequence Number=SeqID_62369
LDPQGFPSFACPTPDQFRAEVAWPGNWPEAHAREAPAKAPGDGKEARMDEEMTDLLDFLGGSGAP

SEQ ID NO: 154055 - protein, 91 aa, Glycine max
  Coding DNA Sequence Number=SeqID_62370
MNSWGLRIRLRMENCKTALGNEFAGLQTRCWRPHEQRKAMNSRCSRLVGGGHMNSTRQLIHGSPNKIENGELANSARQCICGDPDSMVEDT

SEQ ID NO: 154056 - protein, 91 aa, Glycine max
  Coding DNA Sequence Number=SeqID_62371
APVSLAFARPRRARCDNPLLVPQRMYPPMERSDYVVLNSLKREKGDTKEFRREKRKKKMNNTLLFSRFGKPKNLRKLLAKEEGEEVQEDVQ

SEQ ID NO: 154057 - protein, 183 aa, Glycine max
  Coding DNA Sequence Number=SeqID_62372
VVVSPPKPPPKPDPEVDDPLYLMTLTIPKLFLRPYQHEDLSEIAHGGQCLSISVLQLWILHLTETCMRAGNSDIYGFLEPQSIQRSGQSQFESESYIKSCMQSSQRDVYLGAYLNGPDNYLKGIINSAIKGLDDAPQPKSKAPARWIVVKMSTIILGTFRNNWEAYFNDPRSLEPERLKALQI

SEQ ID NO: 154058 - protein, 59 aa, Glycine max
  Coding DNA Sequence Number=SeqID_62373
RVDFVADLGVTFVADWTFLVGRVVSNGQDWYWLSSDIVGEDIGTWDYKELVESLAMREL

SEQ ID NO: 154059 - protein, 88 aa, Glycine max
  Coding DNA Sequence Number=SeqID_62374
MMQAPLELVGLDEWQRNEERERERRRHFKEKMSLEEAHHHRRPWIRAWRKKEMNEGRGREEHEILCSKRALKSEVNIQMIKVEKNAHT

SEQ ID NO: 154060 - protein, 106 aa, Glycine max
  Coding DNA Sequence Number=SeqID_62375
MIEVNTTTVVAKCTATEVDPTHPSGLNQVNSPVSDMVGQGGEALGRHDQEQGHPLEGLGGPMTRARARKAKEGLQQVLSILFEYKPKFQGEKSKVVSCIMAQMDED

SEQ ID NO: 154061 - protein, 105 aa, Glycine max
  Coding DNA Sequence Number=SeqID_62376
MSGFTRNSPQISASPHQLDLAPYASEPYNAQWNAPGLLRDKHTLRSSRILGEMEVDEPWLGLWLPLNYQVDMGSSLAYDNGIWGEPYRLFAAKFTSCCAVDRLCG

SEQ ID NO: 154062 - protein, 86 aa, Glycine max
  Coding DNA Sequence Number=SeqID_62377
MTSKELNEEPYEVKISCTKHVKCVANPNNESFVRELEQATMRQKIFFLKEIRFGTTICPRSNMERISEVFLDFVRVNKQFEMPRLF

SEQ ID NO: 154063 - protein, 69 aa, Glycine max
  Coding DNA Sequence Number=SeqID_62378
MEYFRSWIAFGGSNPARLGELGGNLLPLFPIKRLKGAVLRVPDPPGDVFQLFRVKKIIFVKKIQAEVLP

SEQ ID NO: 154064 - protein, 108 aa, Glycine max
  Coding DNA Sequence Number=SeqID_62379
MDGQWLKKDVQPPQDEHTPSPPPQRDDSSALMHKVLSELRGLRTYVGERFDSLDGRIDAIDACFEGMDTRITQLEEDELSCHQEDHALLKFNSRQESKKFKIYDQDNL

SEQ ID NO: 154065 - protein, 77 aa, Glycine max
  Coding DNA Sequence Number=SeqID_62380
EAVATPERSRKGTSDPPTPVVDLSSPQHTADPSTPILEISEDPTTPVLTLNTSPPTTPVLYLIDKEDVQTQDTQDQS

SEQ ID NO: 154066 - protein, 101 aa, Glycine max
  Coding DNA Sequence Number=SeqID_62381
MVVILPKEHLVVWFCSLHNRPDNYLKGIINSALKGLDDAPQPKSKASASYYVMHWMSTIILGTFRNNWEAYFNDPKPLEPERLKALRIQWAQFYLQVRDQA

SEQ ID NO: 154067 - protein, 35 aa, Glycine max
  Coding DNA Sequence Number=SeqID_62382
MSWQEELERNQKASGSKSDGCARQVKEVACPICTV

SEQ ID NO: 154068 - protein, 116 aa, Glycine max
  Coding DNA Sequence Number=SeqID_62383
  Subcellular localization annotation: CTP_CleavageSite=30; ConfidenceScore=5.40e-01
MYPLLFSVTTTQVDVPSTCTTKDVPSNVLRQSSQAVSPLNLCERETKDISGGRRETQKNSGEQGLETKKFRKLFGKGRRRKMRSKRFQDFSKVVQEILKVVRVVSHLEMQVKVLLL

SEQ ID NO: 154069 - protein, 168 aa, Glycine max
  Coding DNA Sequence Number=SeqID_62384
  Gene Ontology: Mol. function=endonuclease activity
  Homolog annotation: Hit_ID=Q9AY32; Match level="QueryCoverage=37%, HitCoverage=95%, E-value=9e-27, Identity=96%"; Hit description=RRNA intron-encoded homing endonuclease
KKLVVGPWVGSIGPPPVCTGRLVPSAGDALLSLTGRVVPPHGITPQDSDPIVLAFGIGVMINRDSRGHSYFIVRERKLGARRRSDTVLVSTINDADQGSADVAFRTPLAPYEKSKSLGSGGSMVARLKLKGIDGRAPPGVEPAAYFDSTRGNLPGPDIVRIDRLRALS

SEQ ID NO: 154070 - protein, 148 aa, Glycine max
  Coding DNA Sequence Number=SeqID_62385
MWAFLTGRQIDWAHLVWYRMHKALLANAPLPYPQLVTLFLRHFQISLDDEPLVQVKRSFAIGVGAVTSFGYRKDQNDERTPSPPPQQDDSALMTEVLSELRGLRTYVGEHFDSLDNRFADMDIRLTQLEEDVGYIRQSFDLPPPPPPS

SEQ ID NO: 154071 - protein, 88 aa, Glycine max
  Coding DNA Sequence Number=SeqID_62386
MSVLELYIEKDVAGDSMFDFANSVTSCGHNLSHNESELPRNISNLHDDEDDDYLASNSYVEESLDEMMRILKLTKYRLKAKWRRAKAQ

SEQ ID NO: 154072 - protein, 248 aa, Glycine max
  Coding DNA Sequence Number=SeqID_62387
  Gene Ontology: Mol. function=helicase activity; Biological process =viral genome replication
  Homolog annotation: Hit_ID=Q2QZU2; Match level="QueryCoverage=98%, HitCoverage=15%, E-value=1e-61, Identity=44%"; Hit description=AT hook motif-containing protein, putative, expressed
MANGKCFRFFPKKFQPATIVDQDGFPVYRRRDTRRIVQKQGVHLDNRFVVPYSPHLLLKYRTHLNVEWCNQSTSIKYLFKYINKGSDRITTAIVNDQNQDGTQNQVHDEIKHYLDCRYVSAPEACWKIFAFPMHGRAPAVERLYFHLENQQPVYWKDSQEIGTVLAKSTIKESICWKPRKQGNTIGRLIWVPPSSGELFYMRMMLSSAKESQCYEDIRTVENVVYHTFREACFAKVFLGSDQEFVGAL

SEQ ID NO: 154073 - protein, 115 aa, Glycine max
  Coding DNA Sequence Number=SeqID_62388
MGDQEETQEQMKADMSALKEQMASMMEAMLGMRQLMENNVATAAAVSSAAEADPTLPATAHHPPPNAVGRERSTLGHISNPHLGYNRVAYPYGLPPNYMPPVMRDDVGHVPSPVL

SEQ ID NO: 154074 - protein, 29 aa, Glycine max
  Coding DNA Sequence Number=SeqID_62389
MEMQRKTKEKRLGSFLEKLSEENFLEKLL

SEQ ID NO: 154075 - protein, 93 aa, Glycine max
  Coding DNA Sequence Number=SeqID_62390
  Homolog annotation: Hit_ID=A5AYU6; Match level="QueryCoverage=59%, HitCoverage=9%, E-value=3e-11, Identity=54%"; Hit description =Putative uncharacterized protein
MEKSEKKNINEKKLMKAYITWDENDMESSEDSENEEINLCLMAKSYESDEEEPLKKKWYIDSGCSKHMTGDESKFTHISPKKSGHVTYGDNNK

SEQ ID NO: 154076 - protein, 30 aa, Glycine max
  Coding DNA Sequence Number=SeqID_62391
FETHVNLWHHQNIQLDHLSTVYVIFCEYVR

SEQ ID NO: 154077 - protein, 44 aa, Glycine max
  Coding DNA Sequence Number=SeqID_62392
MEVEEPWLGLWLPLIYRVDMGASQHRTLELGTAYVDNWVVGKEE

SEQ ID NO: 154078 - protein, 84 aa, Glycine max
  Coding DNA Sequence Number=SeqID_62393
MGLDDAPLPKLKALARWIVVKCNRQKGSTECDYYVMHWMSTIILGSFRNNWEAYFNDAGLLEPERLKVLRIQWAQYYLRVRHQS

SEQ ID NO: 154079 - protein, 94 aa, Glycine max
  Coding DNA Sequence Number=SeqID_62394
MRGIVHEPQVILGANQKFPTSNIQSCGFGMTDPLDESISCFLIRVNPWVLVPSPPEDYMSSPSEDYTSSPSEDYTSSPPDDFTSSPSEDYTSSP

SEQ ID NO: 154080 - protein, 146 aa, Glycine max
  Coding DNA Sequence Number=SeqID_62395
  Homolog annotation: Hit_ID=UPI00006A2D9E; Match level="QueryCoverage =97%, HitCoverage=79%, E-value=1e-10, Identity=17%"; Hit description =UPI00006A2D9E related cluster
MTDPLNESISCFLIRVDPWVLEPLAFRGLHVLTFRGLRTLAIRGLHALTLRGLHVLAFRGLHALTCRGLHVLAFRGLHVLDLRGLHVLTFRGLHALAFRGLHALTFRGLHILTFRGLHALAFRGLHILTFRGLRTLTFKGLHAGIL

SEQ ID NO: 154081 - protein, 50 aa, Glycine max
  Coding DNA Sequence Number=SeqID_62396
MATPMSTACYLDKDETSQSIDVIAISRLYAILKIAPCNLIGYYELLTYSF

SEQ ID NO: 154082 - protein, 38 aa, Glycine max
  Coding DNA Sequence Number=SeqID_62397
MWTTTGDELATQLAQASKVASSRSNCLLEEETGRPKWA

SEQ ID NO: 154083 - protein, 102 aa, Glycine max
  Coding DNA Sequence Number=SeqID_62398
MTRGNPSDLQPFDPEIDRTFHRLVRHHHLPFEHPEHSVIGETEHFVVDNFEHPDFEHYSFEHSENMTQPLPRERTLREMAAPDFTYESLCIQYLDEDVRICS

SEQ ID NO: 154084 - protein, 591 aa, Glycine max
  Coding DNA Sequence Number=SeqID_62399
  Gene Ontology: Mol. function=nucleoside-triphosphatase activity; Cellular component=cytoplasm; Biological process=protein metabolic process
  Homolog annotation: Hit_ID=P0ABI1; Match level="QueryCoverage=99%, HitCoverage=77%, E-value=0.0, Identity=90%"; Hit description=ATP -dependent Clp protease ATP-binding subunit clpA
  Pfam annotation: Domain name=AAA; Domain location=41-235; Score=73.3; E_value=8e-19; Accession=PF00004.20; Description=ATPase family associated with various cellular activities (AAA)
  Pfam annotation: Domain name=AAA_2; Domain location=318-479; Score =305.8; E_value=8.1e-89; Accession=PF07724.5; Description=ATPase family associated with various c
  Pfam annotation: Domain name=AAA_3; Domain location=322-459; Score= -11.1; E_value=0.0055; Accession=PF07726.2; Description=ATPase family associated with various
  Pfam annotation: Domain name=AAA_5; Domain location=322-484; Score =26.0; E_value=3e-05; Accession=PF07728.5; Description=ATPase family associated with various
  Pfam module annotation: Pfam domain module=AAA::AAA_2::AAA_3::AAA_5; Domain location=41-235::318-479::322-459::322-484
MENFTTNLNQLARVGGIDPLIGRDKELERAIQVLCRRRKNNPLLVGESGVGKTAIAEGLAWRIVQGDVPEVMKECTIYSLDIGSLLAGTKYRGDFEKRFKALLKQLEQDNNSILFIDEIHTIIGAGAASGGQVDAANLIKPLLSSGKIRVMGSTTYQEFSNIFEKDRALARRFQKIDITEPSVEETVQILNGLKPKYEAHHDVRYTAKAVRAAVELAVKYINDRHLPDKAIDVIDEAGARARLVPVSKRKKTVNVSDIESVVARIARIPEQSVSATDRDTLKNLGDRLKMLVFGQDNAIEALTEAIKMSRAGLGQERKPVGSFLFAGPTGVGKTEVTVQLAKALGIELLRFDMSEYMERHTVSRLIGAPPGYVGFDQGGLLTDAVIKHPHAVVLLDEIEKAHPDVFNLLLQVMDNGMLTDNNGRKADFRNVVLVMTTNAGVRETERKSIGLIQQDNSTDAMEEIKKIFTPEFRNRLDNIIWFRHLDTQVIHQVVDKFIVELQAQLDAKGVSLEVSDDARDWLAEKGYDKAMGARPMARTVQENLKKPLANELLFGSLVDGGSVSVGLDKEKNQLTYHFMSAEKRKTEGTVH

SEQ ID NO: 154085 - protein, 780 aa, Glycine max
  Coding DNA Sequence Number=SeqID_62400
  Gene Ontology: Mol. function=pyruvate dehydrogenase (cytochrome) activity; Cellular component=plasma membrane; Biological process =amino acid metabolic process
  Homolog annotation: Hit_ID=A4TN52; Match level="QueryCoverage=73%, HitCoverage=100%, E-value=0.0, Identity=80%"; Hit description =Pyruvate dehydrogenase
  Pfam annotation: Domain name=Beta_elim_lyase; Domain location=572 -780; Score=264.6; E_value=2.1e-76; Accession=PF01212.12; Description= Beta-eliminating lyase
  Pfam annotation: Domain name=TPP_enzyme_C; Domain location=380-526; Score=200.2; E_value=5.2e-57; Accession=PF02775.12; Description =Thiamine pyrophosphate enzyme, C-termina
  Pfam annotation: Domain name=TPP_enzyme_M; Domain location=191-319; Score=174.5; E_value=2.8e-49; Accession=PF00205.13; Description =Thiamine pyrophosphate enzyme, centra
  Pfam annotation: Domain name=TPP_enzyme_N; Domain location=3-172; Score=271.9; E_value=1.3e-78; Accession=PF02776.9; Description =Thiamine pyrophosphate enzyme, N-term
  Pfam module annotation: Pfam domain module=Beta_elim_lyase::TPP _enzyme_C::TPP_enzyme_M::TPP_enzyme_N; Domain location=572-780::380 -526::191-319::3-172
MKQTVAALLAKTLESAGVKRIWGVTGDSLNGLNDSLNRMGTIEWMPTRHEEVAAFAAGAEAQISGELAVCAGSCGPGNLHLINGLFDCHRNHVPVLAIAAHIPSSEIGSGYFQETHPQELFRECSHYCELVSNPEQLPQVLGIAMRKAILNRGVSVIVLPGDVALQAAPENARSEWYPPQLPQVVPSVSELTRLAETLNEAKNITLMCGSGCAGAHAEVVKLAETLKAPVVHAMRGKEHLEYDNPYDVGMTGLIGFSSGYHAMMNADTLVLLGTQFPYRPFYPADARIIQIDINPASLGAHSHVDIALVGDIKATLQALQPQLTSHSDRHHLDRALEHYADARKGLDDLATANDKQAIHPQYLAQQISHYAADDAIFTCDVGTPTVWAARYLKMNGKRRLLGSFNHGSMANAMPQALGAQAIDKQRQVVALCGDGGFSMLMGDFISLAQLKLPVKLVIFNNSVLGFVAMEMKAGGYLTDGTDLENPDFAAIATACGIKGIRVEKASELDGALQQAFAHDGPVLVDVITAKEELSMPPQIKAEQAKGFSLYMLRAILNGRGDEIVELAKTNWLRDTVTRPSAAMLDAMMAAETGDDVYRDDPTVNALEAEAARLSGKAAALFFPTGTQANLVALLCHCQRGDEYIVGQQAHNYKYEAGGAAVLGSIQPQPILAAADGTLPLHDVAAAIKPDDMHFARTRLLSLENTHHGKVLPLSYLEQAWQFTRERQLALHIDGARIFNAVVAQGVQLIDIARYCDSLTICLSKGLGTPVGSLLVVRRLY

SEQ ID NO: 154086 - protein, 358 aa, Glycine max
  Coding DNA Sequence Number=SeqID_62401
  Homolog annotation: Hit_ID=Q0F0I7; Match level="QueryCoverage=28%, HitCoverage=96%, E-value=9e-37, Identity=76%"; Hit description =Putative uncharacterized protein
  Pfam annotation: Domain name=DUF74; Domain location=253-358; Score =227.2; E_value=3.6e-65; Accession=PF01906.8; Description=Domain of unknown function DUF74
  Subcellular localization annotation: CTP_CleavageSite=67; ConfidenceScore=5.24e-01
MPTFWRSSRIALSDGVWLKSKWLPAICRLPERGSSSRLSTRRSELLPAPLGPSNTSVSPCGQASKSVAQNRAGQRGKGLTGKRRLLRGSLAAPQWCGALMVAAECGKNARLFFLFQQLAERAATGVWPVADVAHIIHHPAGRWPRQRRWALCQAGEQIALPPRCRWVALAAGMQQFLIQVVAQVRAIFCQRGAVRQSLGTQQQCSGNKQRKGFVSHLDFLIVHWQSAIFSIEYSRAFTPYELSPHESPQERTMKFSTTPTLEGHSITEYCGVVTGEAILGANIFRDFFAGIRDIVGGRSGAYEKELRKARQIAFEELEEQAKALGANAVVGIDIDYETVGKDSSMLMVSVTGTAVIVR

SEQ ID NO: 154087 - protein, 131 aa, Glycine max
  Coding DNA Sequence Number=SeqID_62402
  Subcellular localization annotation: CTP_CleavageSite=42; ConfidenceScore=5.12e-01
KLRSVGKKKTNARIYTGSATTRAYIQSPSDPRSLIFLFNLIKAFASKDPQGMYPPLFSVTTTQVDVPSTCTIKDVPSNVLRQSSQAVSPLKLCERETKDISGEQGLETKKLRKLLAKEEEEEAQEDAQKVM

SEQ ID NO: 154088 - protein, 106 aa, Glycine max
  Coding DNA Sequence Number=SeqID_62403
  Homolog annotation: Hit_ID=A5AWV0; Match level="QueryCoverage=79%, HitCoverage=5%, E-value=1e-09, Identity=38%"; Hit description =Putative uncharacterized protein
MQSSKRNVYLGAYLNGRHWQMVVIVPKEHLVVWFCSLHNRPDNYLKGIINIALKGLDDAPQPKSKAPTRWIVVKCNRQKGSTECGYYVMHWMSTTILGSFKNNWEV

SEQ ID NO: 154089 - protein, 92 aa, Glycine max
  Coding DNA Sequence Number=SeqID_62404
MMTKVMTKSSKINQRTTQNNSRVQDKNLEEFKTQEESLESRIKIQGSRSQESRFKVQDLKNQNQDSRLKIQESREGSIKISMKSFSQKLNST

SEQ ID NO: 154090 - protein, 58 aa, Glycine max
  Coding DNA Sequence Number=SeqID_62405
MTGVIKLLVVNNGALKSVEDDKEGRIGVGDAPVAPGRGVLVAAAEVDEPLRFQDDSSI

SEQ ID NO: 154091 - protein, 137 aa, Glycine max
  Coding DNA Sequence Number=SeqID_62406
MGGEQAQSPKTNEHPVEEESIINNDATTVEVPHVPNEGAKIVEDAGLKAANQDGLDEALESTRSENDAASQACKRAPGLNCFKNGGKPQYRVLDDVPALEDLVTNILEYGQIWKGDGLFDSGLDGENGVILSARHYK

SEQ ID NO: 154092 - protein, 75 aa, Glycine max
  Coding DNA Sequence Number=SeqID_62407
MEEIHGEEDEGQGIKMKMLSIPHDIAPCGACRPWIFFINGVSYFLKINDSRIEKEERLLETPLQGEDESRTSLPP

SEQ ID NO: 154093 - protein, 44 aa, Glycine max
  Coding DNA Sequence Number=SeqID_62408
VKKRLSFETQKVAVGLSAYPPLSAASARLAQRRIWQSISIQAVC

SEQ ID NO: 154094 - protein, 75 aa, Glycine max
  Coding DNA Sequence Number=SeqID_62409
MWLKGVKTLWFCLEIAMNALSAPAAFSMFITTVKILDFQMNALSGPCRAKRAKCALCAKPECHSDEPELSAPMLH

SEQ ID NO: 154095 - protein, 77 aa, Glycine max
  Coding DNA Sequence Number=SeqID_62410
MAQPPPRERTLREMAAPDFTYESLCIQYPNEDVPYCRNLPFGGRATHGSRVRVPRKEYAQSRHQRLFEENVGKPEKT

SEQ ID NO: 154096 - protein, 86 aa, Glycine max
  Coding DNA Sequence Number=SeqID_62411
MTGLRRSKVRLSETSPLALHNVVIRAGNLSLEVLDWAIEVIWPKISVPMFISKRETRPKINLALSTVKSKVCDVGAKLEYKRTLHT

SEQ ID NO: 154097 - protein, 77 aa, Glycine max
  Coding DNA Sequence Number=SeqID_62412
  Subcellular localization annotation: CTP_CleavageSite=25; ConfidenceScore=5.27e-01
MDMIVCPKFYFNVHLWTWWSFCDNRASRRSKTRACASPQFLSKFFFDPTRTDGSAIVFQIFVVIFSLTDGTNVQYGR

SEQ ID NO: 154098 - protein, 131 aa, Glycine max
  Coding DNA Sequence Number=SeqID_62413
MERSMIDAASGGALGDMTPAEARNLIEKMASNSQQFSARNYAIVIRGVHEVVTNSSSSAETKKLEGKLDALVNLVTQLAMNQKSTPVARLCGLCSSTDHHADLCPSVQQSEAIEQPEAYAANIYNRPSQPQ

SEQ ID NO: 154099 - protein, 183 aa, Glycine max
  Coding DNA Sequence Number=SeqID_62414
  Homolog annotation: Hit_ID=Q84VH5; Match level="QueryCoverage=100%, HitCoverage=28%, E-value=5e-70, Identity=75%"; Hit description =Envelope-like protein
MATSPKETSAPGSPSAPSNQERLEFNIQPIQMIPGQAPVPEKLVPKRQQGVKISENPSLATSPREVDTEMDKKIRSIVSNILKNASVPDADEDVPTSSTPDVTVPDAEKDVPTSSTPNTEVLSSPSKEESTEEEDQATQETPAPRAPEPAPCDLIDLEEVESDEEPIANKLAPGIAERLQSRK

SEQ ID NO: 154100 - protein, 170 aa, Glycine max
  Coding DNA Sequence Number=SeqID_62415
  Gene Ontology: Mol. function=nucleic acid binding
  Homolog annotation: Hit_ID=A5AYU6; Match level="QueryCoverage=38%, HitCoverage=11%, E-value=2e-14, Identity=53%"; Hit description =Putative uncharacterized protein
MEKSEKKNINEKKLKKAYITWDENDMESSEDSENEEINLCLMAKSYESDEEEPLRKKWYIDSGCSKHMMGDESKFTHISPKKSGHVTYGDNNKGRILGVGKIGTNSYTGSATSPTYVQSSRNPLEIFHYLYKSFTVFEHTLGSLTLVFNNLISQETNSLLITTEFMRCTD

SEQ ID NO: 154101 - protein, 90 aa, Glycine max
  Coding DNA Sequence Number=SeqID_62416
IYTRFSSNFSQHQLDLAPYASEPYNAQWNAPGLLHDKHTLRSSRILEEMEVEDLGGVMATIKYRVDMGANFVVDLGMAFVDDWVMGNEKG

SEQ ID NO: 154102 - protein, 222 aa, Glycine max
  Coding DNA Sequence Number=SeqID_62417
RGYIYLGCCTKNKRGYISCGLVQVEGTSTWFFKENKGGYIPCGSLACKGFYKVERNLKNRWLVRARPSDIPSTAAAPAPTSVAPSVLAHVDSQRLKPCFKISIMDRFYCYRVYMWEGEGPTAQVPQQVQDASSETTLLEPFTLHPEAGEEQARPETAATPERSLEGTLEPHTPAADLSSPQPAADPSTPLLDIPKDQTTPVLAQNTSRPATPVLHLTDEEDS

SEQ ID NO: 154103 - protein, 65 aa, Glycine max
  Coding DNA Sequence Number=SeqID_62418
MLRASMFNFERPDMMQSYPARALDRKLQVDWARDAREGPRVLMSLRVGYPRNIGFFSPCILGHLD

SEQ ID NO: 154104 - protein, 78 aa, Glycine max
  Coding DNA Sequence Number=SeqID_62419
MGGACWASGSMVAVGGGGLEDEGMSSALALFLEAIFMGAQRTGSLSSVTAAKKFAWRGDIGLVRNYQLNIKIFYVTWA

SEQ ID NO: 154105 - protein, 102 aa, Glycine max
  Coding DNA Sequence Number=SeqID_62420
MAGAGDNGGVYHQLDGFQRLLLDAMTTQMQRLLKRNNEELYRRIEGLEHQINPNAGRPYGGNRRVNDGSNRIEVQDRIEGVKLNVSFFKGRRDPDTYLTWEV

SEQ ID NO: 154106 - protein, 232 aa, Glycine max
  Coding DNA Sequence Number=SeqID_62421
MAMLKEGLTKDMGKWLLAKRARKDVSVEGSSAPLQVDVEFDGHRFRSEEHQRRFEAIKGWSFLKERRQWTQLTAPMAKYNLEITMEFYANAWPMKRELETSTPRRSQASRFDKEAISQLLCVLGQDFAWSVAGRWVGTTAVGGGLAAASHRCIAAAFTGDTIPIVHLRSPMEDRALDADLNETFYNYTMHRQSQDPSPFPWPTPRARPAWAPGDDEGAQEDDDLAYVLDFFT

SEQ ID NO: 154107 - protein, 52 aa, Glycine max
  Coding DNA Sequence Number=SeqID_62422
MHEKGFQKAVRQADFFVKDLDLGLFDPFKDVKDGVLFDEEEIVAENEAVDEG

SEQ ID NO: 154108 - protein, 113 aa, Glycine max
  Coding DNA Sequence Number=SeqID_62423
MDKSLKVGKDEWRERNRRSTKFCASNEPMSPKSTLRLLRTLGPSTASLVQSSWSLLSNALEGRIMILGTSYSAKQGITQCFDKNKNKKIPRKGVTGALPRKGKRNRGAIELRP

SEQ ID NO: 154109 - protein, 84 aa, Glycine max
  Coding DNA Sequence Number=SeqID_62424
MLSGMSACLARVSSSSFFQILPRAKLQEWCTQPQECDQVGYPWWRKWSGFHERKYLYLGTCHLVWISLVTQAKHHGGRRVAYAR

SEQ ID NO: 154110 - protein, 81 aa, Glycine max
  Coding DNA Sequence Number=SeqID_62425
MSEIEEVQEQMKANMEAIKEKMTTMTEAMMSMRKMMEVNTTTVIAASTTTEVREAKHWEVWAASILCWSRASIPLLDMWPQ

SEQ ID NO: 154111 - protein, 282 aa, Glycine max
  Coding DNA Sequence Number=SeqID_62426
  Gene Ontology: Mol. function=hydrolase activity, acting on ester bonds; Biological process=lipid metabolic process
  Homolog annotation: Hit_ID=A7PXB3; Match level="QueryCoverage=68%, HitCoverage=65%, E-value=2e-62, Identity=51%"; Hit description =Chromosome chr12 scaffold_36, whole genome shotgun sequence
  Pfam annotation: Domain name=Lipase_GDSL; Domain location=50-272; Score=35.1; E_value=2.5e-07; Accession=PF00657.13; Description=GDSL -like LipaseAcylhydrolase
MEVFEGGAFDLGDMGPDAEDGNGASEFKRERWVVWIWIWPLKEKRSSEISFYVGRRDPREGEGKKENRETKNETSSPLITSNDDRWSATSVIPLWKQLEYYKGYQKKLSVYLGESRANETVAKALHIISLGTNDFLENYFAIPGRASQYTPREYQNFLAGIAENFIYKLYGLGARKISLGGLPPMGCLPLERTTNFVGGNECVSNYNNIALEFNDNLRFQVTSMACCATGMFEMGYACSRASSFSCIDASRYVFWDSFHPTEKTNGIIAKYLVKNALAQFLH

SEQ ID NO: 154112 - protein, 330 aa, Glycine max
  Coding DNA Sequence Number=SeqID_62427
  Homolog annotation: Hit_ID=A5AQX1; Match level="QueryCoverage=32%, HitCoverage=25%, E-value=5e-07, Identity=29%"; Hit description =Putative uncharacterized protein
PLDLEIEATLRRNRVERRRKLLQDRTVASILEEEAQSSNSTSSYSPSSRESTTYLPEASVMADEHQHRVTLEDYSSSSVPQFFTREAKKWLHSFKGNNLKTWEEVVEKFLKKYFPESKTAEGKTPTHGFFEPIQLNMFIDELRPQTKQLLHASARGKIKLKTPKEATELIENMSASDHAILRDRVVPFRVRLMNHVIAFPLKSTLRKFITWEINRDKDTPRRIFGVPSRPPQQGPNIFQRTTKLEETIAQFMQVAMSNHKSTESALKNLEIQLAEKSSNNFGANTKKNPKEECKAVMTRSKKLMSAEDEDVVALNEQVVLNDTTDKKKNG

SEQ ID NO: 154113 - protein, 103 aa, Glycine max
  Coding DNA Sequence Number=SeqID_62428
  Subcellular localization annotation: CTP_CleavageSite=55; ConfidenceScore=5.37e-01
MVFTNTPSLISSGLTYKDSVSTKRRCRRHVSCTCPVKMSYIYVNATDHSTTTASRVMKGVQHEAYDYLLKPIRMKELAAYLKKYGYMRSKNLKMLPQQRKENM

SEQ ID NO: 154114 - protein, 72 aa, Glycine max
  Coding DNA Sequence Number=SeqID_62429
MEARSLSFNEVLQWRRRLRRRHPLENKQWKEKLHHLESALDKKLREEVSMEKENERERQRGTWKLKEDREGS

SEQ ID NO: 154115 - protein, 134 aa, Glycine max
  Coding DNA Sequence Number=SeqID_62430
  Pfam annotation: Domain name=G-patch; Domain location=84-129; Score =13.6; E_value=0.0042; Accession=PF01585.14; Description=G-patch domain
MPKATLDKLPFNASHLRPGSMVVRDFGGSHQDVGGPTLDSFIGGGPFNATPKAEVCGGTTVNHSLRKIGHSCELSFFYTICGSRGGVLGDILGSGHGYKPEMGLGQNSDGVASLVEFTENHGRFGLGYKPTPID

SEQ ID NO: 154116 - protein, 36 aa, Glycine max
  Coding DNA Sequence Number=SeqID_62431
MRGGGELNSPRRAGYFSIKPSGGSGELGASLGEPGA

SEQ ID NO: 154117 - protein, 68 aa, Glycine max
  Coding DNA Sequence Number=SeqID_62432
MKGKRQHKCEEEAGRVNGVLALSPELLGVPSKTLGKVIGALLCAPSEIVGAPSNFTIFPFCPSMRPTD

SEQ ID NO: 154118 - protein, 411 aa, Glycine max
  Coding DNA Sequence Number=SeqID_62433
  Homolog annotation: Hit_ID=Q2HTA0; Match level="QueryCoverage=67%, HitCoverage=60%, E-value=2e-14, Identity=37%"; Hit description=IMP dehydrogenase/GMP reductase, related
  Pfam annotation: Domain name=DUF1723; Domain location=136-185; Score =53.1; E_value=9.6e-13; Accession=PF08330.1; Description=Protein of unknown function (DUF1723)
MVRTRGLGCALGKVIGRVPGREYNRDSDDSSQRRRPTASARRQWEAAAVAEDAPHGNDIAEEVFQHAEEVVNDAKGFAGGPHDTSVLTAYVDHEHPELKLSSHGRKVQKFRRPVAEIEGLVTATGLSPLVACSLDTGDWGLIFAFVERWHKETSSFHLPVGEVTITLDDVASLLHLPTIGAFHTFDTLHVNEAVLMLCWIYEHFSSVVEAFTDSDYDERSPRACRWTSTKASTKALSASTYRNRLDRLMTVDVCWMSYGYHCAVREFDLISCFSRHIRWGPIVTIHRIERVVQQFRYVQTIPPHYAGPRLCFKDIDNRWMHFSDYLAPVGQIYVVPRQCAHDYMEWFYLISYPFIRPTQSGEPLRHPLVMQDGTYVEPDIPEISVAPTSVEEPPVQGLSNVEQPRHAMVTF

SEQ ID NO: 154119 - protein, 47 aa, Glycine max
  Coding DNA Sequence Number=SeqID_62434
MECHHQKGEDCGSNAFQDYFDDAKELRVKQVPKNQESKSFKNQVSKI

SEQ ID NO: 154120 - protein, 58 aa, Glycine max
  Coding DNA Sequence Number=SeqID_62435
MQYLGSDPRSSPNEQCEQPHILGKTLKLKTTPQTHAYEDQKVFQGCNGAKDKVDESMG

SEQ ID NO: 154121 - protein, 81 aa, Glycine max
  Coding DNA Sequence Number=SeqID_62436
HLDVTLTSSVGPECVELISIVQRAISGYALSALAHDSWPPRWLLALSGLLGLSSHDALSETIALSVTFQFFNPFPSLMLSL

SEQ ID NO: 154122 - protein, 158 aa, Glycine max
  Coding DNA Sequence Number=SeqID_62437
MKHPSEDLSVFCAEIIDHIVDEYMTGLHSNLHACHSSCIESEFVLDHMAEFDADSESEIDIDYISGDVLPLEIDFLESDRTNHVSGSTHTFDFLYEIQVEKPSLSTIIQPPTPELKPLPSNLKYAYMDGSKSFPVIIFASLADEKEEKLLSVLKKHKK

SEQ ID NO: 154123 - protein, 111 aa, Glycine max
  Coding DNA Sequence Number=SeqID_62438
MAPYCRFIMAACMAPAGVGISPVGLEDEKHCLVTSSQNKQCEIKIVRGKATCVNSNLIYVNALWVIDCRLCNLYHFFSGTKDKALSLIIVGAISVTHFVAQWTKLCRILDK

SEQ ID NO: 154124 - protein, 105 aa, Glycine max
  Coding DNA Sequence Number=SeqID_62439
  Homolog annotation: Hit_ID=A5B1P9; Match level="QueryCoverage=100%, HitCoverage=8%, E-value=5e-14, Identity=35%"; Hit description =Putative uncharacterized protein
MLCDETNSLVQENALEDEDVGFQDKDTTLESKVKDLEQSKEIIATPPKDLPKEWRTQRDLSVDNIIGEKSKGISTHSRLGILCNNMAFVSQIEPRNIDETLHDEN

SEQ ID NO: 154125 - protein, 82 aa, Glycine max
  Coding DNA Sequence Number=SeqID_62440
MGTGMVPYDGEIIKTNEGDTFQSPNPLFFETKRGLTLEAFENKNPPTPLSSTIGPSMQYFILIPTSSEPWNVERYDFSYSSN

SEQ ID NO: 154126 - protein, 464 aa, Glycine max
  Coding DNA Sequence Number=SeqID_62441
  Homolog annotation: Hit_ID=A7PX88; Match level="QueryCoverage=88%, HitCoverage=57%, E-value=1e-146, Identity=63%"; Hit description =Chromosome chr12 scaffold_36, whole genome shotgun sequence
MYILVDNRPWLSDLGSRGVHIWQLMVTKSRLSPFAYSKSRRERKEGKEVCPQSSSSKPKKFMRWFSLIEAVMLSRKKVLLPVKNLRNSLQLSSELHRTLYGFIVFEVAWTSVRGINYYNELQTDTSLAIEAKLMKRWEFDSIAQAADCMSSWFSGTPSEKLLLKEHLDSASGDTFYDASEDFSGTVSVDDGDDNVCRILTVEDSLGTKVGVYSDDTEETTDMLHTPPPSGPNKRRKLMNFFSAGVEVGSYSAAEIDNSLDYSQTFSCVSDDTVETTQDDTVEATQYSDVLLSFRFNDHDLPFKFREVIVSDLRLLTLLEAGLPSWVIFLQSYPVLCNLYRPWMCPLARLLYFLISFVTVLIGFYDLYKNVPVLKATASRICGPLLDWIETWEMVSRVKYLGTMLFLHNFQKAVSLQHLLKQQSVLLKFLCGELFGMTFFPRFSVLSRAYSMGLLPSSQPAIGID

SEQ ID NO: 154127 - protein, 140 aa, Glycine max
  Coding DNA Sequence Number=SeqID_62442
MPFSYLGLPIGANPRRSETWDPIGSKYGGDKIGGITMKVFVGRERAIGREEDTLRQLGDDLLTKGEGDLSAICGAGEDGRWFKEGIKWKIGSGLRVRFWEDGWLEGGVSFRDKYTRLYCMSMQQQQYIQYMGALIDGKWE

SEQ ID NO: 154128 - protein, 72 aa, Glycine max
  Coding DNA Sequence Number=SeqID_62443
MVSLPSDLGRPSKKSYEMSLQTCEGISNGCNKPAGVMIHTYFVGRSSSKDYMVRAKDQGKTTLETMEKLACR

SEQ ID NO: 154129 - protein, 298 aa, Glycine max
  Coding DNA Sequence Number=SeqID_62444
  Homolog annotation: Hit_ID=A7UQU7; Match level="QueryCoverage=53%, HitCoverage=49%, E-value=5e-11, Identity=54%"; Hit description=IMP dehydrogenase/GMP reductase, putative
  Pfam annotation: Domain name=DUF1723; Domain location=100-149; Score =49.6; E_value=1.1e-11; Accession=PF08330.1; Description=Protein of unknown function (DUF1723)
MERLLVRRGLEGLPTRLGLLLKMCHLRVMLGAPSIIAGAPTSSRPHWLLPRRSVCRALGGSLSALRRPAALLCYYTIEVRFYSPLMAASFDFRLVCIVDTGDQGLISTFVERWHKETSSFHLPVGEVTITLDDVASLLHLLIISAFHSFETLHVDEAVLMLVELLEVSGEEARAETVQCHGTHASSKSLPASTYRKRLDGPTIADVCWMPYGDHRVVRDFDLISCFSGHIQWGPIVVRHRPERVVRQFGYVKTIPPQTTGSMLSFEDIDDRLMHFSNYLTAVGQICVVSGQCASNYIH

SEQ ID NO: 154130 - protein, 97 aa, Glycine max
  Coding DNA Sequence Number=SeqID_62445
MENGVSLKEKYPRLYQISQQQHQHIQQMGTIANIGWEWKLQWRRFLLEAEIDTVAKFMEDLQRLTDRPPRFLSMIGIPTIDVVFYCSQRRDEMQSPP

SEQ ID NO: 154131 - protein, 55 aa, Glycine max
  Coding DNA Sequence Number=SeqID_62446
MDICKRNWCVGAHEGPVDVTGAALDRSMFSIAGAGSPTSNGGGRQDNQGGISYFR

SEQ ID NO: 154132 - protein, 230 aa, Glycine max
  Coding DNA Sequence Number=SeqID_62447
  Gene Ontology: Mol. function=sugar:hydrogen symporter activity; Cellular component=integral to membrane; Biological process =carbohydrate transport
  Homolog annotation: Hit_ID=Q0WVE9; Match level="QueryCoverage=74%, HitCoverage=32%, E-value=2e-64, Identity=73%"; Hit description =Probable plastidic glucose transporter 1
  Pfam annotation: Domain name=BacA; Domain location=34-206; Score= -171.8; E_value=0.079; Accession=PF02673.9; Description=Bacitracin resistance protein BacA
  Subcellular localization annotation: CTP_CleavageSite=49; ConfidenceScore=5.08e-01
MNSLNFVSAAIVSVHYSEPSPKLVSISRARDKPYTLVIRSSGHLSNKLKVSALKSNETKPKQFSLCQNGWLPAFPHVLVASMSNFIFGYHIGVMNGPIVSIARELGFEGNSFIEGLVVSIFIAGAFIGSISSASLLDRLGSRLTFQINSIPLILGAIISAQAHSLNEIIGGRFLVGLGIGVNTVLVPIYISEVAPTKYRGALGSLCQIGTCLGIITSLFLGIPSENDPHW

SEQ ID NO: 154133 - protein, 90 aa, Glycine max
  Coding DNA Sequence Number=SeqID_62448
MRWKTPSCGSYYVNSDASIKRNVGTGLGLITRDNKGKVMVAATYFIDAKMEVREVEVYAFRWEIIKAYLAKSIASKHYLLLEQSKQWVKV

SEQ ID NO: 154134 - protein, 135 aa, Glycine max
  Coding DNA Sequence Number=SeqID_62449
MLMLRMTMRRDNVDVDDNIEEEYLYLGHVPRFGTPLRLRLITVGGELPVHDKAISLMNGTTLHLRVESTGVPLESPQQLVSEPMVQIGDRLRRVCKYHRWPEWLAAQRAPAGGAGWPEWLAGRASTASGHDYTHG

SEQ ID NO: 154135 - protein, 683 aa, Glycine max
  Coding DNA Sequence Number=SeqID_62450
  Gene Ontology: Cellular component=integral to membrane; Biological process=morphogenesis of an epithelium
  Homolog annotation: Hit_ID=A7NUT8; Match level="QueryCoverage=91%, HitCoverage=60%, E-value=0.0, Identity=68%"; Hit description =Chromosome chr18 scaffold_1, whole genome shotgun sequence
  Subcellular localization annotation: CTP_CleavageSite=57; ConfidenceScore=5.30e-01
MSTETALCAALWCGGQSAMKFPGLKVSFPTGSSLMKIPLKTTLQADLSQLQAAASFVCRLGWATKVIDPASILQDTNIPGSPKSAVNDEDASIASHGFDNMLIDNDNNQSDAYGPHSCHTRVAFIVDANITSYLMMGSVSPGLKSHAVTLYEAGKLGHASITDLCKDLSTLEGAKFEGELQEFANHAFSLRCVLECLQSGGVASDAKVGEDKMDLATVSNDEFSSLISEISLTEKSGESGITEAGMNSYDILSSDLEKSVEAPASTESAPSNMVGGTRSIPLEGDDSHVQEANEDGNLQNDEKLMVEESDVGTEMLKRKKKYRVNILRCESLASLAPATVDRLFVRDYDVVVSIVPLPHSSVLPGSTGLVHFGPPSYSFMTPWMKLVLYSTVASGPLSVVLMKGQCLRLLPAPLAGCEKALIWSWDGSAVGGLGGKHEGNLVKGSILLHCLNSLLKHSAVLVQPLSRFDLDESGKVITMDIPLPLKNSDGSNTYVGKDLGLCEGESSKLNSLLTDLANKMELWTVGYIRLLKLYNGRESNQFSPEEEKYEWVPLSVEFGMPLFSPKLCNDICQRVVSSELLQSGSFEKHHHAMQSLRKNLRDICAEYQATGPAAKILYQKEKAKESSRQLMSYASGRWNPLMDPSSPISGASSEHQRLKLANRKHCRTEVLSFDGSILRFVNF

SEQ ID NO: 154136 - protein, 212 aa, Glycine max
  Coding DNA Sequence Number=SeqID_62451
MALCESVNTYCSGKPEQMHHLWDRVIKDVPWFLSSFLALVAIEAAWGRSSLKSWRELHELAQGRQSWACQIAKELGGSSSLYAHRITVEHQLCREHVPHSKQIHRFENIGVFALVGVGYHQKPWEARSQLEARPERVRLGPSPVGDRCCLAHQGAMPKNSDGDVSGRSEKIDERLVKRRDHRALKEVELDASGSLEEENYHRDRGSTGQHGY

SEQ ID NO: 154137 - protein, 54 aa, Glycine max
  Coding DNA Sequence Number=SeqID_62452
MTLRAEWRRKRERRCHFKEKISLEEAHHNKRPWIRAWWKNEMNEGRGREEHEIL

SEQ ID NO: 154138 - protein, 295 aa, Glycine max
  Coding DNA Sequence Number=SeqID_62453
  Gene Ontology: Mol. function=nucleotide binding; Cellular component =intrinsic to membrane; Biological process=defense response
  Homolog annotation: Hit_ID=Q2HVE0; Match level="QueryCoverage=93%, HitCoverage=27%, E-value=2e-37, Identity=36%"; Hit description =Leucine-rich repeat; Leucine-rich
MLHLIRSDIESLPTCINNLTRLRYLDLSCCSNLCILPKLPPSLETLHADECESLETVLFPSTAVEQFEENRKRVEFWNYLKLDEFSLMAIELNAQINVMKFAYQHLSAPILDHVENYNDYKDLHDSYQAVYMYPGSNVPEWLAYKTRKDYVIIDLSSAPPAHLGFIFCFILDKDTEEFLDPALQFSISISNGENECKRDSVEIQTSGPYSMIYSDHVCVLYDKRCSCYLNNRLKSLAKFKIKVSWLTDGERWEVLKGFGVSPINTSVYHNFVQQMELCDQGFRPVLKRTPKKRKR

SEQ ID NO: 154139 - protein, 99 aa, Glycine max
  Coding DNA Sequence Number=SeqID_62454
MVAITPARFPQFPFFRGYDSNVTCAYHGGVPGHSIKHCMTSKSKVQSLIDAGWLKFEENLLMWVQAIGLFAQATCAPEFGLSKTIQSEITHATYLVRMP

SEQ ID NO: 154140 - protein, 99 aa, Glycine max
  Coding DNA Sequence Number=SeqID_62455
MAVVNAVESDRPRRSKPLRDVATLGGLSLRPYKREELLQRMIDQGRLEVDSEGREEQHICMQSTDGSVVVKPKPLVIYFTKGKASQKPGHPLAAKPVPF

SEQ ID NO: 154141 - protein, 57 aa, Glycine max
  Coding DNA Sequence Number=SeqID_62456
AHISQTMGETHEIPHHNLADFEPWLRYATEGQAVGGIPFENTLEGPQFLLDKWPQIS

SEQ ID NO: 154142 - protein, 82 aa, Glycine max
  Coding DNA Sequence Number=SeqID_62457
MDKFDIFVPHPLTNASLLIQLSPEYGCKPLACFAQATCAPEFGLPRPFNQRLLVLHVGGERSELSRIGCWTNGLSYLKKKGG

SEQ ID NO: 154143 - protein, 16 aa, Glycine max
  Coding DNA Sequence Number=SeqID_62458
MPEIKRKQAYAIPEIP

SEQ ID NO: 154144 - protein, 112 aa, Glycine max
  Coding DNA Sequence Number=SeqID_62459
MTGPLDESISCFLIRVDPWVLVPITLRGLHVLAIRGLHALTFRGLHVLALRGLHALTLGLHALTSRGLHVLTIRGLHVLAIRGLHALTSRGLPVLALRGLHALTLGTSYPHR

SEQ ID NO: 154145 - protein, 48 aa, Glycine max
  Coding DNA Sequence Number=SeqID_62460
MSVEIKRESIDKSFKVNGHRLKPFLSNPSLVDVVVEETSLLHPTSIPP

SEQ ID NO: 154146 - protein, 213 aa, Glycine max
  Coding DNA Sequence Number=SeqID_62461
  Homolog annotation: Hit_ID=Q2HW90; Match level="QueryCoverage=79%, HitCoverage=34%, E-value=4e-21, Identity=37%"; Hit description =Putative uncharacterized protein
MGPLQRQAFRKVYGKILDLAATEVFTEVVVSLAQYYDQPLRCFTFGDFQMVPTIEEFEEILGCPLGGRKPYLFSGFLPSLSKIAVVIGDSAKELDHMKQTRNGIVGLPRKYLEGKARDIASQEKWGPFADILALLIFGVVLFPNVDGLVDLAAIDAFLAYHHSKESPVVAILADLFNTFDRSYSDKTRDTRVRFKAIPHASKKESIGTNIWLG

SEQ ID NO: 154147 - protein, 126 aa, Glycine max
  Coding DNA Sequence Number=SeqID_62462
MRLSRANEPPSSLPIKFPIIIMCTFKWYTFARQLGQIIEEGLVNDHHYPIDFRNQGTFLNFKNERRRGLCAVYVVLPMRTMRRRKWRKELEYPEPQSVVGFYSKNPCASLMVPPFERLIRNFNQLK

SEQ ID NO: 154148 - protein, 78 aa, Glycine max
  Coding DNA Sequence Number=SeqID_62463
MAQPPPRERTLREMDAPDFTYESLCIQYPDEDVPYVLKTGLIHLLPKFHGLAGLSSFSRVSGKGLALLPSSMVHHELG

SEQ ID NO: 154149 - protein, 87 aa, Glycine max
  Coding DNA Sequence Number=SeqID_62464
  Gene Ontology: Mol. function=phosphoprotein phosphatase activity
  Homolog annotation: Hit_ID=A5C0F5; Match level="QueryCoverage=96%, HitCoverage=13%, E-value=7e-12, Identity=35%"; Hit description =Putative uncharacterized protein
MKRGEFLWVPYPKEVQALLSHLCFVGSAIWRCVVPMICFNVVEWHQPDRVMRQFGLQQPIPGPPLQPSNIHGLTLKGKSGHNWRRLL

SEQ ID NO: 154150 - protein, 217 aa, Glycine max
  Coding DNA Sequence Number=SeqID_62465
  Gene Ontology: Mol. function=RNA-directed DNA polymerase activity; Biological process=regulation of transcription, DNA-dependent
  Homolog annotation: Hit_ID=A7R3D8; Match level="QueryCoverage=82%, HitCoverage=36%, E-value=6e-27, Identity=35%"; Hit description =Chromosome undetermined scaffold_505, whole genome shotgun sequence
  Subcellular localization annotation: CTP_CleavageSite=58; ConfidenceScore=5.10e-01
MASESDDDSKMDLQKQIQKAKQTKTICNQKQSQPLTQQDSTSQPNNSYISKNKFFNVLQMEPKYWDKNPFKATAKKFSAPFDPAGYNYWDYIDAWTNVFWHQNSKFKHSWLIYFKNNTVYNFPNWFLQWWNYFGPIPQIFPEEVQQGFQQFNKLFNSKESRIPADLKYFSSFALSWIFSWQYKYGKTENCKQYPPLQRHAFVKWWSQFDTSKAAPDQ

SEQ ID NO: 154151 - protein, 41 aa, Glycine max
  Coding DNA Sequence Number=SeqID_62466
DLGMPAKSKETVSVFQILPLRGKSSKNGQDLDIRVRPSEAK

SEQ ID NO: 154152 - protein, 295 aa, Glycine max
  Coding DNA Sequence Number=SeqID_62467
MRDARNSSTHGVDLLWSVRFALHLPPQLAGQCAHGIVGIGTVQQADFVVVDHRQLTLAIDDAVLAADRAARQQADADAIGHGALDATERRTGEGDAPAQAQRFHGVDHLVAVQPSRREGDQRQRVLLQAAAAQAVDPVHRLAPAMHRLAAVAALLDQHQVQLAVVEALRQVTAEAAADLQLHLRMAAAESGQHARGLRVDEILGHADADGGLHRRTGQCLGHFLVQVEHAPRVAEQGVAGVGGVHIAVAAFEQAMPGQFLQPAYLLADRGLCRMQARGRRGEAAAVGHHHQRPQQ

SEQ ID NO: 154153 - protein, 71 aa, Glycine max
  Coding DNA Sequence Number=SeqID_62468
MVLEVNTQERRLLEQTDQWLTLTFRWKLNKQRCVRFNKRFSSNFSQPVSIRLHTLCFGVIQCSMECPGAPP

SEQ ID NO: 154154 - protein, 113 aa, Glycine max
  Coding DNA Sequence Number=SeqID_62469
  Homolog annotation: Hit_ID=A0PAV3; Match level="QueryCoverage=33%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRIRFDGNRLPAVENVYHSH

SEQ ID NO: 154155 - protein, 227 aa, Glycine max
  Coding DNA Sequence Number=SeqID_62470
ENFEAPEEDEEVRALKLELGKARLAKEKFKSAATHIRKECTELQEENAATAKALEQETKRARKEEYGREKFRGALWGSNNKLKLRREERDRSRVHGMILKEELVACTRSKRSLAQHLEATEQSMLAIMGQYNEELNQSMAHEQKLVVDFAQVYAEKEARGRVMDALHQEATMWMDRFALTLNESQDLPRLLAKAKAMAEVCTAPEEIHGLINYCQHMIDLMAHIILG

SEQ ID NO: 154156 - protein, 126 aa, Glycine max
  Coding DNA Sequence Number=SeqID_62471
  Homolog annotation: Hit_ID=Q5XM22; Match level="QueryCoverage=79%, HitCoverage=56%, E-value=5e-24, Identity=59%"; Hit description =Resistance-like protein HAAS-2
MLVDLLMVSAESARAETAQCRGPYVRLQWVCDIYERRCQAGHWTVAVRAYLLHLVGCTLFANNSATNVHVVYLEALRDLSMTERYAWGVAALVHMYNQLNNASISHSRQLGVLDLQALAVSRGLHC

SEQ ID NO: 154157 - protein, 26 aa, Glycine max
  Coding DNA Sequence Number=SeqID_62472
MATPMSTVCYLDKDEIGQSIDIKKYR

SEQ ID NO: 154158 - protein, 114 aa, Glycine max
  Coding DNA Sequence Number=SeqID_62473
  Subcellular localization annotation: CTP_CleavageSite=30; ConfidenceScore=5.40e-01
MYPLLLSVTTTQVDVPSTCTTKDVPSNVLRQSSQAVSPLKLCEWGNNSNSQAGEGRHKRIQVVSLSFLWKREKRDTKRIQVVSLSFFWKREKRDTKRIQAVSPWRILFGKERRE

SEQ ID NO: 154159 - protein, 139 aa, Glycine max
  Coding DNA Sequence Number=SeqID_62474
  Subcellular localization annotation: CTP_CleavageSite=53; ConfidenceScore=5.33e-01
MYPPLFSLNNLVDVPSTRTDPQEMYPLLFSVTTTQVDVPSTCTTKDVPSNVLRQSSQVVSPSKLCKGGNKRILRREKGDTKEFRRLVLCSFGKERRGTQKEFRRLVLGEFFLAKGEENKKMNSTSFQGLENQKTSGGIL

SEQ ID NO: 154160 - protein, 29 aa, Glycine max
  Coding DNA Sequence Number=SeqID_62475
MPKDRGRIVIIKKGEIVEGLWCFDDDQKA

SEQ ID NO: 154161 - protein, 124 aa, Glycine max
  Coding DNA Sequence Number=SeqID_62476
MAGSLSKIIPDMSKIEPLDGSNYRRWSQKLLILFEALEVDYVLFEDPPADVNASESSTPETPATPVVTPLPAETQEEGLLMLMLLSLLINTGHKAYECNLRKGQQSNNSKPAAPHAPQAHLAEK

SEQ ID NO: 154162 - protein, 107 aa, Glycine max
  Coding DNA Sequence Number=SeqID_62477
MNTLGFQIVKVLRICGIHYKTCKKNLQDSGTLKRVAWGLDVGTRVWPNQPGHLRVDCPIFKKTHGEVFIEKKNIWEAIEIEGGTSIVDLQAQAGSETIEKPRADWTE

SEQ ID NO: 154163 - protein, 98 aa, Glycine max
  Coding DNA Sequence Number=SeqID_62478
MKGCLTTYLRTPYIAKNLRPVVAGSFDRDYLTVCYKTSSFDRDFNGYRTGSSSSSSAELVSSLFQDEPSSSCCNICKTSFRFLAKTSFDFNPAKDGAR

SEQ ID NO: 154164 - protein, 676 aa, Glycine max
  Coding DNA Sequence Number=SeqID_62479
  Gene Ontology: Mol. function=protein disulfide oxidoreductase activity; Cellular component=outer membrane-bounded periplasmic space; Biological process=cytochrome complex assembly
  Homolog annotation: Hit_ID=Q2NUY0; Match level="QueryCoverage=28%, HitCoverage=80%, E-value=8e-71, Identity=72%"; Hit description =Suppressor for copper-sensitivity C
  Pfam annotation: Domain name=DSBA; Domain location=424-559; Score =69.9; E_value=8.6e-18; Accession=PF01323.11; Description=DSBA-like thioredoxin domain
AAGAARRADSQPDALRAAGAGNQTEQPGAAAGTDTTPDASAVSRVQRRHSVLFPAAGAADDRATAQRSGAGLGHSVSEQRLSAGDGAGDVPVQRQSVRSAAFSPAFRPDHPAGDARRCRSGRAFWPGGLCHAAGDTVQRTVSWHRRRLCADRTAAAAVAAVCRARRRHESAVAAGCGAAGYGALPAASGALDAASAHAAGAADAAGNAVAGDAADSTLGQHRRHSAGGHPAAGADGLANHTPRASAGRSGVYYRDAGGRADKRVFVDVTADWCITCKVNKSRVLNQPDVRAALGAEDVVLLRGDWTQPDPAIGEFLRRRDRVAIPFNQIYGPALPHGQILSPLLSPPALAAAPFTPEQEARIKQLIRETLVQNPAILAEAADAFDKEAARQQQNVVAQMVEKNRAALFDDAGSPRIGAKKPALTLVYFTDYNCVFCKKFEADIEKLLHNYPQVAVVLKPLPYRAESSLSSARLALTVWEQQPNNFLKLHERLMAKKGNHDEASIAAALDKSGISLSAPSTASLDTINLNLTLAQQLGVQGTPATLVRCRLSHEPGNALAARRRAVVADGSGAAAGHGLAACTAAARGCSPAAAQRAAGRGEPGDAEPAAAGAGLRLGQLVWRVQTHHTDGGRAQSARHAGALANQRHADVHRAASGQGGQHQQRLDQQLGAEAAHV

SEQ ID NO: 154165 - protein, 937 aa, Glycine max
  Coding DNA Sequence Number=SeqID_62480
  Gene Ontology: Mol. function=4 iron, 4 sulfur cluster binding; Cellular component=cell surface; Biological process=pyrroloquinoline quinone biosynthetic process
  Homolog annotation: Hit_ID=P27507; Match level="QueryCoverage=33%, HitCoverage=89%, E-value=1e-147, Identity=76%"; Hit description =Coenzyme PQQ synthesis protein E
  Pfam annotation: Domain name=Peptidase_M16; Domain location=602-740; Score=114.6; E_value=2.9e-31; Accession=PF00675.11; Description =Insulinase (Peptidase family M16)
  Pfam annotation: Domain name=PqqD; Domain location=241-310; Score =91.1; E_value=3.5e-24; Accession=PF05402.3; Description=Coenzyme PQQ synthesis protein D (PqqD)
  Pfam annotation: Domain name=Radical_SAM; Domain location=276-433; Score=69.8; E_value=8.8e-18; Accession=PF04055.12; Description =Radical SAM superfamily
  Pfam annotation: Domain name=TENA_THI-4; Domain location=39-223; Score=107.1; E_value=5.2e-29; Accession=PF03070.7; Description =TENATHI-4 family
  Pfam module annotation: Pfam domain module=Peptidase_M16::PqqD::Radica l_SAM::TENA_THI-4; Domain location=602-740::241-310::276-433::39-223
MALLAALPARRKILIHINNTNPILNEHSPQRQFLTQQGIEALRAKGAYYHIHHPYHIAMHNGAATREQIQGWVANRFYYQTNIPLKDAAIMANCPDPATRRKWVQRILDHDGRNGEEGGIEAWLQLGEAVGLDRKVLLSEKLFTHRAVCPADSSVAPRQLATALSVDQRGRLFLLPQPPEPGEPRCGTRPALALEVFTSAEQQNRMLEILQFKLDILWTMLDAMTMAFALQRPPYHTVTDQWEVAQDSHVVLYPEGMAKLNETAAAILELVTGKQDVAAIIATLNARFPEAGGVDDDEQELSTEQWIEVFRQARAMGSVQLGFSGGEPLTRKDLPELIRAARDLGFYTNLITSGIGLTEKKLDAFADAGLDHIQISFQASDETLNAALAGSQKAFQQKLAMAKAVKKHGYPMVLNFVLHRHNIDQIDKIIDLCIELEADDVELATCQFYGWAHLNRQGLLPTREQIARAEAVVARYRERMGSSGNLTNLLFVTPDYYEERPNPFPSVLEQSLEDIWYNSFGFNRYRGFDWMPEPCRSCDEKEKDFGGCRCQAYMLTGDADNTDPVCSKSPHHGKILEARREASCSDIKIAQLQFRNRSNSELIFKQRPDARESAALVRVGAGSLHEPDRWPGLAHLLEHLLFCGSAGFTGDERLMPWLQQQGGQVNATTQLSRSAWFFQLPAQALAAGMARLADMLAAPLLTGTAITQEAAVIEAEYQLLRHHAETLSEAALLDAAGGALRRFRVGSAACFGDNVTELQQALRFAVSGALTPAFAGTPGKWPAVAARKSGAAAGNAAGGAKLAAATAPTAGRTAPCRWQRTLATAAGRLATAAWRAGGAECAGAAATAPCCTKYCDSSVAGSTTAAAAGPGSASCVAGRLVRPQRKRQSARRALAERGGPDSACADALGGATARRQRATLCGERSGLIAVYSAARCR

SEQ ID NO: 154166 - protein, 1057 aa, Glycine max
  Coding DNA Sequence Number=SeqID_62481
  Gene Ontology: Mol. function=transporter activity; Cellular component= integral to membrane; Biological process=transport
  Homolog annotation: Hit_ID=A8GF40; Match level="QueryCoverage=48%, HitCoverage=92%, E-value=0.0, Identity=79%"; Hit description =Extracellular solute-binding protein family 5 precursor
  Pfam annotation: Domain name=BPD_transp_1; Domain location=676-917; Score=185.1; E_value=1.8e-52; Accession=PF00528.13; Description =Binding-protein-dependent transport s
  Pfam annotation: Domain name=SBP_bac_5; Domain location=161-542; Score=279.8; E_value=5.6e-81; Accession=PF00496.13; Description =Bacterial extracellular solute-binding proteins, family 5
  Pfam module annotation: Pfam domain module=BPD_transp_1::SBP_bac_5; Domain location=676-917::161-542
MPISHEDCRKEHNDARLMRAQKKARNTRCGQRNTGSNVSNVVLFFGRATVEAQKNNNHSYYHLCAANLGSARALRYTLAIARESLSSMPKLFPALLLGLSVLSASALAAPADSIRHSGFVYCVNGTVNTFNPQMVSSGLVVDTLAAQLYDRLLDVDPYTYRLIPDLAQSWEVRDNGATYRFHLRKDVSFQHTNWFTPTRKMNADDVVFSFARMFDRQHPWHNVNGGSYPYFDSLQFADSVQSVKKLDNDTVEIRLNSPDASFLWHIATHYAPVLSQEYASQLSAAGQQEQLDRQPVGTGPFQLSEYRTGQYLRLARNPHYWKGVPRLQQVVIDLGVGGTGRLSKLLTGECDVLAYPAASQLSILRDDPRLRMTLRPGMNIAYLAFNTRKPPLDRPEVRHALALAINNERLMESIYYGTAETAASILPRASWAYDNDARVTEYNPAKAREALKALGIEDLHLRLVVPTTSMSWNPSPLKAAELLQADLAQVGVRVTIAPVEGRFQEAQLMAMNHDLTLTGWATDSNDPDSFFRPLLSCAAIRSQTNYAHWCSPAFDEALQRALLSQQLSARIDSYDRAQQMLAQALPVLPLASSLRLQAYRHDIKGLVLSPFGNASFAGVYRDEHGEDLSYFTPNAPLEGASLFDAWWFWFKGLLQFDFGVSSTNGQAIDIQLREVFPATLELCVLAFMLALLVGIPLGICAGVMRNKWQDKAISALALLGFSMPVFWLALLFTLLFSLTLGWLPVSGRFDLLYPVQNITGFALIDAWLSPSPWRHEMLVSALTHLILPVIVLAVAPTTEVIRLLRNSTSDVMDKNYVKAAATRGLSRFTVIRRHVWHNALPPVIPRLGLQFSTMLTLAMITEVVFNWPGLGRWLINAIRQQDYAAISAGVMVVGGLVILVSVLSDIIGAALNPLKHKECAMIGLYGFGILLFLCLFGGLLSPYGIDQQFLGYQLLPPSWSRYGDPFTERRGTDGWLCAAGHGAGSNLRAAAGRAGGDYPRFALGGDESRAGYAAVDSLFVAGDYRGGLSWPATGACDAGGTAGADPASGARNLHGGA

SEQ ID NO: 154167 - protein, 101 aa, Glycine max
  Coding DNA Sequence Number=SeqID_62482
  Subcellular localization annotation: CTP_CleavageSite=82; ConfidenceScore=5.71e-01
MNALPSAVHASSTKESGGSRIDCLALFASSPFSTFTLSPMNLLPSAVHVSSTFESGAPRIDCLALFANSPFSTFIQSPMNSLSSAVQCPPPTSLEACELIA

SEQ ID NO: 154168 - protein, 163 aa, Glycine max
  Coding DNA Sequence Number=SeqID_62483
  Homolog annotation: Hit_ID=A5BSR3; Match level="QueryCoverage=80%, HitCoverage=43%, E-value=1e-11, Identity=32%"; Hit description =Putative uncharacterized protein
MAEKTKKRLEEVAKSGSTEGVIDPLSPIRRHVKWKMARTKKTGQMTSEATKEIADRIDSLDEQASQGSFVPHGRQDVLTAAIGRPEHPGHVCAARAGVTIKQYFGSASRTSRSSEDLQQLTQQIRDQLEESITEKVTRQLMANAITGTCTTSRARGWSLRSLC

SEQ ID NO: 154169 - protein, 201 aa, Glycine max
  Coding DNA Sequence Number=SeqID_62484
  Gene Ontology: Mol. function=manganese ion binding
  Homolog annotation: Hit_ID=A6THJ4; Match level="QueryCoverage=100%, HitCoverage=67%, E-value=1e-110, Identity=95%"; Hit description =Putative sugar phosphate isomerases/epimerases
  Pfam annotation: Domain name=AP_endonuc_2; Domain location=1-153; Score=73.5; E_value=6.9e-19; Accession=PF01261.15; Description=AP endonuclease family 2
MGAKVIGCSEQSGSIQGLDKPILGDVKPCFSDEEWQRVAEGYNALGKLAAEKGMQVCLHHHMGTGIQTTAEIDKFMSLVDERVFLLYDTGHAWYSEGGEAPMLAILKKYLPRINHVHLKDVRPAVIEQVRREGLSFLDGVKKGTFTVPGDGEIDFRPVFQLLDDYGYKGWMVVEAEQDPALANPFEYAVKARKYIRETAGI

SEQ ID NO: 154170 - protein, 52 aa, Glycine max
  Coding DNA Sequence Number=SeqID_62485
MAHPPPRERTLRELVAPNFTYESLCIQYPDEDVPYILKTKLIHLLPKFHGLA

SEQ ID NO: 154171 - protein, 41 aa, Glycine max
  Coding DNA Sequence Number=SeqID_62486
MVRMEKEERERRRHFKEKMSLEEAHHHRRPWDKSLEEEGDE

SEQ ID NO: 154172 - protein, 17 aa, Glycine max
  Coding DNA Sequence Number=SeqID_62487
MATWCGRMTELQDRVDL

SEQ ID NO: 154173 - protein, 21 aa, Glycine max
  Coding DNA Sequence Number=SeqID_62488
NTRGVATNVYLRKTSEKPKEI

SEQ ID NO: 154174 - protein, 73 aa, Glycine max
  Coding DNA Sequence Number=SeqID_62489
MEQLKSTQQALQSVEIQVGELAEVVNQFMSRPEKSFVEAEAQEKSPVKEHESREKDEEKDVGSSGLKIIKKGG

SEQ ID NO: 154175 - protein, 161 aa, Glycine max
  Coding DNA Sequence Number=SeqID_62490
  Homolog annotation: Hit_ID=Q2HW90; Match level="QueryCoverage=72%, HitCoverage=25%, E-value=4e-07, Identity=29%"; Hit description =Putative uncharacterized protein
MRGAPTEERLPYRDRRARSQGYTKKSQGWRTIEERQGALEAAFRNGSRRLFYGWLTEVFTEAVVSFAQYYDQPLRCFTSGDFQMVPTIEEFEEILGCPLGGRKPYLFSGFLPSLSKIAAVVGDSAKELDRTKQTRNGVVGLPRKYMEGKARAYGEPRELGP

SEQ ID NO: 154176 - protein, 186 aa, Glycine max
  Coding DNA Sequence Number=SeqID_62491
MMEAMMSMKKIMEASVVAVATTSAIAKYEWPHDVKIQNEHAFPPYGLPPNYTPPNVAYTPNEDVNNSTPILVESRQPHHVHVSQPMGETHEIPHLNLADFEPFLGYAIEGQAVGGIPLQNTLEGPQFCPQPQVLFLSFFDPAKSESEYPTKLHKEFLGYHNLKLTVPNKYLIILFTAIKCENFGSD

SEQ ID NO: 154177 - protein, 99 aa, Glycine max
  Coding DNA Sequence Number=SeqID_62492
MTIEKQPLKASMQEKTSSMNQDEATTSPSSTESEEAKGEESSEEIVNIASTNKALFQDSLKTKPCLKTKCFQDMQGSGNRLPGSVIDYQKDRVENITVE

SEQ ID NO: 154178 - protein, 81 aa, Glycine max
  Coding DNA Sequence Number=SeqID_62493
YIYLGVTENKRGYISCGSVLVEGTSTRLFKENKGGYILMQAPLELVGLGSSSSMDSFASWKMNGSGMEKGRERGDATSRRR

SEQ ID NO: 154179 - protein, 125 aa, Glycine max
  Coding DNA Sequence Number=SeqID_62494
MERDFVFKPTKEHIVRLKIHHGGMFIYKPSTVYVNGHIVEEEWGWDVDTMSYIDLTKVIKSIGYKAFKCLWYKHPQKALCRRLKPLNGDCWISPAVTFWSTFSLYKYVQAKSNFLETGPDHQVMS

SEQ ID NO: 154180 - protein, 87 aa, Glycine max
  Coding DNA Sequence Number=SeqID_62495
MTGRLLVVTLFLQHFNILLDSEPYVPIKRSFLIGATVIASFGYQKEHDGSWVKKAARPVDEEGHGREDSSLQKILDRFDGLQTFVGE

SEQ ID NO: 154181 - protein, 98 aa, Glycine max
  Coding DNA Sequence Number=SeqID_62496
EEFLQEHPLKVIPAGNEPGSKDVPSNVLRQRSQAVKPLILCEWGYKRILRREKGDTKEFRRLVLCSFGKGRRETQKEFRRLVLGEFFWAKGEGNGKDE

SEQ ID NO: 154182 - protein, 156 aa, Glycine max
  Coding DNA Sequence Number=SeqID_62497
MVAITPTKVHQPPFLREYDSNATCACHGEAPGHSIEHCRALKRKVQGLIDACWLKFGENRVMWVQAIGLFAQVTCAPEFGLPRPFNQRLLVLHVGGGVVKQRGQPFPCVQESSTTRDPRSLNPFSEIRRREEEISLKRDRLYNEDQSKFFIEYASG

SEQ ID NO: 154183 - protein, 75 aa, Glycine max
  Coding DNA Sequence Number=SeqID_62498
  Pfam annotation: Domain name=zf-CCHC; Domain location=45-62; Score =26.7; E_value=8.8e-05; Accession=PF00098.14; Description=Zinc knuckle
  Subcellular localization annotation: CTP_CleavageSite=24; ConfidenceScore=5.16e-01
MIPDDDDDDLSLFVKRFNKFLKVRGNQRRPNFKSKRRTENSSSILKCFECNQPGHLRVDCPIFKKKMEKSGKEKS

SEQ ID NO: 154184 - protein, 117 aa, Glycine max
  Coding DNA Sequence Number=SeqID_62499
MGPDGCRETRETGIREAAHKPRQNFSIQKLFLLPSSPPLFSIETLNFAHHFYSKLQKEAIFGVVKRTSTLWDFEFQVEKCEILRVRENACALLVMGKVVHIGFLTFSSLTNPDPTRA

SEQ ID NO: 154185 - protein, 86 aa, Glycine max
  Coding DNA Sequence Number=SeqID_62500
MCACHGEAPWHSFEHCRGLKLTMLNEMDEVDIFVPHPLTNASLLIQLSPECGCKPLVCLLKRPVPLSLDFQDRSKDYSSCTLLGAP

SEQ ID NO: 154186 - protein, 196 aa, Glycine max
  Coding DNA Sequence Number=SeqID_62501
  Pfam annotation: Domain name=Retrotrans_gag; Domain location=14-93; Score=11.7; E_value=0.0039; Accession=PF03732.8; Description =Retrotransposon gag protein
MDYQMRTPMHIWQREAKKWLHSFKGNNLKTWGEVVEKFMKKYFPESKTAEGKAVISSFHQFPNESFSEALERLQVVLFVVVLMNPTIVFLLKNKRRKSVTWEINKGKDTTKEDSQVSIKVPTISKDNGDHTLRTTKMEETLTQFMQVTMSNHKSTESTLKNLEIQVGQLAKQLAEKSSNSFGANTEKNPKEECKVL

SEQ ID NO: 154187 - protein, 16 aa, Glycine max
  Coding DNA Sequence Number=SeqID_62502
GNGKEDWCHPLKNFES

SEQ ID NO: 154188 - protein, 111 aa, Glycine max
  Coding DNA Sequence Number=SeqID_62503
MILKFHDDPTVNGFEIVVFLRLVWDVTANGQTKYAKYSDSKSIQMPKLRRISEMTRVMSKMTATATKSISLKPLGRDGTGRCHLVEEIPIVVPRYAVKPLARVTLESTDQR

SEQ ID NO: 154189 - protein, 115 aa, Glycine max
  Coding DNA Sequence Number=SeqID_62504
MERSMIDAANGGALGDMTHVEARNLIEKMASDSQQFSARNDAIVIKGVHEVATNSSSSAETKNLEGTIPGGGIIPTLDGRIPSQQQQQQQQPYFHNFVGPSRPYVPPPIQQQQQQ

SEQ ID NO: 154190 - protein, 106 aa, Glycine max
  Coding DNA Sequence Number=SeqID_62505
  Homolog annotation: Hit_ID=Q37082; Match level="QueryCoverage=75%, HitCoverage=58%, E-value=2e-23, Identity=67%"; Hit description =Uncharacterized protein ycf72
  Subcellular localization annotation: CTP_CleavageSite=66; ConfidenceScore=5.22e-01
MVWPIIVGKPQGVAGFFLPIGALPSPPPCGWSTGFITTPLTTGRLPSQHLDPALPKFFWFTPTFPTCPTVAEQFLDIKRTSPEGNFNVADFPSFAISFAYSTCCSS

SEQ ID NO: 154191 - protein, 182 aa, Glycine max
  Coding DNA Sequence Number=SeqID_62506
  Gene Ontology: Mol. function=peptidase activity
  Homolog annotation: Hit_ID=Q8H6W2; Match level="QueryCoverage=51%, HitCoverage=97%, E-value=5e-17, Identity=48%"; Hit description=Gag -protease polyprotein-like protein
IQGTNRLKILCLSTLEATSFVVQVEHTSTWVVILRTREGTSLVDQFKWRVHSLGCSKGTREGHLIQQVASEWYLEKSFTTSIFMASSNSLFPEGNSIHRPPIFNGEGYHYWKTRMQIFIEAIDYNIWEAIEIGPYVASIIDGSTSTGTKIEKPRDKWSEEDRRIVQYNLKAKNIITSALGIN

SEQ ID NO: 154192 - protein, 86 aa, Glycine max
  Coding DNA Sequence Number=SeqID_62507
MGFLTRSPQVSKSEKAESRFSDEEYQEYLKLKSEKPSNQAQPSSIPCFSTACISQSIEGHSPWILNSGASDHISGTWYRATDWRRT

SEQ ID NO: 154193 - protein, 83 aa, Glycine max
  Coding DNA Sequence Number=SeqID_62508
MITKVMTKSSKVNQRISSKCSRWNQEQFKTQEEKLKNTSRFKRKVEFKNQDSRIKLRELRSRFKIQDSRFKIQDSRFKNQVKT

SEQ ID NO: 154194 - protein, 81 aa, Glycine max
  Coding DNA Sequence Number=SeqID_62509
STLEDPQQGLWLPLNYQVDMRVSLAYDTGIWGMTFVDNWVVGKEKGCYWLSNDIVGLVGNSAIPTLILSSATTKSAKLEGV

SEQ ID NO: 154195 - protein, 104 aa, Glycine max
  Coding DNA Sequence Number=SeqID_62510
MVVSFFLTHLLLQVASPIIFLPSPFHCHDLQEAKESIDEEDPKPTSSTWSYINMVNFVFILTKGTKFVVNEVGSTAGVLKNRRGRCLVASVRPYDAILPPKGIG

SEQ ID NO: 154196 - protein, 130 aa, Glycine max
  Coding DNA Sequence Number=SeqID_62511
  Subcellular localization annotation: CTP_CleavageSite=53; ConfidenceScore=5.41e-01
MYPPLFSLNNLVDVPSTRTDPQEMCPLLFSVTTTQVDVPSTCTTKNVPSNVLRQSSQAGKGRIKRILRLCRFEFFDKGEGRLKRIQAVSPSFFWKREKRDTKIIQASLVIDYHQGVIDYASTDVTLHFEF

SEQ ID NO: 154197 - protein, 146 aa, Glycine max
  Coding DNA Sequence Number=SeqID_62512
  Homolog annotation: Hit_ID=Q6L477; Match level="QueryCoverage=82%, HitCoverage=19%, E-value=2e-10, Identity=29%"; Hit description =Putative uncharacterized protein OSJNBa0009L15.8
VDVTYENWKKVPTTQKDLIWEDIPVEFDILEASDSRTKRKLLQTMGERSSQFKSDLTRKWALVADQDEVEDTVCEKYDISKEKWAQFCQTRRDPSWEDVRKKAQAIQKQNIAPHVLSRGGYDYLEQKLLVEKTKKKLEEASQSGIL

SEQ ID NO: 154198 - protein, 274 aa, Glycine max
  Coding DNA Sequence Number=SeqID_62513
VTNITGLSGVTHSGRVFVPPDLPIQPTNVKGKAKVMEEQDDKPPLTPNEDIPVKSLLEKRDGYGKKEVSLEEASEFLRIIQQSEFKPTPNDVRGPLAVPHCQPTGRNNSQEDLPTPFPKVDQPNVKTYPLANHGGGVVNAIESDRSHRSKPLRDVATPRRFIYEALQKGGVIPHGGHEEDSCLLHPDELHNMETCLAVEDLLQRMIDQGRLEVDNEGREEQHICMQSTDERSFGRPKPLVVYFTKGATSQNPRYPSAAKPVPFPIPKQPRSPME

SEQ ID NO: 154199 - protein, 125 aa, Glycine max
  Coding DNA Sequence Number=SeqID_62514
MAYHASSKANQNSMKNHEIHFGKSYSIENFQGDQSYNLTIKMKQKEVGVLVEEVTQFMTKREKYFVKVEAQEENLVKEHESREKDEEQAQQQWEKYSTVENNQESILQINNLPRQRIQEKKPRRA

SEQ ID NO: 154200 - protein, 94 aa, Glycine max
  Coding DNA Sequence Number=SeqID_62515
MLCLNTLEGTSFVVQVEDTSTWVVLTENKRGTFLVDQFKWRVHPLGCSKRTREGFYKVEKKSQELVVAWGLDVATGCCRASINSCVCLLLPYTL

SEQ ID NO: 154201 - protein, 127 aa, Glycine max
  Coding DNA Sequence Number=SeqID_62516
MALCSVFLNLHLLLFVCLTIEALGVAKPSVASYLSQEILAKQEPHRVHGLPVQPPVKFNNMVVISLSMKLKEEHCSIGFPRPLTNQNKNPFSYGSMENHKPKGQEVSAVGVNIDNHMNEGSGWINSA

SEQ ID NO: 154202 - protein, 69 aa, Glycine max
  Coding DNA Sequence Number=SeqID_62517
MTEKEMITMIVDTLPVFYFEKMVGYTPSSFADLVFAGERIEVGLKRGKFDYPALTNKRHRANGEHEKEE

SEQ ID NO: 154203 - protein, 95 aa, Glycine max
  Coding DNA Sequence Number=SeqID_62518
MNNTSFQGLENQKTSERFWYKEEEDIQRDSSLVKDSQRSIKKNSRVQDKNQEEFKTQEESLETRIKIQGSRSQESRSRFKTQDSRMKRRLNQDKY

SEQ ID NO: 154204 - protein, 131 aa, Glycine max
  Coding DNA Sequence Number=SeqID_62519
  Gene Ontology: Mol. function=isomerase activity; Cellular component =endoplasmic reticulum; Biological process=cell redox homeostasis
  Homolog annotation: Hit_ID=P38661; Match level="QueryCoverage=44%, HitCoverage=15%, E-value=1e-16, Identity=74%"; Hit description =Probable protein disulfide-isomerase A6 precursor
  Pfam annotation: Domain name=ERp29; Domain location=52-124; Score =55.6; E_value=1.6e-13; Accession=PF07749.3; Description=Endoplasmic reticulum protein ERp29, C-termi
MCSDIYSNLATFSSRFLDMSKQVHDEVILEGPTESAEVAKSIVIECIVLKTGTVESLDVLVKEFVAASDEEKKSVFTRMEEEVEKLKGSASRHGKIYLKAAKNYLEKKTNETYAEFLCLLQKFIHNRIYVK

SEQ ID NO: 154205 - protein, 81 aa, Glycine max
  Coding DNA Sequence Number=SeqID_62520
MNFAARKPVEFTPIPVSYADLLPYLLDNSMVAHNPNQGFSTFTGIGCKPLVYFLKRPMLLSLGLPRSFNQRLLVLHIGGVP

SEQ ID NO: 154206 - protein, 123 aa, Glycine max
  Coding DNA Sequence Number=SeqID_62521
  Homolog annotation: Hit_ID=Q6WAY3; Match level="QueryCoverage=40%, HitCoverage=2%, E-value=8e-08, Identity=52%"; Hit description =Gag/pol polyprotein
  Subcellular localization annotation: CTP_CleavageSite=38; ConfidenceScore=5.57e-01
QISHEPNNVITQPITVPLTQSSTKAIPKSSTKFVGRTSNAKRKPKHQPRNEFGSEKVCRIHPNSAITTTKVPQPPFLRGYDSNATCAYHGGAPGHSIEHCRALKHNVQGLIDAGWLKFEENHV

SEQ ID NO: 154207 - protein, 125 aa, Glycine max
  Coding DNA Sequence Number=SeqID_62522
MGIQKNSQAISPLNTFVLGNGKNQRILRLCRFEFFDKGEGRHKRIRRLVLCSFGKGRRETQKEFRRLVLHEFFLAKGEENEKMNNTSFQGLENQKTLESFWHKEEEVQRDSRLVKKCNRLIGKVY

SEQ ID NO: 154208 - protein, 81 aa, Glycine max
  Coding DNA Sequence Number=SeqID_62523
MVVILPKEHLVVWFCSWHNRPDNYLKGIINSLNQRLLLGGLSSSVIDKKEYFNDPRPLEPERLKALQIQWAQYYLRVRDQT

SEQ ID NO: 154209 - protein, 87 aa, Glycine max
  Coding DNA Sequence Number=SeqID_62524
MLWKLGGIDGDPVLRGTRIRATWEYVSSVEGGQLRIVDSCVICGCGEMIYTIARSPPSTTYDGRPWGRQVGCYCPKPSLTNPDPTRA

SEQ ID NO: 154210 - protein, 193 aa, Glycine max
  Coding DNA Sequence Number=SeqID_62525
YILRGTSRGYISCGSVLVEGFYMVEKKSQGPQVACGGYIPCGSSHSIIDPKFIDMDFFSNESFECIQAFENSNLIPFMSLKFPVYSDLVKAFYSNLEIQEGTLISEVYGIKMVNDQSLFYDLTQLSNEGVSFEGTLIDDWKYDFSVHDAHRLVCTNQADMTGRLLAGSLAFESRILHYLIVRILLPRPSKLAQ

SEQ ID NO: 154211 - protein, 159 aa, Glycine max
  Coding DNA Sequence Number=SeqID_62526
  Subcellular localization annotation: CTP_CleavageSite=30; ConfidenceScore=5.12e-01
MYPLLFSVTTTQVDVPSTCTTKDVPSNVLRQSSQAGEGRHKRIQEVSPLFFWKREKGDTKEFRQLVLRSFGKGRRETQKEFRRLVLVEFFLAKGEERHKRIQAVSPSFFWKREKRDTKRIQAVSPCRILFGKGRREKSDTKRIQAVSPCQILFGKGRRE

SEQ ID NO: 154212 - protein, 93 aa, Glycine max
  Coding DNA Sequence Number=SeqID_62527
MKPPDVQEDHIFMKAFPHSLEGVPKHWLYYLAPRSITSWDDLKRISEQLLLQYFYEGLSNMERSMIDATCGGALGDMTPAEARNLIEKMASNS

SEQ ID NO: 154213 - protein, 117 aa, Glycine max
  Coding DNA Sequence Number=SeqID_62528
MSGFTRDSPQISASPNQLDLAPYALGPYHVQWNALGLLYDKHTLCSSRILREMEVDEPWLGLWLPLNYQVVFVIGSAVDRLCVDLGMAFVDSWVVGKEKGCYWLSNDIVGLVGNLVV

SEQ ID NO: 154214 - protein, 285 aa, Glycine max
  Coding DNA Sequence Number=SeqID_62529
MVSIWDLARVEVSMEPIASLAQYYDQPLRCFIFGDFQLSPMVEEFEEILGCPLRGRKPYLFSGFYPSLARISKISPNLGAGIRPPKASRKWGGRNTEKIFGVLFPNVDGLVDLAAIDVFLAYHNHKESPVVAMLADLYDTFDRRCPSIRYKVTARASKKERRIGTNSWLAWGGVLTTTRGYSKEFARHGMRREERTDSLGGSSNGIIGGYHKWLRVRTQGLDWLPNLKTVRDDEVKASEESDEVQALKAELERARAAIVSSSSEEVKGIITGQRHDLEGRAEGLP

SEQ ID NO: 154215 - protein, 158 aa, Glycine max
  Coding DNA Sequence Number=SeqID_62530
  Homolog annotation: Hit_ID=A5ADW6; Match level="QueryCoverage=76%, HitCoverage=4%, E-value=3e-11, Identity=32%"; Hit description =Putative uncharacterized protein
  Pfam annotation: Domain name=Retrotrans_gag; Domain location=95-158; Score=3.3; E_value=0.026; Accession=PF03732.8; Description =Retrotransposon gag protein
HPEHSVIGESVHSVTGEAVHSVTGEAVHSVIGDFEHPDFEHYNFEHSENMAQPPPRERTLREMAAPDFTYGSLCIQYPDEDVPYVLKTGLIHLLPKFHGLAEGVAKDWLYYLAPRSITSWDDLKRVFLEKNFPASRTMAIRKDISDIRQLNGESLYEY

SEQ ID NO: 154216 - protein, 77 aa, Glycine max
  Coding DNA Sequence Number=SeqID_62531
MMGERSMFLDLKSIEGGTIAFGGMGKGKITGIDQCIVKTEDDKFFFTVRQHNNMYEIDLTGLSKQNVMCLLSREDEK

SEQ ID NO: 154217 - protein, 108 aa, Glycine max
  Coding DNA Sequence Number=SeqID_62532
MGCSKQMLTWPLGRIHDVGYNVQDILPENTGVAESIEVAGSTMSDTMSRTSCPKILELLKALKLQDPRCRIRCPGHLARKYWTYKSVISLTDYCAVSKRLDDLSLGTN

SEQ ID NO: 154218 - protein, 131 aa, Glycine max
  Coding DNA Sequence Number=SeqID_62533
LCQSFGVPVTPSKAADAPPPHQAGPAGSFDTEQYLRHLVHQQAANHRAHVQTHDCLYQLSLSLQSQDFTSFPCPTPDQFRAEVAWPGDWPEARAGEAPVEAPAEAPDEADEAREDEEIIDLLDFLGGSGAT

SEQ ID NO: 154219 - protein, 68 aa, Glycine max
  Coding DNA Sequence Number=SeqID_62534
MYPLLVPQRMYPPNVLRQSSQAVSPLKLCEMGKQKKFSGGRRETQKEFRWLVLGEFFLAKGEGNEKDE

SEQ ID NO: 154220 - protein, 219 aa, Glycine max
  Coding DNA Sequence Number=SeqID_62535
DPTLPGQVKVGVEEVTDADAPVPVPTDEVSLMGQTLHTFLAWPTHLVKSLSQQVAVSPAKPPPKPDPEVDDLLYLMTLSIPELFLRPYQVTWDATVFGVFNPDFPLYIKHEDLSEITHGGQCLSISVLQHLTETSMRAGNSDIYGFLKPQSIQRSGQSQFESESYRKTWMQSSKHDVYLRAYLNGPDNYLKGIINIALKGLDDGPQPKSKAPARWIVVK

SEQ ID NO: 154221 - protein, 66 aa, Glycine max
  Coding DNA Sequence Number=SeqID_62536
FDDVKKNLLDNDCHHQKGGECESLLQDFFKIKPCLKTKGFKVMQGSSNRLPGSVIDYQKGSLKKGC

SEQ ID NO: 154222 - protein, 124 aa, Glycine max
  Coding DNA Sequence Number=SeqID_62537
  Homolog annotation: Hit_ID=A5ZQM3; Match level="QueryCoverage=55%, HitCoverage=96%, E-value=5e-21, Identity=55%"; Hit description =Putative uncharacterized protein
  Subcellular localization annotation: CTP_CleavageSite=36; ConfidenceScore=5.16e-01
ASQKVTEACKGFLGPDGDWPSSAKAEGSLTARPTRRAGTKVGLSDPTVPSGRAVAQRIKGWAVRPLKRYVSWVQNVVRQFGPYPDREGRTSGVPVIVPTVNAGASGSTAETAMGSLPQRGWSER

SEQ ID NO: 154223 - protein, 42 aa, Glycine max
  Coding DNA Sequence Number=SeqID_62538
VPCYKVMTKDNDGTSKPYTRAMKGTMHKPPSEPRGRLEVLTE

SEQ ID NO: 154224 - protein, 87 aa, Glycine max
  Coding DNA Sequence Number=SeqID_62539
  Subcellular localization annotation: CTP_CleavageSite=79; ConfidenceScore=5.53e-01
PANSLPSTVRQFSILNFIRRPMNSLPSAVHVSSTIESGAPRIHCLALPANSFPSAVRQFSILHLIRRPMNSLPSAVHVSFVMKRGAS

SEQ ID NO: 154225 - protein, 127 aa, Glycine max
  Coding DNA Sequence Number=SeqID_62540
  Gene Ontology: Mol. function=nucleoside-triphosphatase activity; Cellular component=chloroplast
  Homolog annotation: Hit_ID=Q2PMM5; Match level="QueryCoverage=66%, HitCoverage=3%, E-value=1e-33, Identity=85%"; Hit description =Protein ycf2
  Subcellular localization annotation: CTP_CleavageSite=35; ConfidenceScore=5.12e-01
MFRSSSIQSFSFSLLLDISFVHIFSLFLESIVSYRQSSKRYPTSELNSFWLKNLFLVALEQLGDSLEEIRSFAFGGNMLWGGGPTYGVKSIRSKKKYLNLIDLISIIPKSHQSNRFFEKYETSKSSK

SEQ ID NO: 154226 - protein, 32 aa, Glycine max
  Coding DNA Sequence Number=SeqID_62541
MARVAKQNRNEVVRVPRRCLEEKAKALANQGE

SEQ ID NO: 154227 - protein, 91 aa, Glycine max
  Coding DNA Sequence Number=SeqID_62542
DCARKTPSGPEEGQQCLGVASSKYGSLSVQGSACCPQQGHQAPYQSSFHLEVLRLQAGAGRNTTAAWGWPAAGNRCTAITSRVHLNYPQKG

SEQ ID NO: 154228 - protein, 89 aa, Glycine max
  Coding DNA Sequence Number=SeqID_62543
MVSYKDNSIISCTELLGVGSHLLNQIPSLNRCHITKSSTTSSINHIPLHVAKSLRNIAEGVARKSGLLIQALSTMVVKLTILRRIVKVP

SEQ ID NO: 154229 - protein, 36 aa, Glycine max
  Coding DNA Sequence Number=SeqID_62544
MELFDAHARCPSLPQCKAFEVSIVAFRHDLVAREPI

SEQ ID NO: 154230 - protein, 77 aa, Glycine max
  Coding DNA Sequence Number=SeqID_62545
MKMLLIPHDDLLHQWIPLLLEDEWQRNGERKREETHFKEKMSLEEAHHHRRPWIRAWRKKEMNEGRGREEHEILCSK

SEQ ID NO: 154231 - protein, 46 aa, Glycine max
  Coding DNA Sequence Number=SeqID_62546
  Gene Ontology: Mol. function=structural constituent of ribosome; Cellular component=ribonucleoprotein complex; Biological process =translation
  Homolog annotation: Hit_ID=Q2PMP7; Match level="QueryCoverage=100%, HitCoverage=33%, E-value=3e-14, Identity=63%"; Hit description =Chloroplast 30S ribosomal protein S3
  Pfam annotation: Domain name=Ribosomal_S3_C; Domain location=1-43; Score=6.7; E_value=0.008; Accession=PF00189.11; Description =Ribosomal protein S3, C-terminal domain
MKKAIELTEQAGTKGVQVQIAGRIDGKEIARVEWIREGIKVWIFSK

SEQ ID NO: 154232 - protein, 151 aa, Glycine max
  Coding DNA Sequence Number=SeqID_62547
MQSQFQSQMQSQGLALPPEPMAGPSGRFYEGSTVHNIPLLPGQVKVGVEEVKDALAPVPVPTDEEIVSPTKPPQRVDPEVNDPLYMMILTILELFLKPFQVNWDATVFKVFNPDFPLYIKHKDLSKIAHGGQCLSISIIQLWILYVNLAYC

SEQ ID NO: 154233 - protein, 76 aa, Glycine max
  Coding DNA Sequence Number=SeqID_62548
MPAEWRRKRERRRHFKEKMSLEEAHHHRRPWIRAWRKKEMNEGRGREEHKILCSKRALRSEATNPRSISRFSTKCA

SEQ ID NO: 154234 - protein, 201 aa, Glycine max
  Coding DNA Sequence Number=SeqID_62549
  Homolog annotation: Hit_ID=A6BLN7; Match level="QueryCoverage=90%, HitCoverage=34%, E-value=3e-10, Identity=28%"; Hit description =Putative transposase
FLKFLDDYKGDGPITVLLSHCRIKEAQGSYLASISNSFKASKLIINQPVMEIQEFNERLAELGIEARSGFKSHGEGSTQLSGSIQLSSKESFFGKAEAKTIVEINTISEEIVCVTVGTITRIVLDNHSWCYTACIQCHKKSDTKMAPFTCACDKYNKEVVLRYRLEVMINQGNESTKFLLWDRECSELIGQSADAVNKLKL

SEQ ID NO: 154235 - protein, 128 aa, Glycine max
  Coding DNA Sequence Number=SeqID_62550
MSGFTRDSHQISASPHQLDLAPYASEPYNAQWNAPGLLRDKHTLRSSRILGEMEVDEPWLGLWLPLNYQVDMGASGVRHWKCGRQTLWLILGMAFVDKWAVGMAVTAWVSPSSSPSLFAPVFSFVQAG

SEQ ID NO: 154236 - protein, 153 aa, Glycine max
  Coding DNA Sequence Number=SeqID_62551
MYPPLELIHKRCTVSCSQSTTQVPSTCTTKDVPFNVLRQRSQAVKPLILCEWGYKRILKREKGDTKEFRRLVLCSFGKGRRETQKEFRRLVLGELFLAKGEEMKRMNSTSFQGLENQKTLESFWHKEEEEVQRDSRLVKDCNELIGLIDRLIE

SEQ ID NO: 154237 - protein, 56 aa, Glycine max
  Coding DNA Sequence Number=SeqID_62552
PFELIGLGSSSSMESFASWRSIAAEWRRKIDDRRSHFKEKMNQEEAHHHRKPWIRA

SEQ ID NO: 154238 - protein, 71 aa, Glycine max
  Coding DNA Sequence Number=SeqID_62553
MVAITPARFPQPPFFRGYDSNATCACHGKAPGHSIEHCMTSKHKVQGPIDAGWLKFEENRVIFKFMPQLQR

SEQ ID NO: 154239 - protein, 97 aa, Glycine max
  Coding DNA Sequence Number=SeqID_62554
MCPPPTKVKTKGAPKKVMKRSERSTKRDPSYWEYVDAYHLVQNRNTSVRPSASSFKPPKPARMIPMLDQFPPFMHGFIEDVVDVVRQVASDILRRGG

SEQ ID NO: 154240 - protein, 161 aa, Glycine max
  Coding DNA Sequence Number=SeqID_62555
  Gene Ontology: Mol. function=transmembrane receptor activity; Cellular component=intrinsic to membrane; Biological process=innate immune response
  Homolog annotation: Hit_ID=A7PQ86; Match level="QueryCoverage=67%, HitCoverage=16%, E-value=6e-25, Identity=52%"; Hit description =Chromosome chr18 scaffold_24, whole genome shotgun sequence
  Pfam annotation: Domain name=TIR; Domain location=21-146; Score=68.9; E_value=1.7e-17; Accession=PF01582.11; Description=TIR domain
MASNTIIQCSPSTHTKRKYDVFVSFHGEDSHNNSTSFLFEALRKKGIDAFRDDAGLNKGESIAPKLLQAIEGSRLFIVVFSKYYASSTWCLRELTHICNCIEISPRLPIFYDVGPSEATTICREIEEIVQNILKILGPKFSSLPNDHLVGMESRVEDLVKL

SEQ ID NO: 154241 - protein, 76 aa, Glycine max
  Coding DNA Sequence Number=SeqID_62556
MAAEWRRKRERKRHFKEKMSLEEAHHHRRPWIRAWRKKEMNEGRGREEHEILCSKRALKSEPTNPRSIPRFSTKCA

SEQ ID NO: 154242 - protein, 42 aa, Glycine max
  Coding DNA Sequence Number=SeqID_62557
TIVIFRHDLVARNLLGEKELLLALNGSGVRSSKEHRAFHSPK

SEQ ID NO: 154243 - protein, 211 aa, Glycine max
  Coding DNA Sequence Number=SeqID_62558
MAEPSKKRKGSSSRSQQHSETQETPIPSSIPFTSLFSSEEQRIWYTNLFSSRSIIDPKFIDMDFFSNESFECIQAFENSNLIPFMSLKLPVYSDLVKAFYSNLEIQEDTLISKVYGSKMAIDQSLFYDFTQLSSEGVPFEEGHGGEDSSLLQNILDRFDGLQTFFGERFDTLELQVDMHFNEMESRITKVEEDVSYIHTSFDLPPPPPSSS

SEQ ID NO: 154244 - protein, 118 aa, Glycine max
  Coding DNA Sequence Number=SeqID_62559
MNPYENIHSMQKRFTHTINHLASLGKIFPNEDLINKVLRCLSREWQPKEHEMELQRLNQNDETDKKKRSITLKASSSMQEANEEEDSDDEEDFSLFVKKFQKFVKKRRIERRQNFNNG

SEQ ID NO: 154245 - protein, 44 aa, Glycine max
  Coding DNA Sequence Number=SeqID_62560
MDKSLKVGEDEWRGRERERRGTKFCASKEPTNPRSSPRFSTKCA

SEQ ID NO: 154246 - protein, 153 aa, Glycine max
  Coding DNA Sequence Number=SeqID_62561
MHALLGSFNTGNWSDSKVLDSIGLSCRTITRNRDILYTCSYSHLSLHTGHLFAEIAYQITQVPREFDTRFLPFYTTCAIRCTCRKQNKFLAPLPGNFFLFGKSPTSNLVPLDFEIEATLRSNRAEGRSKLLQDRTVASILEEETHFSELSSPD

SEQ ID NO: 154247 - protein, 49 aa, Glycine max
  Coding DNA Sequence Number=SeqID_62562
THLLLEVASPLSLPFFIPLPFIFQEAKESIDEEDPRPTSSNGLGFYQFN

SEQ ID NO: 154248 - protein, 108 aa, Glycine max
  Coding DNA Sequence Number=SeqID_62563
MKMLLIPHDVSSIGACRPRIFFINGFHCILEDEWQRNGEGRERGDATWSEWRRKRERRRHFKEKMSLEEAHHHRRPWIRAWRKKEMNEGRGREEHEILCSKRALKSEV

SEQ ID NO: 154249 - protein, 106 aa, Glycine max
  Coding DNA Sequence Number=SeqID_62564
  Homolog annotation: Hit_ID=A5BJV7; Match level="QueryCoverage=79%, HitCoverage=13%, E-value=2e-08, Identity=36%"; Hit description =Putative uncharacterized protein
MKNWMQNSKRDVYLGAYLNDAHWQMVILLPKENLVVWFCSLHNRLDNYLKGIINSALKGLDDTPQPKSKVGARWIVVKCNRQKGSIECGYYVMHWMSTIILGSFQE

SEQ ID NO: 154250 - protein, 48 aa, Glycine max
  Coding DNA Sequence Number=SeqID_62565
MSKREHELFKEYAQRRKDLVAQVAAPMVEREMITMIVDTLPVFYYEKL

SEQ ID NO: 154251 - protein, 254 aa, Glycine max
  Coding DNA Sequence Number=SeqID_62566
MDNEEGVQEQMKADLSALKDQMASISEVMLKLQKTIEDKATATASSTVREAEPVLQPALNPGLDRNTAVFGRRYSPQAYPYGLPPNFTPRATPEDLSQAPTFEGQLPPYEDYPGQDDGEGDTHLGPLLHLKDLSPHEIPQPNIVRHTPASPTPVKESIPFAEDRGKIEALEERLREVEGLGNYPFSDLADLCLVPNIVIPPKFNVPDFDILQRDDMSKGASPDVFPEDGGHILRTKNFLVHFLSRQLWPEQLYH

SEQ ID NO: 154252 - protein, 162 aa, Glycine max
  Coding DNA Sequence Number=SeqID_62567
MWAFHTARQLGWAHLVRYRMHKALRLNAPLPYSHLVTLFLRHFQIPLHSEPYVPIKRSFLIGAAVIASFGYRKEHDGSWVKKGAQPVDDEGNLPVEDNSSLLRRLLDKFDGLQTFVGDKFDAMELQVDMRFDAMDSRITKVEEDVSFIRTCFDPPPPPPSSS

SEQ ID NO: 154253 - protein, 200 aa, Glycine max
  Coding DNA Sequence Number=SeqID_62568
MKIFLSFDKFLPQHAPFISREVGPAWFTDDFPAVDPDNEEEVNEIWSFYLNPQILSCRTVGDTTIMISKLESGFTQPTVENIRSNLQARGKTIITKKSTETSRADVRPKKPIGVKIQEGKQEEKSQKKDDSTETTTTSKRSKRVVIELDEEKDASFISNVNIITLFQVYILTFLYHHNTGRRGKTSHKKKKITCDFDQIC

SEQ ID NO: 154254 - protein, 155 aa, Glycine max
  Coding DNA Sequence Number=SeqID_62569
VRKAWEVLQKKDKELRGSNNGPIGGYHKWLKAHVQGLDWLPSLRTAKREEVEAPEEDEEVQALRAELEHSPNSQRKTKRARREEHGRNKFRGALWGSNSELKLRREEMDQSRVDSLILKDELKRQQCGWTDLAYLERELKNFPDWLAKAKAMAEP

SEQ ID NO: 154255 - protein, 42 aa, Glycine max
  Coding DNA Sequence Number=SeqID_62570
REKKESHEESTNGGFNPFSVSLTFGNSIGTVEGKTEGISGNR

SEQ ID NO: 154256 - protein, 80 aa, Glycine max
  Coding DNA Sequence Number=SeqID_62571
MMTTKDDDKSDEQKAQVNQRTSISRESRTSQEFKNQEEFKTQEESLQSRIKIQDSRSQESRSRFKTQDSRMKKKLNQDKY

SEQ ID NO: 154257 - protein, 47 aa, Glycine max
  Coding DNA Sequence Number=SeqID_62572
MENTMKNKELKSMAAEWRKRKGDWRRHFKEKMSQEQAHHNRKPWIRA

SEQ ID NO: 154258 - protein, 55 aa, Glycine max
  Coding DNA Sequence Number=SeqID_62573
CGRKLSWPRSHPPSPSDRNCLILRIPTLLPDVGQVNHRAQALKSKAVRDNLSNST

SEQ ID NO: 154259 - protein, 114 aa, Glycine max
  Coding DNA Sequence Number=SeqID_62574
VPLGVENNDGLWWLMVAVGDGESAWKFRNGIGRKKEEEMMRCSRERKLLAHSRHLLKDPNGQIMVKCLLKLNTKCREDPTVNEGWAAFLPRQLYVVFSRSFIKRLPPEASLRGF

SEQ ID NO: 154260 - protein, 46 aa, Glycine max
  Coding DNA Sequence Number=SeqID_62575
MAHHMPIGMCPKGTLVDLLNHEDGTTYKETNSQSPQRPFVIVRNPL

SEQ ID NO: 154261 - protein, 170 aa, Glycine max
  Coding DNA Sequence Number=SeqID_62576
MDSCARNGPFDTSPEIKVRGWWTLGDSVGRRGYVGKLPLLSTICRGSGGIIGNSFPILRGGTVMSPEWVWARTATGMPMWLTLGVTCTNMGWCMSPGNLEEGMHHQDSGQIGHGLVMLASVHKFRDNVRGRGGGNRRGGSTRSAKFRATVPSQFPSGELAHDEPVGSLYR

SEQ ID NO: 154262 - protein, 111 aa, Glycine max
  Coding DNA Sequence Number=SeqID_62577
  Subcellular localization annotation: CTP_CleavageSite=61; ConfidenceScore=5.84e-01
MILSSWQNKLYRHMATPPNSPPPPSESATPSSLSTSKKTSKTTRLRLLATRPVGVGRPMVNVDLVTRNVDGPHRKKLSTYLGIVAHDKVNVIYDNLEKVFVAQKDLIWEDI

SEQ ID NO: 154263 - protein, 70 aa, Glycine max
  Coding DNA Sequence Number=SeqID_62578
MASYGVASPLSLPFSIPLPFIFQEAKESIDEEDPRPTSSNGACIMWYQSIFIKLDVLDKCFLSFCSLNSL

SEQ ID NO: 154264 - protein, 131 aa, Glycine max
  Coding DNA Sequence Number=SeqID_62579
LGFHALITALCKARGVHSDSLTLESLSPANNLAYIKKNYWNLDDPTVTFRGPKKARGKRSEAPSIAPSETEGPSSSTLPPSSSTKIPVIPPTPSQIPLPALLSTNPADFIFTSQMLHSMLQSIHRGQSIIM

SEQ ID NO: 154265 - protein, 100 aa, Glycine max
  Coding DNA Sequence Number=SeqID_62580
TSFRYRKDRNGQWLKKDALPPQDERTPSPPPPLEDSALMNEVLSELRGLRSYVGDRFDSLDTRFADMDIRLTQLEEEVGYIRQSFDLPPPPLLDKWPQIS

SEQ ID NO: 154266 - protein, 103 aa, Glycine max
  Coding DNA Sequence Number=SeqID_62581
MSLHVLYLYAFSGFPPGISCLLYLSLQSFKEMNVDSRLFSPHGQDHLGLPSGVKTKHEWQKPVKVLKDERKRGWGHERPIVALLCAKQAGNVAARQPRILSIL

SEQ ID NO: 154267 - protein, 114 aa, Glycine max
  Coding DNA Sequence Number=SeqID_62582
MGKIKRILRLYRFEFFDKGDTKEFRWLVLRSFGKGRRETRKEFRRLVLPSFGKERRETEKEFRRLVHGEFFLAKGEENEKMNSTSFQGLENQKTSESFWYKRRRRRTSKRFQGL

SEQ ID NO: 154268 - protein, 99 aa, Glycine max
  Coding DNA Sequence Number=SeqID_62583
  Homolog annotation: Hit_ID=A5BWF3; Match level="QueryCoverage=76%, HitCoverage=5%, E-value=3e-07, Identity=34%"; Hit description =Putative uncharacterized protein
  Pfam annotation: Domain name=Retrotrans_gag; Domain location=1-87; Score=12.6; E_value=0.0032; Accession=PF03732.8; Description =Retrotransposon gag protein
MRWLHSFKGNSLKTWDEVVEKFLKKYFPESKIVEGKAAISSFHQFPDESLSEALERFCGGKIKLKTPEEAMDLIENMAASDIAILRDRAHIPTKKSLLS

SEQ ID NO: 154269 - protein, 74 aa, Glycine max
  Coding DNA Sequence Number=SeqID_62584
MSQCALHGRGSRVRFPKDERCAESPPTFIGGKRRENRRKPVDKSGAFAPTYPPSKRKSDLRSSSLSVNQAILFT

SEQ ID NO: 154270 - protein, 45 aa, Glycine max
  Coding DNA Sequence Number=SeqID_62585
MTGNASKFTHISPKKSEHVTYGDNNKDKTSNHAQCFLSKDDDFWL

SEQ ID NO: 154271 - protein, 19 aa, Glycine max
  Coding DNA Sequence Number=SeqID_62586
MAQGLTSWMEQKKKKLGKM

SEQ ID NO: 154272 - protein, 285 aa, Glycine max
  Coding DNA Sequence Number=SeqID_62587
  Homolog annotation: Hit_ID=A7PXW4; Match level="QueryCoverage=92%, HitCoverage=73%, E-value=2e-58, Identity=41%"; Hit description =Chromosome chr15 scaffold_37, whole genome shotgun sequence
MNMLLWLPAYPTIQPGWDLDDEIHATFFKCISWQVEETLDTVNCPYHYFCDKTYPSNYPLVVDILVLLFTAASYFVTLAILVMDMSSGRGRIFLCQSKRFLLPSGPISLPLIILAFAKGPQINTIFPLNCIGPAILLMVLISAFVWHFACKLVSGFRCAALLHRKEALFVGGKLVRYRGWSMTTFFVVGVLCLRIVCKISGENYAGKFLFIKALMERFSWILITVDCVYLTLNSPPERVMLRVAAFGGIFLLIFLQLLKEACSQIYSMACVAEKLRWVSAPSHTI

SEQ ID NO: 154273 - protein, 1776 aa, Glycine max
  Coding DNA Sequence Number=SeqID_62588
  Gene Ontology: Mol. function=metal ion binding; Cellular component =cellular_component; Biological process=protein modification process
  Homolog annotation: Hit_ID=A7P2W1; Match level="QueryCoverage=98%, HitCoverage=62%, E-value=0.0, Identity=47%"; Hit description =Chromosome chr1 scaffold_5, whole genome shotgun sequence
MDRSGKVRSTWNRLLLEDLVAPAFMHMLLGIKELLGPTDIYYSLWPIGSFEEPWNILVQQIYKNIGNAPVMYSNYNGGRWVSPSEAFLHDEKFTKSEDLGLALMQLGMPVVHLPNSLFDMLLQYSSCKVVTSGTVRQFLRECGMFNYLSRQYKLLLLEYCLEDLVDDDVGKEAYDLPLLPLANGNFASFSEASKGVSYFICDEFEYKLMQPVSDRVIDQNIPPNILNRLTGIAMSSKTNVILCSIHHFAQLFPAFMSADWKYRSKVFWDPESCQKPTSSWFLLFWQYLGKQTEILPLFSEWPILPSTSGHLLRPSRQLKMINGSNLSDTVQDILVKVGCNILSPKYVVEHPDISNYVCDGSAGAVLESIFNAVSGPVVMHASFDSLVTEERNELRRFLLDPKWYVGRSMDEFVIRLCKRLPIFQVYGRDSAQDYQFSDLENPRKYLPPLDVPEIILVGIEFMVRSSTIEGDILSRYYGVERMGKAQFYKQHVFNRVGDLQADVRDSIMLSVLQNLPLLSLEDISIKDSLRNLKFIPTFIGALKCPSVLYDPSNEELYALLEDSDSFPAGAFRESEILNILRGLGLRTSVSPNTVLECARCIERLIHEDQQKAYLRGRVLFSYLEVNALKWLPDQVIDNKGAVNRMLSRATTAFRSCNTKSDLEKFWNDLRLVSWCPVLVSTPFQSLPWPVVSSMVAPPKLVRPLNDLWLVSASMRILDGECSSTALLYGLGWMSPPGGGVIAAQLLELGKNNEIVSDQVLRQELAMAMPRIYSILSGMMASDEIEIVKAVLEGCRWIWVGDGFATSDEVVLDGPLHLAPYIRVIPVDLAVFKKMFLELGIREFLQPADYAHILCRMAVRKGSSPLDTQEIRVVTLIVHHLAEVYHHEPVQLYLPDVSGRLFLAGDLVYNDAPWLLGSDDPNGSFGNAPTVALNAKRTVQKFVHGNISNDVAEKLGVCSLRRMMLAESSDSMNFGLSGAAEAFGQHEALTTRLKHILEMYADGPGTLFEMVQNAEDAGASEVMFLLDKSHYGTSSVLSPEMADWQGPALYCFNDSVFSPQDLYAISRIGQESKLEKAFAIGRFGLGFNCVYHFTDIPMFVSGENVVMFDPHASNLPGISPSHPGLRIKFVGQQILEQFPDQFSPLLHFGCDLQHPFPGTLFRFPLRTAGLASRSQIKKEAYTPEDVRSLLAAFSEVVSETLLFLRNVKSISIFVKEGTGQEMRLLHRVHRTCIGEPEIGSTEAQDMFNFLKESRHVGMNRVQFLKKLSLSIGRDLPYKFQKILITEQSTSSRNSHYWITTECLGDGNAQKRTSETANSNCYNFVPWACVAAYLNSVKLDGDLVESSEVEDDCMVSPDLFKSVSLPTYPLENFEGRAFCFLPLPISTGLPAHVNAYFELSSNRRDIWFGSDMAGGGRKRSDWNIYLLENVVAPAYGHLLEKIASEIGPCNLFFSLWPTSLGLEPWASAVRKLYQFVAEFNLRVLYTEARGGQWISSKHAIFPDFTFPKAAELIKALSRASLPVITLPQSLLERFMEICPSLHFLTPRLLRTLLIRRKREFQDRNAMILTLEYCLHDLQESMQFDTLCGLPLLPVADGSFTSVDMKGVGERVYIARGDEYGLLKDSIPHQLVDCAIPEEVHRKLCYIAQTDGTNISFLSCQLLEKLLVKLLPVEWQHARQPVTARGVLNVFLAIAGEPQKIDGILTDVSEGELHELRSFILQSKWFSEEQIDDTNIEIIRHLPIFESYKSRKLDLSLKSSFSSARFVLAGNGSWQQPSR

SEQ ID NO: 154274 - protein, 329 aa, Glycine max
  Coding DNA Sequence Number=SeqID_62589
  Homolog annotation: Hit_ID=A2Q4W6; Match level="QueryCoverage=40%, HitCoverage=16%, E-value=5e-09, Identity=30%"; Hit description=RNA -binding region RNP-1
  Pfam annotation: Domain name=RRM_1; Domain location=97-168; Score =28.3; E_value=2.8e-05; Accession=PF00076.13; Description=RNA recognition motif. (a.k.a. RRM, RB
MRDRGGAFDQHSETHRAQPRETLRERTTRMCKELEQVKWNTEHEDNTDYTTNHGEWVKVSHRRSRKGSEIGGRQTTRGDQKPERYMTWRDKEHVTTFYFSRFPEEIRESDLWKLFQKWGRVREVFIPRYRNKVGHRFGFVRFIEVVDERRLERQLDNNIFIGGMKLFVNSPKFDRGKMFQTNLYEEDIQKEGKSQVKLTGKQHAYKNEPGFGRRQRSYAEVAKEATTGEGSSYMVIGDAQDIKGDRQRKMVLSPTREDKEWLQRAWVGRLKNRGMFERLEEELKWTFEHEVQPCYWVDDWVILPYLDDIKAKHMINEERKHGSSPISEL

SEQ ID NO: 154275 - protein, 78 aa, Glycine max
  Coding DNA Sequence Number=SeqID_62590
MVKEVEIGKGVGEAGEEGRHTLVPFNTGGISKEDTLSGAKFKLVRVIRMQKRIASSAKDFKECVIRKRQEAYEECPLH

SEQ ID NO: 154276 - protein, 1691 aa, Glycine max
  Coding DNA Sequence Number=SeqID_62591
  Gene Ontology: Mol. function=metal ion binding
  Homolog annotation: Hit_ID=Q9FN44; Match level="QueryCoverage=98%, HitCoverage=34%, E-value=0.0, Identity=52%"; Hit description=Genomic DNA, chromosome 5, P1 clone:MYJ24
MHAIDVNLYSEGTTVIDRWLVALSLGSGQTRNMALDRYDYLKNVVDIMWRYLAYDLTPVAGIAALISSNGHHANVYSRSSIMAPLPMSGCINMPITVLGCFLVCHNRGRYLFKYQDRGTLAEGHFDAGNQLIESWNREVMSCVRDSYVEMVLEIQKLRRDIPSSIIDSSVCSAISLSLKAYGDKIYSFWPRSCERHVLSDQLGNHDNNHPSTTAVVLKADWECLKDRVIHPFYSRIVDLPVWQLYSGTLVKAEEGMFLSQPGNGLLGNLLPATVCSFVKEHYPVFSVPWELVTEILAVGFSVREIRPKMVRDLLKVSSKPIALRSVDMYIDVLEYCLSDFQLAESSSSARDNDPASANVFCRETDNGITSSQMGSNIHGSTGMATRGSASSGDALEMMTSLGKALFDFGRGVVEDMGRAGTPVAYNAAGIDQIRDQKFISIAAELKGLPFPTATSHLKKLGFSELWIGNKEQQSLMVPLGEKFIHPKILDRPLLGDIFSNFSLQSLLKLRNFSLNLLANHMKLIFHEDWVNHVMGSNMAPWLSWEKLPSSGSQGGPSPEWIRIFWKSFRGSQEELSLFSDWPLIPAFLGRPVLCRVRECHLVFIPPLLEYPTSTSGISERESAGSYESGVRVSRGNTSEAELAESYISAFERFKTSYSWLFPMLNQCNIPIFDEAFIDCVASNSCFSMPGRSLGHVIASKLVAAKQAGYFTEPTNLSTSNCDALFSLFSDEFFSNDCHYAREEIEVLRSLPIYKTVVGSYTKLRGQDQCMIPSNSFLKPYDERCLSYAIDSNESSFLRSLGVLELHDQQILVRFGLPGFEGKPQNEQEEILIYIFKNWHDLQSDQSVAEALKETKFVRNSDEFSTDLLKPTDLFDPGDAILISIFFGERRKFPGERFSTDGWLRILRKLGLRTATEVEVIIECAKRVEFLGIECMKTGDLDDFEADTINTCSEVSPEVWALGGSVVEFVFSNFALFFSNNFCDLLGNIACVPAELGFPSVGCKRVLASYNEAILSKDWPLAWSCAPILSKQHTVPPEYSWGPLHLQSPPPFCTVLKHLQVIGRNGGEDTLAHWPIASGMNIEECTCEILKYLDKVWSSLSSSDVAELHKVAFLPVANGTRLVAADALFARLMINLSPFAFELPTVYLPFVKILKDLGLQDMLTLSAAKGLLLNLQKACGYQRLNPNELRAVMEILNFICDQIVEGNTLDGLNWKSEAIVPDDGCRLVHSASCVYVDSYGSRYVKCIDTSRIRFVHADLPEGVCIMLCIKKLSDIVLEELDENHTLQTLGSLGSVSLVTIKQKLSSKSLQTAVWTIVNSMGSYIPAFNSFSLDTMECLLNSTAEKLQFVKSLKTKFLLLPNLVDVTRAGKDFIIPEWKNDSAHQTLYFMNQSRSRILVAEPPTYISLFDLIAIIVSQILGSPIILPIGSLFGCPEGSEIAVVNVLKLCSDKKEVEPVNGSSNMVGKEILPQDARLVQFHPLRPFYSGEIVAWRSQHGEKLKYGKVSEDVRSSAGQALYRLKIEVSPGDTQSFLSSHVFSFKSVSASSPLKESLVHESHVLGSNRPHVDFPESSGRGESYSQVQPVRDQSGKVSAAELVQAVNEILSAAGIKMDVEKQALFQRTINLQENLKESQAALVLEQERVEKATKEADTAKAAWVCRMFFCSVKVSLLSASGYKSYQNFSSVISPMLL

SEQ ID NO: 154277 - protein, 150 aa, Glycine max
  Coding DNA Sequence Number=SeqID_62592
GQRKLVWVKWDTVCLPKDKGGLGVLESKYGGWRNLDEARRNHKESIWWWDLCFVCGLEEEGGWLNEGLKWKIGCGLQQHHTIQQMGVEMEIEASFMENIEELRIQPNQQDRWIWKGDVNGLYSVGSGYHLLNEVVTANKSKPKEKECAAR

SEQ ID NO: 154278 - protein, 196 aa, Glycine max
  Coding DNA Sequence Number=SeqID_62593
  Gene Ontology: Mol. function=nucleic acid binding; Cellular component= nucleolus; Biological process=ribosome biogenesis and assembly
  Homolog annotation: Hit_ID=A9PEY6; Match level="QueryCoverage=65%, HitCoverage=21%, E-value=5e-13, Identity=35%"; Hit description =Putative uncharacterized protein
  Pfam annotation: Domain name=RRM_1; Domain location=83-152; Score =45.2; E_value=2.3e-10; Accession=PF00076.13; Description=RNA recognition motif. (a.k.a. RRM, RB
MGEGYCTQPYPCRGKETVSGFEPMTNNNWSKSFHQSEQTKPIKSTESSEYCEEEVEGKASNSYWESSKRVATLKEQNAPPKTIYVRNLSYRVEQADMENLFKECGKIVDVRLHRNHNGRLNGFGQVEFATAEAAKKPQPTKENCLLHHFLTIKFFIGENQPVPMVPYTPYQSYLHSETHLPYTAVRSVPLVFVAIL

SEQ ID NO: 154279 - protein, 57 aa, Glycine max
  Coding DNA Sequence Number=SeqID_62594
MEKVEARFTALESSVQNQERYGKAERDKRYGKKMDAKARYCSRGGIKCGQERIGGGS

SEQ ID NO: 154280 - protein, 285 aa, Glycine max
  Coding DNA Sequence Number=SeqID_62595
MALQEMTRLTSSIEFATYELGTTSTHRRRQRKTGGDWSEPEIGGTLLTYLHSISSVFLMKLAFKGVSNVQYLEQQLDNIVLEGLKLHVNVPKHGRDLRVAEKEDDVARVEMIMKDKGIAKEDTGTSSMAVFGSEKDKQTSNREAGSNVKVVMLGNRSNGAEKRWLSRHNQHHRAESNRGFHLSHSSIVLSVPMETKACAEEVDLKYLGGDMVLITGIGEDIIKELCKEGVVAGWFGCCVGGIPLHAWDSQNIKKIVGSMDDVIDVDDDVENLHRIDCARVLVKTA

SEQ ID NO: 154281 - protein, 584 aa, Glycine max
  Coding DNA Sequence Number=SeqID_62596
  Gene Ontology: Mol. function=iron ion binding; Cellular component =integral to membrane; Biological process=transport
  Homolog annotation: Hit_ID=A7P2W7; Match level="QueryCoverage=95%, HitCoverage=78%, E-value=0.0, Identity=64%"; Hit description =Chromosome chr1 scaffold_5, whole genome shotgun sequence
  Pfam annotation: Domain name=OPT; Domain location=1-555; Score=422.1; E_value=8.2e-124; Accession=PF03169.6; Description=OPT oligopeptide transporter protein
MNSSHPEGLLDILLGLGGMGTYLLGMSPYIASQVDGGNTPINTKTISLGWMFGFLFVVSFVGLFSIVPLRKVMILKYKLTYPSGTATALLVNSLHTPKGAKLAKKQIALLFKSFCGSFAFGFFQWFFTAGDDCGFSTFPTFGLQAYSKRFYFDFSSTYVGVGMICPYIINASLLLGAIFSWGILWPLIELKKGIWYSTDLPSGSLSGIQGYRVFTAIAMILGDGLYHCIIMLIRVAYSLITQYLKKRVSSAVDPEDVDQNSSEDFDSQRRTEYFLKDEIPSWVAIIGYSVLAVISIITVSLIFPQLKWYHVLITYLIAPILAFCNAYGCGLTDWSLAANYGKLAIIIFSSWVGLEHGGLIAGLASCGVMMSIVSTASDLMQDFKTGYLTLASPRSMFVSQVLGTATGCLVSPLMFWFFHKAYTLGDPQGSYPAPYGEVYRGMALLGAKGFSSLPKNCLELAIIFFLLAVFINIVRDLLERYETKYRLHRFVPNPMALAIPFYLGGYFAIDMCIGSLILFLWEKKNKQKAKDYGPALASGLICGDSLWSVPAAILSLAGANPPICMKFLSRAMNNKVDTFLSGGH

SEQ ID NO: 154282 - protein, 187 aa, Glycine max
  Coding DNA Sequence Number=SeqID_62597
  Homolog annotation: Hit_ID=A7PNE1; Match level="QueryCoverage=27%, HitCoverage=15%, E-value=5e-15, Identity=76%"; Hit description =Chromosome chr1 scaffold_22, whole genome shotgun sequence
  Pfam annotation: Domain name=zf-DHHC; Domain location=69-115; Score= -12.2; E_value=0.0087; Accession=PF01529.11; Description=DHHC zinc finger domain
MGSNLGGALYNSKTTLYAACQWEAWNKDIQYMEELVDSTDLVDLAAKEYGHLPKRTIQWSQAAGGCTVSADSKRPEGYVHVSTVNYSGSYQLIGNCVGAANHRSFIAFLISAVLSTIYVSIMSVYSGLRTWPPLKYSLGHINGGTHSCLSFHCKCFIADRIERSFMAAALLYIPGENLFESLELTSR

SEQ ID NO: 154283 - protein, 329 aa, Glycine max
  Coding DNA Sequence Number=SeqID_62598
  Gene Ontology: Mol. function=oxidoreductase activity; Cellular component=integral to membrane; Biological process=electron transport
  Homolog annotation: Hit_ID=A7PL07; Match level="QueryCoverage=96%, HitCoverage=76%, E-value=1e-49, Identity=32%"; Hit description =Chromosome chr7 scaffold_20, whole genome shotgun sequence
  Pfam annotation: Domain name=p450; Domain location=1-324; Score= -139.6; E_value=8.9e-06; Accession=PF00067.13; Description=Cytochrome P450
MGFLMLIFYTWKQEREILHSLLKRKKFKIFLQLTIQKKIENCLIPFLMMHPKLELRWTCKMPFRGSPLTLPAPVFLDIYDPICLPNMFTKLSHFAYQKALIVMEDVAFHRHITPRCLWKLQEWLQIGQEKKFKEAIKAFDKFLHERIASKREEQSRCNNHTKKEDDNTHSDLIRVLMEEGAEKGKIMDDKYLRDTAFTLVSAGSGTVSAEFGKLVYLHGAICEALRLFPSIPFDHKCTIKSDILLSGHHVSPNTMIFYSLYSMGRMERIWGPRSCLGKDITFIEMKMVAVALLWRFHMQVVEGHPITPRLSITLGTEHGLKVKVTERCI

SEQ ID NO: 154284 - protein, 465 aa, Glycine max
  Coding DNA Sequence Number=SeqID_62599
  Gene Ontology: Mol. function=transferase activity, transferring glycosyl groups; Cellular component=membrane
  Homolog annotation: Hit_ID=Q8GXF5; Match level="QueryCoverage=90%, HitCoverage=91%, E-value=1e-145, Identity=58%"; Hit description =Putative uncharacterized protein At1g68470/T26J14_4
  Pfam annotation: Domain name=Exostosin; Domain location=79-424; Score= 358.6; E_value=1e-104; Accession=PF03016.6; Description=Exostosin family
  Subcellular localization annotation: CTP_CleavageSite=71; ConfidenceScore=5.51e-01
MFFRKPSPTPPLHSLSSLPSTAISFSKTKDPHNNKLRYTIFSCLFLASWLLILHRFNFTILAPSTTTTTPTCDGSKPLFYIYNLPSRFNLGLLERCQSLNIYTNMCPHVANNGLGQPLSTPDWYSTHQFIAEMIVHARLENHPCRTWDPYTAVLFYVPFYGGLYASSVFREANLTLRDSLAVDLVDFLQSQPWWKRHYGKDHFVALGRTAWDFMRTEGGSDFGANIFLNLPPVLNMSVLTVERQPWRGHNQFAIPYPSYFHPKTLAQTLTWQSHLRRRARPHLFSFVGGTRPGLQKAKVRDHIVSQCQASKRCVLVRCASGDSKCHNPMNVLEVMEKSTFCLQAPGDSFTRRSTFDSVLAGCIPVFFSEHTAYTQYKWYFPRERDTYSVFIDEREVIEGKEKMMIEEVLLGFGEKEVERMREVLIGLIPTLTYAHPNATAAFPDVVDVMLRRLSRRVTHHFNPII

SEQ ID NO: 154285 - protein, 626 aa, Glycine max
  Coding DNA Sequence Number=SeqID_62600
  Gene Ontology: Mol. function=protein disulfide oxidoreductase activity; Biological process=intracellular signaling cascade
  Homolog annotation: Hit_ID=A7PNI1; Match level="QueryCoverage=93%, HitCoverage=80%, E-value=0.0, Identity=56%"; Hit description =Chromosome chr1 scaffold_22, whole genome shotgun sequence
  Pfam annotation: Domain name=DEP; Domain location=254-325; Score =72.5; E_value=1.4e-18; Accession=PF00610.12; Description=Domain found in Dishevelled, Egl-10, and Pleckstrin
  Pfam annotation: Domain name=DUF547; Domain location=391-554; Score =124.3; E_value=3.6e-34; Accession=PF04784.5; Description=Protein of unknown function, DUF547
  Pfam annotation: Domain name=Glutaredoxin; Domain location=136-195; Score=56.6; E_value=8.5e-14; Accession=PF00462.15; Description =Glutaredoxin
  Pfam module annotation: Pfam domain module=DEP::DUF547::Glutaredoxin; Domain location=254-325::391-554::136-195
MGSEVVEEPTETTSLSSPRKIQTNDAPTANCHVSVTPTTLSIVQPHSLLPKPVPPTTTYSPNDVVVSSSATFAKFLRQRRNDLSSAISKGISTLKHSINDQNDCNCVTEFNLSGLKVFVTVENKNDASFARGRMRISFFSRSNCRECCAVRRFFRERALRFVEINVDVFAEREKELRERTGSATVPKIFFGEKLIGGLVELNALRKDGGEELERRLTAAVGEGPSAPAYGFDEAAEVEEEEEEEEEIGRVVRVLRQRLPIQDRWMKMKIARNCFAGSELVELLVRHHGCAPSKAVEIGKQLCKKHFIHHVFGENDFEEGNHFYRFLEHEPLISKCFNFRGSTNDSEPKAAAAVCDRLTKIMCAILESYASEDRRHVDYMAISKSEEFRRYVNMTQDLQRVNLLELSENETLAFFINLYNAMIIHAMIRVGCEEGVINRRSFSDFHYLIGGHPYSLGAIKNGILRSNQRPPYSLIKPFGTGDRRLENLMARRQGTGSKCCPIIKPMLQPQLHALVKMDPLVHFGLCNGTKSSPKVRFFSSYRVAEELRSAAREFFENDGIEVDLEKRTIHLTPIFKWHSSDFGQERNILKWIINFLDANKAGLLTHLLGDGGHVNISYMSYDWSINS

SEQ ID NO: 154286 - protein, 233 aa, Glycine max
  Coding DNA Sequence Number=SeqID_62601
  Gene Ontology: Mol. function=nucleic acid binding; Cellular component= intracellular; Biological process=regulation of transcription
  Homolog annotation: Hit_ID=Q8GYC1; Match level="QueryCoverage=59%, HitCoverage=26%, E-value=3e-64, Identity=81%"; Hit description =Putative C2H2-type zinc finger protein
  Pfam annotation: Domain name=RS4NT; Domain location=182-219; Score =15.5; E_value=0.023; Accession=PF08071.3; Description=RS4NT (NUC023) domain
  Pfam annotation: Domain name=zf-C2H2; Domain location=121-143; Score =26.0; E_value=0.00014; Accession=PF00096.17; Description=Zinc finger, C2H2 type
  Pfam annotation: Domain name=zf-C2H2; Domain location=197-219; Score =21.1; E_value=0.0042; Accession=PF00096.17; Description=Zinc finger, C2H2 type
  Pfam module annotation: Pfam domain module=RS4NT::zf-C2H2::zf-C2H2; Domain location=182-219::121-143::197-219
MACGKGNEATTQVVCLLAIRYETRRRDKEKLFAFSTLEITTWLLLPHPHPSWESDKKIKVTLHNSNNTNPLLLLLPLLLLLVLLQPQCLKRKGGINPEHHANPDAEVIALSPKTLMATNRFICEVCNKGFQREQNLQLHRRGHNLPWKLKQKTNKEPKRKVYLCPEPTCVHHDPSRALGDLTGIKKHYSRKHGEKKWKCEKCSKKYAVQSDWKAHSKTCGTREYRCDCGTLFS

SEQ ID NO: 154287 - protein, 1551 aa, Glycine max
  Coding DNA Sequence Number=SeqID_62602
  Gene Ontology: Mol. function=RNA binding; Cellular component =spliceosome; Biological process=mRNA processing
  Homolog annotation: Hit_ID=A7QRU2; Match level="QueryCoverage=94%, HitCoverage=99%, E-value=0.0, Identity=80%"; Hit description =Chromosome chr13 scaffold_152, whole genome shotgun sequence
  Pfam annotation: Domain name=ResIII; Domain location=874-996; Score= -31.7; E_value=0.022; Accession=PF04851.6; Description=Type III restriction enzyme, res subunit
MTKVYGTGLYDFRRHRVAEYPVAAAPAESKTLVPKTGGGGGGVPSSITLSEIQRDRLTKIAEANWLKSGDAGRPKKDFDPELVRKIYETELLVKEGSKPVPLQRVMILEVSQYLENYLWPYFDPLTATFEHVMSIIIMVNEKFRENVAAWTCFHERKDAFKGFLESVLRLKEGRELSIAEKTNYLVFMINAFQSLEDEVVSRTILRLANLKSWYSLSYGRFQMELCLNPGLIKKWKRMIKKEPVKGDGSHLDPSTTVEVMFVRNLIEEFLEILDSQVFPLKQLSGEDDELIDATGLGLVNDACVLYCERFMEFLIDLLSQLPTRRYLRPLVADVAVVAKCHLSALYRHEKGKLFAQLVDLLQFYEGFEINDHTGTQLTDHEVLESHYSRMQSFQLLAFKKMEKLRELALTNIGSIHKRANLSKKLSVLSPEELRDFVCCKLKLVSKEDPWSERVDFLIEVMVSYFEKQQSQKEAINALPLYPNEQIMWDESVVPSINYSGEGCLALPKLNLQFLTLHDYLLRNFNLFRLESTYEIREDIQEAVPHLLAYINNDGGTAFRGWSRMGVPIKEFKITEVKQPNIGEVKPSSVTAEVTYSVSSYRAHIRSEWDALKEHDVLFLLSIRPSFEPLSTEEEDKASVPQKLGLQFVRGCEVIEIRDEEGNLMNDFSGKIKRDEWKPPKGELRTVTVALDTAQYHMDVSNIAEKGAEDVYGTFNVLMRRKPKENNFKAILESIRDLMNEYCIVPKWLENIFLGYGDPSAAQWTNMPDLLETVDFKDTFVDADHLKESFLDYEVSFVNPDGSGNLNPRPPFKIKLPRTLKPNNGALTGHAISTSGATNEINVVDANYQKEALIIETYTPPDPGPYPQDQPKQNSVRFTPTQVEAIISGIQPGLTMVVGPPGTGKTDTAVQILNVLYHNCPSQRTLIITHSNQALNDLFEKIMQYITKCLFWGRGSSIIAPLCKRASLDTRRDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFCDTPHPVFTGESFEKDMRAAMGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPTIAKLYNWRYRDLGDLPSVKEEVIFNRANAGFAYDYQLVDVPDYLGKGETTPSPWFYQNEGEAEYVVSVYIYMRLLGYPANKISILTTYNGQKLLIRDVINRRCVPYDFIGPPSKVTTVDKFQGQQNDFILLSLVRTRFVGHLRDVRRLVVAMSRARLGLYVFCRRSLFEQCYELQPTFQLLLKRPDHLALNVNEITSYTERNVEDPGPGHHLHLVSGIEEMGSIIDRLYQEKLRHQFDQNGAYFSHLEPSANTDWVQSGQQTMDTDMPEQTEEATTVDNHVAVDMPPENSMEDVTMVDNGDGVANGNPSP

SEQ ID NO: 154288 - protein, 615 aa, Glycine max
  Coding DNA Sequence Number=SeqID_62603
  Gene Ontology: Mol. function=methyltransferase activity; Cellular component=cytoplasm; Biological process=metabolic process
  Homolog annotation: Hit_ID=Q08A71; Match level="QueryCoverage=35%, HitCoverage=48%, E-value=6e-83, Identity=68%"; Hit description =Probable protein arginine N-methyltransferase 6
  Pfam annotation: Domain name=Methyltransf_11; Domain location=296 -383; Score=13.0; E_value=0.0051; Accession=PF08241.3; Description =Methyltransferase domain
  Pfam annotation: Domain name=Methyltransf_12; Domain location=296 -381; Score=13.6; E_value=0.025; Accession=PF08242.3; Description =Methyltransferase domain
  Pfam module annotation: Pfam domain module=Methyltransf _11::Methyltransf_12; Domain location=296-383::296-381
MENLFKSIESIRRFRSSQFDLIKAGFKAEGDVVSVNMVFLKAGTPSPTGFVMNLQPSEAEAGFDIRVPPTADPESLERRIAEEWAPSSRNMSFTNKENKGQKTVENSISILAGTEFKQKAHTRDKSGKPILTKTDSSNPWWALLENAVQKAGGKLGKPEVFPAATDSRYFRERGLPAIGFSPMANTPVLLHDHNEGMLSGLFELGSILVGEVELSLEGAVVVVAVEGSRASTSSHSHSVRVYDQPRPPCTDFDVAYFHSYAHLGIHQEMIKDRVRTDTYRDAIMQHQSFIAGKVVVDVGCGTGILSIFCAQAGAKRANEVVKANNLSDVVVVLHGRVEDVEINEEVDVIISEWMGYMLLYESMLGSVINARDRWLKPGGLILPSSSTLYMAPVTHTDRYSDSVDFWRNVYGIDSEFSTWTKREREYPSPDQYDPRGKVSAMVSLAKQCAFEEPSVETITGENVLTWPHVGVEGRGGEWRKKGEKEGNGEGRGVAEGGEGGHTVAVAVSLASNRCLRKQIHGTLLSWGHNDERLLWTIGTIGSSKKLRDRLECASAAALVASKLGQDIAAFVYHDLTQQGTLFTGRCLRKAQFSDKRTTLFHAQKRKCFKRPCTTP

SEQ ID NO: 154289 - protein, 73 aa, Glycine max
  Coding DNA Sequence Number=SeqID_62604
MHFSCDFFSSDDHFSAYTGPQTNASTYASIIVVVSEVLPWSHAVSILVAVVKHSSFRERRRVAVHLLPLIAEH

SEQ ID NO: 154290 - protein, 136 aa, Glycine max
  Coding DNA Sequence Number=SeqID_62605
  Gene Ontology: Mol. function=nucleotide binding; Cellular component =myosin complex
  Homolog annotation: Hit_ID=A5AF73; Match level="QueryCoverage=84%, HitCoverage=9%, E-value=3e-16, Identity=38%"; Hit description =Putative uncharacterized protein
  Subcellular localization annotation: CTP_CleavageSite=48; ConfidenceScore=5.03e-01
MSATSKVLPALHPIKSLPPKFKITSGNPTAGLMENHGDAKFRSNDVIRSGSPENDALIGEVAEEAQNCAGDMGVYGEDLAYSRKGVSLEDRPSIADEDLESVPLPFPSISMSSRERRWSDTTPYASKKELQSTHKS

SEQ ID NO: 154291 - protein, 81 aa, Glycine max
  Coding DNA Sequence Number=SeqID_62606
  Subcellular localization annotation: CTP_CleavageSite=52; ConfidenceScore=5.13e-01
MWKRIAATKISIKQMPLKNMIMSSTFSMLPKILVIKLVETSTLDSGCSKITRLKMGASLRILMTPSLEMVYLSFSRHVLGM

SEQ ID NO: 154292 - protein, 89 aa, Glycine max
  Coding DNA Sequence Number=SeqID_62607
MDEEHWRYDTTIFEEVDMNVENEEDTSVEVEHVDCSDAFNTSQLILGGEGWMMKLICGTNNREMAKSFVRHPYAGRLIKDEKIVVADMM

SEQ ID NO: 154293 - protein, 234 aa, Glycine max
  Coding DNA Sequence Number=SeqID_62608
MIYVVKNVRIPKYLDLEWFSPQGFKFPNLLEAQGFSKLVQMKETFDPELVKVFYTCACVDLEGNLFSTINGVDMVIDAAMWKEVVGLDMGGVHKFDEKLDGYNKMQTYREKCFLTQYQDELVLLIEGIMLKSHCLVDYKFSYVVFALRFIDYFSVDIFNEIVDFTKASSEIIERHIKKLEMRFVDHEWIMAGELVMQSYPPRALDRRLQEDWTKDAREGHRILMSLKVDFEPIG

SEQ ID NO: 154294 - protein, 143 aa, Glycine max
  Coding DNA Sequence Number=SeqID_62609
SLDKDDSVDGISDTDDEVTDMIQPIRIVHPAEGIENPFWNDALHYNNINWSYLDEEDICGLEMPSTFNVGQELYVGMKFDSKDAVKNAVKQYVMKVHQSFKVVENKSNNMIREDPSIKVSLIQERINSEFAYKVSYKKAWLAK

SEQ ID NO: 154295 - protein, 221 aa, Glycine max
  Coding DNA Sequence Number=SeqID_62610
  Subcellular localization annotation: CTP_CleavageSite=26; ConfidenceScore=5.71e-01
MASPPASPPPPPPSPPPPSDASASPCAVKRTRKASRLRSLSTRPPGADKPVVHVDPTTDKADNPHRKKLRTYLGIVARDKVDVMYENWKEAEFEILEASDNRTKKKLLQTVGERWRQFKSDLTRKWALAADQDGVDDTVCEKYDISKEKWAQFCQTRRDPSWEDVRKKAMAIQKQNTAPHVLSRGGYEYLEQKLLAEKTKKKLEEVAQSGSVDGVIDPPSP

SEQ ID NO: 154296 - protein, 55 aa, Glycine max
  Coding DNA Sequence Number=SeqID_62611
MFNPPDICESLKISEKNCFREENPSRGASVTLPRHFRGRFREDFPPFFIVLRSST

SEQ ID NO: 154297 - protein, 269 aa, Glycine max
  Coding DNA Sequence Number=SeqID_62612
  Pfam annotation: Domain name=Transposase_23; Domain location=139-209; Score=-1.7; E_value=0.0018; Accession=PF03017.5; Description =TNP1ENSPM transposase
QKLLAEKTKKKVQEAAQSGNVDGVIDPPSLVRRHVKWKMARTKKTGEMTTEAAKKIAEKIDVLAVAIGCPEHPGRVRTAEPQLTQQIRDQLEESITKKVTRQVMASFSQLQSQMQSQGLAVPPEPLGSCVDPSRNDPETGDSNWCGLYIEADPACLVSMGRVYEGSTVVHNTPLLPGQVKVSVEEVIDADSPVLVPTDEVFLVGQALHTFLAWPTHLVAVSPPKPSPKPHPEVDNPLYLMALTIPELFLRPYQVRWDATVFGVVNPDLP

SEQ ID NO: 154298 - protein, 52 aa, Glycine max
  Coding DNA Sequence Number=SeqID_62613
MKKQQWKKRCSGRQRRRGERKRHPLGNKPWKKELHHQDEPWIRSLERMLQWR

SEQ ID NO: 154299 - protein, 59 aa, Glycine max
  Coding DNA Sequence Number=SeqID_62614
MSRGSGDLGDVRARLTGALSKGGKMRGVTTNEGISTSHVDKSGVFAPMYPPLERKSDLR

SEQ ID NO: 154300 - protein, 267 aa, Glycine max
  Coding DNA Sequence Number=SeqID_62615
MAKFDPDIVLEFYANAWPTEEGVRDMRSWVRVLEEGQECEYGQRRNRSDGFDEEAIAHLLCIPGQDFARTATGRRVRIMRTNMTTLTQIWMTLLLNNIQPNDHNSDLPLPKCMAPTRHPLDPDKSNRALGFPALITGLCQSFGVPVAPSKVIRPPITRAFIEKYCTQRQARGMFPRPTTGLMYRPMIVFPDEPQPAEPGFYFLSVPYYGSVQSRGHLAWRLARGPSRRGTCRGTCRGPAEAPNEADEAREDEEIADLLDFWGGGGAT

SEQ ID NO: 154301 - protein, 177 aa, Glycine max
  Coding DNA Sequence Number=SeqID_62616
MGPVLSDLLRLLVGGSAKKAQAIQKQNIAPHVLSRGGYEYLEQKLMVEKTKKRLEEAAQSGSIEGIIDPPSPIRRHVKWKMARTKKTGQMTSEAAKEITEKIASQGSFIPHGRQDVLTAAIGRLELLGYVRAAGAGVTIKQYFGSAPRTSRGSSSMPPEDLQQLTQQIKDQLEDLIT

SEQ ID NO: 154302 - protein, 223 aa, Glycine max
  Coding DNA Sequence Number=SeqID_62617
  Homolog annotation: Hit_ID=A5BSR3; Match level="QueryCoverage=57%, HitCoverage=41%, E-value=2e-12, Identity=34%"; Hit description =Putative uncharacterized protein
QNLLVEKTKKKLEEAAQSGSVDGVIDPLSLVRCHMKWKMARTKKTGEMTTKAAKEIVEKIDSFKEQASQGSFVPHGRQDVLTAAIGCPEHPGRVRAAGAGVTIKQYFGSAPRTSLSSSSLPPKELQQLTQQIRDQLEESITEKSQMQSQGLALPPEPLVGPSGPRVSIKESCVDSSGNDPETGDSDMCELYIEANPARLVALGRVYEGSNVVDNTPLLSGQVK

SEQ ID NO: 154303 - protein, 92 aa, Glycine max
  Coding DNA Sequence Number=SeqID_62618
MAKGCEMTKFCLRVSSGLPPLDDKGCRMTNFCLCAPSDTAVSKMAKGCGMTKFSLRVSSGPPPLDDKGCRITNFFLCAPSDTAVSEWQRGAE

SEQ ID NO: 154304 - protein, 128 aa, Glycine max
  Coding DNA Sequence Number=SeqID_62619
MASTSGDATPPSPKTARLMAEMIKLDDQMRRMGYEQEERMERMRKDNEESLGRIQMSSEALSVRIENIEQRREDKLSNSSQAEDEWYGEDDGGRRNMRYRKRRNHKRYGGRQREEGIEGVKVKIPTFK

SEQ ID NO: 154305 - protein, 206 aa, Glycine max
  Coding DNA Sequence Number=SeqID_62620
  Gene Ontology: Mol. function=motor activity; Cellular component=cell projection
  Homolog annotation: Hit_ID=UPI00006A2D9E; Match level="QueryCoverage =95%, HitCoverage=85%, E-value=5e-19, Identity=16%"; Hit description =UPI00006A2D9E related cluster
LDVFAIRGLHIVNLRGLHALTFRGLNILAFRGLHVLPFRGLHVLAIGGLHVLPFRGLHTLAFRGLHALAFRGLHVLTFRGLHVLAFRGLHTLAFRGLHVLAFRGLHVLAFRGLHALALRGLHVLSFRGLHALTFRGLHVLAFRRLHALAFRGLHVLHFRGLHVLAFGGLHALAFKGIHAFAFRGLHALAFRGLHILAFRGLHVLAF

SEQ ID NO: 154306 - protein, 102 aa, Glycine max
  Coding DNA Sequence Number=SeqID_62621
MKLLRGKEIALVKVQWGPDEGDSTWELEDRVYWGKDTRVRLINEEKSITGQLLRWPLLCNSSLASGNRLPMLCNRLPEKKTLEAYLLTTCSGYGTHCVVTRS

SEQ ID NO: 154307 - protein, 199 aa, Glycine max
  Coding DNA Sequence Number=SeqID_62622
MIMRGQDIYNSQDKATTSPSFSESEEAKGEESNKEIYPQEEGQPLVVKEKCKEVSVSSKRLAKKETHFTIKTNIKETFPLRQPPHFLFCKKTLASIATPLVLEFIPQVKKLLDEGLVRKSLNPCALLVPKIGIIRHQVPKNRCDQRVPMNPKRIKVIPEWLTPPSVEGRSPEYEEPRDLRSNPFQGGGNDAILPRKGIG

SEQ ID NO: 154308 - protein, 71 aa, Glycine max
  Coding DNA Sequence Number=SeqID_62623
MVNFMLSYSGSSEGFWGEAMLAACYLLNRIPNKRNKRLEHIIESIPKGARKKMTTYITMKFSRFKKPGTWL

SEQ ID NO: 154309 - protein, 81 aa, Glycine max
  Coding DNA Sequence Number=SeqID_62624
MALCMDSLSLNASKIVGMRNNNVKSTFKHGSKNHKKEVYLGVYLNQQRWQLVVIFHSENVVVWFCSLHKNGGPKFKSMVNQ

SEQ ID NO: 154310 - protein, 62 aa, Glycine max
  Coding DNA Sequence Number=SeqID_62625
MGAKHLTRTKEWSHVIEQRSPDEIREMAPKKLSAKRSRRDAAAEGTSAAPEFDSHRFRSAEH

SEQ ID NO: 154311 - protein, 89 aa, Glycine max
  Coding DNA Sequence Number=SeqID_62626
MASISEVMLKLQKTIEDKATTTASSTSQAYPYELSSEERKETGSRVHGMILKEESSCLRKGPKGVWLPPYDEARQSMLAIDEEGRITHL

SEQ ID NO: 154312 - protein, 84 aa, Glycine max
  Coding DNA Sequence Number=SeqID_62627
  Homolog annotation: Hit_ID=A5BY07; Match level="QueryCoverage=94%, HitCoverage=7%, E-value=2e-10, Identity=39%"; Hit description =Putative uncharacterized protein
MSPYRVVFGKACHLPVEIEHKAYWAKVLLYNSRLGLMSVEIKSESTDKSFKVNGQRLKPFLTNPSLVDVVVEETSLLHPTSLPP

SEQ ID NO: 154313 - protein, 112 aa, Glycine max
  Coding DNA Sequence Number=SeqID_62628
  Subcellular localization annotation: CTP_CleavageSite=54; ConfidenceScore=5.55e-01
SLTNQMGQLATQLNQQQSQNYDRLPSQSVQNPKNVSAITLRSGKQCQGPQPTISSSSANEPVQLHSTPETDDDKNLKSKLRNNFYAGESSTGNSDLQKQHIPLPFPPRAISN

SEQ ID NO: 154314 - protein, 217 aa, Glycine max
  Coding DNA Sequence Number=SeqID_62629
  Gene Ontology: Mol. function=RNA-directed DNA polymerase activity
  Homolog annotation: Hit_ID=A2Q500; Match level="QueryCoverage=35%, HitCoverage=9%, E-value=7e-09, Identity=37%"; Hit description =Endonuclease/exonuclease/phosphatase
KALLDCCQKWGVKFSFSAHESGWLVFKFESEDDLNQVLSAGPYFIFQRPLLLKVMPAFFDFGNEELSKIPVWVKLRNLPLELWNPQALGKILSKIGSPIRSNHFTSSKGSISFAKALVEVDASLELIDEMIGHRLTNCKVVTGNKFALITASPTLDQPQVGDLAMPPHTNTVGPSDNPKTVQTNMSVPPHRKHILVANHVPVLHNSSDLKETGNTEF

SEQ ID NO: 154315 - protein, 79 aa, Glycine max
  Coding DNA Sequence Number=SeqID_62630
  Subcellular localization annotation: CTP_CleavageSite=48; ConfidenceScore=5.04e-01
MMTKVMTKSSKINQRTTQVNQRSIKNNSRVQDKNQEEFKNQEESLETRSKIQGSRSQESRSRFKTQDSRMKRRLNQDKY

SEQ ID NO: 154316 - protein, 68 aa, Glycine max
  Coding DNA Sequence Number=SeqID_62631
MLIDVGNALACACCVCSWRAKCTDLPGSLALALGHVHTLDIVYVRGGQSALTFQGLWHLLWATFICRM

SEQ ID NO: 154317 - protein, 95 aa, Glycine max
  Coding DNA Sequence Number=SeqID_62632
  Homolog annotation: Hit_ID=A5AQM5; Match level="QueryCoverage=89%, HitCoverage=10%, E-value=2e-09, Identity=29%"; Hit description =Putative uncharacterized protein
MQIFIEAIDLNIWEAIEVGPYVPTMVAGNTTIEKPREEWSKEERRIVQVSNCKSVKDMWDTLQATHEGTIEEPEMELQRLNQHEENDKKKKGNCS

SEQ ID NO: 154318 - protein, 76 aa, Glycine max
  Coding DNA Sequence Number=SeqID_62633
MEASGNRLPVCVIDYTEGWVTGNRLPGFHVLKLCNSSLASGNRLPRLCNRLSEMKSLKIPLLLACSGYETNCVRHS

SEQ ID NO: 154319 - protein, 157 aa, Glycine max
  Coding DNA Sequence Number=SeqID_62634
AQETTLVSACYQAFRLTDSKKVYTDDHSGISARQRDSKVSMADLVSAEMTAQETTLVSACYQAFRLTDNKKVYTDDHSGISARQRDSKVSMTDLVSAEDDVFRLTDSKKVYTDDHSGISARQRDSKVSMTDLVSAEDDETTLVSACYQAFRLTDSKK

SEQ ID NO: 154320 - protein, 151 aa, Glycine max
  Coding DNA Sequence Number=SeqID_62635
MPPDRSTPLEAQKILRNGPKEACLKEICTGRIKRLRNPHQVDLVGSFDTERYLRHLVRQQAANHRAHFRAEVHGREIGLRPRQWILFDADALSQFLGYPLVLEEGQECEYGQRRNRADGFDKEAIAQLLCIPGQDFARTAAGRRLRIMRTT

SEQ ID NO: 154321 - protein, 59 aa, Glycine max
  Coding DNA Sequence Number=SeqID_62636
STLTTGHSAPGGLVANDRSRVALRVRFNVDGDADASTGGGGVDAIGFDVLMMIMMVCCN

SEQ ID NO: 154322 - protein, 58 aa, Glycine max
  Coding DNA Sequence Number=SeqID_62637
  Subcellular localization annotation: CTP_CleavageSite=35; ConfidenceScore=5.38e-01
MRGSGEFVPFLDTTSRGSKMPQRTFLRRRHGPSVVVKNGTQRIRSVPLFKGPIRERTN

SEQ ID NO: 154323 - protein, 363 aa, Glycine max
  Coding DNA Sequence Number=SeqID_62638
  Subcellular localization annotation: CTP_CleavageSite=84; ConfidenceScore=5.11e-01
QGVESSQATVRSQDKSMAEINQGSRPTDRCPFPALNKQRTSLQGSPKWPRGNLPQRDPKRIRRPKELVPLPSMIVTVLGALNTSSASRPSRDGGDSSPAVGITGYPYGQWISFDADAIGQLLGYPLVLEEGQECEYGQRRNRSDGFDEEAIAQLLCIPGQDFARTAAGRRVRIMRTKMTTLTQIWMTLLLSNILPSNHNSDLPLPKCQLVYAILTWMSVHVAQLIADAIYIFAGMAPTRHPLDPDKSNRALGFPSLITGLCQSFGVPVAPTKVIRPPITQAFIEKYCTQRQAQGDAPQAAGAPPPPHQAGQAGAFDMEQYLRHLVRQQAANHRAHVQTHDCLYQMSLSMQSQGFPSFSCPTPD

SEQ ID NO: 154324 - protein, 349 aa, Glycine max
  Coding DNA Sequence Number=SeqID_62639
  Homolog annotation: Hit_ID=A5B5G7; Match level="QueryCoverage=57%, HitCoverage=13%, E-value=2e-07, Identity=25%"; Hit description =Putative uncharacterized protein
MASKKRKAPFTPTQARFDRFRFTSQEAWERYTDIMVPRKILPERNVILHDSEFDEFTEELKSRNWHKELTNFVDGSIDVAIIKEFYANLYDPEDKPPKQVKVRGRLMKFDADALNSFLKTPMILEEGENFPIYSRFYHSKPEPHELAARLCIPRRGFELNADRLPLNILWKNLTTLAQTWSGFSFSNLVPTSHTSNITLDRASLNHTALCKARGVVSDSLTLESLGPATNVAYVKKNWWNLDDLSVTFRGSRKAKGKRSEAPPSSAPAPIPAAPSASTSVLPIPLSTRPSDFIFTPQMLHSMLQSIHRRSSSSMDSFASWKMNDIEMEKEEREKRPLQGEDESRRSSPP

SEQ ID NO: 154325 - protein, 74 aa, Glycine max
  Coding DNA Sequence Number=SeqID_62640
MHVVGHAFKVTLYKKLSGMVSRYALNEIAAKYEHVPYAGKNPSRCGCVMRSTHGLPCASDANCGHQAIAALLGM

SEQ ID NO: 154326 - protein, 215 aa, Glycine max
  Coding DNA Sequence Number=SeqID_62641
  Subcellular localization annotation: CTP_CleavageSite=31; ConfidenceScore=5.23e-01
MAEPSKKRKGSSSRSQRHSETQKTQIPSSISSSSLFSSEEQQIRYPNLFSSRSIIDPKFIDMDFFSNESFECIQAFENSNLIPFMSLKLPVYSELVKAFYSNLEIQEGTLISEVYGIKMVIDQSLFYDLTQLSSEGVPFEGTLNDDWKFDFSVHDARRLVCTNQADMTERLLAGSLAFEGRILHYLIVRILLPRSSNLAQVSEEDLIVMWAFHTG

SEQ ID NO: 154327 - protein, 78 aa, Glycine max
  Coding DNA Sequence Number=SeqID_62642
MRDDKRSSYVIGIGVNSRIGLGGKFLIALEPAPKWALSVGQVVVGVGAWGASLWMGVGALGCTGAELEELPARAEKLR

SEQ ID NO: 154328 - protein, 81 aa, Glycine max
  Coding DNA Sequence Number=SeqID_62643
MHRDRTYIPIIGFPNPNYVIRWQAKAARSDHWWSMGVEEEVGGVGEGYSGREGEGNGSFTLLDVFVACNTRPSKIWLAWAS

SEQ ID NO: 154329 - protein, 60 aa, Glycine max
  Coding DNA Sequence Number=SeqID_62644
MENWRTALGNEFMGLRKKVENGEFANSARQSIRGAPDSKASRLVCGGCMNSARQYSWGSE

SEQ ID NO: 154330 - protein, 53 aa, Glycine max
  Coding DNA Sequence Number=SeqID_62645
SSGGYIHLVVQREQGRIANETFSLSWPEDADISGEGADDDVSQCMLSGFESDG

SEQ ID NO: 154331 - protein, 15 aa, Glycine max
  Coding DNA Sequence Number=SeqID_62646
MEKIHGEDDEEQGIK

SEQ ID NO: 154332 - protein, 67 aa, Glycine max
  Coding DNA Sequence Number=SeqID_62647
MEETHGEEDEEQEIKALDLLHQYMMQLHVELVGLGSSSSMESFAFGDQWQWNGKEGKVIADATSRRR

SEQ ID NO: 154333 - protein, 34 aa, Glycine max
  Coding DNA Sequence Number=SeqID_62648
MEKSDKRNFKEKKEKKAYITWEDNVINSSSYVDY

SEQ ID NO: 154334 - protein, 221 aa, Glycine max
  Coding DNA Sequence Number=SeqID_62649
MWLHPEDSSTSRCRKHAWSLVEETKATNVCFISGSYTTWKPAPRWKSYFNGSWTGGSSMCLRGREEPQICTQSAERKAPPTPKALVICFTRNMTSPRSEYPQTVPKPTPFSNQSNKVVPWKYAPPAFGEGAATEVDSLSAKVTNITGLSGVTRSGQVFAPPHSAELPSKGKAPMTQESAGAATPSKEVDPPIVKGAKKKEGLQGREVTLEEAHEFLRLIQQ

SEQ ID NO: 154335 - protein, 252 aa, Glycine max
  Coding DNA Sequence Number=SeqID_62650
MAPRKLASKRSRKDKVAEGTSSAPEYDSHRFRSAEHQQRFEAIKDDEYTNFQEEIVRRRWASLVTPMAKFDPDIVLEFYANAWPTEEGVRDMRSWVRGQWIPFDADALSQFLGYPLVLEEGQECEYGQRRNRSDGFDEKAIAQLLCIPGQDFARIAAGRRVQIMRTNMTTLTQIWMTLLLSNIQPSDHNSDLPLPKCQLVYAILTRMSIHVAQLIADAIYLFAGMAPTRHPSRPDNFNRALGFPALITGLLP

SEQ ID NO: 154336 - protein, 167 aa, Glycine max
  Coding DNA Sequence Number=SeqID_62651
MVINQSLFYDLTQLSSEGVPFEVRYRMHKALRLNAPLPYPHLVTLFLQHFNIPLDFEPYVPIKRSFLIGAAVIASFGYRIEHNGSWVKKGAQPIDEEGHLHGGEDSSLLQKILDRFDGLQTFVGERFDTLELQVDMRFNEMESRITMVEEDVSYIRTSFDLPPPPPP

SEQ ID NO: 154337 - protein, 183 aa, Glycine max
  Coding DNA Sequence Number=SeqID_62652
  Subcellular localization annotation: CTP_CleavageSite=45; ConfidenceScore=5.32e-01
SSLSRGSCSSLVFFPAVFLPLVFFPAVLHLVPSLRLLHWLSVSVSSAIEVEDEVLPQEEPSSARVLGDENGAYGRRCSAPFSARGRTCEPSSAGFQSFSWKNLPNFFRRIHFAADVPRHRRPTASTRRQRVTQRVKDVPQLPEDVPQLAEDVPHASDGSLERTGAADGVETDRVASDVEAKLH

SEQ ID NO: 154338 - protein, 84 aa, Glycine max
  Coding DNA Sequence Number=SeqID_62653
MTNKAKGKGKEVAGKGSSGKRKGAFDDDKIGGGRKRNKRGPVRMNWCLLLFFLDSLACKHETGDLWRVLRLSQIILKTTPNRGT

SEQ ID NO: 154339 - protein, 77 aa, Glycine max
  Coding DNA Sequence Number=SeqID_62654
  Homolog annotation: Hit_ID=A5AEB7; Match level="QueryCoverage=74%, HitCoverage=4%, E-value=2e-17, Identity=68%"; Hit description =Putative uncharacterized protein
MNNENVFWNFAVNQSANISDIKCDIPELKGDNYKVWREKILLRLGWMDIDYAIRKDEPPGITETSTPDVADLYGGIL

SEQ ID NO: 154340 - protein, 47 aa, Glycine max
  Coding DNA Sequence Number=SeqID_62655
MGEEEKKPEENKVEEKKANEEEKKKEKKPDESKDDKESKEESALQLS

SEQ ID NO: 154341 - protein, 106 aa, Glycine max
  Coding DNA Sequence Number=SeqID_62656
MSLATLFEKLQEHEMELMRLHQHEENDIKRKGIALRASSSFIQEESDKEDLTETEEDDDDFRLFVKRFNKFLRNKRNNRESNINTKKKEEDSSLAPTCYESNQPGH

SEQ ID NO: 154342 - protein, 153 aa, Glycine max
  Coding DNA Sequence Number=SeqID_62657
  Subcellular localization annotation: CTP_CleavageSite=43; ConfidenceScore=5.60e-01
MGVFPFLLCNLSAMPGANLLAMGSSSDSTSSRSMRSPGAERTSAFGVEDVGTSLSASGTEAFFQNATHNTADLLIHLRVYFPRTCCRARVFRKSSLPVVFWGPVSQEQGLDQESFVWVGYLNSGCSWCGDDGTEGEPGAAVSFGEVAMEKQSF

SEQ ID NO: 154343 - protein, 125 aa, Glycine max
  Coding DNA Sequence Number=SeqID_62658
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=5e-10, Identity=31%"; Hit description= UPI00006A17C9 related cluster
  Subcellular localization annotation: CTP_CleavageSite=48; ConfidenceScore=5.69e-01
MKVKTCSPLKMRTCSPLKMRMFGPLKVRACSPLMVRTRSPLKVRACSPLMARTCSPLKVRTCSPLKARMSSPLMARTCSPLKVRTSSHLKVRTCSPLKVRACSPLKARTCSPLKERVLVPKGPPL

SEQ ID NO: 154344 - protein, 133 aa, Glycine max
  Coding DNA Sequence Number=SeqID_62659
QKLLAEKTRKKLEEAAQSGSVDGVIDPPSPARRHVKWKMACTKKTGEMTTEAAKEIAEKIISHFQDVITAAIGRPEHPRRACATGAGVTIKQYFGSAPWTKSDSVAHGNVQLDAVPVSVPDEISGTCIASGAS

SEQ ID NO: 154345 - protein, 89 aa, Glycine max
  Coding DNA Sequence Number=SeqID_62660
MVKEECKGGIIRHQIPKISDMMNVLSVATFFCKIGHAHNIFMIHVHRDSLGRNNQHKNIEKGVPMNPKRIKVTPEWPTPPSIRKIWGFP

SEQ ID NO: 154346 - protein, 98 aa, Glycine max
  Coding DNA Sequence Number=SeqID_62661
MPSLRSGECLRPFGRHIRWIGELAFIANGLAAIPILPGELYTAPRPRAAYGHMAVARSVTPFVQHAYYARNHQDRSRRAPVVGDHTIDDISTSQGPTD

SEQ ID NO: 154347 - protein, 44 aa, Glycine max
  Coding DNA Sequence Number=SeqID_62662
MEVEEPWVGLWLPLNYRVDMGSSLAYDNGIWGEPYRGPSSLKVR

SEQ ID NO: 154348 - protein, 249 aa, Glycine max
  Coding DNA Sequence Number=SeqID_62663
  Homolog annotation: Hit_ID=Q2R2K2; Match level="QueryCoverage=78%, HitCoverage=31%, E-value=2e-07, Identity=25%"; Hit description =Transposon protein, putative, CACTA, En/Spm sub-class
  Pfam annotation: Domain name=Transposase_23; Domain location=98-168; Score=4.4; E_value=0.00039; Accession=PF03017.5; Description =TNP1ENSPM transposase
DVLAAAIGRLEHLGRVRAAGAGVTIKQYFGSAPRTSRSSSSLPPEELQQLTQQIRDQLEESITERGLAVPPDPLVRPSDPQVSIKGSCVDPSRNDPETGDSDRCDLYIEVDPARLVAMGRVYEESTVVHNTPLLPGQVKVSVEDVTDADAPVPVPTDEVSLVGLTLHTFLAWPTHLVKSLSQQVAVSSTKPTLKPDLEVDDPLYLMTLTIPELFLRPYQVRWDATVFEVFNPDFAFYIKHEDLSEIAHG

SEQ ID NO: 154349 - protein, 195 aa, Glycine max
  Coding DNA Sequence Number=SeqID_62664
GAPLEDELTPVISRGFNKTNVEALHKVRKAWEVFQKKDKELRGSNNGPIGGYRKWLKAHVQGLDWLPSLRTAKREEVEAPEEDEEVQALRAELEACREEHGRNKFRGALWETNMLAIVSKYQEELNLATAHEHKVADEYDRGRVINSLHQEATMWMDRFALTLNGSQELPRLLAKAKAMADTYSAPEEIHGLLGY

SEQ ID NO: 154350 - protein, 118 aa, Glycine max
  Coding DNA Sequence Number=SeqID_62665
MAAQLIHDRVVMECLEVHPEQPARTLQQPVEWILPTPTPYRLVEPVQVIEVSSSEKDLEEDPEELPPEPAVDALDFPEDDEDPLPDVDSPEDIMPASEANSTEESGPGGTTNSDNSSS

SEQ ID NO: 154351 - protein, 85 aa, Glycine max
  Coding DNA Sequence Number=SeqID_62666
MENCTKKSLRKASNSKVEVENGELHKAITTHSSKLEGGGHMNENAIHGAPKKAITTHSSKLDGGGHMNENEIHGAPKKVENGELH

SEQ ID NO: 154352 - protein, 46 aa, Glycine max
  Coding DNA Sequence Number=SeqID_62667
MVLFGNLVQPPISQCRLSNCSAPEGFNSGVVGWTVVEGDGFSSFTS

SEQ ID NO: 154353 - protein, 105 aa, Glycine max
  Coding DNA Sequence Number=SeqID_62668
MGEAHEAPRDHNLANFEPHLGYAARGQAFCGVPLPNTLGEPSVSPTTTTLAFCEGKSPSCYGGKGEIQSYGGKAEEVSLVIRGVWVVKTLASQRSLSRKLLKEAS

SEQ ID NO: 154354 - protein, 169 aa, Glycine max
  Coding DNA Sequence Number=SeqID_62669
  Gene Ontology: Mol. function=helicase activity; Biological process =viral genome replication
  Homolog annotation: Hit_ID=A2Q378; Match level="QueryCoverage=89%, HitCoverage=11%, E-value=1e-30, Identity=38%"; Hit description =Putative uncharacterized protein
LVPVKNEDGTTKQTVDDIKHYLDGRYISPCEACWRIFSFQIHKRSPAVERLYFYLLGENSVIFEDGDEIDALLSKLTIKESMFTSWLQANAIFQQAKDPTYLLNWVPPSTRELYYLRMMLDVVKGPTTYEQIHIVNGQLYSTFREACFAMGFMVNDKEYIEALREAYHW

SEQ ID NO: 154355 - protein, 132 aa, Glycine max
  Coding DNA Sequence Number=SeqID_62670
  Homolog annotation: Hit_ID=Q945K3; Match level="QueryCoverage=31%, HitCoverage=14%, E-value=2e-08, Identity=61%"; Hit description =Putative transposase
MKVSKDYLNFQPCTLEGAEANKWRWFERCIGALDGTHIPVTVSPDERPRYRNRKGDVSTNEILEYYEMHYVIKTNLKFQLVCIFLWMRDIPMVRDFEHEIEGLDIISMSGLETPLKVTRSYLIFVMQVPKMQ

SEQ ID NO: 154356 - protein, 45 aa, Glycine max
  Coding DNA Sequence Number=SeqID_62671
MGDQEETQKQMKADMSALKEQMASMMKAMLGMRQLMEKNVATPAA

SEQ ID NO: 154357 - protein, 137 aa, Glycine max
  Coding DNA Sequence Number=SeqID_62672
CLNTFGGYILCGTSRGYIYLGLTKNKRGYISCGSVLVEGTSTRFKENKGGYIPCGSLLIKGFLQGFDSCLLDPKTKSKGRAKWSFFQDFKHPLAQASNQLSWANKISSSISNQLAWASYNSPGRIGAFSTKSQIRLG

SEQ ID NO: 154358 - protein, 100 aa, Glycine max
  Coding DNA Sequence Number=SeqID_62673
MEVNTATVVATSTATEVDPTHPPGFNQVNRPTSDMVGSEQAFLPPMWIASQLTPPNVVHAPDENVDNYAPVPIKSQQPQSDHAHVSQPMGETMKYPEATL

SEQ ID NO: 154359 - protein, 174 aa, Glycine max
  Coding DNA Sequence Number=SeqID_62674
KVRKAWEVLQKKDKELRGSNNGPIGGYRKWLKAHVQGLDWLPSLRTAKREKVEAPEEDEEVQALRTELKQAQIVKERFKSAALKIRKENTKLRDEARGRVIDSLHQEATMWMDRFALTLNGSQELPRLLAKAKAMADTYSAPEEIHGLLDYCQHMIDLMAHKPLGNLYCYSDLD

SEQ ID NO: 154360 - protein, 59 aa, Glycine max
  Coding DNA Sequence Number=SeqID_62675
MKHSSKLFGGGCMNENAIHGAPKKRRGWRIALEGCLNENAIDGAPKTRRGWRIALEGPH

SEQ ID NO: 154361 - protein, 168 aa, Glycine max
  Coding DNA Sequence Number=SeqID_62676
  Homolog annotation: Hit_ID=A5BH93; Match level="QueryCoverage=62%, HitCoverage=11%, E-value=4e-10, Identity=29%"; Hit description =Putative uncharacterized protein
MTTQMQRMLNRNNEELYEQIEGLENQLNQNVGRHYGGYIGGNDGPRQNRMEGQNKIEGEKLNVPPFKGRSDPDAYLDLEIKIEHGSLAVEEYYKEMEMTLVRANIEKETEDTMAHFLSGLNPDIRDEKHNKKELIQYLQPELDQQIQEGGRQFVQPINTIPTWKVSST

SEQ ID NO: 154362 - protein, 167 aa, Glycine max
  Coding DNA Sequence Number=SeqID_62677
  Pfam annotation: Domain name=Transposase_23; Domain location=12-77; Score=-8.6; E_value=0.01; Accession=PF03017.5; Description=TNP1ENSPM transposase
DGILQPDAIPVSVSDAITRTCIASGAIGKLYEGYTAVHNIPLLHGQVKVGVEEVKDAEASVPVPTDEVALVGQALKTFLAWLTHLVKRLSEQAAVSPAKPPESPDHEVDDPLYLMTLTIPQLFLKPLQVMWDATMFGVFNQNFSLYIKHEDLSKIAHGGQCLNISVI

SEQ ID NO: 154363 - protein, 47 aa, Glycine max
  Coding DNA Sequence Number=SeqID_62678
MPSTSQGPKKGRMSSSKGPRTKLGYDRLTGFIFVKITTGVHRSSQVF

SEQ ID NO: 154364 - protein, 60 aa, Glycine max
  Coding DNA Sequence Number=SeqID_62679
PFAKHKPRAKRIFCHVLSGESLALSTQPLHLKLIWSAKLAKAKLSPFQFDLNSAKRWPAH

SEQ ID NO: 154365 - protein, 82 aa, Glycine max
  Coding DNA Sequence Number=SeqID_62680
MTKSKGKDPLEGLGGPMTRARARKAKEALQQVLSILFEYKPKFQGEKSKVGFSSSCNKGPIGNLGISLLGDQMVADLLAVGG

SEQ ID NO: 154366 - protein, 180 aa, Glycine max
  Coding DNA Sequence Number=SeqID_62681
MGSSQKPSLKKRFYQVKIKSLEVTSLRKLGQLMGQLQRQAFRKAYEFLKSPNLSAGIRPPKASRKWGGRNTEKIFGGSPLSKCGWVGGPGSDRRFLAYHNHKESPVVAMLADLYDTFDRRCEESNARIVCCTPALYVGLVSHLFFQEGRPVYPLQGYHSCVEKGKANWNQLLASMGGGVC

SEQ ID NO: 154367 - protein, 143 aa, Glycine max
  Coding DNA Sequence Number=SeqID_62682
MHKALQLNAPLPYPHSVTLFLQHFNIPLDSKPYVPIKKSFLIGAIVVASFGYRKERDGSWVKKGTQPNDDEGQLSVEGESSLLQSILDRFDGLQTYVGERFDALEQQVDMRFDEMDSRITKVEEDVTFIRTCFDLPPPPPPSS

SEQ ID NO: 154368 - protein, 243 aa, Glycine max
  Coding DNA Sequence Number=SeqID_62683
  Pfam annotation: Domain name=Transposase_23; Domain location=45-115; Score=5.7; E_value=0.00028; Accession=PF03017.5; Description =TNP1ENSPM transposase
  Subcellular localization annotation: CTP_CleavageSite=28; ConfidenceScore=5.20e-01
MQSQIQSQMQSQGLALPPNPLVGPSGPRVSTKGSCVDPSGNDPETGDSDRCGLYIEADPARLVGMGRVYEGSTVLHNPPLLPGQVKVSVEEVTDADAPVPVPTDEVSLVGQALHTFLAWPTHLVKSLSQQVAVSPAKPPPKPDPEVDDPLYLMTLTIPELFLRPYQVRWNATVFGVFNPDFPLYIKHEDLSEIAHGGQCLSISVLVILPKEHLVVWFCSLPNRPDNYLKGIINRLVFFSIHLH

SEQ ID NO: 154369 - protein, 256 aa, Glycine max
  Coding DNA Sequence Number=SeqID_62684
  Homolog annotation: Hit_ID=Q84VH5; Match level="QueryCoverage=100%, HitCoverage=41%, E-value=2e-77, Identity=59%"; Hit description =Envelope-like protein
  Subcellular localization annotation: CTP_CleavageSite=21; ConfidenceScore=5.19e-01
MATSAKETSSPGSPSVPSSPSSTKAPSNQEQPEFHIQPIQMIPGQAPVPEKLVPKRQQGVKTSENPSLATSPREVDTEMDKKIRSIVSSIFEDASVPEADKDVQHLPPQIKEESTEEDDQATEETPAPRAPEPAPGDLIDLEDVESDEEPIANKLAPGIAERLQSRKGKTPIKRSGRIKTMAQKKSTPITPTTSRRSKVAIPSKKRKEISSSDSDDDVEPDVPDIKRAKTSGKKVPGNVPDAPLDNISFHSIGNAE

SEQ ID NO: 154370 - protein, 72 aa, Glycine max
  Coding DNA Sequence Number=SeqID_62685
MMATKGDEQKAQRSKNNSRESRTIQEFKNQEEFKTQEESLESRIKVQGSRSQESRFKTQDSRMKKILNQDKY

SEQ ID NO: 154371 - protein, 82 aa, Glycine max
  Coding DNA Sequence Number=SeqID_62686
MGGLGIKDIKAHNNALLIKWKWLIFHQSDQLWSRILISKYKGWSGLDQRPSKKYFSQWWSDLRSYRSYQNKWQSEGHLAVGS

SEQ ID NO: 154372 - protein, 145 aa, Glycine max
  Coding DNA Sequence Number=SeqID_62687
MAVPLGVGFQWRTMMRCSRERKLLAHCRYLLKDPNGQIMEKYLAKLKTKFREDPTVNEGWTAFFPRQLHVVFSRSFIKRLPLEASLRDFWRTPDIFSKIPTLKTKFREDPTVNEDWEAFLPRQLHVAFSRSFIKRLPPEASSWLL

SEQ ID NO: 154373 - protein, 107 aa, Glycine max
  Coding DNA Sequence Number=SeqID_62688
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=78%, HitCoverage=8%, E-value=1e-37, Identity=92%"; Hit description =Phosphoenolpyruvate carboxylase
LSFSSTFLQQLCGSGVLADGRLADLIRRVATFGMVLMKLDLRQESSRHAETIDAITRYLDMGTYSEWDEEKKLDFLTRELKGKRPLVPPSIEVRLLYIAKLYKLYIQ

SEQ ID NO: 154374 - protein, 142 aa, Glycine max
  Coding DNA Sequence Number=SeqID_62689
MWAFHISRQIDWAHLVRYCMHKALRLNAPLPYPHLVTLSLQHFNIPLDSEPYVPIKRSFLIGVVVVASFGYRKERDGSWVKKGTQPNDDEGQLPIEGDSSLLQSILDSFDGLQTYVGERIIKVEEDVTIIRDCLDLPPPPSV

SEQ ID NO: 154375 - protein, 83 aa, Glycine max
  Coding DNA Sequence Number=SeqID_62690
QVGQLAKQLADRPSSNFSANTEKNPKEKCKAIMTRSRMAIQADEGRAEEKVGGYKQQLTAEPALEPVSDFVELKEVVEDEDDQ

SEQ ID NO: 154376 - protein, 141 aa, Glycine max
  Coding DNA Sequence Number=SeqID_62691
  Homolog annotation: Hit_ID=Q6WAY6; Match level="QueryCoverage=97%, HitCoverage=28%, E-value=6e-16, Identity=31%"; Hit description =Putative uncharacterized protein
MANQEDWVPFMDVLALLIFGVVHFPNVDGLVDLAAIDAFLAYRHSKESPVQDTRHPCPLQSHRSCTEKRRIDWDQLLAGIGGRTINWFPRWKEGNEGVLFSCGGYPNIPLIGTRGCINYNPALAIRQLGYPMRGAPMKGIL

SEQ ID NO: 154377 - protein, 97 aa, Glycine max
  Coding DNA Sequence Number=SeqID_62692
  Pfam annotation: Domain name=zf-CCHC; Domain location=77-94; Score =22.6; E_value=0.00057; Accession=PF00098.14; Description=Zinc knuckle
MELQCLNQNEETEKKKRSIALKASSSMQEANEEEDSDDEEDFSLFVKKFQKFVKKRRIERRQNFNNGRKSQEESQVLRCYKCNQLGHIQANFPSNEE

SEQ ID NO: 154378 - protein, 136 aa, Glycine max
  Coding DNA Sequence Number=SeqID_62693
MEGEQLMQLNPIGPTAKPVPFPYQNSHAVPWRYTPPGKKEEEVTDVSSLSAKVTNITGLSGVTRSGRVFAPPDLPVQPADVKGKGKVVEEQDGEAPHASNKDIPAKGPPEKKDGRKEVSLEEASEFLRIIQQSEFK

SEQ ID NO: 154379 - protein, 170 aa, Glycine max
  Coding DNA Sequence Number=SeqID_62694
MQLPQEPLNKRPRGLARKSMAGTNFAELYGVAIVNSSCEGKKETSREHIAWSKRSLSQHLCETETNMLAIIAKYQEELGLAAAHEHRIADEYAQVYAEKEARGRVIRLFTPRGNPCGWIGLLLPLNGSQELPRLLAKAQVMADTYSAPRRDSWGGGAYCQHMINLMAHIN

SEQ ID NO: 154380 - protein, 91 aa, Glycine max
  Coding DNA Sequence Number=SeqID_62695
MEDESSEATIPKPFDIGEEAEEMQVRQVVVTTPERSLEATSEPSTPMVNLPSPQPAADPSTPLLQMPEDPTTPVLAVDTSPPHYSSASTDR

SEQ ID NO: 154381 - protein, 118 aa, Glycine max
  Coding DNA Sequence Number=SeqID_62696
MGKIKRILRLYRFEFFDKGDTKEFRWLVLRSFGKRRRETRKEFRRLVLPSFGKERRETEKEFRRLVHGEFFLAKGEENEKMNSTKFSRFRKPENFRKAFGTKEEEEELPKRISRLVND

SEQ ID NO: 154382 - protein, 132 aa, Glycine max
  Coding DNA Sequence Number=SeqID_62697
  Pfam annotation: Domain name=G-patch; Domain location=1-42; Score =25.7; E_value=0.00015; Accession=PF01585.14; Description=G-patch domain
MVARVMLGNGYEPGIGLGKDNDDITSLISAKGNRGKFGLGYKPTQADIRKSIAGRKSGSQGSRLRQEDEGGPPCHITRSFISAGLGDEGQVVAICGDDAPAGSDLVRPCPPNFRLGNWQVKERPDIYATSIM

SEQ ID NO: 154383 - protein, 102 aa, Glycine max
  Coding DNA Sequence Number=SeqID_62698
MDAIFANFHVGIPLVVCHSLCQGINTLNSNVKSDTAFKGGYYIITVFECRSDVTFKGGYYIITVFEYRSDVTFKGGYYVITVFECRPDVTFKNGYYIITVFE

SEQ ID NO: 154384 - protein, 56 aa, Glycine max
  Coding DNA Sequence Number=SeqID_62699
MHAHLPFDSGFVERVERCYAYKWLQSPDLGELNLRLQFHLAYTKTSTTVQIIEEKE

SEQ ID NO: 154385 - protein, 72 aa, Glycine max
  Coding DNA Sequence Number=SeqID_62700
MSWERSHCLQCPTKKTMIMRGQDIYSSQEETTSSPSSSGSEDEVRGAESSEKVYPHEEGDLLTVRRLLEAQD

SEQ ID NO: 154386 - protein, 47 aa, Glycine max
  Coding DNA Sequence Number=SeqID_62701
MENKMKNKELKSMEVEWKWKKDDWRHHFKEKMSQEEVRHHRKPWIRA

SEQ ID NO: 154387 - protein, 143 aa, Glycine max
  Coding DNA Sequence Number=SeqID_62702
MVIDFQQFIQILKPVIYYTSLVIDYQRRFSENNFQESHLFKWFMNGHQRIHDVGYNVQDILPENTGIAKSIEAAGSTMSDTMSRTSCPKILELLKALKLQDPRCRIRCPGHLARKYWTYKSVISLTDYCAVSKRLDDLSLGAN

SEQ ID NO: 154388 - protein, 113 aa, Glycine max
  Coding DNA Sequence Number=SeqID_62703
MYQSCLTQNQALQHSNTESRCPTPLNSMGFLGLKSEIENEHINITNIITKTLKQNGKLARPPIISPKTPYPRNLREKEVHPNLKFRSPTRSHALHDSKNALLSRFGAEMMAKG

SEQ ID NO: 154389 - protein, 99 aa, Glycine max
  Coding DNA Sequence Number=SeqID_62704
DVLDIVSDIVDPALCIVQQLQYFRAGCPGHCIRHLMQVGSATFIIRVIKHSGICSGNSKILQVASRFQDVKTSHVTSAFCSPCLHAPTAVKQFTAASSI

SEQ ID NO: 154390 - protein, 97 aa, Glycine max
  Coding DNA Sequence Number=SeqID_62705
  Subcellular localization annotation: CTP_CleavageSite=50; ConfidenceScore=5.10e-01
MKMLLISHDVSSIGACRLSQPTLLRASEARLMGASSKGGKCAESPPTFICGKRRKNRRKPVMKNIPDSGVVFTFEEGRQKRGSCSYVPSIEEEIRPT

SEQ ID NO: 154391 - protein, 182 aa, Glycine max
  Coding DNA Sequence Number=SeqID_62706
MAKFDPDIVFEFYANAWPTQEGVRDMRSWVRGQWIPFDADALSQFLGYPLVLEEGQECEYGQRRNRADGFDEEAIAQLLCIPRQDFARTAVGRRVRIIRTNMTTLTQTWMTLLLSNILPSDHNSDLPLPKCMPPTRHPLDPNKSNRALGFSALITGLCQSFGVPVTPSKVIRPPITRAFIEK

SEQ ID NO: 154392 - protein, 127 aa, Glycine max
  Coding DNA Sequence Number=SeqID_62707
YPGLQRTTLLANRGLHALTLRGLCVLNFRGLHALAIRGLCVLTFRGLHALAIRGLHVLTFVGLHALTFRGLHVLANRGLHALTLRGLHVLANVGLHALTFQRTISRPWTIPQPSEAASHLRTTASSP

SEQ ID NO: 154393 - protein, 55 aa, Glycine max
  Coding DNA Sequence Number=SeqID_62708
GELSYYRGNLLKQASQRGELSYERVCVAKLYLLKEVFSRKLLKEVFSRNLLKEAT

SEQ ID NO: 154394 - protein, 45 aa, Glycine max
  Coding DNA Sequence Number=SeqID_62709
MCVQEDERLIMEEGEKSMESLRKPVGSEQCIYLGRRMSLHVEAIG

SEQ ID NO: 154395 - protein, 199 aa, Glycine max
  Coding DNA Sequence Number=SeqID_62710
  Homolog annotation: Hit_ID=Q6WAY6; Match level="QueryCoverage=50%, HitCoverage=18%, E-value=1e-10, Identity=33%"; Hit description =Putative uncharacterized protein
TINWFPRWKEGKEGVLFSCGDYPNIPLIGTRGCINYNPALAIRQLGYPMRGALTEESLSPFLVRDFGTQSFKIVQRVHKEWESPLRKDKELRGIRNGIIDGYHEWLKVHTRGLDWLSKLKIINEENFEAPEEDEKMSGKSVLSYEKKMQLPQEPLNKKPRGLARKSMAETNSELAACSRSKRRAVTLEEAHEFLRLIQQ

SEQ ID NO: 154396 - protein, 121 aa, Glycine max
  Coding DNA Sequence Number=SeqID_62711
  Homolog annotation: Hit_ID=A2Q5X7; Match level="QueryCoverage=98%, HitCoverage=12%, E-value=8e-13, Identity=31%"; Hit description =Ovarian tumour, otubain, putative
MMHNELIKELGKWSQDYIKIFGGTERYEQLRLSLHVDGLSKVSMDKWMDITNMRYVIASRYNSFTFFPLRSRPSADSAAHRIICVGHVHDSHFVQVFLKDRCPLPPMALLWSSNAYPEAKQ

SEQ ID NO: 154397 - protein, 158 aa, Glycine max
  Coding DNA Sequence Number=SeqID_62712
  Homolog annotation: Hit_ID=Q6WAY6; Match level="QueryCoverage=86%, HitCoverage=26%, E-value=1e-12, Identity=31%"; Hit description =Putative uncharacterized protein
IATVVKDSARGLDRIKQTRNGIAGLPQKYLVDKARGMANQGDWVPFMDVLALLIFGVVLFPNVDGLVDLAAIDAFLAYHHSKESPVVAVLADLFDTFDRRCEKSSARIICCLPALYRRIDWDQLLAGIGGRTISWFPRWKEGKEGVLFSCGGYPDISL

SEQ ID NO: 154398 - protein, 90 aa, Glycine max
  Coding DNA Sequence Number=SeqID_62713
MVIDQSLFHDLTKLTSDGVPFEGTLNDDWKFDFSAHDARQLVCTNNADMTGRLLAGSLAFESRILHYLIVRILLPRSSNLAQGVNLTGHT

SEQ ID NO: 154399 - protein, 265 aa, Glycine max
  Coding DNA Sequence Number=SeqID_62714
MEIYHTELDEFKAKLERRNFHKRLTNLADNSIDLALVKEFYANLYSPEGPSPKQVRIQGHLIRIDADNLNVFLETPMVLAEGESLPAYSRYYRMPTDIREIEAALCIPGQGFILNVEGHPGKILRKDLTTLAQLDMNVRALISRQITSMAQSNSSRLGFPALITTLCKSRGVVSDSLAFERLSSVINLAYIRKNCWNPDDPTVIIRGGRRPRARPAEVLSTSAAPHPTSTLAAPSTLPPADFQRFEAMLRSIHQGQIILLQSLQL

SEQ ID NO: 154400 - protein, 52 aa, Glycine max
  Coding DNA Sequence Number=SeqID_62715
MSVKNLVGRLGVHDKTNHTLASQVTLTRIKGALKPCDPQGLYSEESVRASPS

SEQ ID NO: 154401 - protein, 134 aa, Glycine max
  Coding DNA Sequence Number=SeqID_62716
  Subcellular localization annotation: CTP_CleavageSite=71; ConfidenceScore=5.20e-01
MAQATHGTHQYAQHHLSFSARAEASSDTALTQPRAPTPLQGGALQAPAPTRPHPTNNAHFGANTARNFSPRQAQIFAPIPMTYGELLPSLIANQLVVVVPGKIFQSPFPKWYNLSATCAYHGGPQATRSNSAWP

SEQ ID NO: 154402 - protein, 177 aa, Glycine max
  Coding DNA Sequence Number=SeqID_62717
ELRGSSNGIIGGYHKWLRVRTQEFDWLPNLKTVRDDEVKASEESDEVQALKAELERARVVEEKFKAAIVSSSSEEVKGIITGQRHDLEGRAKGNMWAIIDKCKEKLNLAATHEQRLEDEYAKISAEREAREGSQELPRLLAKAKAVADTYSAPEEIHGLLSYCQHMIDLMDHMIGNR

SEQ ID NO: 154403 - protein, 93 aa, Glycine max
  Coding DNA Sequence Number=SeqID_62718
MALRKLSAKRSRKDAVTEGTSAAPEFDSHRFRSAEHQQRFEAIKGWSFHRERRVQLRDDEYTDFQEEITRRRWTSLVTPDGSLLVGLLWRLDL

SEQ ID NO: 154404 - protein, 63 aa, Glycine max
  Coding DNA Sequence Number=SeqID_62719
MLVDLALIDTFLAYHHNKESLAIVVLADACATFDLRCKKSSARIVCCKPALYVWLVSHVFRHE

SEQ ID NO: 154405 - protein, 32 aa, Glycine max
  Coding DNA Sequence Number=SeqID_62720
MTSNLKDIKEALLGGNPEEDEDMTDPVDYFIG

SEQ ID NO: 154406 - protein, 32 aa, Glycine max
  Coding DNA Sequence Number=SeqID_62721
EEGKQTGKGIKERRDLACNVGADGCVFNVCVC

SEQ ID NO: 154407 - protein, 67 aa, Glycine max
  Coding DNA Sequence Number=SeqID_62722
RVHLLGDCYAENKRGYISCGSVHVEGTSTWVFKENKGGYSPCGSLACKGFYMVERNLKNHRLLGDWI

SEQ ID NO: 154408 - protein, 132 aa, Glycine max
  Coding DNA Sequence Number=SeqID_62723
MECLEGVWETLKGNARCRFRGTIRLTATSLVHPEEPAHTLQRTVEWILPTPTPYRLVEPVQVIEVTSSEEDPEEDPEELPPEPAVDALDFLEGDEDPLPEVDSPEDVMSASEADSTEESGHGGIATSRGSSS

SEQ ID NO: 154409 - protein, 88 aa, Glycine max
  Coding DNA Sequence Number=SeqID_62724
  Pfam annotation: Domain name=zf-CCHC; Domain location=68-85; Score =30.9; E_value=4.6e-06; Accession=PF00098.14; Description=Zinc knuckle
MWDTLQLSHEGTTDVKRSKEEEEEEETDDEEDFSLFMKKFHKFVKNRRMERSHNLNNGKRSQEVSPTLKCYKCNQPDHIKANCPSNES

SEQ ID NO: 154410 - protein, 45 aa, Glycine max
  Coding DNA Sequence Number=SeqID_62725
MVIFNHGVAAEDKGEEPSTWEAPLGSKKGSFLGKLEGGYSHPSNS

SEQ ID NO: 154411 - protein, 117 aa, Glycine max
  Coding DNA Sequence Number=SeqID_62726
IMAHSPDKIKSIDGSKETLKLSVRISDLWFIGTPNKSEQAEMVFVDFDEVVFRQVSGKGRRVVFKLKDLSQQLLSCTSWDDYCLQFLKFLDDYEGDGPITVLLSHCRIKEAQGISSS

SEQ ID NO: 154412 - protein, 84 aa, Glycine max
  Coding DNA Sequence Number=SeqID_62727
  Subcellular localization annotation: CTP_CleavageSite=54; ConfidenceScore=5.57e-01
MCTCAIFGTPNALSMHEWPRGSLPQRGPGRTRRPKGLVPLRSTTVTALGALYTSSASRPSRDGRFSGSDASSSGTTSILISRRK

SEQ ID NO: 154413 - protein, 148 aa, Glycine max
  Coding DNA Sequence Number=SeqID_62728
MTNREMITIMVDMLPMFYYEKLIGYMPAKFADLIFTGERIESGLRKGKFEYASNTTLNNNRRTPNHLVVAIPGKVFQPPYPKWYDPGAKCAYHSGAAGYNIDSCIPFKYKEGPNVKTNPLASHGGASVKCRRRGWAIAGKEIRRGGYF

SEQ ID NO: 154414 - protein, 181 aa, Glycine max
  Coding DNA Sequence Number=SeqID_62729
MTAVHQQRFEAIKGWSFLRERRVQLRDDEYTEFQEEIGRRRWASLVTPMAKFDLEIVLKFYANAWPTEEGVRDMRSWVRGQWIPFDAVAIGQLLGYPLVLEEGQECEYGQRRNRSDGFDEEAIAQLLCIPGQDFARTATRRRVRIMRTNMTTLTQIWMTLLLSNILPTDHNSDLPLLKCQL

SEQ ID NO: 154415 - protein, 306 aa, Glycine max
  Coding DNA Sequence Number=SeqID_62730
  Homolog annotation: Hit_ID=Q6WAY6; Match level="QueryCoverage=66%, HitCoverage=35%, E-value=1e-14, Identity=29%"; Hit description =Putative uncharacterized protein
EASQKWGGWDTEKVFEGKSKELGRGVLFPNVDGLVDLAAIDAFLAYHNHKESSVVAMLTDLYDTFDRRCEKSNTRIVCCTPALYVWLVSHLFHQEVRHTCPLESHRSCTEKGRANWDQLLARKEGTSVNWFPRWKEGRTEVLISCGGFPNVPLMGTRGCISYNPVLKTTWLSYERSTTRGRDRANQCGALQKVRKAWKVLQKKDKELRGSNNGPIGGYCEWLKAHVQGLDWLPSLRTTKREEDEAPEEEEEVQALRTELKQAQTVKERFKSAALKIRKENAELRDGLCGAVTANLNSEEKKGTNRE

SEQ ID NO: 154416 - protein, 276 aa, Glycine max
  Coding DNA Sequence Number=SeqID_62731
  Homolog annotation: Hit_ID=Q6WAY6; Match level="QueryCoverage=96%, HitCoverage=44%, E-value=3e-35, Identity=34%"; Hit description =Putative uncharacterized protein
MVEVSIEAIASLAQYYDQPLRCFTFGDFQLSPMVEKFEEILGCPLGGRKPYLFLGFYPSLARISKIVQISTQELDHRKQVKNGVVGIPRKCLKAKARNLAGKGEWAPFIDILALLIFRGVLFPNVDGLVDLAAIDAFLAYHNHKESSVVAMLTDLYDTFDRRCEKSNTRIVCCTPALYVWLVSHLFHQEVRHTCPLESHRSCTEKGRANWDQLLARKEGTSVNWFPRWKEGRTEVLISCGGFPNVPLMGTRGCISYNPVLAIRQLGYPMKGAPPRG

SEQ ID NO: 154417 - protein, 145 aa, Glycine max
  Coding DNA Sequence Number=SeqID_62732
MAKFDPEIVLEFYANAWPTEEGVREMRSWVRGQWIPFDADALSQFLGDLLVLEEGQECELSQRRNRADGFDKEAIAQLLCISGQDFARTATGRQASASPFGVPIKPSKVIRSPISRAFIKKYCTPRQAQGDAPQAADAPPPPSSG

SEQ ID NO: 154418 - protein, 63 aa, Glycine max
  Coding DNA Sequence Number=SeqID_62733
MSPKGCPFLCGQCNTKWMYAPLELIHKRCTLSCSQYYNPSRCTLYLYHKGCTLQCVKTKISQA

SEQ ID NO: 154419 - protein, 50 aa, Glycine max
  Coding DNA Sequence Number=SeqID_62734
MWDRHKLKGALKPSVFTPKAYTSKSPSGSLPPDSDTAHELYNTHDLTLVF

SEQ ID NO: 154420 - protein, 163 aa, Glycine max
  Coding DNA Sequence Number=SeqID_62735
MQQQQQYSKQRQQATEAPPQTSLEELVRQMTIQNMQFQQETRASIQSLTNQMGQMATQLNQAQSQNSDKLPSQTVQNLKNVSVITLRSSNQIQVPSPVAAPAPEPVKLHSTPEKEDEIIAQKRKLPNKNFHAGGPSSTNSDLPQPLIPLPFPPRAIPNKKNWK

SEQ ID NO: 154421 - protein, 142 aa, Glycine max
  Coding DNA Sequence Number=SeqID_62736
  Subcellular localization annotation: CTP_CleavageSite=64; ConfidenceScore=5.40e-01
MQFQQETRASVQSLTNQMGHLATQLNQQQSQNSDRLPSQSVQNPKNVSAITLRSGKQYQGPQPVASSSSANEPAQLHSTPEKDDDKNLKSRLPNNFYAGESSTGNSDLQQQHIPLPFPPRAIPNKKMEEAEKEILETFRKVE

SEQ ID NO: 154422 - protein, 120 aa, Glycine max
  Coding DNA Sequence Number=SeqID_62737
  Gene Ontology: Mol. function=oxidoreductase activity; Cellular component=flagellum; Biological process=negative regulation of transcription
  Homolog annotation: Hit_ID=Q9AYU0; Match level="QueryCoverage=100%, HitCoverage=59%, E-value=1e-30, Identity=55%"; Hit description =Quinone-oxidoreductase QR2
MAAQFNAFLDSTEELCKTQQLSGKPVAIITGTNSQGGGQETTVLTAITPLAHHGMIFVPFGIRFAYSNEFGNVKEVKGGSPYGAGTYAETEGPTSIESMHAFDHGYYFANITKQLKEATA

SEQ ID NO: 154423 - protein, 237 aa, Glycine max
  Coding DNA Sequence Number=SeqID_62738
MVIDQSLFYELTQLSSEGVPFDGTLIDDWKYEFSVHDARRLVCTNQVDMTGRLLASSLAFESRILHYLIVRILLPRSSNLAQVSEEDLIVMWAFHEGRQIDWAHLVGYRMHKALRLNAPLPYPHLVTLFPQHFNVPLDYELYVPIKRSFLIGVVVIASFGYQKEHDGSWVKKDSSLLQNFLDRFDGLLTFVGERFDTLELQVDMCFSEMDSRITKVEEDVSYIRTSFDLPPPPPPSF

SEQ ID NO: 154424 - protein, 170 aa, Glycine max
  Coding DNA Sequence Number=SeqID_62739
  Subcellular localization annotation: CTP_CleavageSite=51; ConfidenceScore=5.13e-01
MGNQQRQGYNQGGFLGFQQGPYNQPPQQGPNIFQRTTKLEETLAQFMQVTMSNHKSTESALKNLEIQVGQMAKMLAEKSSNSFGANTKKNTKEECKAVMTRSMKLVAAEDKDVVALKEQVSLKDTTVKKKNRVTNKRSQWREKPIIVRKEEMKDNEKEIEGGKQKEKEKV

SEQ ID NO: 154425 - protein, 113 aa, Glycine max
  Coding DNA Sequence Number=SeqID_62740
MNGKSGAWTSFVCMTFTPLTKSEWKFLDKIDEELLMFNHHWKWKVHYEKEKQFAKMESSIVIVSNVVSSNLAAFYEIKLQKRKTESLIRHRIQMEHVIIGMKTDEKFEITFLT

SEQ ID NO: 154426 - protein, 52 aa, Glycine max
  Coding DNA Sequence Number=SeqID_62741
NTGVRTDDIGFTLVDLKKLGYHNDPFIMAEQARQGKTIGVNVEDDDSYMDTY

SEQ ID NO: 154427 - protein, 45 aa, Glycine max
  Coding DNA Sequence Number=SeqID_62742
MRIKRSFRVVMGPRTSLSYPNFVRGPLLDDMRPFFGPCEVLGTHH

SEQ ID NO: 154428 - protein, 90 aa, Glycine max
  Coding DNA Sequence Number=SeqID_62743
MWAFHTGRQIDWAHLVQIVIIKKGEIVEAMPSKIILMMPKNQELSKFQRFKNQVSRIKIQDSRTKFQELRFKNNQDQDSRIKRTLNQDKY

SEQ ID NO: 154429 - protein, 145 aa, Glycine max
  Coding DNA Sequence Number=SeqID_62744
MYPGPGFCPDCCRETGMPPTRHPLDPDKSNRALGFPALITGLCQSFGVPGTPSKVIRPLIARAFIENYCTPRQVQGGDLQAPDSPPPPHQADPAGSFDTERYLRHLVCQQAANHRAHMQTHDCLYQLSLSQQSQGFAPFPCHTPD

SEQ ID NO: 154430 - protein, 98 aa, Glycine max
  Coding DNA Sequence Number=SeqID_62745
MGILEIKILYFFKALKLSINSKRKGEKEMSERIVIIKKGEIVEAMPSKIILMMPKNQELSKLERFKNQVSRIKIQEQSRSRFKTQDSRIKRRLNQDKY

SEQ ID NO: 154431 - protein, 58 aa, Glycine max
  Coding DNA Sequence Number=SeqID_62746
GQDHLELPSGVETKLEQQKPIKVHRDGCKWGWGHDRPIVAPSLRQTSRERHARQPSIL

SEQ ID NO: 154432 - protein, 67 aa, Glycine max
  Coding DNA Sequence Number=SeqID_62747
MQILNSNFNSCCKSVLATGNRLHPLDPRCRIQCPDILLENTGVAVHCKIKVKCRSEAAGSTMLDTMS

SEQ ID NO: 154433 - protein, 42 aa, Glycine max
  Coding DNA Sequence Number=SeqID_62748
MDKSMKVKEDEWREKERRSTKFCVSKEPTNPRSSPRFFTKCA

SEQ ID NO: 154434 - protein, 117 aa, Glycine max
  Coding DNA Sequence Number=SeqID_62749
LGGPMTRARARKAKEALQQVLSILFEYKPMFQGEKSKVGPIGNLGISLLGDQMVADLMVVGGTNPNDGVGLSQFQMQALMHHLERLMKQRDDALHESLDQMENRDHNEEERRRRGND

SEQ ID NO: 154435 - protein, 185 aa, Glycine max
  Coding DNA Sequence Number=SeqID_62750
MWPPTTTESPSGRFTRKKEETGSTPVYPRAAPKPTPFAYQSNKAVPWKYTPPASSERVATEVDSLSAKVINISRPQWRNPQWSGVRFPSPGGIALQRESAYGPRAHTHSTTPSKEVDPSFQWHTRKERRSSLGKTVTLVVAHTRKFLRHPTQQSGMTRVPSVRTIVEFPDTTLTPASRSNIRYGT

SEQ ID NO: 154436 - protein, 132 aa, Glycine max
  Coding DNA Sequence Number=SeqID_62751
MAPPMVEREMITMIVNTLPVFYYEKLVGYMPSSFTDLVFAGERIKVGLKRGKFDYVFPTGINNRRIGAVGAKRKEGDAYAITSTPAWPTKERMTNRLNSFVSLFSLSKRIQRTLPENSFDSSLSLKQKISKD

SEQ ID NO: 154437 - protein, 172 aa, Glycine max
  Coding DNA Sequence Number=SeqID_62752
  Subcellular localization annotation: CTP_CleavageSite=85; ConfidenceScore=5.17e-01
MLTTSKDWKAVSNDSSAASTYGIEEGQLTKMSSSPDTMTKCPSTTNFSFWWSVEGMTPTEWIHGSISPPTSRRLPSKARTTMELVGSVKRQFLQRVFGHHVQTRVVIDEYLGHDVVHAFDRHMQSPVMSSPLGRDFLFSEGEVVVGCDVIDESPKSFYKDVLGYMSFIQDFY

SEQ ID NO: 154438 - protein, 122 aa, Glycine max
  Coding DNA Sequence Number=SeqID_62753
MVVWSGAQPSLHREHEGPTAQVPQHVEDESSEATVPEPFIVGEEAGETQVRQVAAVTPERSLVATSEPLAPVVDLSSTQHVADLSTPILEIHEDLTTPVLTMDTSPPATPVLHLKDAEGVQT

SEQ ID NO: 154439 - protein, 168 aa, Glycine max
  Coding DNA Sequence Number=SeqID_62754
  Homolog annotation: Hit_ID=Q0KIL1; Match level="QueryCoverage=51%, HitCoverage=9%, E-value=6e-08, Identity=35%"; Hit description =Gag/pol polyprotein, 3'-partial, putative
  Pfam annotation: Domain name=G-patch; Domain location=43-82; Score =27.1; E_value=6.4e-05; Accession=PF01585.14; Description=G-patch domain
MPYVEAAKESLETAFQSFEVVSISSVDSFSGQPCLSDAAVMMARVMLGNGYEPGMGLGKDNGGITNLINAKGNRGKYGLGYKPTQADIKRSIAGRKSGSQGSRLRQEGEGSPPCHISRSFISAGLGDEGQVVAIYEDDVPSTLDLDLSSSVPTSLPILIHLHVYFFTF

SEQ ID NO: 154440 - protein, 102 aa, Glycine max
  Coding DNA Sequence Number=SeqID_62755
MRKGKSEVNIDKKKDTTPNEGKEVPYPLVPSREEKERHLARFLDIFKKLEITLPFGEALQQLSLYAKFLKDMLTKKNRYIHNDIIVVERVGSSGLRIIKKGG

SEQ ID NO: 154441 - protein, 177 aa, Glycine max
  Coding DNA Sequence Number=SeqID_62756
  Subcellular localization annotation: CTP_CleavageSite=47; ConfidenceScore=5.41e-01
MAQGVTSDSLTFKSLSPAINLAYIKKNCWNLDNPTVSFPGTRKARTRGSEGPSSVAPQTSTAPAPIPSTSVPDTSDPSAQSTYLMMAMLQSIHQGQYLVAWPGVQPSSHGGGEASAAQEPQPDLETTPAAQEDDLEATPPESFVPETNPEKDVVIVEASPQASPVSTPVLELSTLQG

SEQ ID NO: 154442 - protein, 106 aa, Glycine max
  Coding DNA Sequence Number=SeqID_62757
MGRIKRILRLCRSEFFDKGEGRHKTIQAVSPSFFWKREKGDTKEFRRLVLPSFGKGRRETQKEFREKRMKRMNSTSFQGLEKPENFRKLLVQRRRSSKRFKACKGL

SEQ ID NO: 154443 - protein, 253 aa, Glycine max
  Coding DNA Sequence Number=SeqID_62758
  Gene Ontology: Mol. function=helicase activity; Biological process =viral genome replication
  Homolog annotation: Hit_ID=Q9LTU4; Match level="QueryCoverage=89%, HitCoverage=15%, E-value=6e-62, Identity=49%"; Hit description =Helicase-like protein
SLDDGSRKGLNKGKRVILPSTFVGSLRYMDQLYFDGMTICSHVGFPNLFITLTCNPNWPEIHRLLNPLNLKAADRLDIISRVFKLKYEQMLMDLTKNHMLGKVIAYMYTIEFQKRGLPHAHLLLFLHLDNKYPSSDKIDQIILAEIPSQQDDPELYSLVKTHMVHGPCGTLNPGSPCMKEGKCSRFDPKMFQPHTVLDVDGFPVYRRRNNGHAIEKNGVIIDNRVTVVLIHEDNDQTENGGTHNDEIKEYLDC

SEQ ID NO: 154444 - protein, 82 aa, Glycine max
  Coding DNA Sequence Number=SeqID_62759
MHIVVVKQGQDHLELPSGWGQNMNSRNQSRYLGTDASGDGVTTDRSLPLLCAKQAENAAQGGPVSFGVAVFYYHCLFLVINA

SEQ ID NO: 154445 - protein, 45 aa, Glycine max
  Coding DNA Sequence Number=SeqID_62760
MFRGAPGASGVEGRSKNGPPGRAEGRYTNAPDPPITPPLSVLGGG

SEQ ID NO: 154446 - protein, 86 aa, Glycine max
  Coding DNA Sequence Number=SeqID_62761
MIMRGQETEKAKGEESSEEIYPQEEGQPLVVKEKCKEVSVSSKRLAKKETHFTIETNIKETFPLRQPPYFLFCKKTLASIATPSWA

SEQ ID NO: 154447 - protein, 125 aa, Glycine max
  Coding DNA Sequence Number=SeqID_62762
MSIGQPSQSFVLQVTGCTICGGAHESGHCIPFEEQMKEVSYMGNQQRQGYNQGGFSGFQQGPYNQQGQWRSHLGNQFNKDQGGPSNRPPQQGPNIFQRTTKLEETLAQFMQVTMSDAILPPKDIG

SEQ ID NO: 154448 - protein, 116 aa, Glycine max
  Coding DNA Sequence Number=SeqID_62763
MLGFTSDSQFSASPHQLDFAPYASRPYNAQWNAPGLLHDKHMLCLRRILGKMEVDEPWLGLWLPLNYQVVFVLVVWQVGFVVDLGMTFVDNWVIGKEKGWYWLSNDIVGLVGNLAV

SEQ ID NO: 154449 - protein, 89 aa, Glycine max
  Coding DNA Sequence Number=SeqID_62764
  Gene Ontology: Mol. function=nucleic acid binding
  Homolog annotation: Hit_ID=A5C3F7; Match level="QueryCoverage=100%, HitCoverage=9%, E-value=2e-13, Identity=44%"; Hit description =Putative uncharacterized protein
MKKAYITWDDNNMESSEDSENEEINLCLMVKSYESDEEVSLRKEWYIDSGCSKHMTGDASKFTHISLKKSRHVTYGDNNKGRILGVGKI

SEQ ID NO: 154450 - protein, 42 aa, Glycine max
  Coding DNA Sequence Number=SeqID_62765
TSDKVNAPPHEHTQHPTYETWAPSSTMTMDELKLLRIPLKDA

SEQ ID NO: 154451 - protein, 94 aa, Glycine max
  Coding DNA Sequence Number=SeqID_62766
MSWQAHALLIDRGGTRCGLSAHPPLSIASACLARPKNLEEHQYQGCALRARSVCYAQQLSSARLSARLALSSNPLTRAKREGGAKRNVTDSEPI

SEQ ID NO: 154452 - protein, 160 aa, Glycine max
  Coding DNA Sequence Number=SeqID_62767
MWGIPFILEPNQALTCIMSSHSTSFEPKSRLIINLDPGGENTETFSSLTSYPELRRSEFLIGGYVGARASLLSTTPPFVAMTQELVARGDTLRLSAPRHLVTPSVIHEQRPIWSSAPFPEMSAFSDGDFSSLTSYPELRRSEFLIGGYVGARALLLSAAP

SEQ ID NO: 154453 - protein, 121 aa, Glycine max
  Coding DNA Sequence Number=SeqID_62768
MEWRRKRERRCHFKEKMSLEEAHHHRRSWIRAWRKKKVKAEIKCTAESKRVWKKETNTQEFLYWFGKNPCLHPVPKRPAVLEISFNLVKILLQAKIHKGCTLYLYHKGCTLQCVETKISGG

SEQ ID NO: 154454 - protein, 168 aa, Glycine max
  Coding DNA Sequence Number=SeqID_62769
  Gene Ontology: Mol. function=catalytic activity
  Homolog annotation: Hit_ID=A3BIW7; Match level="QueryCoverage=90%, HitCoverage=41%, E-value=7e-16, Identity=27%"; Hit description =Putative uncharacterized protein
MKEMKREKHASYSSHDSCKSLSEELSDYYRGCYRSHTKHHSQRREKDRRLQEVNISLPYFHGKDNVEAYLDWEMKVEQLFACHHISEERKVPLATLSFQGAGLREEERTSIARFLSGLNMEVRDKVELPPYMDLDELVQLCIRVEQQLKRKPSSKSYGFHSYLRKDQA

SEQ ID NO: 154455 - protein, 72 aa, Glycine max
  Coding DNA Sequence Number=SeqID_62770
MEAVMVAMDGKALGWFQWFQGYSLGNPFQVLLALEQEETMQGFIGQFEKCVGMVKGLEEPFLVEVLLNGLKE

SEQ ID NO: 154456 - protein, 90 aa, Glycine max
  Coding DNA Sequence Number=SeqID_62771
MSGKAIREILVRWLDDLVEQQGGGEAKAKENETRDVAEDQGRGEKAIPRRFLGGGSIPRVSGQHCVDPLERWDGMNVCGQSGPESSQSQR

SEQ ID NO: 154457 - protein, 46 aa, Glycine max
  Coding DNA Sequence Number=SeqID_62772
MKGYVIKEFYQLPNVSLKMNGSLMEKEEREEMPLQGEDESRRSSPP

SEQ ID NO: 154458 - protein, 81 aa, Glycine max
  Coding DNA Sequence Number=SeqID_62773
  Gene Ontology: Mol. function=peptidase activity
  Homolog annotation: Hit_ID=Q8H6W2; Match level="QueryCoverage=93%, HitCoverage=82%, E-value=3e-11, Identity=46%"; Hit description=Gag -protease polyprotein-like protein
MASSNFLFPEGNSINRSPIFNGVDYHYWKTRMQIFIEAIDLNIREAIEIGPYIRTMVVGNATIEKPREQWNEEERKWYNII

SEQ ID NO: 154459 - protein, 55 aa, Glycine max
  Coding DNA Sequence Number=SeqID_62774
MARFNSSWYLLMMANMKAGVAAHDVQRYVKESDWAPQCTRQDKMPNEELKLQDPR

SEQ ID NO: 154460 - protein, 138 aa, Glycine max
  Coding DNA Sequence Number=SeqID_62775
MMHAHDLNSQMQCGTYRIQYQGNSPKRVYTTPHLGNHAVFVEVTQSCTVTPPPLGDQPGATRSSLPGTSDKVNAPPPPPPPMNIHYIQRMNVAKSHPTRSVHSAPHEHTQHALVNAFPTSSTFHFNDIPNNHNNLIPY

SEQ ID NO: 154461 - protein, 91 aa, Glycine max
  Coding DNA Sequence Number=SeqID_62776
  Homolog annotation: Hit_ID=Q2HW90; Match level="QueryCoverage=69%, HitCoverage=13%, E-value=3e-07, Identity=38%"; Hit description =Putative uncharacterized protein
MDQVQLQAFRKAYGKIWDLAMIEVSAEAIASLAQYYNQSLRCLTFGDFQLVPTIEEFEGILECPLRVRKPYLFSKFYPSVERVAKMVKIST

SEQ ID NO: 154462 - protein, 231 aa, Glycine max
  Coding DNA Sequence Number=SeqID_62777
  Homolog annotation: Hit_ID=Q2HW90; Match level="QueryCoverage=87%, HitCoverage=40%, E-value=9e-24, Identity=34%"; Hit description =Putative uncharacterized protein
MGTNQTGKRFYQVKVKGLDTTNIKELGRLMEPLQMQAFRKTYGKILELTIAEVSIEAIASLTQYYDQPLRCFTFGDFQLVPTIEEFEEILGCPLRERKPYLSSGCLPSLSRIATVVKDSARGLDHIKQTRNGIAGLPRKYLEDKARGMANQGDWVPFMDVLALLIFGVVLFPNVDGLVDLAAIDAFLAYHHSKESPVVAVLADLFDTFNRSKTRGIHVRSRAIAHVLKREE

SEQ ID NO: 154463 - protein, 88 aa, Glycine max
  Coding DNA Sequence Number=SeqID_62778
DRNGQWLKKDALPPQDERTPSPLLQREDSALLNEVLTELRGLHSYVGERFNSLDTRFAGMDIRLTQVEEDVSFIRSCFDPPPPPPSSS

SEQ ID NO: 154464 - protein, 98 aa, Glycine max
  Coding DNA Sequence Number=SeqID_62779
MSEEVYMNEQNEDKDGVKSKHVDCSNVFNTSQVFATRDDVLNWARVVAYEIGFVVVIMRSDTNTGIRGRTSFALIGCERSGQCKSRKKEIFCKKRYWQ

SEQ ID NO: 154465 - protein, 84 aa, Glycine max
  Coding DNA Sequence Number=SeqID_62780
MEWFYMISHPFMSLTQPGDPSRHPLVVHDDTFVESNLPQQPMTTGAMDEAPADAPADVEKPRHAVACQAIAKRLEKLLNLRIVT

SEQ ID NO: 154466 - protein, 102 aa, Glycine max
  Coding DNA Sequence Number=SeqID_62781
MGGIKRILRLCRFEFFDKGEGRHKRIQAVSPLFFWKREKRDTKRIQAREKGMKKMNSTSFQGLENQKISESFWYKEEEEVQRDFKACKGLIGISVQDCCSKD

SEQ ID NO: 154467 - protein, 285 aa, Glycine max
  Coding DNA Sequence Number=SeqID_62782
  Homolog annotation: Hit_ID=A4PP05; Match level="QueryCoverage=63%, HitCoverage=46%, E-value=6e-16, Identity=30%"; Hit description=IMP dehydrogenase/GMP reductase, putative
MELLKVSGQEVRAETAQARGAYIRLSWLNEASQSSRRQLVGYITLLQCWIYKHFPSIHGCIIDDAYDETSPCVCRWLTTKAYIKGLRASAYQTRLDALTITDVCWMPYGDHRGMVTTEELEDKEVRQFGYIQTIPPPSVSASLSYEDINDRWMHYEDHIAAVGEIFVVLGQILAYYIEWFFRISHPFVTPTQVGDQPKHPPAPQHEEYIEPSIPKVPVRADVGPSQALAVDGCEAIAKRLERVLNLRMVTEGIELHEIVEDCLRIARGVEKELSLVGITNVVAIL

SEQ ID NO: 154468 - protein, 92 aa, Glycine max
  Coding DNA Sequence Number=SeqID_62783
MDLCHPKQDQAIGFLVPLQIQDTSDQLSSIVENQRDIRVTHHFFCQLHAMLVAGVSLSEACALSESHALSGALSLLSKLGESGGESEKYLHA

SEQ ID NO: 154469 - protein, 409 aa, Glycine max
  Coding DNA Sequence Number=SeqID_62784
  Homolog annotation: Hit_ID=Q5XM22; Match level="QueryCoverage=12%, HitCoverage=28%, E-value=4e-11, Identity=70%"; Hit description =Resistance-like protein HAAS-2
MLHNVPSNENLRFLGQTRENVQIMVRTRGLDRALGRVVDRGLGRGDRDDSDDSPVVPGAEPAVFADEPMVDAHIQDTSADIGADTGAKAATDEPEGFPGGPINPFVLTEYAEHVATNERPELKLSSHGRKMQKLGRPAPAIEGLVALGDEQFPSSCGGGYHHAGRRGISSSFAHHWRVPYLPTSARGRGGADVSRLTTSLTRGSQDRDRTLSWTARHWTAAARAYLLHLLGCTLFANKSATYVHVVFLDALRDLSQSGRYTWGATALVPIYDHLNDACISTGQHVAEYDEKHIHRDVQEVPGSIEDSRCLLDAIWGALTERVMRQFGYVQSISTPPVDSWVSFDEINDRWMHYSNHLALADPLRDAPATQPRHIPHIPQVPKPHIPQVLELAVASTPATSDVDARHIDT

SEQ ID NO: 154470 - protein, 34 aa, Glycine max
  Coding DNA Sequence Number=SeqID_62785
MDRGLLTLGLLFIGFFGAPFVLTFAGEDTRTFDQ

SEQ ID NO: 154471 - protein, 62 aa, Glycine max
  Coding DNA Sequence Number=SeqID_62786
MAIQLHVFQVPLKISKIPSKPQDLYIIKVDKSGSFAPTYPPSKRKSDLRSSFLRVNQVILFT

SEQ ID NO: 154472 - protein, 297 aa, Glycine max
  Coding DNA Sequence Number=SeqID_62787
  Homolog annotation: Hit_ID=A5AWV0; Match level="QueryCoverage=83%, HitCoverage=17%, E-value=4e-13, Identity=25%"; Hit description =Putative uncharacterized protein
  Pfam annotation: Domain name=Peptidase_C48; Domain location=125-297; Score=-29.6; E_value=0.033; Accession=PF02902.10; Description=Ulp1 protease family, C-terminal catalytic domain
MKDMSILYEDADAPVPVPTDEVFLVGQTLHTFLAWPTHLVKSLSQQVAVSPAKPPPKPDPEVDDLLYLMTLTIPELFLRPYQVRWDATVFGVFNPDFPLYIKHEDLSEIAHGGQCLSISVHLTKTCMRVGNSDIYGFLEPQSIQRSGQSQFECESYIKSWMQSSQRDVYLGAYLNGEHWQMVVILPKEHLVVWFCSLHNRPDNYLKGIINSALKGLDDAPQPKSKDSIRWIVVKCNRQKGSTECGYYVMHRMSTIILGTFRNNWEAYFNDPRPLEVERLKALRIQWAQFYLRVRDQT

SEQ ID NO: 154473 - protein, 89 aa, Glycine max
  Coding DNA Sequence Number=SeqID_62788
  Subcellular localization annotation: CTP_CleavageSite=14; ConfidenceScore=5.09e-01
MTTPPSSPPPLPPTDAASQSPSTLKLNLISLKHLMLGQKRKYFRLWGSDGDTNKDSVNDTVCEQYSISKEKWAQFCQSRRDLSWEVSTL

SEQ ID NO: 154474 - protein, 34 aa, Glycine max
  Coding DNA Sequence Number=SeqID_62789
MAAKLGQQTVELSTLITRATNDRLNTMVLAESLH

SEQ ID NO: 154475 - protein, 102 aa, Glycine max
  Coding DNA Sequence Number=SeqID_62790
MVDNSVQWQMMLGWALDNISEHNEGVGDRQDLGTRALAISLECLRESVCLAFKNNCSEHEFPKLTYGTQYNMVKRTKSHKMYLRWRRTEHEEESSMEKNSHD

SEQ ID NO: 154476 - protein, 103 aa, Glycine max
  Coding DNA Sequence Number=SeqID_62791
  Gene Ontology: Mol. function=transferase activity
  Homolog annotation: Hit_ID=Q4A3R5; Match level="QueryCoverage=81%, HitCoverage=77%, E-value=2e-09, Identity=46%"; Hit description =Capsule O-acetyl transferase
MMTTKDDDKSDEQKAQVNQRTSISRIKIQDSSSRIKKNSRLKKKAYKQRFKISRIKIKIQDLKNQDQDSRIKNQDSRSQESRSRFKTQDLKNQDQDSRLKIQE

SEQ ID NO: 154477 - protein, 239 aa, Glycine max
  Coding DNA Sequence Number=SeqID_62792
MFGPFSLINVVGGIEEFDDAGQSRKNMVEVATVMKIIKNCFKGHFLRSSNWVIHTDIYVCVIDGLMQHSWSIICDNCRVQASKQGKELCMRKRFERVSAPQTGASTEHATRGTARRTRQQQGSAPDEGASGSALPLGATGGAQRVGTTGHAPNAGATQAPSPHTPKPLPTPPPPGLFLSHPPASSQTPQSLLLTPPSLFPHPPPQNFPHGRSQFLAALSGFLLLGFALSSTWSASTEKS

SEQ ID NO: 154478 - protein, 130 aa, Glycine max
  Coding DNA Sequence Number=SeqID_62793
MMGEHLLISKEEVADLVMNIEEAEIMVTMITETMEIMITGIFEMVITGIMEKLEIMEILKALGQDVSCLLIGRHKWQANYSSIQFLVYKVVINLNVLRSIMLKRIVSYAYCSLAVTIQLQWEFYCHLEFF

SEQ ID NO: 154479 - protein, 163 aa, Glycine max
  Coding DNA Sequence Number=SeqID_62794
  Gene Ontology: Mol. function=subtilase activity; Cellular component =cytoplasm; Biological process=proteolysis
  Homolog annotation: Hit_ID=A7QXF8; Match level="QueryCoverage=99%, HitCoverage=13%, E-value=3e-45, Identity=53%"; Hit description =Chromosome undetermined scaffold_222, whole genome shotgun sequence
MLFRPGHIERRYIEVPHGASWAEVTMKTSAVPTAKTFEMGDFCKFSFSAAKSFSFRVVSSQTLELVISQFWPSGTGSHETASVDFEVVLHGIKVNEEEVILDGSDAPVRIDAETLLVFEELAPVALLNKIRVPYRPINSKIIALSTDRDKLPSGKQILALTLK

SEQ ID NO: 154480 - protein, 58 aa, Glycine max
  Coding DNA Sequence Number=SeqID_62795
MSTISIISTQRCSNFIGNRGGAGGVASKSMGTDRGETEERIEALIASNKKVSSFLVSV

SEQ ID NO: 154481 - protein, 310 aa, Glycine max
  Coding DNA Sequence Number=SeqID_62796
  Gene Ontology: Mol. function=subtilase activity; Cellular component =cytoplasm; Biological process=proteolysis
  Homolog annotation: Hit_ID=A7QXF8; Match level="QueryCoverage=89%, HitCoverage=22%, E-value=1e-115, Identity=76%"; Hit description =Chromosome undetermined scaffold_222, whole genome shotgun sequence
  Pfam annotation: Domain name=Peptidase_S8; Domain location=36-302; Score=87.8; E_value=3.4e-23; Accession=PF00082.13; Description =Subtilase family
MTFCKQYFSMYLVSSLRVYGFVSVISMLTVTAYSFTIERKYGVFSKLDACTFVVNVYNDGNVLSIVTDCSGHGTHVAGIATAFHPKPLLNGIAPGAQIISCKIGDSRLGSMETGTGLIRALIAAHKSDLINMSYGEATLLPDYGSFVDLVNGVVNKHRLIFVSSAGNSGPGLSTVGAPGGTSSSIIGIGAYVSPAMAAGALVLLNLHPRGLNTLGPTADGDLGVCVSAPGGAVAPVPTWTLQRRMLGIGTSMASPSASGGTTLLISAMKAEGIPVSPYCVRKALENIAIPIGDLPEDKLSTGQGLMQVDK

SEQ ID NO: 154482 - protein, 79 aa, Glycine max
  Coding DNA Sequence Number=SeqID_62797
MWSGIAKAQSLKKVVDGGGQGVNGSDEVELTEGKFGQRGLEAVHANGKRFGIRHSRCMLKWKEQRWLLMEGSVERMAWE

SEQ ID NO: 154483 - protein, 199 aa, Glycine max
  Coding DNA Sequence Number=SeqID_62798
  Gene Ontology: Mol. function=subtilase activity; Cellular component =cytoplasm; Biological process=proteolysis
  Homolog annotation: Hit_ID=Q6ESI7; Match level="QueryCoverage=46%, HitCoverage=6%, E-value=3e-38, Identity=84%"; Hit description =Putative tripeptidyl peptidase II
  Subcellular localization annotation: CTP_CleavageSite=70; ConfidenceScore=5.79e-01
MHSQTPNSKQKPPLPPSTCISSKRYRIAHKPMPCSSFTSTTTTGNSSNMKKKDGSSLREFKLNESTFLASLMPKKEIGVDRFLDAHPKYDGRGALIAIFDSGVDPAADGLQVTSDGKPKVLDVIDCTGSGDIDTSKVVKADSDGRICGASGCLQKKGNNSKRKKRKGFQRAIALPSERNFSALPYSLVISTMWLQSPPL

SEQ ID NO: 154484 - protein, 508 aa, Glycine max
  Coding DNA Sequence Number=SeqID_62799
  Gene Ontology: Mol. function=subtilase activity; Cellular component =cytoplasm; Biological process=proteolysis
  Homolog annotation: Hit_ID=A7QXF8; Match level="QueryCoverage=98%, HitCoverage=39%, E-value=0.0, Identity=81%"; Hit description =Chromosome undetermined scaffold_222, whole genome shotgun sequence
  Pfam annotation: Domain name=Peptidase_S8; Domain location=1-489; Score=160.8; E_value=3.7e-45; Accession=PF00082.13; Description =Subtilase family
MPKKEIGVNRFFDAHPEYDGRGALIAIFDSGVDPAADGLQITSDGKPKVLDVIDCTGSGDIDTSKVVKADSDGRICGASGASLVINTSWKNPSGEWRVGYKLVYELFTEDVISRLKVKERKKKWDEKNQEEIAKAVKQLADFDQVEDVKLKMSREDLQNRLDILRRQSESYDDKGPVIDAVVWHDGEVWRVALDTQSLEDDPNCGKLASFMPLTNYRIERKYGVFSKLDACTFVVNVYSDGNVLSIVTDCSAHATHVAGIATAFHPKPLLNGVAPGAQIISCKIGDSRLGSMETGTGLIRALIAAVEHKCDLINMSYGEATLLPDYGRFVDLVNEVVNKYRLIFISSAGNSGPGLSTVGAPGGTSSSIIGVGAYVSPAMAAGAHCVVEPPSDGLEYTWSSRGPTADGDLGVCVSAPGGAVAPVPTWTLQRRMLMNGTSMASPSACGGTALLISAMKAEGIPVSPYSVRKALENTAIPIGDLPEDKLSTGQGLMQVDKSAKMFHVFGIK

SEQ ID NO: 154485 - protein, 21 aa, Glycine max
  Coding DNA Sequence Number=SeqID_62800
MAAPFFSTPFQPYVYQDGFIV

SEQ ID NO: 154486 - protein, 133 aa, Glycine max
  Coding DNA Sequence Number=SeqID_62801
MQPLAARVNIKGSCAALEAQGFPKQPYDVDVDLMGLFLVEDESTLLVALGKVYNNSSTIHNVRYADDVVRVKVVQYHHSDVRSLILHQRFDSSISSLAHSSHGPDILLEKWCWYPISLHRILLNSLTRPMLWP

SEQ ID NO: 154487 - protein, 990 aa, Glycine max
  Coding DNA Sequence Number=SeqID_62802
  Gene Ontology: Mol. function=zinc ion binding; Biological process =regulation of transcription
  Homolog annotation: Hit_ID=A7QU44; Match level="QueryCoverage=98%, HitCoverage=98%, E-value=0.0, Identity=59%"; Hit description =Chromosome chr2 scaffold_176, whole genome shotgun sequence
  Pfam annotation: Domain name=PB1; Domain location=890-972; Score =103.0; E_value=9.5e-28; Accession=PF00564.15; Description=PB1 domain
  Pfam annotation: Domain name=RWP-RK; Domain location=575-626; Score =103.8; E_value=5.3e-28; Accession=PF02042.6; Description=RWP-RK domain
  Pfam module annotation: Pfam domain module=PB1::RWP-RK; Domain location=890-972::575-626
MSESKDENPDLPPKSKPQEEHGFAMDFDISLESLWPSDHISLVSNPMSPFLFSTISDQPCSPVWAFSDAEDERLIRIAASAGNTNTTTENLVENYDNKKTVPPLVAIPTSENPDAYCLIKERMTQALRHFKELTEQNVLAQVWAPMRNGNRYALTTSGQPFVLDPHSNGLHQYRTVSLMYMFSVDGENDEIMGLPGRVFQQKIPEWTPNVQFYSSKEYQRLNHAQHYNVRGTLALPVFELAGQSCVAVVELIMTSQKINYAPEVDKICKALEAVKLRSSEILEHQYIQICNEDRQYALAEILEILTVVCETHSLPLAQTWVPCKHRSVLAHGGGHKKSCSSFDGCCMGQVCMSITEVAFYVIDAHTWGFHEACVEHHLQQGQGVAGRAFLSHNMCFCGNIAQFCKTEYPLVHYALMFGLTSCFAVCLQSSHTGNDDYVLEFFLPPGITDFNEQKRLLGSILATMKPHFQSLKIASGIELEENASIEIIEARNERVNLRFESIPITQSSKSPPRHASPNVGEGLPLEPSEQKIMAYFDGINDGGSLGDNAGGHIDQNTSLKIKTKKKPSERKRGKAEKSISLDVLQHYFTGSLKDAAKSLGVCPTTMKRICRQHGISRWPSRKIKKVNRSLSKLKCVIESVHGAERAFGLNSLSTVSLPIAAGSFSEPSTSNKFNRQTSLTIRPSEPKINEKDFDASGASETKRQAAMEDQFLGLEARAQSPEKVINDRGVATQEIGTKGTNKFRTGSGSSESSGNPTPHGSCHGSPPNEISPPKDIFVTGHSEKCLVLRGSLGSTTLHSTSTPNCTTAYPMPHIVETTEPQELFGGQLLERAGSSKDLRNLCPSADAVLEDQVPEAYKMNPQCSDLPQMQHMDNLNNTLTPFAVRKEVKSVTIKATYKEDIIRFKVSMDCGIVELKEEIAKRLKLEAGTFDIKYLDDDHEWVLIACDADLQECMDISRSSGSNVIRLVVHDILPILGSSCESSGDWKGCI

SEQ ID NO: 154488 - protein, 116 aa, Glycine max
  Coding DNA Sequence Number=SeqID_62803
MKFLRSRIIVAEMIQMDLFLGCKEKASPTFDTKGEPRTELMATKKAWGLETATKTTKFIFFHRVRWDDGSSSKIELWLLWAVVAPTIHPLDQVFFARKTMGIKGIVVISQPMICNQ

SEQ ID NO: 154489 - protein, 135 aa, Glycine max
  Coding DNA Sequence Number=SeqID_62804
  Gene Ontology: Mol. function=protein serine/threonine kinase activity; Cellular component=integral to membrane; Biological process=recognition or rejection of self pollen
  Homolog annotation: Hit_ID=Q7EZ33; Match level="QueryCoverage=60%, HitCoverage=9%, E-value=6e-23, Identity=64%"; Hit description =Putative S-receptor kinase KIK1
  Pfam annotation: Domain name=Pkinase_Tyr; Domain location=4-129; Score=-149.7; E_value=0.003; Accession=PF07714.8; Description =Protein tyrosine kinase
MNAITQGKLADGKEIVVKRLSSSSGQGITEFMTEVKVIAKLQHRNLVKLLGCCIRGQEKILVYEYMVNGSLYSFVFDNIRKGFTESTVNTEQLRDEVQDKAEDDIIGQNKLRVVLCCERNRAKKEEKCLVVRTNK

SEQ ID NO: 154490 - protein, 283 aa, Glycine max
  Coding DNA Sequence Number=SeqID_62805
  Subcellular localization annotation: CTP_CleavageSite=35; ConfidenceScore=5.33e-01
MASPLASPPPPPAPSDASALPSTVKRTRKASRYILCGTSRGYIYLGLTENKRGYISCGSVLVEGTSTRFKENKGGYIPCGSLLVKGFLQGHSIPQRLRALSTRSTISRGTVVHVDPATDKADGPQRKKLRIYLGIVARDKMDITCENWKEVPTAQKDLLWEDIQDEKEVTLDYGREIEATSRGNEPLQPIKTQKLLAEETKKLEEAAQSGSVDGVIDPSSLVRRHVKWKMARTKKTGEMTTEAAKEIVEKIIPLRSRRHRDPSSPMDVRMFSPLQLDVQSTLD

SEQ ID NO: 154491 - protein, 259 aa, Glycine max
  Coding DNA Sequence Number=SeqID_62806
  Homolog annotation: Hit_ID=A7QG28; Match level="QueryCoverage=99%, HitCoverage=100%, E-value=1e-69, Identity=54%"; Hit description =Chromosome undetermined scaffold_91, whole genome shotgun sequence
MSGGVGPTGCDISLPKEQELSFKEQQDQQQSLLKNLNKPTTPPQQHKVGTILSFNQLNSLAVVIVLSASGLVSPEDFAFVFFSLIYLHFIAKVAFPSLHPSRDPQEVFNPQNKLIQLYTLIGATIGLFIPIAYIFEGVFEGDKEGIKAAAPHVFLLASQVFMEGVASSSSQRFSAPVRAFVPAFYNARRIFTIVDWLRSEVYKIDGEHSGSAWRIHVGRALAMANMAYWSFNLFGFLLPVFLPKVLKLYYSSEYNDKDR

SEQ ID NO: 154492 - protein, 316 aa, Glycine max
  Coding DNA Sequence Number=SeqID_62807
  Gene Ontology: Mol. function=oxidoreductase activity; Cellular component=integral to membrane; Biological process=metabolic process
  Homolog annotation: Hit_ID=A7QG33; Match level="QueryCoverage=85%, HitCoverage=84%, E-value=6e-89, Identity=64%"; Hit description =Chromosome undetermined scaffold_91, whole genome shotgun sequence
  Pfam annotation: Domain name=Epimerase; Domain location=23-285; Score= -54.5; E_value=0.0042; Accession=PF01370.12; Description=NAD dependent epimerasedehydratase family
  Pfam annotation: Domain name=adh_short; Domain location=21-172; Score= -5.4; E_value=2.8e-05; Accession=PF00106.16; Description=short chain dehydrogenase
  Pfam module annotation: Pfam domain module=Epimerase::adh_short; Domain location=23-285::21-172
MLVVSCIHELLNLNYIFLLVVDILITGTTHGIGTETARVLALRGVHVIMAARDVIAAKAVKEAILKEIPTAKVDAMELDLSSMTSVRKFALEYISSGLPLNILINNAGISAFPFTLSKDNIELQFATNHLGHFLLTNLLLDTLKKTASESKKEGRIIIVSSDGHQYTYPEGILFDKINDESSYQKWHAYGQSKLANILHANELTRLLKEDGIDNITANSLHPGAIMDTNIYKPEINGPVPTDLINRLGSFLLKNIQQGAATTCYVALHPQVRGISGEYFSDNNLAKASSLAKDTNLAKKLWDFSMKTIDYNTHEQI

SEQ ID NO: 154493 - protein, 134 aa, Glycine max
  Coding DNA Sequence Number=SeqID_62808
  Subcellular localization annotation: CTP_CleavageSite=35; ConfidenceScore=5.18e-01
MASYPSRAQMKAKSSKRKQGKCSHAATLNKLNTCKMQTYKGMLLDPIRNLRNCLGVGGLTAEDKMLVYLIPYIVTLRSSNHAQIVLAINLGMDPKEAMSKVNTLSDAILPPQGHWIEDSKKIGPKMQEKALRFS

SEQ ID NO: 154494 - protein, 175 aa, Glycine max
  Coding DNA Sequence Number=SeqID_62809
  Homolog annotation: Hit_ID=Q2HW90; Match level="QueryCoverage=90%, HitCoverage=31%, E-value=8e-19, Identity=36%"; Hit description =Putative uncharacterized protein
AIASLTQYYDQPLRCFTFGDFQLVPTIEEFEEILGCPLGRRKPYLSSGCLPSLSRIATVVKDSARGLDRIKQTQNGIAGLPRKYLEDKARGMANQGDWVPFMDVLALLIFGVVLFPNVDGLVDLAAIDAFLAYHHSKESPVVAVLADLFDTFNRSKTQGIHVRSRAIARVLKREE

SEQ ID NO: 154495 - protein, 41 aa, Glycine max
  Coding DNA Sequence Number=SeqID_62810
RDVVTSGTTSVIGIRISTRNTHRRPLTTTRERCEGWQPASS

SEQ ID NO: 154496 - protein, 128 aa, Glycine max
  Coding DNA Sequence Number=SeqID_62811
  Pfam annotation: Domain name=zf-CCHC; Domain location=56-73; Score =12.1; E_value=0.023; Accession=PF00098.14; Description=Zinc knuckle
MGLLRLRQHEENDKKKKGIALKASSSIQEESDKENDLDEDDDLSLFKEHRNFILYLKCFECNQPGYLRVDCPIFKKKMEKSEKKNLSEKKLKKAYITWDENDMESSEDSKNEEINLCLMAKSYESDEE

SEQ ID NO: 154497 - protein, 143 aa, Glycine max
  Coding DNA Sequence Number=SeqID_62812
MAAQLIHDRVEMECLEGVWETLEGNVRCRFRGTIRFTATSLVHPEEPARTLQCTVEWILPTPTPYRLVEPVQVIKVTSSEENPEEDSEELPPEPAVDAIDFLEGDEDPLPEVDSPEDVMSASEADSTEKSGPRGIATSGGSSS

SEQ ID NO: 154498 - protein, 58 aa, Glycine max
  Coding DNA Sequence Number=SeqID_62813
MDEDQWMYDNIMSEEVDMDYQNEEECGVNEPHVDRSDAFNTSQIIMFMIVFASRDDVL

SEQ ID NO: 154499 - protein, 80 aa, Glycine max
  Coding DNA Sequence Number=SeqID_62814
MTMQNMQFQQETRASIQSLTNQMGQLATQLNQQQSHNSDKLPSQAVQNPKNKQHIPPLPFPPRAVSNKKMEEAEKDLGNV

SEQ ID NO: 154500 - protein, 186 aa, Glycine max
  Coding DNA Sequence Number=SeqID_62815
  Subcellular localization annotation: CTP_CleavageSite=63; ConfidenceScore=5.07e-01
METILQNPQLNSAKFCVFTDLIPQPQPSSPQSSFPQLQLPPPQQLSYNNIDLNNPLSSYNNLEAQDPFDIYTSYTQLLSKNDSLFDAQKTSFDQQNHPSSLLRHLHNNHKRKHQTKMNITSLTKISLYDFMTKTWMILVRMRINSSLIISITKAMTKVMTKAMMRVSTDQQHLCHIRCNITNLGVQ

SEQ ID NO: 154501 - protein, 142 aa, Glycine max
  Coding DNA Sequence Number=SeqID_62816
MKNERRTQKDLHRFAHGNVSEALRKHFDSIFLHENMFFFTQNSRNAKPRGHEHFGTAPPPLFIGKKGVKYAYPRFSEILRKHYGSHGCPGHHFSTKRGGALMQYYPARALDRRLLVDWARDPREGPRVLMSLRVDFEPMGYV

SEQ ID NO: 154502 - protein, 126 aa, Glycine max
  Coding DNA Sequence Number=SeqID_62817
MDHVVAKVLIDNGSSLNVMPKSTLEKLPFNASHLKPSSMVVRAFDDTRRELHVGAPVDPLGGSCSLYTPPKVEIRSGRASDHRIKRGRHLRKLPILYALCGGRRGVVRNRFPVFRGGKHFLRGFLL

SEQ ID NO: 154503 - protein, 83 aa, Glycine max
  Coding DNA Sequence Number=SeqID_62818
MLSYNLRQGRWGLQFIGSGLKSINQTFSSTWVQGIIYSCPRKINESLANNHPEQQWAHPELVQARHEVKKEYPGLAAVSLVLL

SEQ ID NO: 154504 - protein, 77 aa, Glycine max
  Coding DNA Sequence Number=SeqID_62819
MTTEWRRKRERRCHFKEKKMSLEEAHHHRRPWIRAWRKKEMNEGRGREEHKIFCSKRALKSEPTNLRSSPRFSTKCA

SEQ ID NO: 154505 - protein, 186 aa, Glycine max
  Coding DNA Sequence Number=SeqID_62820
  Homolog annotation: Hit_ID=Q5XM22; Match level="QueryCoverage=67%, HitCoverage=85%, E-value=2e-30, Identity=50%"; Hit description =Resistance-like protein HAAS-2
MRVQMLVDLLMVSPESARAETAQCCGPYVRLQRVRDIYERRCQTGHWTAAARAYLLHLLGCTLFANKSATNVHVVYLEALRDLSMTEMYAWGVAALVHMYDQLNDASMSHSQQLDGYITLLQCWIYEHFPSVADSTADKEYDEDSPRACRWIATKKTVKSIRTLTYRERLDRIRIPDVCWIPYGEH

SEQ ID NO: 154506 - protein, 43 aa, Glycine max
  Coding DNA Sequence Number=SeqID_62821
MRGSGEFVPFLDTTSRVGIKTEPICNAYAKDTMRECTQYDNIY

SEQ ID NO: 154507 - protein, 1081 aa, Glycine max
  Coding DNA Sequence Number=SeqID_62822
  Gene Ontology: Mol. function=ATP binding; Cellular component=plasma membrane; Biological process=cell morphogenesis
  Homolog annotation: Hit_ID=A7MNQ7; Match level="QueryCoverage=41%, HitCoverage=75%, E-value=1e-161, Identity=59%"; Hit description =Putative uncharacterized protein
  Pfam annotation: Domain name=Actin; Domain location=486-789; Score= -176.0; E_value=3.6e-05; Accession=PF00022.10; Description=Actin
  Pfam annotation: Domain name=EAL; Domain location=248-447; Score =74.7; E_value=3e-19; Accession=PF00563.11; Description=EAL domain
  Pfam annotation: Domain name=FtsA; Domain location=599-786; Score= -12.1; E_value=0.0012; Accession=PF02491.11; Description=Cell division protein FtsA
  Pfam annotation: Domain name=GGDEF; Domain location=73-234; Score =68.4; E_value=2.3e-17; Accession=PF00990.12; Description=GGDEF domain
  Pfam annotation: Domain name=HSP70; Domain location=483-930; Score= -340.6; E_value=0.01; Accession=PF00012.11; Description=Hsp70 protein
  Pfam annotation: Domain name=MreB_Mbl; Domain location=478-779; Score= 630.2; E_value=1.8e-186; Accession=PF06723.4; Description=MreBMbl protein
  Pfam annotation: Domain name=MreC; Domain location=933-1077; Score =190.5; E_value=4.3e-54; Accession=PF04085.5; Description=rod shape -determining protein MreC
  Pfam module annotation: Pfam domain module=Actin::EAL::FtsA::GGDEF::HS P70::MreB_Mbl::MreC; Domain location=486-789::248-447::599-786::73 -234::483-930::478-779::933-1077
MSALLVMTHRWLNRRWQHMERLEARAERILAGERAPRSDTIAEWPPKASRAIDLLLGDLQEAGEQRLRIDTLIRTFAAQDSRTGLNNRLFFDNQLATLLEDQEDVGTHGVVMMVRLPDLDTLHETLGPTLVDEYLFDLVNMLSTFVLRYPGALLARYFRSDFAVLLPHRTLKEANSIADQLINAVDSLPPMRMVDRDDLIHIGISAWRSGESVSQVMENVELATRRAALQGGNNWSVGEGNTLEMGRGSVRWRTLLENTVNRGGPRLYQKPAVLLDGKVHHREMLARVFDGDKEVVSAEFMPLVLQLGMADSWDRQLVMRIAALSEVWPDETLALPADVCQHINRLVPVFRMLTAFGCRIAVDQAGLTVVSSAYIKQFPIELIKLDPGLIRNIERRTENQLFVQSLLEVCKSTPTKVFAAGVRTRAEWQTLAGLGVAGGQGDFFAPSLPSGSLAPFNAGVGRQHRREKLFSLVFHRSRTFLRLVAASRGQGIVLNEPSVVAIRQDRAGSPKSVAAVGHDAKQMLGRTPGNIAAIRPMKDGVIADFFVTEKMLQHFIKQVERRAIRESAQGAGAREVFLIEEPMAAAIGAGLPVSEATGSMVVDIGGGTTEVAVISLNGVVYSSSVRIGGDRFDEAIINYVRRNYGSLIGEATAERIKHEIGSAYPGDEVREIEVRGRNLAEGVPRGFTLNSNEILEALQEPLTGIVSAVMVALEQCPPELASDISERGMVLTGGGALLRNLDRLLMEETGIPVVVAEDPLTCVARGGGNSDDTQNQHNGRTMAIACRTAASAAGTGQQRHNVVTAVCRMREFMKPIFSRGPSLQLRLFLAVIVAIAIIVADSRISTFSQIRNYLDTSVSPFYFLANGPRQLLDGVSETLASRQQLELENKALRRELFLKNSDLLMLGQYKQENARLRELLGSPLRQDEHKMVTQVISTGTDPYTDQVIIDKGSVNGVYEGQPVISDKGVVGQVVAVGQMTSRVLLICDASHALPIQVLRNDIRVIAAGNGCSEDLQLEHLPGNTDIRVGDVLVTSGLGGRFPEGYPVGVVSSVKVDTQRAYTVIQRVRPPVCSVCATAAAV

SEQ ID NO: 154508 - protein, 725 aa, Glycine max
  Coding DNA Sequence Number=SeqID_62823
  Gene Ontology: Mol. function=ribonuclease activity; Cellular component=cytoplasm; Biological process=RNA processing
  Homolog annotation: Hit_ID=Q6DAI2; Match level="QueryCoverage=60%, HitCoverage=90%, E-value=0.0, Identity=86%"; Hit description =Ribonuclease G
  Pfam annotation: Domain name=S1; Domain location=35-122; Score=70.2; E_value=6.9e-18; Accession=PF00575.14; Description=S1 RNA binding domain
MTAELLVNVTPSETRVAYIDGGILQEIHIEREARRGIVGNIYKGRVSRVLPGMQAAFVDIGMDKAAFLHASDIMPHTECVAGDEKKNFIVRDIAELVRQGQDLMVQVVKDPLGTKGARLTTDITLPSRYLVFMPGASHVGVSQRIESEAERERLKAVVAAYCDDLGGFFIRTAAEGIGAEELAQDAAFLKRLWTKVSERKKRNQTRCLLYGELALAQRVLRDFAGAALDRIRVDSRLTCDLLVEFTSEYIPEMASKLELYNGKQPIFDLYDVENEIQRSLERKVELKSGGYLIIDQTEAMTTVDINTGAFVGHRNLDETIFNTNIEATQAIARQLRLRNLGGIIIIDFIDMNNDDHRRRVLHSLESALSKDRVKTSINGFSALGLVEMTRKRTRESIEHVLCADCPVCQGRGSLKTVETVCYEIMREIVRVHHAYDSDSFLVREVERRNPTESKERCVRRLPGILLLLLAAIIVIVALLVSGLRLVMPHLNSYRGEVLHTLSRVSGVTIDASEIQGKWENFGPTLQVRDLRIDMDKDGELQIGRVTLALNVWQSLLHWRWQFRDLTFWQLRLATNRPLLTSDEQKNSFKPAQINDLFLRQFDHFDLRDSSIRFLTPSGQHAELAIPRLTWLNEDNRHRAEGEVSLSSFTGQHGVVQVRLDLNDTNGLLNDGRIWMQADDVDVRPWIGRWLRDNTSLQSARGWPDRASGALPEWLEPDGAANPADD

SEQ ID NO: 154509 - protein, 68 aa, Glycine max
  Coding DNA Sequence Number=SeqID_62824
MAILISNTSTTFHRDERLWNTFMIPTWLAHVKKVIWTFQLPVTKDKTNIQRMRDDMMQMHKSTTEGCT

SEQ ID NO: 154510 - protein, 112 aa, Glycine max
  Coding DNA Sequence Number=SeqID_62825
MYPLLFSVKPKEKGDTKEFRRLALRSFGKGRRETQKEFRRLVLGEFFLAKGEENEKMNSTSFQSLENQKTSESFWYKEQEEVQRDSRLVKDCNEMIGKVFKILEMQNKALLL

SEQ ID NO: 154511 - protein, 46 aa, Glycine max
  Coding DNA Sequence Number=SeqID_62826
VSHISFALLQFDTLKYSSIPRANAKGPSGEGQSPRVEKDEGPSGEG

SEQ ID NO: 154512 - protein, 47 aa, Glycine max
  Coding DNA Sequence Number=SeqID_62827
MENKMKNKELNSMAAEWRWKKDDWRRHFKEKMSQEEAHHHRKPWIRA

SEQ ID NO: 154513 - protein, 87 aa, Glycine max
  Coding DNA Sequence Number=SeqID_62828
MAVEWRRKKDLERPLQGEHESRTSSPPYEAMDKSLKVGEDEWRERERMMQSYPPRALDRRLQEDWAKDAREGPRVLMSLRVDFGPMG

SEQ ID NO: 154514 - protein, 122 aa, Glycine max
  Coding DNA Sequence Number=SeqID_62829
RDSNVSMTDLVSAEDDISKKNVCTDNHSGISAGQRDSNVSMTDLVSAEDDLNLQTAKKNVYTDNHSGISARQHDSNVSMTDLVSAEDDTAKKNVYTDNHSGISACQLDSNVSMTNLVSTEDD

SEQ ID NO: 154515 - protein, 124 aa, Glycine max
  Coding DNA Sequence Number=SeqID_62830
  Subcellular localization annotation: CTP_CleavageSite=40; ConfidenceScore=5.34e-01
MTTPPSSPPPPLPTDAASHSPSTLKRTRKATCLRSLVHVDPAMGKVDSPYKKKLRTYLGIVARDKVDVAYENWKQVLTAQKDLIWEDIQPTRTVSMTLYAKSTTLARKNGPNFVKATETLRGRM

SEQ ID NO: 154516 - protein, 311 aa, Glycine max
  Coding DNA Sequence Number=SeqID_62831
  Gene Ontology: Mol. function=helicase activity; Biological process =viral genome replication
  Homolog annotation: Hit_ID=Q2A9E0; Match level="QueryCoverage=98%, HitCoverage=20%, E-value=2e-68, Identity=45%"; Hit description =Putative uncharacterized protein
MWYDERINKDKQTKNPKFSLCCGDGKIQLPILHDAPQPLRQLLFDSRDSQAKKFQQNIRLYNLMFAFTSPGIKVDTSYNTGRGPPTLCIHGQSHHLIGSLLPMPDNSPKFAQLYIYDTENEVNNGLSQYPIKNNVDEDIITGIKNMLDTHNPYAQKFRMASDKLDSSAVCDLKLKLISARKTDGRLYNLPNAFEVAALIVGDEHTTNNRDIIIEKQTGMLQRINELHPAYLPLQYPLLYPHGEDGYRPNILHKHHPHSHATKRNKVVMREYFCYRMQSRDNEARAILHSRRLFHQWVVDGYCMIESQLSIN

SEQ ID NO: 154517 - protein, 32 aa, Glycine max
  Coding DNA Sequence Number=SeqID_62832
MAHENPRIFSCISGPMFLESSIQCPWGIRLHH

SEQ ID NO: 154518 - protein, 213 aa, Glycine max
  Coding DNA Sequence Number=SeqID_62833
  Homolog annotation: Hit_ID=Q6WAY6; Match level="QueryCoverage=73%, HitCoverage=26%, E-value=2e-12, Identity=32%"; Hit description =Putative uncharacterized protein
MVPTIEEFEEILGCPLGGRRLYLFSGFLPSLSKIAAVVGGSARELDRMKQTRNGVVGLPRKYLEGKARDMASQEKWGPFVDILALLIFGVVLFPNVDGLVDLATIDAFLAYHHSKESPVVAILADLFDTFDRRCEKNSARIVCCLPALCVWVVSHLFQQDTRHPCPLQSYRSCAEKGRVDWDQHLAGIGGNAINWFPRWRKARKESLLVWGLP

SEQ ID NO: 154519 - protein, 73 aa, Glycine max
  Coding DNA Sequence Number=SeqID_62834
MERRPTRTKRWPICLTSWEGVELHDWEIPQIHGGRCENFPGRPKWTRMNAQMDKRTCFGNVGLTKIGEMNPEP

SEQ ID NO: 154520 - protein, 72 aa, Glycine max
  Coding DNA Sequence Number=SeqID_62835
MSARVQPIAFLCFLRTANNFSSCSSAREADIITGKLLLSSKLQFWCGRLDSGRRRWFLSLYLIKKVRGMCTS

SEQ ID NO: 154521 - protein, 283 aa, Glycine max
  Coding DNA Sequence Number=SeqID_62836
  Homolog annotation: Hit_ID=A5BSR3; Match level="QueryCoverage=25%, HitCoverage=23%, E-value=8e-11, Identity=50%"; Hit description =Putative uncharacterized protein
PSWEDVRKKAQAIQKQNTAPHILSCGGYDYLEQKLLVEKTKKKLEEATQSGSIDGVIDPPWPVRRHVKWKMARTKKTGEMTIEAAKEIAENIDSFEEQATQGSFVPHGSQDVLTAAIGCPEHPGHVRAVGAGVTIKQYFGSAPRTSRSSSSMPPEELQQLTQQIRDQLEESITEKGLAPPPEPQVGPSGPRVSTKGSCVDPSGNDSETGDSDRCGLYIEADPARLVAMGRVYEGSTVVHNTPLLPGQVKALHTFHAWPTHLVKSLSQQVAVSPKKPPPKPDLK

SEQ ID NO: 154522 - protein, 96 aa, Glycine max
  Coding DNA Sequence Number=SeqID_62837
QTQVDVPSTCTTKDVPSNVLRQRSQAVKPLILCEWGYKRILRREKGDTKEFKRLVLCSFGKGRRETQKEFKRFRKPENFGKLFGTMKKKKFKEIQG

SEQ ID NO: 154523 - protein, 202 aa, Glycine max
  Coding DNA Sequence Number=SeqID_62838
  Homolog annotation: Hit_ID=Q2HW90; Match level="QueryCoverage=88%, HitCoverage=35%, E-value=9e-21, Identity=35%"; Hit description =Putative uncharacterized protein
MGPLQMQAFRKTYGKILDLTIAEVSIEAIASLTQYYDQPLRCFTFRDFQLVPTIEEFEEILGCPLGGRKPYLFSGFLPSLSRIATVVKGSARGLDRVKQTRNGIVGLPRKYLEDKARDMANHEEWVPFMDVLALLIFGVVLFPNVDGLVDLAAIDAFLAYHHSKESPVVAVLADLFDTFDRSKTRGIHVRSEAIARVLKREE

SEQ ID NO: 154524 - protein, 94 aa, Glycine max
  Coding DNA Sequence Number=SeqID_62839
MNLGISQSRISTPSQEVKQIGHLLVLVGLFSTAGSFWGCLSCLGLGPISGPCDLCPELVWSRACKRSEALALHAEAYLPVEHHPEPVSGYSTSR

SEQ ID NO: 154525 - protein, 125 aa, Glycine max
  Coding DNA Sequence Number=SeqID_62840
  Subcellular localization annotation: CTP_CleavageSite=53; ConfidenceScore=5.31e-01
MTMQSMQFQQETRASIQSLTNQMGQLATQLNQQHSQNSDRLPSQSVQNPKNVSAITLRSGKQCQGPQPATSSSSANEPTQPHSTPEKDDDKNLKKLCTNKRKLKGSESMSRNVFALIGKSVPQIP

SEQ ID NO: 154526 - protein, 73 aa, Glycine max
  Coding DNA Sequence Number=SeqID_62841
MKKQQWRTSARQRRRGERRRHPLGNKPWKKELRHQESALDKKLGKGASMKEKKEREKERGGSMKLKEEKRKRS

SEQ ID NO: 154527 - protein, 93 aa, Glycine max
  Coding DNA Sequence Number=SeqID_62842
MASRKRKSIGSRPVATYPSAGGRRETRGMRVPRKEYARSRHQRLFEENVGKTGKDEIYELFSERFGSCIYARGRVFPFAPTYSSIWDEKIRPT

SEQ ID NO: 154528 - protein, 62 aa, Glycine max
  Coding DNA Sequence Number=SeqID_62843
MGLNQFRFFNMVHDILVKMKLEVTRTSTVLNVFSSSDRKMQGSCMSEHENKKYVERICMRMQ

SEQ ID NO: 154529 - protein, 127 aa, Glycine max
  Coding DNA Sequence Number=SeqID_62844
MDNEEGVQEQMKADLSALKDQMASISEVMLKLQKTIEDKATATASNTVREAEPVLQPALNPGRDRNTVVFGRRASPDVLPEDGGVFRGRKVVGPFLSRQLGRSSSDMVYQSGSFPDPIMEGLGNCFH

SEQ ID NO: 154530 - protein, 188 aa, Glycine max
  Coding DNA Sequence Number=SeqID_62845
PLGPSGIFLQKAVASGGSNPARLGELGGNHLPYFAINRGGRQEGRAEALPKRFRNVFREESRKGFNRSSTFFIRSSSFFDLQRGRLRHSALTHPCPTSESNPGMNSNARRNHPVKKLSEFAPIPVSYGDLLLSLITNQLEVCVALKHKVQSLINTGWLTFQEDGPNVKMNPLANHGGSAMNAIEAGEL

SEQ ID NO: 154531 - protein, 177 aa, Glycine max
  Coding DNA Sequence Number=SeqID_62846
MVGFLWPHSGDFSRADLKYFSSFALSWIFSWQYRYSKTEKTNQYPSLQRHAFVKCWAQFDTSKADPEQVKLWFQSHPEFLKAADPETSVFLNQKSHLAAFLAGSKSKESLTKNLKEVLQMLQQEEKGSSSKKEETSSTEEEEEDLFYQNEDDCFVSVKEIGTVATSTLTDFKRRPRA

SEQ ID NO: 154532 - protein, 52 aa, Glycine max
  Coding DNA Sequence Number=SeqID_62847
MKAKGNREWLEGARTASLRGLLAQASSAHPGELTCHFFFEGNIDHVFSSLTG

SEQ ID NO: 154533 - protein, 174 aa, Glycine max
  Coding DNA Sequence Number=SeqID_62848
AQLGTVTQLPVHPASPVLRTKNGPLGALDSMARLNRAAAPYPEGNFRGNQLLDGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 154534 - protein, 125 aa, Glycine max
  Coding DNA Sequence Number=SeqID_62849
  Gene Ontology: Mol. function=aspartic-type endopeptidase activity; Biological process=DNA integration
  Homolog annotation: Hit_ID=Q0ZCB7; Match level="QueryCoverage=98%, HitCoverage=9%, E-value=6e-11, Identity=28%"; Hit description =Integrase
MEFSDITIHFNILDAIKHPSEDLSVFHVEIIDHVVDEYMTDLHSIESNKTNHVPGSTHTSDFLYEVQAEKPSLSTTIQPATPELKLMPSNLKYSYLDDSKSFPVIISASLVDEQEEELLSVLKKH

SEQ ID NO: 154535 - protein, 95 aa, Glycine max
  Coding DNA Sequence Number=SeqID_62850
MGYMGVRELNWRWATGDGGFMRAIVDVENLLCTIARPPPSTTCDGYPIILQACDEEVLKEWYLEICRGGQETLGTSGGGAIAPKPSLTNPDPTRA

SEQ ID NO: 154536 - protein, 184 aa, Glycine max
  Coding DNA Sequence Number=SeqID_62851
PTVEEFEEILGCLLGGRKPYLFFGFYPSMTRVAKVVKISAQELDRVKQNRNGVVGVPRKFVLFPNMEGLVDLAAIDAFLAFHHGKESSVVAILAMYDTFDRGCPSIRYKVTARHGMRREERTESLGEATVRDDEVKASEESDEVQALKAELEKSPAIVSSSSKEVKGIITGQKHDLEGRAKGLP

SEQ ID NO: 154537 - protein, 68 aa, Glycine max
  Coding DNA Sequence Number=SeqID_62852
MPQQPMLFCEVFDVWVSYPNFVRGPLFGGMQPLLDRFKGVPTEGGAFWWKQPSSPGRAGRQPPPFFPL

SEQ ID NO: 154538 - protein, 66 aa, Glycine max
  Coding DNA Sequence Number=SeqID_62853
MDEFDAQVAWTGAHPSPFGGDEASIAQEPESEEPTAAAKGEDKLTPFEPLYFDAGIHMAQGGGDFH

SEQ ID NO: 154539 - protein, 141 aa, Glycine max
  Coding DNA Sequence Number=SeqID_62854
MIVNQQVKVPFSIGTYKDEVNCDIKRAFLLKQSFYLLLSRETSLSTAIPLELEVIPQVKELLDEGLVRKSLTPCALLMPKIGIMRHRIPMICGMMNVLSGATLFCKIIHASNIFMIHIHRNSLDSDKGVPTNPKRIKVILE

SEQ ID NO: 154540 - protein, 251 aa, Glycine max
  Coding DNA Sequence Number=SeqID_62855
  Gene Ontology: Mol. function=RNA-directed DNA polymerase activity; Biological process=regulation of transcription, DNA-dependent
  Homolog annotation: Hit_ID=A5AWY3; Match level="QueryCoverage=97%, HitCoverage=71%, E-value=5e-40, Identity=40%"; Hit description =Putative uncharacterized protein
MSIDAAILMCLRDIRHKKFEDSLIGTVETSLGQGPIYFNCYPNKTVSLMDRNILDSLFLNIHFHGLDMKEGSIPAALIYRIQYKVMNTCASRVLLKPLKGETTLFVTDMTKANVSLPRTIKWDEVTLPEKWVMDKTTSFVPQPAPTIEQIKQDNSGKVEITFNRRNSLSSRLEASRYEYESARRSFSVRTHSIPVGLTRSESHNQFPTVNLQGLDTTSSIPRTTYNQEQEDDQKSIQSPTYSSMHEPYDVI

SEQ ID NO: 154541 - protein, 84 aa, Glycine max
  Coding DNA Sequence Number=SeqID_62856
MDFQPPPTNICWGAHGIHFSGGCSPLHSPQKLKIRSGRGIWSSYKKEEDILVSCPSSMPYVEAAEGVIRKPLFQSFEVAKTTAA

SEQ ID NO: 154542 - protein, 104 aa, Glycine max
  Coding DNA Sequence Number=SeqID_62857
  Homolog annotation: Hit_ID=A5C7Z4; Match level="QueryCoverage=75%, HitCoverage=28%, E-value=4e-09, Identity=39%"; Hit description =Putative uncharacterized protein
MFTNVLTHINLRYSGHWQVVVILPKKHLVVWFCSLHNRPDNYLKGIINSALKGLDDAPQPKSKAPARWIVAKCNRQKGSTECGYYVMHWMSTIILGTFRNNWEA

SEQ ID NO: 154543 - protein, 185 aa, Glycine max
  Coding DNA Sequence Number=SeqID_62858
VTGCTICGEAHETGQCIPIEENTQEFHYMGNQQRQGYTQGGFSGFQQGPYNQQGQWRTHPDNQFNKDQSGPANRPIQQGPNIFQRNTNLEETLTQFMKVTMSNHKSTESALKNLEVQVGQLAKQIADKSSNSFVENTEQNPKEECKAVMTRSKRFVEAEDEDSVVHKNKTADKKRVLMARKMRKE

SEQ ID NO: 154544 - protein, 106 aa, Glycine max
  Coding DNA Sequence Number=SeqID_62859
MIKEKCKEVSVSSKRLAKKERHFEIKTNIKEISLLRQPPHFLLCKKTLVSIATSLRLEFIPQVKEFLDEGLVRKRLNPCALLVPKIGVPMNPKRIKVIPKWPAPPS

SEQ ID NO: 154545 - protein, 95 aa, Glycine max
  Coding DNA Sequence Number=SeqID_62860
ELEGGLVPSLEEFEHDVSSIGACRPRLPLINGFLCFLEDECQRNEERKRERRRYFKEKMSLEEAHHHRRPWIRAWRKKEMNEGRGREEHEILCSK

SEQ ID NO: 154546 - protein, 94 aa, Glycine max
  Coding DNA Sequence Number=SeqID_62861
MVFLRASQFHNYIFHARLKNCHSLNYRVEPSSCFYKKVHQVKLKYGSNRLAKLGQKMNRVTSLLRLLPNIFRIVDVLVTSSFTLTKMSWTMLKI

SEQ ID NO: 154547 - protein, 36 aa, Glycine max
  Coding DNA Sequence Number=SeqID_62862
MSGTWRYVAGVRRPWGRQGDKALVIDYQLGIIDYTG

SEQ ID NO: 154548 - protein, 131 aa, Glycine max
  Coding DNA Sequence Number=SeqID_62863
MKADMEALKDQMTSMMEAILSMKQMIESNAGAIIATSAAPVADPTYTSAINQANQPIPDMVGQGGEVLGSTGGPHTGHNRNTYPYGLPPNYKLPTMHIPNENNNHVVPVTFEGQQPQPVRGAHEEPREHAQ

SEQ ID NO: 154549 - protein, 481 aa, Glycine max
  Coding DNA Sequence Number=SeqID_62864
  Pfam annotation: Domain name=UnbV_ASPIC; Domain location=374-424; Score=21.7; E_value=0.00018; Accession=PF07593.3; Description=ASPIC and UnbV
AGQQSKVVAVAAAAAAAAEAALQEQSGARTTIAAATTKTSKKTCKKEREENGYMPVHCTSTHIHQQQQQQKNNNATFICVLIMTTQGKCCGRLWGEWQAPKSQWSRFHVAISKSSLIHTCTHAHTAEAQLQDMYVYVHSKKSSVAVVVAAHSPHISNATPRNGDVGHIPYRAMQQPQRYIPSVSDLYGTDEIELLLDEIRELELEPVCCQLDDEQDFEIAGSRAGELSLSLESPLGTCTSWDSHANYKQRNGHTPLPWGVALHCDPQHLKSPTGIVRILLVHDKPSRYSHVRLSVRLSVRLSVCMNARISESGPLSTATHWTPKADGLLCALLTTHHMSHAVSGYIAYSAHVSIQLDESEYVDVPEYWFDIDFELHAACSHGALRHRIIGYVCALEALLLSGIASWPWTQYRQVPDDVSELFIEDREMTPMSPLNSTDLQPGNNHSPYQHSSHNNGNAPTTAADVYNQQQQSSYNQKPYIP

SEQ ID NO: 154550 - protein, 339 aa, Glycine max
  Coding DNA Sequence Number=SeqID_62865
  Gene Ontology: Mol. function=membrane alanyl aminopeptidase activity; Cellular component=cytoplasm; Biological process=leukotriene biosynthetic process
  Homolog annotation: Hit_ID=Q9VJ39; Match level="QueryCoverage=98%, HitCoverage=48%, E-value=1e-148, Identity=78%"; Hit description =CG10602-PA, isoform A
  Pfam annotation: Domain name=Leuk-A4-hydro_C; Domain location=190 -336; Score=184.5; E_value=2.6e-52; Accession=PF09127.2; Description =Leukotriene A4 hydrolase, C-terminal
STLEDPLAGDKSLADVVAHEIAHSWTGNLVTNKNFEHFWLNEGFTVFVEAKVVGRMQGQKELDFKMLSNLTDLQECLRTQLAGTPELSKLVVDLSNCGPDDAFSSVPYMKGSTFLRYLEDLFGGPSVFEPFLRDYLKKFAYKSIVTDDFKGALYDYFKDTDKKDKLGEVDWELWLKSEGMPPIIPKFDETLSNVTKELARIWSKSTVAELIDNNNIKQKISIHQLIDFLGKLIEHQDIVDLNERKIELLEDTYNLKQSKNAEVRFRLNRLIIRARLIKRLDEIIEFANSNFRMKFCRPIYRDLAAWPEAKPIAVRNFVSVRDQMMAVCSHTIEKDLGLK

SEQ ID NO: 154551 - protein, 117 aa, Glycine max
  Coding DNA Sequence Number=SeqID_62866
MNRGNPGDLQPFDPKIDRTFHRLARHSVHPGHSVHFEHLDHFEHFVAGDSKYSDFEHSAINFHTENMTQPPPREKTLREMAAPDFTYESLCIQYPDEGVPYVLKTRLIHLLPKFHGL

SEQ ID NO: 154552 - protein, 97 aa, Glycine max
  Coding DNA Sequence Number=SeqID_62867
MTAPQTDPSRDAYATQPNHNPHEAAPASTRADPDVDEPRHAVEACHAIAEALEQHLNAPDTSTHEEVIQTCLRITRGVTKDCNVYVRSRRRRRTDQQ

SEQ ID NO: 154553 - protein, 199 aa, Glycine max
  Coding DNA Sequence Number=SeqID_62868
MFVSLGGVTRHGNLSRGGRIASAAHGLGGSLKCPKEGRKNHKFACSRKKRRFPQPPKALVICFTRKGTGSTPIYPQTAPKPTPFAYQSNKAVPWKYTPPAFGERVATEVDSLSAKVTNITDLSGVTRSGRVFASPHSAELPSKGKAPMVQEPTDVATPSKEVDPPVVKGAEKKEGLQGKTVTLEEAHEFLRLIQQSEFK

SEQ ID NO: 154554 - protein, 95 aa, Glycine max
  Coding DNA Sequence Number=SeqID_62869
  Homolog annotation: Hit_ID=Q5NRP4; Match level="QueryCoverage=53%, HitCoverage=3%, E-value=8e-08, Identity=52%"; Hit description =Putative gag-pol polyprotein, identical
MELMDKLQRLGQGSMSVEEYRQQMELILIRTGLREEERTSIARFLSGLNMEVRDKETTSSPSSSGSEDEVRGEESREEVYPHEEGDLLMVRRLLR

SEQ ID NO: 154555 - protein, 188 aa, Glycine max
  Coding DNA Sequence Number=SeqID_62870
  Pfam annotation: Domain name=zf-CCHC; Domain location=119-136; Score =10.8; E_value=0.036; Accession=PF00098.14; Description=Zinc knuckle
MMREQIREEERRKNIKRVKKKKKHVSYSSYGSCKSLSEELRDYYEGRHKSHLRPYSHRREKERKPQEANINLPYFHGKDNKDQGQGILRVTPSKPKDDKGKTIEKQPPKASMQEKSNSIKCFKCLGRGHITSQFSTMKTMIMRGQDIYSSQDEATTSTSSSESEEAKWEESSEEIFPHEEEQPLMVKE

SEQ ID NO: 154556 - protein, 45 aa, Glycine max
  Coding DNA Sequence Number=SeqID_62871
  Gene Ontology: Mol. function=oxidoreductase activity; Biological process=negative regulation of transcription
  Homolog annotation: Hit_ID=A7PUZ6; Match level="QueryCoverage=95%, HitCoverage=17%, E-value=2e-10, Identity=74%"; Hit description =Chromosome chr4 scaffold_32, whole genome shotgun sequence
FGARMFNLESTRGGSSYGAGVFAGDGTRQASEMELELAEYHGKCT

SEQ ID NO: 154557 - protein, 35 aa, Glycine max
  Coding DNA Sequence Number=SeqID_62872
MGWRQMEDRVVTDQSSPLPGVGLAENVAARQPSIL

SEQ ID NO: 154558 - protein, 65 aa, Glycine max
  Coding DNA Sequence Number=SeqID_62873
PAELGFLLLFPCPTPDQFRAEVAWPGDWPEAPAEAPAEAPDEADEAHEDEEMTDLLDFLGGSRAT

SEQ ID NO: 154559 - protein, 129 aa, Glycine max
  Coding DNA Sequence Number=SeqID_62874
MEFGDITVHFNILDAMKHPSEDLSVFCAEIIDHIVDEYMIDLHSNLHACHSSCIESEFVLDHMAKFDAESEFEIDIDYMSGDVLPLESDKTNHVLGSTHTSDFLYEDGAKPVRQPQRRLNLVILDGGIL

SEQ ID NO: 154560 - protein, 46 aa, Glycine max
  Coding DNA Sequence Number=SeqID_62875
MAHGCQALTFNKEYGVAPVEVRIEVRYPCRAKGNISCQSLYDTVIF

SEQ ID NO: 154561 - protein, 171 aa, Glycine max
  Coding DNA Sequence Number=SeqID_62876
MEAMLGMRQLMEKNVATAAAVSSAAEADPTLLATAHHPPSNIVGRGRDTLWHDGNPHLGYNRAAYPYGLPPNCSPPILQDDAGHLASPVLEREPPQQPDEVHKDPQDYARRDVEFYPPIPEGPAPSTLPQPNITTQPIVLSIEGPPPAAEERRKLDLLEERLRVVEGFGDY

SEQ ID NO: 154562 - protein, 50 aa, Glycine max
  Coding DNA Sequence Number=SeqID_62877
SASGHGPFKCFMVLAFSCVLITILYWRIPMNPSFPNKGSPPIEGIPLKAK

SEQ ID NO: 154563 - protein, 71 aa, Glycine max
  Coding DNA Sequence Number=SeqID_62878
MSVKNHVGRLRVHDKINHTLSESHCFARMLQPCGIGTGLKEYSNRVTPKAYTPKSLSGSFPPDSSPTQKTF

SEQ ID NO: 154564 - protein, 143 aa, Glycine max
  Coding DNA Sequence Number=SeqID_62879
MAAQLIHDRVEMECLEGAWETLEGNTRCRFRGTIRFTTTSLVYPDEPARTLQRTVEWILPSPTPYRLVEPVQVIEVTSSEEDPEEDLEELPPEPAVDALDFLEGDEDPLPEVDSPEEVTSASEADSTEDSGPGEMAINEGSSS

SEQ ID NO: 154565 - protein, 334 aa, Glycine max
  Coding DNA Sequence Number=SeqID_62880
MGSNQAPSFKKRFYHVKIKSLKVAVFVEVIASLTQYYDQPLKCFTLGDFQLVRIMEEFEEMLGCLLGGRKPCLFSRLYPSMARIAKVVKVSVQELDRVKQNRNGVVGIPRKNLEQKEKALVDQASQGSFSRKLLKEVSLVIRGEFSQGSFSEKLLKEVSQESFSRKLLKEAHSWWRSSFFHGLFPSGWCLPSPLLLCLPLHLHGEKSPLKDLIEAQNPASIEVPQASFHHEGFTNIPLMASVTPMQECFKESEKHRMWCKERIRSSKEAAMGSSTIIISEKFKTKTIKVWKECDELRHVNVATAKALERETKRGRKEEWENDRFITQRSYDLDG

SEQ ID NO: 154566 - protein, 116 aa, Glycine max
  Coding DNA Sequence Number=SeqID_62881
MSRGARDDPKYGTVEIRMDRSYNLFDPFISAHNQQQGTSMVGDVPYIESDHVQDDVPYQVEEMSHVNEVVEVESISGLQDLRGGVQEVDPTNLLINEEESNYLNRETILNMTMNEN

SEQ ID NO: 154567 - protein, 78 aa, Glycine max
  Coding DNA Sequence Number=SeqID_62882
MASGFHVLKLCNSSLGTEEPARTLQRTVEWILPTPTPYRLVEPVQVIEVSSSEEDPEEDPEELPPEPAVDALDLPEDD

SEQ ID NO: 154568 - protein, 196 aa, Glycine max
  Coding DNA Sequence Number=SeqID_62883
MAPRKLPAKRSRKDKAAEGTSAAPDYDSHRFRSAEHQQRFEAIKGCLPAVDIAGYPHGQVRPRHSPGILCQCLAYTGGRAGYTILGEGSVDSFRCGCPQPIPGIPFSAGGGPGVRAIARLLCIPGQDFARTTTGRRVRIMRTNMTTLTQMWMTLLLINIQPSDHNSDLPLPKCQLVYAFLTRMSVHVAQLIADAIY

SEQ ID NO: 154569 - protein, 116 aa, Glycine max
  Coding DNA Sequence Number=SeqID_62884
MITKDDDKGDDKKLKGQSKDEFKMFKKESRTIQDSRGKVEEHFKIQEEGRIQESSFRNQDQDSKFKTQESREDLIKISMKRIFQKLSSTWIFHKTCFPKSFYSLVIDYQIVVIDYQ

SEQ ID NO: 154570 - protein, 49 aa, Glycine max
  Coding DNA Sequence Number=SeqID_62885
MEGDLIKETSQFLDIGLVGYQSIAAWTARAHASYSAILLVQSNPSLVVK

SEQ ID NO: 154571 - protein, 181 aa, Glycine max
  Coding DNA Sequence Number=SeqID_62886
GENTETFSSLTSYPELRRSEFLIGGYVGARASLLSTTPPFVAITQELVARGDTLRLSAPLCYLDTVVSDGKQRPSLVILHPRYAEIPYGYLHPFARQTQLCPMASRDQVWSFCTQDTRRYLTVICTPLLGRHSCVRWQAETKGGAVSDDKQRPSLVILHPRYAEIPYGYSHPLLLSVRQNA

SEQ ID NO: 154572 - protein, 107 aa, Glycine max
  Coding DNA Sequence Number=SeqID_62887
  Subcellular localization annotation: CTP_CleavageSite=33; ConfidenceScore=5.13e-01
MNTGKQGWWPSSNHWIAEPGKLSSKAGVATYPSAGGRRETRGMCVPRKEYARSRHQRLFEENVGKTGKDAIYELLSERFGSCIYARGRVFPFAPTYSSIWDEKIRPT

SEQ ID NO: 154573 - protein, 122 aa, Glycine max
  Coding DNA Sequence Number=SeqID_62888
MAPRKLASKRSRKDKAAEGTSSAPEYDSHRFRSAEHQQRFEAIKGWSFLRERRGDSSPAVGIAGYPHGQVRPRHSPRVLCQCLAYRGGYTRYAILGEGSVDPIRYGCSQPVPGISFSAGGGP

SEQ ID NO: 154574 - protein, 83 aa, Glycine max
  Coding DNA Sequence Number=SeqID_62889
MYQGRTLGFGTVATYPSVGGQREAHGCIFQGRKARGVATNVYSRKTSEKPEKVWSTNFKRERVFPSLLRILNYDEEIRPTQFF

SEQ ID NO: 154575 - protein, 57 aa, Glycine max
  Coding DNA Sequence Number=SeqID_62890
MTLSSWQNKLDKYFTCKTLVMKGETEVTKARLHPTDVCRQFHHPPPFSSVPSHVCCC

SEQ ID NO: 154576 - protein, 89 aa, Glycine max
  Coding DNA Sequence Number=SeqID_62891
MASGNQLPRMCNRLPEWDQERERASGNRLPMLCNRLPGLKMETIAMAVQLIHDRVEMECLEGVWETPRRQCEVPIPGHDFDSRPLRWYI

SEQ ID NO: 154577 - protein, 44 aa, Glycine max
  Coding DNA Sequence Number=SeqID_62892
MSLSGLKEHSNPVTPKAYTPKSPSGPLPPDSGPTCNIILAHRHC

SEQ ID NO: 154578 - protein, 83 aa, Glycine max
  Coding DNA Sequence Number=SeqID_62893
MMTTKDDDKSDEQKAQVNQRTSQENQEQVKSSRLKKKAYKQESRFKIQDLKNQDQDSRLKIQEIRKDSIKISIKKFFKTLNST

SEQ ID NO: 154579 - protein, 183 aa, Glycine max
  Coding DNA Sequence Number=SeqID_62894
MDLTRRLLPSCYAYRVRIFARNRCREAGRIMRTSMTLTQMWMTLLLSNVLPSDHNSDLPLPKCQLVYAILTQMSVHVAQLITDTIDLFAGMPPTRHPLDPDKSNRALGFPALITGLCQSFGVPITPSKVIRSPITRAFIEKYCTPRQVQGDAPQAADAPPPPHQADPAGSFGMEQYLQHLVRQ

SEQ ID NO: 154580 - protein, 52 aa, Glycine max
  Coding DNA Sequence Number=SeqID_62895
MKRRADGFIGNRDVPGAPPLVEVPARLPLVVAPGRQVTCRVLVERAPQVGAL

SEQ ID NO: 154581 - protein, 130 aa, Glycine max
  Coding DNA Sequence Number=SeqID_62896
VGVKEVKDAEASVPVPTDEVTLVGQTLNTFLAWPTHLVKRLSEQAPVSPAKPPESPNHEVDDPLYLMTLTIPQLFLKPLQVMWDATVFGVFNQNFPLYIKHEDLSEIAHDGLDDTPQPKSKVAARWIVVK

SEQ ID NO: 154582 - protein, 87 aa, Glycine max
  Coding DNA Sequence Number=SeqID_62897
MLTSPERVQMTTLVSTCQSDLGSPNDEVRITIRCLRMLPDSWVMIAKGGVVDKSEALASTYPPFVMKNSDLRSSFKSETKIVSVFSH

SEQ ID NO: 154583 - protein, 41 aa, Glycine max
  Coding DNA Sequence Number=SeqID_62898
MARSVFAPCPLFKGPIRERTNQAFSNNPQEVSSPSKNILQQ

SEQ ID NO: 154584 - protein, 121 aa, Glycine max
  Coding DNA Sequence Number=SeqID_62899
MHRSPTENLVPLDLEIEATLRRNRAERRRKLLQDRTIAFILEEETHFSDLLSPDSPSSRESATQFPETTIMVDEQHQRITLEDYSSSSVPQFFTSIACPEVQAHNINYPHSLIHLIQGNLF

SEQ ID NO: 154585 - protein, 132 aa, Glycine max
  Coding DNA Sequence Number=SeqID_62900
MRAPTFMSMRETRPKISLALSTVRSEVCDAGARLEYERKLHTWAKVIKFFLRILPGWPSVFKMNPRPGMHRAASISLGSEGSLQYLEYVGKVSPSANTTGGSRNVLKLSASIFTRWPLTLGCFGGKDPQSWY

SEQ ID NO: 154586 - protein, 174 aa, Glycine max
  Coding DNA Sequence Number=SeqID_62901
MDNWGTLVDCLSKHQFHESHQKFQVACSPWPMFIDYVNDTWIIPHKEKFITAWTNKGSKNQLIEIRLSKIYKMRDPSYWGMLMLFILFNKQINSPVKRSASCSEPPNQQVYCWQHPIGVSPSFLEETLLFNNQGLCETEVTIKEDIEIISKRFDELDMDGITRVNFGKDCFTIT

SEQ ID NO: 154587 - protein, 58 aa, Glycine max
  Coding DNA Sequence Number=SeqID_62902
MWYHGDQSGSQCFARMLQPYGINIDLKEHSNRVTPKAYTLKSPSGPLPPDSSPTRKIF

SEQ ID NO: 154588 - protein, 42 aa, Glycine max
  Coding DNA Sequence Number=SeqID_62903
MASYGSAFAYSKPLRRRFPFVQSWARDYDLSVVTLASTRVRP

SEQ ID NO: 154589 - protein, 96 aa, Glycine max
  Coding DNA Sequence Number=SeqID_62904
MMKDYENGEEQKRYIDNNFSKHMAYIKVYSTNKGHLINKPNNYVEKPENYLVIGTKWVFRNKLDKHGIVRNKTVLLYPLLKRNISLPAVVVHRFYG

SEQ ID NO: 154590 - protein, 206 aa, Glycine max
  Coding DNA Sequence Number=SeqID_62905
  Homolog annotation: Hit_ID=Q0KIL1; Match level="QueryCoverage=46%, HitCoverage=10%, E-value=3e-07, Identity=35%"; Hit description =Gag/pol polyprotein, 3'-partial, putative
  Pfam annotation: Domain name=G-patch; Domain location=116-160; Score =25.1; E_value=0.00018; Accession=PF01585.14; Description=G-patch domain
MVVRAFDGSRRGSDGVNRHPHSDRPPHLQCGFSSDGHKSRLQLPLGETLDSCAGSGPFEASPEIEVRGWWTFGDSVRRRGYVKAAEESLETTFQSFEVVSCASVETSPLLPSLSNAAIMVARVMLKHGYEPGMGLGKDDLGNADVVDIRGNPYKYGLGYEPGMPGRRNAPSRLREDRAWPGHVNQCFTSARIMFEEEVASIGEEFP

SEQ ID NO: 154591 - protein, 206 aa, Glycine max
  Coding DNA Sequence Number=SeqID_62906
MGDQEETQEQMKADMSALKEQMASMMEAMLGMKQLMEKNAATAAAVSSAAEADPTPLATTHHPPSNIVGRGRDTLGHDGSPHLGYNRTAYPYGLPPNYSPPILQEDAGHIASPVHEKEPPQQPDEVHKDPQDYARRDVEFYPPIPEGPAPGTLPQPNLAASPIVLSMEGPPPTTEERRKLDLLEERLRAVEGFGDYPFADMTDLCL

SEQ ID NO: 154592 - protein, 43 aa, Glycine max
  Coding DNA Sequence Number=SeqID_62907
MVVLKHLIVSACFRKEGEFKEEEEEDGDKVNEVVMTIVVVQNI

SEQ ID NO: 154593 - protein, 136 aa, Glycine max
  Coding DNA Sequence Number=SeqID_62908
MGEERPQKEFRRSPTLSCSQSTTQVDVPSTCIHKGCTLQCVKTKISGEKGDTKEFKRLVLRSFGKGRRETQKEFRRLVLGKFFLAKGEEMKRMNSTSFQGLENQKTLESFWHKEEEEAQRDSRLVKDCIRLIGKVY

SEQ ID NO: 154594 - protein, 89 aa, Glycine max
  Coding DNA Sequence Number=SeqID_62909
  Pfam annotation: Domain name=zf-CCHC; Domain location=20-37; Score =32.2; E_value=1.9e-06; Accession=PF00098.14; Description=Zinc knuckle
MEKRHNFDNGKGSQEGSPTLKCYKCNRPGHIKAQCPTNESWPEKKSHEERRSKKAYIAWDDNDSSDGSEKEINLLSKDYESDDNISKED

SEQ ID NO: 154595 - protein, 204 aa, Glycine max
  Coding DNA Sequence Number=SeqID_62910
MSLHSSSSINGEGSTPKDPLYKILDELRSLKLWKEKQERKEKGKKRVEEISQDEKKKIREEERRKILKELRKEKHASYSSHNSCKSLSEELRDYYEGRHRLHLRPHSHRREKERKPQEANINLPYFHGKDNVEANLDWEIRVEQQLKRKSTSKSYGSPSYPKKGQGQGILGVTPSDMNGSGMEKEEREEMPLQGEDESRRSSPP

SEQ ID NO: 154596 - protein, 156 aa, Glycine max
  Coding DNA Sequence Number=SeqID_62911
NSHLPCLDDTSGQVFITAVVSPTKPPPKLDPEVDDPLYLMTLTIPELFLRPYQVTWDATVFGVFNPDFPLYIKHEDLSEIAHGGQCLSISMLQLWILHLTETSMRVGNSDIYGFLEPQFIQRPDNYLKGIINSAIKGLDDAPQPKSKASARWIVVK

SEQ ID NO: 154597 - protein, 326 aa, Glycine max
  Coding DNA Sequence Number=SeqID_62912
MGLIIPQDYAEEVANPSIEGKRALRLTPKSLNQSSQKLFLKYMRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLNENYNLHPFEFNHSHFCTMGFVTWWEKYYSTRSIGDTTIMISRLESGFTQPTVENIRSNLQARGKTIITKKSTETSRADVRPKKPTGVKIQEGKQEEKEEEERPLIRKRKLPATSTKSTEQTEAGNSQAQMPKKKKKVKQVEPEPSVAVEGGEPIKKKKKKTKPSKEQ

SEQ ID NO: 154598 - protein, 154 aa, Glycine max
  Coding DNA Sequence Number=SeqID_62913
LCQSFGVPVAPTKVIQPPITRAFIEKYCTQRQAQGNAPPAAGAPPPPHQAGPAGSFDMEQYLRHLVRQQAANHRAHVQTHDCLYQMSLSMQSQGFASFSCPTPDQFRAEVAWPGDWPEAQAGEAPPEVPGDGEEAHEDEEMADLLNFLGGSGAT

SEQ ID NO: 154599 - protein, 100 aa, Glycine max
  Coding DNA Sequence Number=SeqID_62914
  Homolog annotation: Hit_ID=A5BTR2; Match level="QueryCoverage=78%, HitCoverage=3%, E-value=1e-12, Identity=51%"; Hit description =Putative uncharacterized protein
  Pfam annotation: Domain name=zf-CCHC; Domain location=53-70; Score =23.3; E_value=0.00046; Accession=PF00098.14; Description=Zinc knuckle
MAMCVQEEERLVMDMGESALLTTACGKNKATKSQANQKGNGKIRPQVDIKKVAKCFFCKKKGHMKKNCPRFQKWLEKKVLILTPGGLILDLQSILQILYK

SEQ ID NO: 154600 - protein, 70 aa, Glycine max
  Coding DNA Sequence Number=SeqID_62915
MGVQIAPRPTWALQNIPPEGCCFCRKQPGSPGRAGRQPPPLFCYNRGGSEEEKEKSKPEALPKRFRNVFP

SEQ ID NO: 154601 - protein, 53 aa, Glycine max
  Coding DNA Sequence Number=SeqID_62916
MTLRQHGLKPNQKTMEDIHGEQDEEQGIKENSPNKKIEEAKEHHLDEDALDTT

SEQ ID NO: 154602 - protein, 66 aa, Glycine max
  Coding DNA Sequence Number=SeqID_62917
  Homolog annotation: Hit_ID=A5BBN5; Match level="QueryCoverage=81%, HitCoverage=6%, E-value=2e-10, Identity=53%"; Hit description =Putative uncharacterized protein
EAIKILLEEAKSNDELPREWKASRDHPLDNIIGDISKGVTTRHSLKDLCDNMAFVSIIEPKNGVLS

SEQ ID NO: 154603 - protein, 74 aa, Glycine max
  Coding DNA Sequence Number=SeqID_62918
MGLSLCGSDIVKGFYKEKGKSQVGCLSTGCRHKDDDKGDDKKLKDQSKNNSSKSRTIQEFKIRIKKNSRLKKKG

SEQ ID NO: 154604 - protein, 157 aa, Glycine max
  Coding DNA Sequence Number=SeqID_62919
MAKFDPDIVLEFYVNAWPTKEEVRDMRSWVRGQWIPFDADALSQFLGDPLVLEEGQECEFSQRRNRADGFDEEAISQLLCIPDQDFARTAAGRRVWIMRTSMTTLTQMWMTLLLSNVLPSDHNSDLPLPKCQLVYAILTWMSVHVAQLIADAIYLFA

SEQ ID NO: 154605 - protein, 109 aa, Glycine max
  Coding DNA Sequence Number=SeqID_62920
MAAEWRRKRERRCHFKEKMSLEEAHHHWRPRIRAWRKKEMNEGRGREEHEILCSKRALKSEVLSQPTLRREGNAALTRASSKEGKCAELPPMFIRGKRRKNRKGVVYEL

SEQ ID NO: 154606 - protein, 85 aa, Glycine max
  Coding DNA Sequence Number=SeqID_62921
MMTTKDDDKGDEQKAQRSKNNSSESKNISSESRTSQEFKNQEEFKTQEEILESRIKIQDSRFKISRIKIKIQDSRFKNEEKTQSR

SEQ ID NO: 154607 - protein, 45 aa, Glycine max
  Coding DNA Sequence Number=SeqID_62922
GFVLYRNCKPSWKIPLQLKGSSQCGVATENNSGLWWLMVAVDDGE

SEQ ID NO: 154608 - protein, 117 aa, Glycine max
  Coding DNA Sequence Number=SeqID_62923
DVPSVGELMNLDAVFLLKNTPLVKSNYMGNQPRNNFNAGGFSRFQHGQQYNQQQGQWRNHPGNQFNRDQGGPSTRPQQQGPSLYDRTTKLEETLSSVYAGFPMSNQKSTKSTIKNLE

SEQ ID NO: 154609 - protein, 51 aa, Glycine max
  Coding DNA Sequence Number=SeqID_62924
MAGSWYQIYAKKNRKMQGSRMSEHENKRYAVCRTKERYVHYDAMKRCLCDA

SEQ ID NO: 154610 - protein, 119 aa, Glycine max
  Coding DNA Sequence Number=SeqID_62925
  Homolog annotation: Hit_ID=A7Q538; Match level="QueryCoverage=67%, HitCoverage=19%, E-value=4e-09, Identity=42%"; Hit description =Chromosome undetermined scaffold_51, whole genome shotgun sequence
MQAQAQQQKNLEINGLKRIEEESNIILKPKNIITSALGIDEYFRVSNYSNAKEMWDTLQLTHEGTTDVKRSRVNTFTHEYELFRMNTNENIQRNGSPRNMKWNFNVSTKMKRLTRENEA

SEQ ID NO: 154611 - protein, 211 aa, Glycine max
  Coding DNA Sequence Number=SeqID_62926
MARGGTGPMGSMRRPSPSCYVYRGKILPRLLPGDGNILPSDHNSDLPLPMCLLVYAILTRMSIHVAQLIADAIYIFAGMAPTRHPLDPDKSNRALGFPALITGLYQSFGVPVAPSKVIWPPITRAFIEKYCTQRQVQGDAPQAADAPPPHQAGPAGSFDTQQYLRHLVRQQAANHWVHVQTHDCLYQMSLSLQSQGFTSFPCPTPDQFRAE

SEQ ID NO: 154612 - protein, 59 aa, Glycine max
  Coding DNA Sequence Number=SeqID_62927
METLQKPYGSASTRIFFTEPIFFTNFKKMGEMLATQLAQASKVTSSKSNRLLQESSGGP

SEQ ID NO: 154613 - protein, 61 aa, Glycine max
  Coding DNA Sequence Number=SeqID_62928
MLIDVGNALACACCVCSWGAKCTDLPGSLALVLGHIHTLDVVYYMSWGVECTDLVGWPRRG

SEQ ID NO: 154614 - protein, 127 aa, Glycine max
  Coding DNA Sequence Number=SeqID_62929
MARIEKVVKISEQELDRLKQNRNEVAEIPRKCLEEKAKALANQGEWATFINVLALLVFGTVLFPNVDGLVDLVAIDAFLAYHHSKESPIIAVLADTCDIFDLRYQSVSYKVISCAPKRVKKIGKNSW

SEQ ID NO: 154615 - protein, 78 aa, Glycine max
  Coding DNA Sequence Number=SeqID_62930
MYPLLFSVTTTQVDVPPTYTIKDVPSNVLRQSSQAGEGRHKRIQAVSPLFFWKKEKKDTKRIQAVSPCRILFGKGRRE

SEQ ID NO: 154616 - protein, 96 aa, Glycine max
  Coding DNA Sequence Number=SeqID_62931
MPLRGRIASFGQVFITVVVSPAKPPPKSDTEVIDPLYLMTLTIPKLFLRPYQVRWDATVSRVFNPDSPLYIKHEDLSEIAHDGQCLSISVLQLWIL

SEQ ID NO: 154617 - protein, 235 aa, Glycine max
  Coding DNA Sequence Number=SeqID_62932
MTTLTQIWMTLLLSNILPSDHNSDLPLPKCQLVYAILTRMSIHVAQLIADAIYLFAGMAPTRHPLDPDKSNRALGFPALITGLCQSFGVPVAPTKVIRPPITRAFIEKYCTQRQAQGDAPQAADVPPPYQAGPVGSFDTEQYLRHLVRQQAANHRAHVQTHDCFYQLSLSMQSQGFASFSCPTLDQFRAEVAWPGDWPEAQAGEAPPEAPDDGEEAHEDEEMADLLDFLGGSGAT

SEQ ID NO: 154618 - protein, 170 aa, Glycine max
  Coding DNA Sequence Number=SeqID_62933
DMTGRLLAGSLALESHILHYPIMHILLPRSSNLAQVSEEDLIVMWAFHTGRKIDWAHLVRYRMHKALRLNAPLPYPHLVTLFLQHFNIPLDSKPYVPIKRSFLIGAFVGAKPNDDEGHLPVGEDYSLLQSILDRFDGLQTYVGERITKVEGNVTFIRTCFDLPPPPPPSS

SEQ ID NO: 154619 - protein, 130 aa, Glycine max
  Coding DNA Sequence Number=SeqID_62934
MPLMLALKEWMPASLSLKRIHYSLNFVEAKLHGESKVIQRCFDDNNVTKDDDKGDDKKLKDQSKNNSSESRTIQEFKIESRRIQDSRRKLRVKNQDSRFKIPRIKIKIQESREGLIKISMKSFSQKLSST

SEQ ID NO: 154620 - protein, 197 aa, Glycine max
  Coding DNA Sequence Number=SeqID_62935
MIMRGQYIYSSQDKVTTSPSSSESEEAKGEESSEEIYPQEEGQPLMVKEKCKEALASIATPLGLEFIPQVRKLLDKGLVRKSLNPCALLIPKIGIIRHQVPKISGMMNVLSVATLFCKISHAPKVFMIDVHRDSLGRNNQHKNTEKGTLYCIPFLKFLNSDQGVPTDPKKIKVIPDWPPPPSIREIWGFHDLTNFYK

SEQ ID NO: 154621 - protein, 52 aa, Glycine max
  Coding DNA Sequence Number=SeqID_62936
MRISSFTGQGSKRSEVVFQRGLLSWEPNLDIWGETNQGDKLGGHSSILFMAS

SEQ ID NO: 154622 - protein, 117 aa, Glycine max
  Coding DNA Sequence Number=SeqID_62937
MGRIKRIFRLCRFEFFDKGEGRHKRIQAVSPLFFWKREKQKEFRRLVLGEFFLAKEKENEKMNNTSFQGLENQKTSESFWYKEEEEVKRDSRIVKDCKRLIGKVFRIIEMQNKALLL

SEQ ID NO: 154623 - protein, 139 aa, Glycine max
  Coding DNA Sequence Number=SeqID_62938
MHRSPTGTLVPLDLEIEATLRRNKVERRRKLLQDRIVASILEEETHFSDSLSPDSPSSRESANQYSEAVTMADEHDQRTTLEDYSSGSRFAILLRLLVYQMKLSDSAFSHFHWQERPRGGSTHSKATVLKPGKKWWKNS

SEQ ID NO: 154624 - protein, 103 aa, Glycine max
  Coding DNA Sequence Number=SeqID_62939
MTGRLLAGSLAFECRIMHYLIVRILLPRSSNLAQHFNVPLDSESFVKVKRSFSIGANDAPVQAAEDHSLSPHPQRDDSSSLMHNILDKLDGLHTFVGDRFDLC

SEQ ID NO: 154625 - protein, 81 aa, Glycine max
  Coding DNA Sequence Number=SeqID_62940
MPASANAPFPGMDPSPPQHAIDSSIPVLEIHEGQTIPVLPLDTSPPATPMRFVFPFMKFSKCACRTKKEQECELAFRIVSQ

SEQ ID NO: 154626 - protein, 68 aa, Glycine max
  Coding DNA Sequence Number=SeqID_62941
MAVSFFLTHLLLEVASLIIFLPSPFHCHDLQESKDSIDEEDPRPTSSTCNYIMWYQEHHHLGSIIFQS

SEQ ID NO: 154627 - protein, 86 aa, Glycine max
  Coding DNA Sequence Number=SeqID_62942
MVGPLEGYTSLPLEGCTSSPSEGYTSSPSEGYMSSTLEGYTSSPSETISQSLDFLHTNQLLLSEVVFDFRLHGPENLRATLVPRPH

SEQ ID NO: 154628 - protein, 167 aa, Glycine max
  Coding DNA Sequence Number=SeqID_62943
CTICGEAHETGQCTLLKKTLKKFIIREINIDKGIFKEDFQSSNRVHIINKDSGGHTLEISSTKTRVTMSNHKSTESALKNLEVQVEDEDNVVHEKKTVDKKSTNGKKNEVRGPFMLTASCIVDMGKRKLELGFEDQKIDFDLFVEDKLAPEHNVCLQVMEGGQEVLK

SEQ ID NO: 154629 - protein, 129 aa, Glycine max
  Coding DNA Sequence Number=SeqID_62944
MVICALSGDDRTFPRRGETLSSQVIARYAEFRRIPYGYCTLLSSRGGGPMTSRDQVWSFCTHDTRRYLMVIRTLLSSRGGGPDDKQRPKTKFGHSAPMIRGDTLWLFAPFCHPEAAGPMTSRDQVWGIL

SEQ ID NO: 154630 - protein, 99 aa, Glycine max
  Coding DNA Sequence Number=SeqID_62945
RSTTGDLILIDLEINATCRRRNQERIRNFFQDLEAAAIPEEEPQSSEASSSFPIARHSHLDPIEDHIMAEEPRRVTLEDYSSSNVPQFFTSIAQPEVQA

SEQ ID NO: 154631 - protein, 16 aa, Glycine max
  Coding DNA Sequence Number=SeqID_62946
MVETSKINTKRGVKDK

SEQ ID NO: 154632 - protein, 97 aa, Glycine max
  Coding DNA Sequence Number=SeqID_62947
  Subcellular localization annotation: CTP_CleavageSite=49; ConfidenceScore=5.12e-01
MVARVMLGHDYKPEMGLGKNNGGRTSLVSTRGNRGVATYPSAEGRRVTRGMRVPRKEYARSRHQRLFEENVGKTGKDAIYELLSERLGSCIYARGRY

SEQ ID NO: 154633 - protein, 73 aa, Glycine max
  Coding DNA Sequence Number=SeqID_62948
MEKGYAAASEVGQVHLRMRKMLLVEVAEEPQLFVVSGAVAVAAFVVAAGWVEEHMVCLGQQHSENKAVVVAAA

SEQ ID NO: 154634 - protein, 84 aa, Glycine max
  Coding DNA Sequence Number=SeqID_62949
  Homolog annotation: Hit_ID=Q2AA51; Match level="QueryCoverage=78%, HitCoverage=20%, E-value=5e-07, Identity=40%"; Hit description =Retrotransposon gag protein
MVDEDQQRVTLEDYSSSSVPQFFTREAKKWLYSFKGNSLKTWEEVGYKFMKKYFPESKTAEGKAAISSFHQFPDESLSEALERF

SEQ ID NO: 154635 - protein, 65 aa, Glycine max
  Coding DNA Sequence Number=SeqID_62950
MDKSLNVGENEWRERERGGHKIYASNELLFSPLIQDQVQDSPLSVLRCHEACKARRTCTKCDNGV

SEQ ID NO: 154636 - protein, 121 aa, Glycine max
  Coding DNA Sequence Number=SeqID_62951
  Pfam annotation: Domain name=zf-CCHC; Domain location=51-68; Score =29.8; E_value=9.8e-06; Accession=PF00098.14; Description=Zinc knuckle
MQEENEEEDSDDEEEFSFFRKKFQKFIKKRRIDRHQNFNNGRKSQEDSQVLRCYKCNQIGHIKVNCPSNEEWPEKSDKKRYDERRNKKAYIAWDDNDSSDGSKKINLLTKDYESDENISQE

SEQ ID NO: 154637 - protein, 242 aa, Glycine max
  Coding DNA Sequence Number=SeqID_62952
  Homolog annotation: Hit_ID=Q09JM0; Match level="QueryCoverage=29%, HitCoverage=96%, E-value=9e-14, Identity=43%"; Hit description=10 kDa putative secreted protein
MVNECLSGAKPEETLVEARSDTDVQIVRLTWVGRCGCSVEPRHGIESSKWAIFGKQNWRCGMNRKLGYGAQLRANLDPHKGCWSIKTAGRWSWKSKSAKDCVTTHLPNQLAPKMDGAKARDLYPAGASPGGAVVGADLGGSSKYSNENFEGRRGERFHGIGLKFLNRDVAADGNVRESGDVGGGPGKSYLFCLTACPPWKLLSRRTECLPRPVVLITASGLQGEQPLVDGTLSAMEVEQHGS

SEQ ID NO: 154638 - protein, 159 aa, Glycine max
  Coding DNA Sequence Number=SeqID_62953
VLFPNMEGLVDLAVIDAFLAFHHGKESPVVAILAMYDTFDRGCEKSGARIVCCALALYVWLVSHLFLQEGRPVYPLQGRKNQDSIFMRRMSKCSLDGTRGCINYNPILAIRQLGYPMRGVPSDESITPFIARGFSDPNARDKELRGSSNGIIGAAIISG

SEQ ID NO: 154639 - protein, 103 aa, Glycine max
  Coding DNA Sequence Number=SeqID_62954
MGLGKDGLGNADVADIREIRTNMDWSMNPGCREEGMHRQDFGRIGHGQAIYEGRFFEDPNKEGLTIDFDRDVSQTMNEEEEEDILSPELERLIAQEEREMKPH

SEQ ID NO: 154640 - protein, 219 aa, Glycine max
  Coding DNA Sequence Number=SeqID_62955
MAPRKLASKRSRKDKAAEGTSSAPEYDSHRFRSAVHQQRFEAIKGWSFLREQRVQLRDDEYTDFQEEIGRRQWASLVTPMANGFSFDADAIGQLLGYPFSWKRAKSASMARGGTGRRVRIMRTNMTTMTQIWMTLLLSNILPTDHNSDLPLPKCQLVYAILTRMSIHVAQLIVDAIYIFAGMAPSRHPLDPDKSNGALGFPALITGLCQSFRSPPWHLP

SEQ ID NO: 154641 - protein, 108 aa, Glycine max
  Coding DNA Sequence Number=SeqID_62956
MSIRILPTWFPLEEFMRGRRSSTMSLGNDQVKGLPKPVDMPNPDVEPLYMMALTIPQLFLKLLQMLWDATMFEVYNDHFALHIKHEDLSKIAHSVQCLGISVIQLWIF

SEQ ID NO: 154642 - protein, 91 aa, Glycine max
  Coding DNA Sequence Number=SeqID_62957
IASARHPVDSRKSNKVLELPALITSLCQFYGVSVAPSKVIKPPTNRAFIKKYCTPRQAQGETPQQPGDGRQRATDAPPPPLEFTSAHPQKG

SEQ ID NO: 154643 - protein, 46 aa, Glycine max
  Coding DNA Sequence Number=SeqID_62958
MPLRGEDESRRSSPPQEAMDKSLKPTNPRSSPRFSTVEAKTLPLMF

SEQ ID NO: 154644 - protein, 197 aa, Glycine max
  Coding DNA Sequence Number=SeqID_62959
  Homolog annotation: Hit_ID=Q6WAY6; Match level="QueryCoverage=73%, HitCoverage=22%, E-value=4e-14, Identity=33%"; Hit description =Putative uncharacterized protein
MDLAAIGAFLAYHHNKESPVIAVLADAYDTFDLRCKKSSVRIVCCTPALYVWLVSHVLHHEGRPVRPLQGHRMCTKKGKTNWEELLTGMAGASVSWFPQWKEGGTRALCSCEGFPNIPLMGTKGCINYNPILAIRQLGYPMRGAPRRRLSRLSSHGVSMKAMQKYFRESARRGIQWKERIRSLEEAAMVSSVAIING

SEQ ID NO: 154645 - protein, 73 aa, Glycine max
  Coding DNA Sequence Number=SeqID_62960
MENCTKQSLRMAPNSWVEGLENGELHKAITTYGSKLVGGGCMNENAIQGAPKQGREWRIALSNHYAWLQTRGW

SEQ ID NO: 154646 - protein, 167 aa, Glycine max
  Coding DNA Sequence Number=SeqID_62961
MGDQKETQEQMKADMSALKEQMPSMMEAMLGMRQLMDNNVATAAAVSLNAEADPTLPTTAHHPLPNAVGQERSTLGHISNPHLGYNRVAYPFGLPPNYTPPVMRDDAGHVPSPILEGEPPQQPDEVHEDHREYDQGDVNFYPPVPVEGPAPVTSWKFLPGIFGNDVF

SEQ ID NO: 154647 - protein, 109 aa, Glycine max
  Coding DNA Sequence Number=SeqID_62962
MKTPDEAIDLIESMTASDTAILRDRAHIPTTKSLLELTSQDALLAQNKLLSKQLETLTETLRCTICGGAHEYGYCIPNEDKVAHKVNDMGNQPRGNFNTSGFLGFQNNQ

SEQ ID NO: 154648 - protein, 110 aa, Glycine max
  Coding DNA Sequence Number=SeqID_62963
MADSFIGEISQQQLHPQKEDMWIWKHDSSGHYSTKSGYDLIRRGVVGADQTSDFVELWKLKIPAKSALYLKTQGITSCNMELGKIRERRLQDGNAGGLLSQEQYGSIETE

SEQ ID NO: 154649 - protein, 125 aa, Glycine max
  Coding DNA Sequence Number=SeqID_62964
MAPTRHPLDPEKSNRALGFPALIMGLCQSYGVHVTPSKVIRPPITRAFIEKYCTPRQAQGDTHQDADAPPPPRQADSTGPLGVEWYLQHLVCQQTANHHGQGQGFAAFVCPTPEQFGAEVAWPED

SEQ ID NO: 154650 - protein, 82 aa, Glycine max
  Coding DNA Sequence Number=SeqID_62965
MDSGRFQVSVQGNNCPSKTFLEEMYQHFLIFYVCPHLPTIHLRMVLGASNDAILPPPPPQGHWIEDSKKIGPKMQEKALGFS

SEQ ID NO: 154651 - protein, 336 aa, Glycine max
  Coding DNA Sequence Number=SeqID_62966
  Homolog annotation: Hit_ID=Q6WAY6; Match level="QueryCoverage=30%, HitCoverage=18%, E-value=4e-12, Identity=35%"; Hit description =Putative uncharacterized protein
MDWDQLLAGIGGRTISWFPQWKEGKEGVLFSCGRYPNIPLVGTRGCINYNPTLAIRQLGYPMRGAPTEESMSPFLVRDLGAQNSKTIQRIHKAWETPLRKDQELRGVRNGIIDWLAKLKVVSEENFEAPEEDEEVQALKSKLGKAKLAKEKFKLAATHVRKECAGLREENAITARALEQETKRARKEEYGRNKFRGALWGSNSELKLRREERDQSRAHGMVLKEELMTCSRSKRSLSQRLCETETNMLAIIAKYEEELGLATAHEHRIADEYAQVYAEKEARGRVIDSLHREATMWVGRFALTLNGSQELPRLLAKAKAMADTYSAPEEIHGLLGY

SEQ ID NO: 154652 - protein, 26 aa, Glycine max
  Coding DNA Sequence Number=SeqID_62967
MEALEKFKLSYITLGCPIQAHQGSIL

SEQ ID NO: 154653 - protein, 78 aa, Glycine max
  Coding DNA Sequence Number=SeqID_62968
MAPVTMGLCTVIVQIQCWLGIVMLIGLEVQMTEKALLVDASIWATILFHGSARSRTIFRKMIDLIQHQAVAAQKRTLL

SEQ ID NO: 154654 - protein, 200 aa, Glycine max
  Coding DNA Sequence Number=SeqID_62969
  Homolog annotation: Hit_ID=A5B939; Match level="QueryCoverage=37%, HitCoverage=53%, E-value=7e-23, Identity=69%"; Hit description =Putative uncharacterized protein
MDGAKARDLYPAVGARTKPRCVGGRGGRCKTQGASPGGAVVGADLGGSSKYSNENFEGRRGESLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 154655 - protein, 197 aa, Glycine max
  Coding DNA Sequence Number=SeqID_62970
  Homolog annotation: Hit_ID=Q6WAY4; Match level="QueryCoverage=85%, HitCoverage=30%, E-value=2e-21, Identity=36%"; Hit description =Putative uncharacterized protein
MGTNQNDKRFYQVKVKSLDVTSLKELGRLMGPLQRQAFRKVYGKILDLIAAEVFTEVVVSLAQYYDQPLRCFTFRDFQMVPTIEEFEEILGCPLGGRKPYLFSGFLPSLGKIAAVVGDSKKELDPMKQTRNGVVGLPRKYLEGKVRDIASQEKWGPFADILALLIFGVVLFPNVDSLVDLAAIDAFLAYHHSKESPV

SEQ ID NO: 154656 - protein, 278 aa, Glycine max
  Coding DNA Sequence Number=SeqID_62971
MAKFDPDIVLEFYANAWPTEEGVRDMRSWVRGQWIPFDADAIGQLLGYPLVLEEGQECEYGQRRNRSNGFDEEAIAHLLCIPGQDFARTAARRRVRIMRTNMTTMTQIWMTLLLSNIQPSDHNSDLPLPKCQLVYAIPDADEVHVAQLIADAIYLFADKSNKALGFPALITGLCQSFRVPVTPSKATDAPPPPHQADPAGSFGMERYLQHLVRQQAANHRGQVQTHECLYQLSLSLQSQGFAPFPCPTLDQFRAEVAWPGDWPEDQTEEASAEAPGDP

SEQ ID NO: 154657 - protein, 61 aa, Glycine max
  Coding DNA Sequence Number=SeqID_62972
MASRKRKSIGRFSSLDAWNRYIDNVLGRNILPERKVELYHTELDDFKTELERRNFHKCLTN

SEQ ID NO: 154658 - protein, 162 aa, Glycine max
  Coding DNA Sequence Number=SeqID_62973
MGMRGCINYNPVLAIRQLGYPMRGRKDKELRGRSNDVIGGYHKWLKSRMQGIAWLKKLKGLNGEEAEVPEESEEVQSLKVEHEKAKVAEEKLKVAVARVRKECDKLKDINMTADEALEQETRKSKKEEWSRNKFRGASLGSSNELKLRKVERDKSRTKNLML

SEQ ID NO: 154659 - protein, 61 aa, Glycine max
  Coding DNA Sequence Number=SeqID_62974
MEFLELKQGNMTVAEYAAKFKELRHTQRDCSRLKKEQNGGGPNGHTGHPKATGRVFTLNGY

SEQ ID NO: 154660 - protein, 81 aa, Glycine max
  Coding DNA Sequence Number=SeqID_62975
MLKLKNKGGEWKFICHHQKGGDCRSKLHDESRLIQRVLMITKMMTKSSKVKNTYDNKDDDLKNQRMSSRLNHVHFKDQDES

SEQ ID NO: 154661 - protein, 179 aa, Glycine max
  Coding DNA Sequence Number=SeqID_62976
MDFFSNESFECFQAFENSNLIPFMSLKLPVYYDLVKAFYSNLEIHEGTLMFEVYGIKMVIDQSLFYDLTQLPSKGVPFEGALIDDWKFDFSVHDARRLVKKGGRHVGVEGHDGEDSSLLSKILDRFDGLQTFVGERFDNLELQVDMRFNEMESRITKVEEDVSYIHSSFDLPPPPPPSS

SEQ ID NO: 154662 - protein, 59 aa, Glycine max
  Coding DNA Sequence Number=SeqID_62977
MVILHHGDAAEGSFLEKLSKENFLEKLELSYTHPSKTKLTSLRSFLEKLELSYTHPSNN

SEQ ID NO: 154663 - protein, 68 aa, Glycine max
  Coding DNA Sequence Number=SeqID_62978
MQTCVSQPTRLRASEARLMGASSKGGKCAESPPMFIERKTLEKPKETGRQKRGSCSYVPSIEEEIRPT

SEQ ID NO: 154664 - protein, 66 aa, Glycine max
  Coding DNA Sequence Number=SeqID_62979
MKIIQATQTCSGKCYYLEACHAIAETLEHHLSLNEITPDTSTHEVIQKCLRIARGVTKDGNVYVRS

SEQ ID NO: 154665 - protein, 62 aa, Glycine max
  Coding DNA Sequence Number=SeqID_62980
MAGSSESSTSSKGCGEIEESAQFFIFKSQVRQDHIDASEQCELGLYDGYDNEELSLVTSYYY

SEQ ID NO: 154666 - protein, 154 aa, Glycine max
  Coding DNA Sequence Number=SeqID_62981
  Gene Ontology: Mol. function=lipid binding; Cellular component =anchored to membrane; Biological process=lipid transport
  Homolog annotation: Hit_ID=A7QR85; Match level="QueryCoverage=65%, HitCoverage=67%, E-value=2e-31, Identity=57%"; Hit description =Chromosome chr13 scaffold_149, whole genome shotgun sequence
  Pfam annotation: Domain name=Tryp_alpha_amyl; Domain location=34-111; Score=23.8; E_value=0.00065; Accession=PF00234.13; Description =Protease inhibitorseed storageLTP f
MDSNACLPHLLVLAITLVLVSHAMEDSAQDKQRCAESLTGVATCLPYLGADAKAPTADCCGGLTQAMKTNKKCVCLILKDRDVPDLGLKINMTIAVGLPSLCKTPDNLSQCSVFKIQLNKVLDSNNNITEEPEVAANSRPARNHNRPTHLRDYV

SEQ ID NO: 154667 - protein, 619 aa, Glycine max
  Coding DNA Sequence Number=SeqID_62982
  Gene Ontology: Mol. function=DNA binding; Cellular component=nucleus
  Homolog annotation: Hit_ID=A7QXJ1; Match level="QueryCoverage=77%, HitCoverage=90%, E-value=2e-24, Identity=28%"; Hit description =Chromosome undetermined scaffold_225, whole genome shotgun sequence
  Pfam annotation: Domain name=MBD; Domain location=95-164; Score=11.8; E_value=0.0023; Accession=PF01429.10; Description=Methyl-CpG binding domain
MEEPNSDCWLPPGWTVEVRVRKNGKRDKVSENFKGGFGLWRSFFNSGKNETRHCEMERGHSRSSESESHLSAFPPIIYYFPPSSGLKFNSKVEVIVEKAIAEGLPPGWVKKTRITTNGDSVRRDTFYIDPVNGYTFCSIKDVDCYLESGEIGSYEFKSKDNDGTDMELKADKSPSTSVTVKPTLSISMGQSSDMDMIANDQQIPRSASSEEYMSVPISECVVGAKLTSSVLSLAKSSDKKQGKVGVAQSASVSGCTNKDAEEKQLQENSETKHGTEKAQAKDPQCKNKHKKEINLPRRASKRLAGIKVDPVPELKIRNRARRVAVKQSEEEETITNVDKSANSLLDGLAKQKLNNEDTDKTLEVQRSDKEKECFSFSSLENNATVEECVRVIENGDKVDAKLDYTLDFPLRELLTDPCIAFAIQTLTGVTFEASKDLQTFSELKNSQHSKTSASAAAIGEGDGKKSNDGLGGNEFSSPENLSIPPEHAGDAKTDLKAKNENAGPSSEKTLDMSSWMDPCIEFAIKTLTGTIPSDSADQNPKNCLQQQLSSSNSQHSEMALSSVSLDNIYKTDYSCSQYFDTQKPMFNKQSFVDPSLQHTRNIGIGNSAGSRLSHCGERY

SEQ ID NO: 154668 - protein, 77 aa, Glycine max
  Coding DNA Sequence Number=SeqID_62983
MVFYGAAARVWFQIQGGFGRVGEEASMELRKCTCFSSVQNAVASLAGTCAIAVGGGTDAAVALVVSSGIPRRRVRLF

SEQ ID NO: 154669 - protein, 191 aa, Glycine max
  Coding DNA Sequence Number=SeqID_62984
  Gene Ontology: Mol. function=protein phosphatase inhibitor activity; Biological process=regulation of phosphoprotein phosphatase activity
  Homolog annotation: Hit_ID=A5B112; Match level="QueryCoverage=91%, HitCoverage=57%, E-value=4e-38, Identity=51%"; Hit description =Putative uncharacterized protein
  Pfam annotation: Domain name=IPP-2; Domain location=18-157; Score= -18.6; E_value=4.5e-05; Accession=PF04979.5; Description=Protein phosphatase inhibitor 2 (IPP-2)
MGYEVFFISGQSFRGRVRWDEANIGEIEANKPVRQKITEPKTPYHPMIDDDSSLSPVRGSFDACIDDQNHTMHAEAIWSALNDVASSSRRGTGQSGGWTSSEDEPEAMEQDDDDSETDRNLSFKEHRKAHYDEFLKVKELQQRGSLEDESDEDNNSEPSKVEKCESSSLSDSVKEMDIEGKKSSTPQANGS

SEQ ID NO: 154670 - protein, 80 aa, Glycine max
  Coding DNA Sequence Number=SeqID_62985
  Subcellular localization annotation: CTP_CleavageSite=14; ConfidenceScore=5.03e-01
MSSQNYLQFSTSPPFGYKGGLAKDAWVSNTFAWLALIMFPFLESILKASVVSGLNATVLHYETNNALKWIEKEGLSDTRH

SEQ ID NO: 154671 - protein, 764 aa, Glycine max
  Coding DNA Sequence Number=SeqID_62986
  Gene Ontology: Mol. function=sequence-specific DNA binding; Cellular component=nucleus; Biological process=regulation of transcription, DNA-dependent
  Homolog annotation: Hit_ID=A7PXZ1; Match level="QueryCoverage=99%, HitCoverage=92%, E-value=0.0, Identity=55%"; Hit description =Chromosome chr15 scaffold_37, whole genome shotgun sequence
  Pfam annotation: Domain name=Homeobox; Domain location=56-112; Score =90.7; E_value=4.6e-24; Accession=PF00046.20; Description=Homeobox domain
  Pfam annotation: Domain name=START; Domain location=289-514; Score =240.8; E_value=3.1e-69; Accession=PF01852.10; Description=START domain
  Pfam module annotation: Pfam domain module=Homeobox::START; Domain location=56-112::289-514
MEGHSEMGLMGESFDTSNLLGRMRDDEYESRSGSDNFDGGSGDDQDAGDDQPHKKKKKYHRHTPQQIQELEAFFKECPHPDEKQRTDLSKRLGLENKQVKFWFQNRRTQMKNKLLKINIIVISCYLFGGSQMKTQLERHENMILRQENDKLRAENSVMKDALANPICNNCGGPAIPGQISLEEHQTRMENARLKDELNRICALANKFLGRPLSPLASPMALPPSNSGLELAIGRNGLGGSSNFGMPLPMGFDVGDGALGSSPAMSTMGARSPMGMMGNEIQLERSMLLDLALSAMNELIKMAQPDTSLWIKSSDGRNEVLNHDEYARLFSPYIGSKPAAGYVTEATRGTGVVSASSLGLVEILMDADQWSEMFSSMIASAATVEVLSSGTGGTRSGALQVMLAEVQLLSPLVPARQVSFLRFCKKHAEGLWAVVDVSVDIGRNVTNSHPLMSCRRLPSGCVIQDMPNGFSNITWVEHSQYDESVIHQLYRPLVSSGIGFGAQRWIATLLRQCDCLAILRSPQGPSEDPTAQAGRTNMMKLAQRMTECFCSGICASSACKWDILHIGNLADDMRIMARKIDDPTEAPGIVLSASTSVWMPVSRKRVFDFLRDENLRGEWDLLSKDGPMKEMLHIAKGQDRGNCVSILHSANSECNVLYLQESWSDASGSMVVYSPINMQALQMVMSCGDSSFVPLRPSGFAILPDGTSNNGDGSDGGGSCLLTVGLQMLPNGNHQSAKFTMESVDAVNNLISFTIQKVKDALGVA

SEQ ID NO: 154672 - protein, 437 aa, Glycine max
  Coding DNA Sequence Number=SeqID_62987
  Homolog annotation: Hit_ID=A7QKI1; Match level="QueryCoverage=87%, HitCoverage=74%, E-value=2e-46, Identity=38%"; Hit description =Chromosome chr2 scaffold_112, whole genome shotgun sequence
  Pfam annotation: Domain name=IQ; Domain location=127-147; Score=34.5; E_value=3.9e-07; Accession=PF00612.18; Description=IQ calmodulin -binding motif
  Pfam annotation: Domain name=IQ; Domain location=149-169; Score=19.5; E_value=0.013; Accession=PF00612.18; Description=IQ calmodulin -binding motif
  Pfam module annotation: Pfam domain module=IQ::IQ; Domain location =127-147::149-169
  Subcellular localization annotation: CTP_CleavageSite=76; ConfidenceScore=5.34e-01
MGFLRRLFGGKKHHNPPPSSDASKPSKDKKTWSFVKHSTRYKPNTLPTTLNNNSNFDPSTSSSPFPESLDANKHAIAVAAATAAVAEAALAAAHAAAEVVRLTSSTGCASSLPAAAPQSRRVANETTAAAVKIQSAFRGYLARRALRALKALVKLQALVRGHIVRKQTSDMLRRMQTLVRLQSRARATRGNLSDNMHSFKSSLSHYPVPEDYQHSLRAYSTKFDGSILKRCSSNANFRDIDVEKARFGSHWLDSWMEENSWRQTRDASLKNGHLDDEKSDKILEVDTWKPHLNSHHSSGSSFQTSSHHYLSSDYNNENFVAYESPSKRSSKALNPSLSSREVLPFGSLKSHKGKEEAALQNVEDSPQAFSASSRLGSDARRGPFTPTKSECAWSFFSGYPGHPNYMANTESSRAKGLVQIGILILGARPMQQPQAAV

SEQ ID NO: 154673 - protein, 489 aa, Glycine max
  Coding DNA Sequence Number=SeqID_62988
  Gene Ontology: Mol. function=oxidoreductase activity; Cellular component=cytoplasm; Biological process=ethylene biosynthetic process
  Homolog annotation: Hit_ID=A9PIV6; Match level="QueryCoverage=79%, HitCoverage=77%, E-value=1e-109, Identity=63%"; Hit description =Putative uncharacterized protein
  Pfam annotation: Domain name=2OG-FeII_Oxy; Domain location=359-455; Score=83.2; E_value=8.2e-22; Accession=PF03171.11; Description=2OG -Fe(II) oxygenase superfamily
  Pfam annotation: Domain name=2OG-FeII_Oxy; Domain location=63-147; Score=42.9; E_value=1.1e-09; Accession=PF03171.11; Description=2OG -Fe(II) oxygenase superfamily
  Pfam module annotation: Pfam domain module=2OG-FeII_Oxy::2OG-FeII _Oxy; Domain location=359-455::63-147
MDFVESVFVSGNGNVTGIYLKNLVLSLKNPGIKVINHGIGAEVLDEMICGIHRFHELDAETVLMDNFLCHCYPSFPEPELTLGTSEHIDSDFMTILLQDQMGGLQVLHENQSVDVHPVHRSLVNIGDFLQLTYHTEPKMDVAVSGNSLAGTSTPYNRLQELKAFDESKAGVKGLVDSGITKLPKIFVRPPEDLAAADPVSGNPAGAQFTIPIIDLDGLTGERSGVVAGVRRAAETVGFFQVVNHGIPVKVLEETMAAVHEFHELPQELKAEYYSREQMKKVKYGSNFDLYQSKYANWRDTLFCVMGPDPLDPQELPPICMDVAMEYSRQVKLLGRVLFGLLSEALGLDPDHLEGMDCAKGHSILFHYYPSCPEPELTMGTTRHSDPDFLTILLQDHIGGLQVLSHNGWVDVPPVPGALVVNIGDLLQLYDLIHKVYFGGGTRKIYGNENVLWFLSNECNHHCGCVAVAFTPKNLDIVAKIVVMDCLLKP

SEQ ID NO: 154674 - protein, 362 aa, Glycine max
  Coding DNA Sequence Number=SeqID_62989
  Gene Ontology: Cellular component=nucleus; Biological process =regulation of transcription, DNA-dependent
  Homolog annotation: Hit_ID=Q9ZSM7; Match level="QueryCoverage=98%, HitCoverage=82%, E-value=1e-101, Identity=58%"; Hit description =Putative uncharacterized protein
MLLVIRVLTAGRQLAKILELQSLNDLGFSKRYVRCLQISEVVNSMKDLIDICSEHKIGAIESLKNYPRLATASKGQMQKMQEMEQLANVQGLPTDRNTLNKLMTLNPGLNNHMNNTNNMVGRGALSGSAQAALALNNYQNLLMRQNSMNSSPGSLQREGSSFNNSNPSPSSALQGTGPALIPGSMQNSPVGGFPSPHLTPQQQQQQLLQQRTLSANGLLQQNHSQGSQGNQALQQQQMIQQLLQEMSNNNGGLQSQSLGGHNANGNISKNTMGFGGHTPSLSGGSANVPGNNRPISRNNSFKTASNSDSSAAGGNNGFNQRTSDMQQNLHLQDVAQDIGNEFLDNPFFNSDLDDNMGFSWKA

SEQ ID NO: 154675 - protein, 289 aa, Glycine max
  Coding DNA Sequence Number=SeqID_62990
  Gene Ontology: Mol. function=protein binding; Biological process =ubiquitin cycle
  Homolog annotation: Hit_ID=A7QVJ9; Match level="QueryCoverage=91%, HitCoverage=94%, E-value=1e-106, Identity=64%"; Hit description =Chromosome chr16 scaffold_189, whole genome shotgun sequence
  Pfam annotation: Domain name=F-box; Domain location=24-71; Score =18.0; E_value=0.036; Accession=PF00646.24; Description=F-box domain
MGAGVSTTAIENDDGGTFSLSTKTTLDDIPENCISSMMMSFDPQEICTLARVNKAFHRASSADFVWESKLPPSYKFLLNKVLGEQNLGSMTKKEIYAKLCRPNFFDGANKEVWLDRSRGQVCMFISSKSFKITGIDDRRYWNNIPTEESRFKSVAYLQQMWWVEVIGELEFEFPKGNYSVFFKLQLGKPSKRLGRRVCNLDQVHGWDIKPVRFQLSTSDGQRSLSQCYLRGSGEWAHYHVGDFAIDKPNGPTNINFSLAQIDCTHTKGGLCIDGVVICPKEFTERLKQF

SEQ ID NO: 154676 - protein, 462 aa, Glycine max
  Coding DNA Sequence Number=SeqID_62991
  Homolog annotation: Hit_ID=A7QVK0; Match level="QueryCoverage=50%, HitCoverage=62%, E-value=1e-69, Identity=59%"; Hit description =Chromosome chr16 scaffold_189, whole genome shotgun sequence
  Pfam annotation: Domain name=F-box; Domain location=9-57; Score=22.8; E_value=0.0013; Accession=PF00646.24; Description=F-box domain
MSEVRNKVDFIQLLGPDMSIKILTHLDDPCDLIRVSSVSSSWHRFVIEHGLCKQLCLKMFPEISGVAHIIELDNIIEPLSNTLGSYVSWESHKRNHRVYAFLASGLTPMRKNCISKAISASSTDNYPEESILHTLEPGDRTEYRASYWSSKGESDPSVPETLVYELASKLCLVTEIYVHPFQAYFQHGFPIYSAKAVRFRMGHSKHPMELESPVDNMAANHVLGNNQFIWTYTSPEFPMLQLEVEIHLLAFFWESSTYEILILGLLAHFRYHSDGEFMSRTGSVRAAIVDVRGSRATMCSTIHKPSSHRGYTQQSSELGSCHIRNLAEGKRVDVFRGIVKDGNSGRKDSVKDMATIVLSDLGSPISPLWTSISHVQVMGRLLFPEFDVKIHHWSGKCTLKYCPQTDCYMSSPTSSPRSNSSNPSRLRTITSSIMQRGVRRWEQFLLGALLGTGPVVVDNEDQ

SEQ ID NO: 154677 - protein, 158 aa, Glycine max
  Coding DNA Sequence Number=SeqID_62992
  Homolog annotation: Hit_ID=A7QVK2; Match level="QueryCoverage=52%, HitCoverage=33%, E-value=6e-29, Identity=75%"; Hit description =Chromosome chr16 scaffold_189, whole genome shotgun sequence
  Subcellular localization annotation: CTP_CleavageSite=63; ConfidenceScore=5.25e-01
MNIVCFKPCIPSSLLCPRTSFRKFPLTIPRFSLQDSQQQQQQQQQQQLNLSVLRFTLGIPGLDESYLPRWIGYGFGSLLLLNHFLGSDSATVTPAQLSTEVLGLSLASFSIVLPYLGKFLKLDLEIYTTTPYPTRWGRLHGSTSAIMFYQVPYFYPNH

SEQ ID NO: 154678 - protein, 562 aa, Glycine max
  Coding DNA Sequence Number=SeqID_62993
  Gene Ontology: Mol. function=drug transporter activity; Cellular component=membrane; Biological process=multidrug transport
  Homolog annotation: Hit_ID=A7QVK5; Match level="QueryCoverage=79%, HitCoverage=82%, E-value=1e-172, Identity=68%"; Hit description =Chromosome chr16 scaffold_189, whole genome shotgun sequence
  Pfam annotation: Domain name=MatE; Domain location=312-475; Score =150.2; E_value=5.6e-42; Accession=PF01554.9; Description=MatE
  Pfam annotation: Domain name=MatE; Domain location=91-251; Score =133.4; E_value=6.6e-37; Accession=PF01554.9; Description=MatE
  Pfam module annotation: Pfam domain module=MatE::MatE; Domain location=312-475::91-251
MCHPTLDVTCNCQCCSTSPPDCPISITNPLISKPQNTTTPPPPPHQHNNTTTKTKTPPPSTTATKTTTAPKPHHVPEAIKEVFSISKIVIPMILTGLLLYCRSMISMLFLGHLGELALAGGSLAIGFANITGYSILSGLAVGMEPICGQAFGAKRFTLLGLCLQRTILLLLFTSLPISLLWLYMKQILLLCGQDVAIATQAQSYLVYSIPDLIAQSFLHPLRIYLRTQSITLPLTLCASFSILLHIPINYFLVAHLKLGIKGVALGGVLTNFNLVASLILYIVFSGTHKKTWGGFSFECFTQWKSLLNLAIPSCVSVCLEWWWYEIMILLCGLLVNPKATVASMGILIQTTSLLYIFPSSLSFSVSTRVGNKLGAQKPSKARLSAIVGLSCSFMSGVLALVFALMVRNTWASMFTKDKDIITLTSMVLPIIGLCELGNCPQTTGCGVLRGTARPKVGANINLGCFYLVGMPVSIWLAFFTGYDFQGLWLGLLAAQGSCAVTMLVVLCRTDWEFEAQRAKKLTGMGGAASGVDQSREVDPEKPLKHESNEDSLLLADSDENEQ

SEQ ID NO: 154679 - protein, 442 aa, Glycine max
  Coding DNA Sequence Number=SeqID_62994
  Gene Ontology: Mol. function=transmembrane receptor activity; Cellular component=intrinsic to membrane; Biological process=innate immune response
  Homolog annotation: Hit_ID=Q5JBT4; Match level="QueryCoverage=94%, HitCoverage=38%, E-value=1e-155, Identity=65%"; Hit description =Candidate disease-resistance protein SR1
  Pfam annotation: Domain name=LRR_1; Domain location=10-31; Score=9.7; E_value=4.9; Accession=PF00560.24; Description=Leucine Rich Repeat
  Pfam annotation: Domain name=LRR_1; Domain location=103-124; Score =8.4; E_value=8.5; Accession=PF00560.24; Description=Leucine Rich Repeat
  Pfam annotation: Domain name=LRR_1; Domain location=126-147; Score =6.0; E_value=24; Accession=PF00560.24; Description=Leucine Rich Repeat
  Pfam annotation: Domain name=LRR_1; Domain location=188-209; Score =17.0; E_value=0.069; Accession=PF00560.24; Description=Leucine Rich Repeat
  Pfam annotation: Domain name=LRR_1; Domain location=211-236; Score =5.5; E_value=30; Accession=PF00560.24; Description=Leucine Rich Repeat
  Pfam annotation: Domain name=LRR_1; Domain location=33-55; Score=7.0; E_value=15; Accession=PF00560.24; Description=Leucine Rich Repeat
  Pfam annotation: Domain name=LRR_1; Domain location=57-77; Score=7.3; E_value=14; Accession=PF00560.24; Description=Leucine Rich Repeat
  Pfam annotation: Domain name=LRR_1; Domain location=79-101; Score =12.6; E_value=1.4; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1; Domain location=10-31::103-124::126 -147::188-209::211-236::33-55::57-77::79-101
MAHRRQKLGHLTVLNFDQCKFLTQIPDVSDLPNLRELSFEECESLVAVDDSIGFLNKLKILNAKGCSKLTSFPPLNLTSLETLELSGCSSLEYFPEILGEMKNIKILYLIDLPIKELPFSFQNLIGLSEINLNRCGIVQLRSSLAMMPELSAFYIADCNRWQWVESEEGEEKVDSIQYSKARSKRFTHVEYLDLSGNNFTILPEFFKELQFLRALMVSDCEHLQEIRGLPPNLEFFDARNCASLTSSSKSMLLNQKLHEAGGTNFMIPGTRIPEWLDQQSSGHSSSFWFRNKFPAKLLCLVIAPVSTGIGVKAKVFINGKILKLPFFYGSKKIQSMLELDHTYIFDLQPFAFKNNINRFEEAAWEKEWNHVEIRYQIVLNHIKEKREQGSVIKATGIYIFKEESSMEQDIRFDDPYLSSSASENPWLPQTIALGTRNCQKWT

SEQ ID NO: 154680 - protein, 144 aa, Glycine max
  Coding DNA Sequence Number=SeqID_62995
MAMNPCSTIDIKPKRKKKERERGREREREKLTCKADRRRRGWRRGGGGGRIRWRRARENERDSSESQESKSQSPKGKEEWEKVPARIDDEFCIEGKGWRGCGDGGERWWWRLISEGKGLSQLGASWGAVVVCGWPKENQNLVGR

SEQ ID NO: 154681 - protein, 247 aa, Glycine max
  Coding DNA Sequence Number=SeqID_62996
  Homolog annotation: Hit_ID=Q6WAY6; Match level="QueryCoverage=60%, HitCoverage=35%, E-value=2e-14, Identity=31%"; Hit description =Putative uncharacterized protein
MGSSQMPSLKRRFCQVKVKSLGTTSLKELGQLMGHLQRQAFRKAYSKIWDLAIIEVSTKAIASLAQYYDQSLRCFTFGDFQLSPMEAKARILAGKGEWAPFIDILALLIFGGVLFPNVDGLVDLAAIDAFLAYHNHKESPALYVWLVSHLFLQEEGRTGVLISCGGFPNVPLMGMRGCISYNLVFAIRQLGYPMRRAPLEDELTPVISRGFNKTNLETLKKVRKAWEVLQKKDKELRGSNNGPIGGY

SEQ ID NO: 154682 - protein, 106 aa, Glycine max
  Coding DNA Sequence Number=SeqID_62997
  Homolog annotation: Hit_ID=A5BK51; Match level="QueryCoverage=57%, HitCoverage=4%, E-value=1e-07, Identity=37%"; Hit description =Putative uncharacterized protein
MAPEDTNNLYYLSEVYRVKVELPTAGNPGPNVVLKGIEIDPEKVKAILEMPEPRTEKQGSAFENYLAQQPLQDYRPMHPEVPDEDIMALFQEKWTHEDIDQWIGCF

SEQ ID NO: 154683 - protein, 40 aa, Glycine max
  Coding DNA Sequence Number=SeqID_62998
IQLQGMRLDSHIGSMGFQYGIYKALGSRTTIASFCGVVLP

SEQ ID NO: 154684 - protein, 146 aa, Glycine max
  Coding DNA Sequence Number=SeqID_62999
MKREKHVSYSSHNSCKSLSEELRDYYEGRHRSHLRPHSHRRENERKPQEVNIKLPYFHGKDNVEANLDWEIRVEQQLKRKSTSKSYGSHSYPKKDQGQGILGVRPSKPKDDKGVPMNPKRIKVIPEWPAPPSVLREKAQSFKNLGI

SEQ ID NO: 154685 - protein, 339 aa, Glycine max
  Coding DNA Sequence Number=SeqID_63000
  Homolog annotation: Hit_ID=Q2HW90; Match level="QueryCoverage=89%, HitCoverage=65%, E-value=5e-23, Identity=27%"; Hit description =Putative uncharacterized protein
MANQEEWVLFADVLDFLIFGVVLFPNVDILVDLAAIDAFLAYHHSKEWPVVAILADLFDTFDRRCEKNSARIICCLPALCVWLVSHLFQQDIRHPCPLQSHCSCVKKRRVDWDQYLAGIGGRTINWFPRWKEGKEGVLFSCRDYPNVPLIGTRGCINYNPALAIRQLGYPIRGAPTEESLSPFLVRDFGAQSFKIVQRVHKAWESPLRKDKELRGIRNGIIGGYHEWLRVHTRGLDWLSKLKIINEENFEAPEEDEEVQALKTELGKARLAKEKFKLVATDIRKECAKLREENAATARALEQETKRARKEKHGRDKFRGALRGSTNELKLRREERDQSR

SEQ ID NO: 154686 - protein, 87 aa, Glycine max
  Coding DNA Sequence Number=SeqID_63001
MDLRLLVLTLVSHLAGQDHLGLPSGVKTKHESAETNQGRVLKDERKRGWGHDRPIVALLCAKQAGNVAARQLRILCILQLSFTICLF

SEQ ID NO: 154687 - protein, 169 aa, Glycine max
  Coding DNA Sequence Number=SeqID_63002
AFVMASLEVYHEWLKVRTRGLDWLAKLKIINEENFEAPEEDEEVRALKTELGKARLAKEKFKLVATDIRKECVGLREENAATAKALEQETKRARKEEHGRDKFHGALWGSNTHEHRVANEYAQVYAEKEARGRVIDSLHQEATMWMDQFALTLNGSQELPRLLAKAKAM

SEQ ID NO: 154688 - protein, 132 aa, Glycine max
  Coding DNA Sequence Number=SeqID_63003
MMTTKDDDKKLKRIKEHPSQENLEQVKEFKNQEEFKTQEESLQTRIKIQDLKNQDQDSRMKKRLNQDKGYIYLDLTENKRGYISCGSVLVEGTSTRFKENKGGYIPCGSLLVKGFYKVERNPKDRRLLGDWR

SEQ ID NO: 154689 - protein, 174 aa, Glycine max
  Coding DNA Sequence Number=SeqID_63004
ISAIVSNDLPRESVPTNQLTLYEFDHHTPHDIQRMWRNIDIVRERLTFMAFPYMGATIAFHGEPVITCSKDIPGHSMPIGVRSKRTLVDFLDHVVRLFGIHASQEGHVMAYRPIPLPPNNNARVCHDTRTQCMVGPRAMLAGTWMPMWNAHSPLDFPPGERDGRRSHQRNHPIP

SEQ ID NO: 154690 - protein, 197 aa, Glycine max
  Coding DNA Sequence Number=SeqID_63005
  Homolog annotation: Hit_ID=Q6WAY4; Match level="QueryCoverage=85%, HitCoverage=30%, E-value=3e-19, Identity=34%"; Hit description =Putative uncharacterized protein
MGTNQNGKRFYQVKIKGLDVTNLKELGWLMGPLQRQAFRKVYRKILDLTTAEVFTEAVVSLAQYYDQPFRCLTFGDFQIVPTIEEFEEILGCPLGGRKPYLFSRFLPSLSKIVAVVRDSARELDRMKQTRNGVVGLPRKYLEGKARDMASQEEWVPFADILALLIFGVVLFPNVDGLVDQAAIDAFLAYRHSQESPV

SEQ ID NO: 154691 - protein, 163 aa, Glycine max
  Coding DNA Sequence Number=SeqID_63006
MAPTRHPLDPDKSNRALGFPALITGLCQSFGVPVAATKVIRPPITWAFIEKYYTQRQAQGDAPQAADAPPPHQAGQAGSFDTERYLRHLVRQQAANHRAHSQGFASFSCPTPDQFRAEVAWPGDWPEAQAGEAPPEAPGDGEEAHEDEEMADLLDFLGGSGAT

SEQ ID NO: 154692 - protein, 100 aa, Glycine max
  Coding DNA Sequence Number=SeqID_63007
MGYGHSLSSFLMLQLGNVQSVVELMTLDVVFLVKNQLFMKSITSGISLEILLMEEDSPDSKMASNINNRDNGRTTLAINSIGLNSKGLLSMSVPRSWKRL

SEQ ID NO: 154693 - protein, 191 aa, Glycine max
  Coding DNA Sequence Number=SeqID_63008
MQQQQQQQKQQATEAPSQPSLEELVRQMTIQNIQFQQETRASIQSRTNQMGQMATQLNKAQSQNSDKLPSQTVQNPKNVSVITLRSGKQIEVPPPVAAPAPEPVKLHSTPEKEDEIVAQKRKLPDHERANKNFHAGGPSSSSSDLQQPPIPLPFPLRAIPNKKMEEVDKEILETFRKVEVNIPLLYASSKF

SEQ ID NO: 154694 - protein, 101 aa, Glycine max
  Coding DNA Sequence Number=SeqID_63009
MERSMIDAAIGGALGDMTPAEARNLIEKMTSNSQQFSAKSDAIVIRGVHEVATNSSSLGETKKLEDLCPSVQQSEAIEQLEAYAANIYNRPPQPQQQNQPP

SEQ ID NO: 154695 - protein, 73 aa, Glycine max
  Coding DNA Sequence Number=SeqID_63010
MGLICPKAHSHDTPVVTPEPSQHEKARDAEELTESWRQLFPLRLVGGMRNSGVVPWHISHGVGCFARCTSNSW

SEQ ID NO: 154696 - protein, 120 aa, Glycine max
  Coding DNA Sequence Number=SeqID_63011
  Gene Ontology: Mol. function=peptidase activity
  Homolog annotation: Hit_ID=Q8H6W2; Match level="QueryCoverage=66%, HitCoverage=85%, E-value=1e-15, Identity=47%"; Hit description=Gag -protease polyprotein-like protein
MEGISTRLFKENKGGYIPCGSLLVKDFTRLKRNLKDRNSIHRPPIFNGEGYHYWKNRMQIFIESIYLNIWEAIEIGPYIPTVVDASTSTTTQKPRDKWTEEDRRRIQYDLKAKNIITSDL

SEQ ID NO: 154697 - protein, 136 aa, Glycine max
  Coding DNA Sequence Number=SeqID_63012
  Subcellular localization annotation: CTP_CleavageSite=41; ConfidenceScore=5.02e-01
MNCVFVRVSSTFEFGAMRSDCLVQFSIHNLFRSPMNCIFVHVSSTFEFGAMRSDCLVQFSILHFFRSPVNCVFVHVSSTFEFGAMRSDCLAQFSILTLFRSPMNFVFVHVFSTFEFRGMRSDCLVQFSILNLFGAP

SEQ ID NO: 154698 - protein, 53 aa, Glycine max
  Coding DNA Sequence Number=SeqID_63013
MGDFRTGLRFGPHVVIRLPKHSGSPGERKLPCHGDKNKPRRQWGHAGDSAVEN

SEQ ID NO: 154699 - protein, 78 aa, Glycine max
  Coding DNA Sequence Number=SeqID_63014
MASYGEINIISLLTPESSKTTLLSKQFNKTWLEDNQSIPRITSIWLCRNLPFGGRATRDSRDACSTKGIRAESPPTFI

SEQ ID NO: 154700 - protein, 15 aa, Glycine max
  Coding DNA Sequence Number=SeqID_63015
MAPVMPSEQKGAEPQ

SEQ ID NO: 154701 - protein, 73 aa, Glycine max
  Coding DNA Sequence Number=SeqID_63016
MSQLQYMVIIGSFKVDNCTCKGNIRLCLQRGMSRLSGGNHRYGHGPPATLKAELIMEYAKAAALSPDMNNDIP

SEQ ID NO: 154702 - protein, 59 aa, Glycine max
  Coding DNA Sequence Number=SeqID_63017
MQITFLPNDVRPTCDRLNQPLSHATVRFDEDDLLQSLHGYRGGLDCHGSSLRWVNVERT

SEQ ID NO: 154703 - protein, 321 aa, Glycine max
  Coding DNA Sequence Number=SeqID_63018
  Homolog annotation: Hit_ID=A5BSR3; Match level="QueryCoverage=35%, HitCoverage=38%, E-value=5e-07, Identity=33%"; Hit description =Putative uncharacterized protein
MAEKTKKKLEEVAQSGSTEAVIDSPSPIRHHVKWKMARTKKTGQMTSEATKEIAEKIASQGSFVPHGREDVLTAAIGRPKHPGHVRVGGAGVTIKQYFGSAPRTSRTSSSMAPEELEQLTQQIKDQLEESITEKGLALPPKPEVGPSAACVSTKGSYVGPSPTDPETGDSDKCGLYIEENPFRLVALGRVYEGSTAVHNIPLLHGQVKVGVDEVKDAEAPIPVPTDELFLKPLQVMWDATVFEVFNEHFPLYIKHEDLFEIAHDGQCLNISVIQLWILHMTETSIKLHEELDAKLKKGCLPWSLLEWRTLAQYYLKVKNQT

SEQ ID NO: 154704 - protein, 92 aa, Glycine max
  Coding DNA Sequence Number=SeqID_63019
MAAQLIHDRVVMECLEVEPAQVIEVSSSEEDLEEDPEELPLEPAMDALDLPMNDEDPLPDVDSLEDIMSASEADSTEESGPGGTANSDDSSS

SEQ ID NO: 154705 - protein, 134 aa, Glycine max
  Coding DNA Sequence Number=SeqID_63020
MSPVKPLDRAHPEVDDPLYLMTLTIPQIFLRSLQVMWDATMFRVFNQDFPFYIKHEDLFEIAHDGQCLSIYVLQLWILHLTETSMRAGNSDVYGFLEPQSIQRSRQSQFELESYIKSWMQSSKYDVYLGAYLNG

SEQ ID NO: 154706 - protein, 143 aa, Glycine max
  Coding DNA Sequence Number=SeqID_63021
MERRKNRGSYFVQRISECSLDGNKGLHQLQSRLAIRQLGYPMRGAPLEVELAPVISRGFNKTNGETLQKKYKELRGSNNGPIGGYRRWLKAHVQGLDWLPSLRTAKGEEVEAPEEDEEVQALRAELEQAQTVKERFKSAALKI

SEQ ID NO: 154707 - protein, 46 aa, Glycine max
  Coding DNA Sequence Number=SeqID_63022
MGSKFYPKVHENPRAFFSSSSPSLLESSIQYPWGDRNLVLQEGSMD

SEQ ID NO: 154708 - protein, 72 aa, Glycine max
  Coding DNA Sequence Number=SeqID_63023
MPIGWTSQKSGADIEEEELTDLRSNPLQGEGDDAILPRKGPVTRAMSKRLQQDWARAAEEGPRVLMNLRVDF

SEQ ID NO: 154709 - protein, 36 aa, Glycine max
  Coding DNA Sequence Number=SeqID_63024
MEITSWPPQQGPNIFQRTTKLEETPGSIHASDHIQP

SEQ ID NO: 154710 - protein, 235 aa, Glycine max
  Coding DNA Sequence Number=SeqID_63025
NMERSMIDAASGGALGDMTPAEAKNLIEEMSSNSQQFSARNDAIVIRGDHEVATNSSSSAETKKLKGKLDALVNLVTQLAMNKKSAPVARLYGLCSSADHHTDLCPFVQQSEAIQQPEAYAANIYNRPPQPQQQNQPQQNNYDLSNNRYNPGSRKQCQGPQPVASSSFANEPAQPHSTPEKDDDKNLKSKLPNNFYAGESKEKQHIPLPFPPREISNKKMQEAEKEILETFRKVE

SEQ ID NO: 154711 - protein, 196 aa, Glycine max
  Coding DNA Sequence Number=SeqID_63026
MGDQEETQEQMKADMSALKEQMTSMMEAMLGMRQLMEKNAATAAAVSSAAEADPTLLATAHHPPSNIVRRGRDTLGHDDNPHLGYNRAAYPYGLPPNYSPPVLQDDVGHIASPVLEREPPQQPDEVHKDPQDYARRDVEFYPPIPEGPAPSSLPQPNITTQPMVLSMEGPPPATEERRKLDLFKERLRAVEGFGDY

SEQ ID NO: 154712 - protein, 213 aa, Glycine max
  Coding DNA Sequence Number=SeqID_63027
MAPRKLASKRSRKDKAAEGTSSAPEYDRHRFRSTKHQQRFEAIKGWSFLRERRVQLRDDEYTDFQEEIVRRRWASLVTPMAKFDPDIVLEFYANAWPTEEGVRDMRSWVRGQWIPFDADALSQFLEYPLVLEEGQECEYGQRRNRSDGFDEEAIAQLLCIPGQDFARTAAGRRVRIMRTNMTTLTQIWMTLLLSNIQPSDHNSDLPLPKCQLV

SEQ ID NO: 154713 - protein, 346 aa, Glycine max
  Coding DNA Sequence Number=SeqID_63028
  Gene Ontology: Mol. function=protein transporter activity; Cellular component=flagellum; Biological process=protein secretion
  Homolog annotation: Hit_ID=A8GG38; Match level="QueryCoverage=95%, HitCoverage=83%, E-value=1e-112, Identity=60%"; Hit description =Flagellar biosynthetic protein FlhB
  Pfam annotation: Domain name=Bac_export_2; Domain location=1-311; Score=427.6; E_value=1.8e-125; Accession=PF01312.10; Description =FlhB HrpN YscU SpaS Family
  Pfam annotation: Domain name=NADH5_C; Domain location=19-164; Score= -88.3; E_value=0.075; Accession=PF06455.2; Description=NADH dehydrogenase subunit 5 C-termin
  Pfam module annotation: Pfam domain module=Bac_export_2::NADH5_C; Domain location=1-311::19-164
MLLAGLLIIWLGGHNMAQRLASMVATGFRFDHGMVNDDKIIVSHIGNLVMQAVIALLPLMAGLVIVAIAAPMILGGINISGKSIKFDFKKLNPLPGIARMFSGQTWAELVKAILKAVLVALVAGWYLWSHWQEMLRLMSESPVNALQHGLSMTAISCALVMLGLIPMVGFDVFWQLYSYFKKLRMTRQEIRDEHKQNEGDPHVKGRIRQAMRAAARRRMMADVPKADVIVTNPTHYSVALQYQEGKMSAPKVIAKGAGDIALRIREIAKEHRVPILEAPPLARALYRHTEIGQFIPGALYAAVAEVLAWVWQLRRWKREGGLIPNKPKHLPVPAEMDFAGENTNHG

SEQ ID NO: 154714 - protein, 482 aa, Glycine max
  Coding DNA Sequence Number=SeqID_63029
  Homolog annotation: Hit_ID=A8GG67; Match level="QueryCoverage=50%, HitCoverage=43%, E-value=5e-72, Identity=60%"; Hit description=FHA domain containing protein
MDVIGFDDLPCTLSWREVADRFDPQQHISYWWSNRSDGFAHATHKHSGPLTAQLFSLLFNPAAGAQPGRTGAPVARRRVPPDQPGQRHFSGAERRGAAARLAGAAAPRRYAADWRIWPGSAAADPLGMQQDESVPEPEVLPQSDSPRHERRPDARLAIDPQSDAPVMPAVLAGADQDKLIAALLEGMGLNNGHQTPITEEQMRVTGRMLSLFSQGTVALLSSRSILKRGVKADMTMILNEANNPFKILPSGKTVLMQMYQSQMPGFMPPEAAVRDALVDLQAHQLGMIAGIRAIIAAMLQSFNPQRLEEEARKDGVLPKMPFSGGRKAALWDYFLRHYQRTAGEIEDDFHTLFGEAFLHAYDMEGMRDENQDRTGAEVDEHKACFLVCDGVAGLPGGDYAAQLVRDTLLTQLQQSDTFTPESTRAAIEKCQQTLVSAQGNNPNFSRMSTTLAALFIDRTTQRAWWAHAGDSRSGAAAARSRL

SEQ ID NO: 154715 - protein, 90 aa, Glycine max
  Coding DNA Sequence Number=SeqID_63030
MLAFLGKYQEELNLATAHEHKVADEYARVYAKKEARGRVINSLHQEATMWMDRFALTLNGSQELPQLLAKAKAMADTYSAPEEIHRLLRY

SEQ ID NO: 154716 - protein, 327 aa, Glycine max
  Coding DNA Sequence Number=SeqID_63031
MAPRKLASKRSRKDKAAEGTSSAPEYDSHRFRSAEHQQRFEAIKGWSFLRERRVQLRDDEYTDFQEEIVRRRWASLVTPMAKFDPDIVLEVLCQCLAYKWRVGIPFDADALSQFLGYPLVLEEGQKCEYGQRRNQADGFDEEAIAQLLCISGQDFARTAAGRRVWIMRTNMTTLTQIWMTLLLSNIQPSDHNSDLPLPKCQLVYAILTRMSIHVAQLIIDAIYLFAGMAPTRHPLDLDKSNRALGFPALITGLCQSFGVPVAPSKVIRSPITRAFIEKYCTQRQAQGDAPQAADAPPPHQAGPAGSFDTEQHLRHWVRQQAANHGAH

SEQ ID NO: 154717 - protein, 142 aa, Glycine max
  Coding DNA Sequence Number=SeqID_63032
MEKSEKKNHSEKKLKKAYITWDENDLESSDDSENRRDKSLPYGKKLRKYVSNKNGLGYKSEKLQKEHGYSTCYFKKNDKKKKGIALKASSSIQEESDQDNDPDDDDDLSLFVKRFNKFLKVRGNQRRPNFNQREGQKNHPLL

SEQ ID NO: 154718 - protein, 43 aa, Glycine max
  Coding DNA Sequence Number=SeqID_63033
MKMLLIPHDVAPLELMNGSGMEKEESEETPLQGEDESRRNSPP

SEQ ID NO: 154719 - protein, 86 aa, Glycine max
  Coding DNA Sequence Number=SeqID_63034
MLDKQGAVSPAKPVDRPDPEVDDPLYLMTLTIPQIFLKLLQLVGLGSSSSMDSFSSGKMNGSGMEKEEREETPLQGEDESKRSSPP

SEQ ID NO: 154720 - protein, 156 aa, Glycine max
  Coding DNA Sequence Number=SeqID_63035
  Subcellular localization annotation: CTP_CleavageSite=13; ConfidenceScore=5.12e-01
RPPRPPTHRGLVLAPTAGAQLGTVTQLPVHPASPVLLTKNGPLGALDSMARLNRAAAPSYLFKGNFGGNQLLDGSISLSPLYPSQTNDLHVCSHSNPSQKIRVGRRCNPQGDPTNQLPCALRVYSPVDSHTCQTPWSVFPDGPKWGAHRPDARSAQ

SEQ ID NO: 154721 - protein, 45 aa, Glycine max
  Coding DNA Sequence Number=SeqID_63036
GTYWVRTSNLPLGSLKAHARCPSLPQCKALRFLHGAFRCPSVGLR

SEQ ID NO: 154722 - protein, 83 aa, Glycine max
  Coding DNA Sequence Number=SeqID_63037
MEDIYMENKMKNKELKPWIFFINGDLCFLKMNGSGMEKVDDWRRHFKEKMSQEEVHHYRKEKMSGGRGREEAQNLLPQMRFEL

SEQ ID NO: 154723 - protein, 157 aa, Glycine max
  Coding DNA Sequence Number=SeqID_63038
MAKRTLCAKPKCHSDEAELSAPCCEFDEFKEELKRRHWVEKLTDFADSSINIAIVKEFYANLYDPEDKSPKQVRVRGNLVKFDKDTLNTFLKTPIILEEGENLCTYSRFALLRPDPQELAAKLYIPGRGFELNVDGQPLKILRKNMTTLAQTWGSSR

SEQ ID NO: 154724 - protein, 245 aa, Glycine max
  Coding DNA Sequence Number=SeqID_63039
  Homolog annotation: Hit_ID=Q6WAY4; Match level="QueryCoverage=86%, HitCoverage=37%, E-value=1e-25, Identity=34%"; Hit description =Putative uncharacterized protein
MGTNQTGKRFYQVKIKGLDITNIKELGQLMGPLQMQAFRKAYGKILDLTIAEISTEAIVSLTQYYDQPLRCFTFGDFQLVPTVDEFEEILGCPLGGRKPYLFSGFLPSLSKIAVVVRDSARKLDRIKQTRNGIVGLPRKHLEGKARDMANQEEWVPFMDVLALLIFGVVLFPNMEGLVDLAAIDAFLAYHHSKESPVVAILVDLFDTFDRRCEKSSARIICCLPALCVWLVLHLFQQDIRHPCPL

SEQ ID NO: 154725 - protein, 77 aa, Glycine max
  Coding DNA Sequence Number=SeqID_63040
MLIDVGNALACACCVCSWGAKCTDLPGSLALALGHVHTLDVVYVRGGRTALIFQVYVHGGWSALTLLDNLDVGGKRG

SEQ ID NO: 154726 - protein, 114 aa, Glycine max
  Coding DNA Sequence Number=SeqID_63041
WLPLTNLTEGSIDVAIAKEFYANLYVPDEKFPKQVRVRGHLIKFDVDSLNTFLETLVVVKQGESLPSYSRFARLRPDPQELVARLCIPGRGFVLNAEGLPWKLLRKDLTTLTQT

SEQ ID NO: 154727 - protein, 54 aa, Glycine max
  Coding DNA Sequence Number=SeqID_63042
MGVCKIHSDIQSKGPLSSIESASDAAMISSGESTSGSESSSSFGSQEHPQQVQE

SEQ ID NO: 154728 - protein, 45 aa, Glycine max
  Coding DNA Sequence Number=SeqID_63043
MGLSGLKEHSNPVTPKAYTLKSPSGHFPPDSGPTPKIILAHRHCS

SEQ ID NO: 154729 - protein, 174 aa, Glycine max
  Coding DNA Sequence Number=SeqID_63044
  Gene Ontology: Mol. function=RNA-directed DNA polymerase activity; Biological process=RNA-dependent DNA replication
  Homolog annotation: Hit_ID=Q0ZCD0; Match level="QueryCoverage=86%, HitCoverage=12%, E-value=1e-09, Identity=27%"; Hit description =Integrase
MERSMIDATSGGALGHMTPAEARNLIEKMASNSQQFSARSEKKKLEGKLDALVNLVTQLAMNQKSAPIARLCGLCSSADHHTDLCPSVQQFEAIEQPEAYAANIYNKSPQPQQQNQPQQNNYDLSSNRYNPGWRNHPNLRWWNPSQQQQQQQQTYFQNVAGPSKPYVPPPIQQQ

SEQ ID NO: 154730 - protein, 382 aa, Glycine max
  Coding DNA Sequence Number=SeqID_63045
  Gene Ontology: Mol. function=ribose-5-phosphate isomerase activity; Cellular component=integral to membrane; Biological process =carbohydrate metabolic process
  Homolog annotation: Hit_ID=Q6D8V9; Match level="QueryCoverage=34%, HitCoverage=86%, E-value=7e-46, Identity=66%"; Hit description =Ribose 5-phosphate isomerase
  Pfam annotation: Domain name=LacAB_rpiB; Domain location=233-373; Score=261.3; E_value=2.1e-75; Accession=PF02502.9; Description =RiboseGalactose Isomerase
MRIAWQRYAHKHYAPALQAKQPVLLNQRGSQRCAKYHRQRLCQVEQRENFAAVARRHPQAEIKDGAREETGLGNPQQQAQRVQPFDTADPGKQQRDDAPADHDARQPAPRAELMQRQVAGHFQQDVTNKEDAGGETKLQRTEAEVLRHAVWAGKGNGGAIEEVDKEHQRHKRYQAPGDFADCGLLNRADSRVIHNAPPNVRSETVLARRKTGAGDRQNARCQTLYYWRNMMKTIAIGADDAAIDLKNTIKKLLEEQDYQVTDYSNDAQNDRPMYPDVAFALATAVQQKQFERGILLCGTGIGVAIVANKVEGVRAAQCHDTFSAERARKSNNAQIMTMGSRVIGPELAKNIVNAWLASEFEGGGSTVKVEKIGYYEQVSHAK

SEQ ID NO: 154731 - protein, 522 aa, Glycine max
  Coding DNA Sequence Number=SeqID_63046
  Gene Ontology: Mol. function=oxidoreductase activity; Cellular component=cytoplasm; Biological process=hydrogen peroxide catabolic process
  Homolog annotation: Hit_ID=Q1QZE8; Match level="QueryCoverage=93%, HitCoverage=99%, E-value=0.0, Identity=87%"; Hit description=Catalase
  Pfam annotation: Domain name=Catalase; Domain location=44-425; Score =868.3; E_value=3.9e-258; Accession=PF00199.10; Description=Catalase
MALFPARKICLASSRNKKQICELGWIILTKAGDIMSNDDRKPTTTDAGIPVASDEHSLSVGPDGPLMLHDHYLIEQMANFNRERIPERQPHAKGSGAFGYFQVTEDVSRYTKAAVFQPGTKTDVVMRFSTVAGERGSPDTWRDPRGFAIKFYTSEGNYDMVGNNTPVFFIRDPMKFQHFIRSQKRRADNNLRDNDMQWDFWTLSPESAHQVTWLMGDRGIPKSWRHMNGYSSHTYMWVNAAGEKFWVKYHFKTDQGVEFLTQDNADLLAGQDGDYHTRDLFSAIKNGDFPSWTLYMQIMPFAEAETYRFNPFDLTKVWPHSDYPLIKVGKLMLNRNPTDNHAQIEQAAFEPNNLVPGIGLSPDKMLIGRVFAYADAHRARLGVNYKQIPVNAPQAPVHSYSKDGAMRINPVSDPVYAPNSKGGPAADGERYPTDSTWEAHGNMVRAPYTLRQDDDDFGQANTLVNKVLDEAARDRLVNNVSGHLLNGVEEPVLSRAFEYWRNIDQTIGDRIAQRVQTERAKR

SEQ ID NO: 154732 - protein, 325 aa, Glycine max
  Coding DNA Sequence Number=SeqID_63047
  Gene Ontology: Mol. function=quinoprotein glucose dehydrogenase activity; Cellular component=outer membrane-bounded periplasmic space; Biological process=electron transport
  Homolog annotation: Hit_ID=Q4ZTA9; Match level="QueryCoverage=91%, HitCoverage=37%, E-value=1e-134, Identity=73%"; Hit description =Quinoprotein precursor
  Pfam annotation: Domain name=PQQ; Domain location=137-174; Score=8.8; E_value=1; Accession=PF01011.12; Description=PQQ enzyme repeat
  Pfam annotation: Domain name=PQQ; Domain location=2-40; Score=20.1; E_ value=0.0086; Accession=PF01011.12; Description=PQQ enzyme repeat
  Pfam annotation: Domain name=PQQ; Domain location=86-120; Score=16.1; E_value=0.1; Accession=PF01011.12; Description=PQQ enzyme repeat
  Pfam module annotation: Pfam domain module=PQQ::PQQ::PQQ; Domain location=137-174::2-40::86-120
MDNGFNSGNPSGVIRAYDVQSGRLVWNFDPANPQNTAPIAAGQTYPQDTPVAWGTLSADLKNGLVYVPFGNASPDELGIERDANSNTEKFRDALVALDLQTGAFKWRYQSSHHDLWDRDNPSQPSLVDIDYQGQKQPVVILPTKTGNLFVLNRLTGQPVYPVNDVKVSTEGGVPGEKFAATQPVSSLNFIPQPLTEKSMWGITPFDQMACRMDFRSLRYDGNPWTPATEGGSLVFPGNIGVFNWGSVAVDPQRQMLIAAPVRLAYKYNLIKRTPATATERLFTKDGQPYWNENFHGITPSTSSSWPLVSAFRALHRRGAAWSAWI

SEQ ID NO: 154733 - protein, 114 aa, Glycine max
  Coding DNA Sequence Number=SeqID_63048
  Gene Ontology: Mol. function=transporter activity; Cellular component= integral to membrane; Biological process=transport
  Homolog annotation: Hit_ID=A8G7T8; Match level="QueryCoverage=88%, HitCoverage=22%, E-value=4e-28, Identity=61%"; Hit description=Major facilitator superfamily MFS_1
MAIPWVGSAAGIIALMTLGNALNALVNNVYWSVVIDVTPKASVGTFSGMTLAIANLASIISPMLCGWLAQYYGYNAMFTVTACIAFGSMLAMTLLQPEKRLQADAPPAAAQQAV

SEQ ID NO: 154734 - protein, 42 aa, Glycine max
  Coding DNA Sequence Number=SeqID_63049
PKRALSTRHGLSGPGSTPAKHAYEGPKPTSATINREPVQEDK

SEQ ID NO: 154735 - protein, 29 aa, Glycine max
  Coding DNA Sequence Number=SeqID_63050
MELSTALPENNNCLTTTVGSSGLRIIKKE

SEQ ID NO: 154736 - protein, 209 aa, Glycine max
  Coding DNA Sequence Number=SeqID_63051
MVSRGGGERDECLFHLGESHDMETRPAVEELLQRLMDWGQLEVSIGGREEPQVCMQSEEKKVPLTPKALVICFTRKGTGSTPTYPRTAPKPTPFAYQSNKVVPWKYTPPASSERVATEVDSLSAKVTNITGLSGVTRSGRVFASPHPAELPSKGKAPMVPESTDIATPSKEVDPPVVRGVEKKEGLQGKTVTLEEAHKFLRLIQQSEFK

SEQ ID NO: 154737 - protein, 94 aa, Glycine max
  Coding DNA Sequence Number=SeqID_63052
MIAQQLSPVLPRTLESDQFPLLNDPNKACIYVITNFLVEARLHGECDSKMMTKVMNKKLKDQRTTQVNQRTSQVNQEQVKSSRIKKNSRLKKKS

SEQ ID NO: 154738 - protein, 78 aa, Glycine max
  Coding DNA Sequence Number=SeqID_63053
  Homolog annotation: Hit_ID=A5AV98; Match level="QueryCoverage=92%, HitCoverage=10%, E-value=2e-08, Identity=39%"; Hit description =Putative uncharacterized protein
MKDKWNMHELHSMLVQEETRLKNQGSHSVHYVSHQGNQGAGKKFMKKHDKGRGKSGHFQKDYLKCKSWFENKSELNAH

SEQ ID NO: 154739 - protein, 153 aa, Glycine max
  Coding DNA Sequence Number=SeqID_63054
  Homolog annotation: Hit_ID=Q84VI1; Match level="QueryCoverage=75%, HitCoverage=16%, E-value=8e-37, Identity=71%"; Hit description =Envelope-like protein
MAYSPKETSAPGSPAVPSSPHQEQPEFNIQPIQIIPGQASVPEKLVPRRQQGVKIAENPSPATSPREVDTEMDKKIRSIVSSILKDASVPDAEKDVPTSSTPSVSVPDAEKDVPTSSAPNAEALPSPSEEESTEEEDQASEETPAPRAPETAP

SEQ ID NO: 154740 - protein, 114 aa, Glycine max
  Coding DNA Sequence Number=SeqID_63055
MWVQAIGLFAQATCAPEFGLPRPFNQRLLVLHVGGGAVKQRIKSLREERNANLIYTDSATSRAYVQSSSNPLEIFHSLCKTPFTKSEPHRDNPSPVFKNPLQQETHGLLIPFQK

SEQ ID NO: 154741 - protein, 103 aa, Glycine max
  Coding DNA Sequence Number=SeqID_63056
DEFCAPLSFRSSESKWNNKLGGKRVETDSVPFIIREQQAEWINAHRQILRPLSFRNNKLGGKRIETNYVPFIMQEQQAENNKLGGKRAKTNFVHFIIQEQQVG

SEQ ID NO: 154742 - protein, 229 aa, Glycine max
  Coding DNA Sequence Number=SeqID_63057
  Gene Ontology: Mol. function=endonuclease activity
  Homolog annotation: Hit_ID=Q9AY32; Match level="QueryCoverage=22%, HitCoverage=77%, E-value=2e-10, Identity=70%"; Hit description=RRNA intron-encoded homing endonuclease
KKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSFGFRGESVMPLDVLGPHARYTDVFNESIALADSPSARVDYVPALCTTPPVRSYRLNGPVKCSDCGDVSGSLPATLLTRELVYSSTAGREGMTTAPRAPGLLVLATNTNPGASCAKELKSVKCDSRGPGD

SEQ ID NO: 154743 - protein, 192 aa, Glycine max
  Coding DNA Sequence Number=SeqID_63058
  Homolog annotation: Hit_ID=A6FJQ2; Match level="QueryCoverage=19%, HitCoverage=84%, E-value=5e-11, Identity=92%"; Hit description=50S ribosomal protein L5
MRKEKIPHQAPFAIQAAQLLGRAIGAGLFAITPAGERGMCCKAIKLEDPNGHNLDFCIRNPQLNFQGDPMVNESGMRTLLRWATGDGVLMPGLVEMGYLFCAIARSPPSTTYDGVVREDMSRGSGDHGDVRWGAIAQNQAWPIPTQPRHSQPVRTCDVPQQASTWQSTNKGTKVHEAGRLGLKIETERSVAA

SEQ ID NO: 154744 - protein, 74 aa, Glycine max
  Coding DNA Sequence Number=SeqID_63059
MLIFRGVLFPNVEGLVDQAVIDAFLAYHSHKESPDFRMFPRWGRGGCISYNPVLAIRQLGYPMRGAPLEEEIAP

SEQ ID NO: 154745 - protein, 101 aa, Glycine max
  Coding DNA Sequence Number=SeqID_63060
VEFDIPETSDCRTKKKDVWKKAHVIQNQNTVPHVLSRGGYEYLEQNLMVEKTKKKLEEAAQSESTEGVIDPSSPIKRHVKWKMACTKKTGQMCWIEWPQNN

SEQ ID NO: 154746 - protein, 143 aa, Glycine max
  Coding DNA Sequence Number=SeqID_63061
MASCKRKALASVSQARYDRSRFLSQNVWDCYANNVLGWKVLPERNVKLYITKFDEFKREIERRNWHKELTNFFEGSIDMALVKEFYANLYDLEDKSPKQVKVRGHLIKFDDDALNTFLKTPVAIEEGESLPSYSRFCRLRPDP

SEQ ID NO: 154747 - protein, 212 aa, Glycine max
  Coding DNA Sequence Number=SeqID_63062
MAPRKLASKRSRKDKAAEGTSSASEYDSHRFRSAEHQQHFEAIKGWSFLRERRVQLRDNEYTDFQEEIVRRWWASLVTPMAKFDPEIVLEFYANAWPTEEAVRDMRSWVRGQWIPFDADAIGQLLGYPLLLEEGQECEYSQRRNRSDGFDEEAIAHLLCIPGQDFARTAAGKRVRIMRTNMTTLTQIWMTLLLSNIQPSDHNSDLPLPKCQL

SEQ ID NO: 154748 - protein, 78 aa, Glycine max
  Coding DNA Sequence Number=SeqID_63063
MKIAAKYEHVPYAGKNPSRCGCVMRSTHGLPCASDANCGHQAIAALLGVWVDKDLASQRSILRKLLKEATRKLLEEAS

SEQ ID NO: 154749 - protein, 85 aa, Glycine max
  Coding DNA Sequence Number=SeqID_63064
  Gene Ontology: Mol. function=aspartic-type endopeptidase activity; Biological process=DNA integration
  Homolog annotation: Hit_ID=A5B532; Match level="QueryCoverage=92%, HitCoverage=31%, E-value=6e-11, Identity=41%"; Hit description =Putative uncharacterized protein
MVPGNVTIEKPREQWDEEEREMVQYNLKAKNIITSALGMDEYFRVLNCKNAKEMWDTLQVTHEGTTDDMQKRFTHIVNHLASLGN

SEQ ID NO: 154750 - protein, 181 aa, Glycine max
  Coding DNA Sequence Number=SeqID_63065
MVRRKLLPERNVVIYYTEFDEFKEELKRCHWDKKLTDFYDSSIDITIMKELYANLYDLDDKSPMQVKVGGHIVKFDEDTLNTFLKTPVVLEGGENLCTYSICALLRLDPQELATKLCIPGRGFELNADGQPLKILRKNMTTLAQTWSVLSFSNLIPTSHTFDMTLDRAKLIYGIIMKMDMN

SEQ ID NO: 154751 - protein, 97 aa, Glycine max
  Coding DNA Sequence Number=SeqID_63066
MIFQANIYNPGWRNHPNLRWENPPQPQQQQQQPIPLFQNAAGPSRPYVPPPMQQQQQRQQETEAPSQPSLEELVRQMTIQNMQFQQETRAFIQSLTN

SEQ ID NO: 154752 - protein, 41 aa, Glycine max
  Coding DNA Sequence Number=SeqID_63067
MILRGRLLLLMMIDIPLCLITLIKKVADPTCITARTCSGSV

SEQ ID NO: 154753 - protein, 25 aa, Glycine max
  Coding DNA Sequence Number=SeqID_63068
GNGRGIGGYGVEGSLTGSGAGAATG

SEQ ID NO: 154754 - protein, 89 aa, Glycine max
  Coding DNA Sequence Number=SeqID_63069
MAVEWRRKRERRRHFKEKMSLEEAHQHRRPWIRAWRKKEMNDGRGREEHEMLCSKRALNFEPKCHTKLGGKIQISLEFEIEFVEPNFGA

SEQ ID NO: 154755 - protein, 176 aa, Glycine max
  Coding DNA Sequence Number=SeqID_63070
MRGAPLEEELAPVISRGFNKTNVETLQKVRKAWEVVQKKYKELRGSNNGPIGGYRRWLKAHVQATTKALEQETKRARREEHGWNKFRGALWGSNSELKLWREERDQSRVDSKILKDELKVCSRFKRNLSQRLCETETNMLAITSKYQEELNLATAHEHKVVDEYARVYVEKEARGR

SEQ ID NO: 154756 - protein, 235 aa, Glycine max
  Coding DNA Sequence Number=SeqID_63071
  Homolog annotation: Hit_ID=A5BJD2; Match level="QueryCoverage=21%, HitCoverage=2%, E-value=3e-07, Identity=50%"; Hit description =Putative uncharacterized protein
GVAKDWLYYLAPRPIFSWDDLKKVFLEKFFPTSRTTAIRKDISGIRKLSGETFNIERSMIDAASGGSLGDMTPAKARNLIEKMASNSQQFSARNDAIVLRGVHEVATDSSSSTENKKLEGKLDALVNLVTQLAMNQKSTPVARPVHPFQNVAGPSKPYVPPPMQQQQQATEAPPQPSLEELVRQMTIQNMKFQQETRADAILPRKGPITRAMSKRLQEDWARAAEEGLRVLMNLR

SEQ ID NO: 154757 - protein, 79 aa, Glycine max
  Coding DNA Sequence Number=SeqID_63072
MVLKEELASCSRSKRNLSQRLCETKTSMLAIVNKYQEELNLATTHEHKVEGEYAQVYAEKEARGRVIDSLHQEATMWMD

SEQ ID NO: 154758 - protein, 66 aa, Glycine max
  Coding DNA Sequence Number=SeqID_63073
MTKSKGKDPLEGLGGPIDEDMTKSKGKDPLEGLGGPMTRARARKAKEALQQVLSKVVICIMAQMED

SEQ ID NO: 154759 - protein, 81 aa, Glycine max
  Coding DNA Sequence Number=SeqID_63074
  Homolog annotation: Hit_ID=A5AW48; Match level="QueryCoverage=98%, HitCoverage=34%, E-value=3e-08, Identity=37%"; Hit description =Putative uncharacterized protein
MPFGLCNAPGTFQQCMLSIFSDFLESCIEGFKGALSRILAKWPFHYPICCKKRWSLILTPWCKDAFDCLKRAVTTTLIVQL

SEQ ID NO: 154760 - protein, 108 aa, Glycine max
  Coding DNA Sequence Number=SeqID_63075
MSGFTCDSPQISASPHQLPLAPYASGPYNAQWNAPGLLHDKHTLRSSRILGEMEVDEPWLGLWLPLNYQIDMGASFLAAKFISWLVFLVCAKGGVRHWKCGRQTLWLI

SEQ ID NO: 154761 - protein, 73 aa, Glycine max
  Coding DNA Sequence Number=SeqID_63076
MVKEFYANLYSPEDQSPKQVRVRGHLIKIDADSLNTFLETPIVLEEGETLPTYFKFTRMRIDPQEFAARLCIP

SEQ ID NO: 154762 - protein, 34 aa, Glycine max
  Coding DNA Sequence Number=SeqID_63077
MEEIHGEEDEEQGIKIHGKLVGHGSSSSMESFDP

SEQ ID NO: 154763 - protein, 110 aa, Glycine max
  Coding DNA Sequence Number=SeqID_63078
MLLSNGGDNLTLQRLLRTKSRTGFRVTQNFSNLLTQKHHYFLIKNLNLQHSWPAQNPKKALRRTLKKFSSYFNKKKRKNLQRKRLNLRKTLMIKTMILSTRMRMIVSASH

SEQ ID NO: 154764 - protein, 250 aa, Glycine max
  Coding DNA Sequence Number=SeqID_63079
AISQFQGYPVVLEEGQECEYGQRRNRSDGFDEEVIAHLLCIPGQDFARTAARRRVWIMRTNMTTLTQIWMTLLLSNIQPSDHNSDLPLPKCRLVYAILTRMSIHVAQLIADAIYLFAGMAPTRHPLDPDKSNRALGFPALITGLCQSFGVPVAPSMRQAQGDAPQAVDAPPPHQAGPAGSFDTEQYLRHLVRQQAANHRAHFRAEVTWPGDWPEAQAGEAPTEAPDEADEAHEDEEMTDLLDFLGGSGAT

SEQ ID NO: 154765 - protein, 200 aa, Glycine max
  Coding DNA Sequence Number=SeqID_63080
  Pfam annotation: Domain name=G-patch; Domain location=71-110; Score =24.8; E_value=0.00019; Accession=PF01585.14; Description=G-patch domain
MDINPPYSCLVGAPVVPTQWGVVPSTLHQKAEIRRGRGTWSSCQARKISCISSVDSLFGQPCLSDAAVMMARVMLGNGYEPGMGLGKNNGGITSLINTQGNRGKYGLGYKPTQADMKRSIAGRKNNGQSSRWRQEGEGSPPCHISRSFISAGSGDKGQAFAICEDGIPSTLDLVRPCPPDFQLGNWRVEERPGIYTTSIM

SEQ ID NO: 154766 - protein, 117 aa, Glycine max
  Coding DNA Sequence Number=SeqID_63081
  Pfam annotation: Domain name=Transposase_23; Domain location=34-104; Score=-6.3; E_value=0.0058; Accession=PF03017.5; Description =TNP1ENSPM transposase
MELALPLEPEVGPSAVRVNTKESCVDPSTTDPDMGDSDKCGLYIEENHSRLVALGKVYEGSTAVHNIPLLHGQVKDGVEEVKDADAPVPVPTDEVILVGQTLNTFLAWPTHLVKCLL

SEQ ID NO: 154767 - protein, 76 aa, Glycine max
  Coding DNA Sequence Number=SeqID_63082
MAVEWRRKRERRRHFKEKISLEEAHHHRRPWIRAWRKKEMNEGRGREEHEILCSKRALKSEPTNSRSSPRFSTECA

SEQ ID NO: 154768 - protein, 85 aa, Glycine max
  Coding DNA Sequence Number=SeqID_63083
MMTTKDDDKGDEQKTQRSKNNSSESKNISSESRTSQEFKNQEEFKTQEESLESRIKIQDSRSQESRSRFKTQDSRMKKRLNQDKY

SEQ ID NO: 154769 - protein, 116 aa, Glycine max
  Coding DNA Sequence Number=SeqID_63084
  Homolog annotation: Hit_ID=Q5XM22; Match level="QueryCoverage=36%, HitCoverage=23%, E-value=1e-09, Identity=64%"; Hit description =Resistance-like protein HAAS-2
EHPELKLSSHGRKMAKFGRPALEIEGLVAASGLSPLIAWAFHSFELLHVDDAVEMLVELLEVSAAKVRPKMIQCRGSYVRLSWLRDVYELKIEACEWIVAVRAYLLHLLGCKLFAN

SEQ ID NO: 154770 - protein, 31 aa, Glycine max
  Coding DNA Sequence Number=SeqID_63085
PIPLKIIEATRSNNVVLVFMGALRVNSRLDT

SEQ ID NO: 154771 - protein, 122 aa, Glycine max
  Coding DNA Sequence Number=SeqID_63086
MVPRGGDERDECLFHLGESHDMETCPVVEELLQRLMDCGQLEVFIGGKEEPQICMQSKEKKVPLTPKALVICFTRKGTGSTPIYPRAAPKPTPFAYQSNKAVPWKYTPLASSERVTTEVDSL

SEQ ID NO: 154772 - protein, 84 aa, Glycine max
  Coding DNA Sequence Number=SeqID_63087
MSEKPYRSTGGCACALRSRGCQNCFMAAQPFLTHSTPSWKRGGKEADPQAHGTVKHNYWLRCFMHWEPRDEGLEPHVCEPSNHA

SEQ ID NO: 154773 - protein, 70 aa, Glycine max
  Coding DNA Sequence Number=SeqID_63088
  Subcellular localization annotation: CTP_CleavageSite=42; ConfidenceScore=5.11e-01
MYPPLELIHKRCTLSCSQYYNPRKRKNQKNSQAVSPFNLLARGRRKKQKNSQAISPLNLLTRERRNEEEE

SEQ ID NO: 154774 - protein, 252 aa, Glycine max
  Coding DNA Sequence Number=SeqID_63089
  Homolog annotation: Hit_ID=A2Q4S5; Match level="QueryCoverage=83%, HitCoverage=33%, E-value=7e-21, Identity=31%"; Hit description=IMP dehydrogenase/GMP reductase, putative
  Pfam annotation: Domain name=DUF1723; Domain location=165-214; Score =56.8; E_value=7.2e-14; Accession=PF08330.1; Description=Protein of unknown function (DUF1723)
MVRTRGLHRVVGTGRGRDLSQDVAENVPRRRRPTASARRQQVTQRVEDVPQFPKDVPQLAEDVPHASDGSPERTGAADGAESDRVASDGTIADDEGFPGGPRDPSVLIGFADHVAHNIWRGQEQPDLMLVSHGRKVDKFGRPAAEIEGIIAATGLDPLIRCSVITTDPGLISAFVVRWHSETSSFHLPVGEVTITLDDVSSLLHIPITGALHSFGPLATSDAVALLTELLEVTPDEATAETRQAGGPHVRLS

SEQ ID NO: 154775 - protein, 105 aa, Glycine max
  Coding DNA Sequence Number=SeqID_63090
  Pfam annotation: Domain name=zf-CCHC; Domain location=86-103; Score =31.8; E_value=2.5e-06; Accession=PF00098.14; Description=Zinc knuckle
MSLATLFGKLQEHEMELQRLNQNEETDKRKRSVALKATSSLQEEEEDEEDFSLFVKKFHKFVKMRRIERRQNFNHGKRFQEDSPTLRCYKCNQIGHIKANCPSNE

SEQ ID NO: 154776 - protein, 95 aa, Glycine max
  Coding DNA Sequence Number=SeqID_63091
MQSQGLSLPPEPLVSPSGPRVSTKGSCVDPSGNDPETGDSDRRGLYIEAYPARLVALGEFMRDPLLFITLLCCLAKHFHTFLAWATHLGQSFITA

SEQ ID NO: 154777 - protein, 228 aa, Glycine max
  Coding DNA Sequence Number=SeqID_63092
VSVEEVTDADAPVPVPTDEVSLVGQALHIFLAWPTHLVKSLSQQVAVSPAKPPPKPDPEVDDPLYLMTLTIPELFLRPYQVRWDATVFGVFNLDFPLYIKHEDLSKIAHGGQCRSISVLQLWILHLTETCMRVGNSDIYGFLEPQSIQRSGQSQFESESYINSWMHSSQRDVYLGAYLNGFHCSRHWQMVVILPKEHLVVWFCSLHNRPDNYLKGIINRLVFFSIHLH

SEQ ID NO: 154778 - protein, 197 aa, Glycine max
  Coding DNA Sequence Number=SeqID_63093
MTQELVARGDTLRLSAPRHSVTPSMIDEQRPIWSSAPFPEMSAFSDGDFSSLTSYLELRRSEFLIGGYVGARALLLSAAPGGRPDDTRRYLTVIRTLLSSRGGGPDDKQRKIWSFCTLVSSRGGGPDDTRRYLTVIRTLVSSRGGRPDDTRRYLTVIRTLVSSRGGGPDDTRKYPSGYPYKHSFAICKTERLIACRG

SEQ ID NO: 154779 - protein, 127 aa, Glycine max
  Coding DNA Sequence Number=SeqID_63094
MRMPKESGQQGQKGRKGMPMPSLQHPRGSNPSKHLMEFPSEAIAGIHPAPNDVRRSSTIPHRQSFGRGNSRKGPSNPLSRSGMTLTQLASTMGVSRGIPLKKCLALKYKVQHLMDAGWLTSKRIGPM

SEQ ID NO: 154780 - protein, 76 aa, Glycine max
  Coding DNA Sequence Number=SeqID_63095
MAAEWRRKRERRRHFKEKMSLEEAHHHRRPWIRAWRKKEMNEGRGREEHEILCSKRALKSEPTNSRSIPRFSTKCA

SEQ ID NO: 154781 - protein, 97 aa, Glycine max
  Coding DNA Sequence Number=SeqID_63096
  Subcellular localization annotation: CTP_CleavageSite=30; ConfidenceScore=5.07e-01
MYPLLFSVTTTHVDVPSTCTTKDVPSNVLRQSSQAGKGRIKRILRLCHFEFFDKGEGRHKRIQAVSPLFFWKREKRDTKRIQAVSPWRILFGKGRRE

SEQ ID NO: 154782 - protein, 20 aa, Glycine max
  Coding DNA Sequence Number=SeqID_63097
MIMCCLGIMKVYELCVSDKS

SEQ ID NO: 154783 - protein, 67 aa, Glycine max
  Coding DNA Sequence Number=SeqID_63098
MGWDRARPGHVSQCFTSAGIMFEEEEAAIGEEAPQDPPCFVRPCHYNFQLGNWHVMSQSEVYTADSM

SEQ ID NO: 154784 - protein, 41 aa, Glycine max
  Coding DNA Sequence Number=SeqID_63099
MHPPLSSTEPPMRGKYEKGEGETGVTYFKSFWVGTIVIEIN

SEQ ID NO: 154785 - protein, 178 aa, Glycine max
  Coding DNA Sequence Number=SeqID_63100
MASRKHKSIGSRPTTQYDTRRFSSLDAWNRYTDNVLGRNILPERKVELYHTELDDFKTELKRRNFHKCLTNLVDGSIDLALVKDFYANLYSSKGPSPKHYRVRGHLVKIDADSLNTFLETPVVLAEGENLPIYSRYCRLPTDYREIKVALCIPGRGFILNTEGYLGKILRKDLTTLAQ

SEQ ID NO: 154786 - protein, 42 aa, Glycine max
  Coding DNA Sequence Number=SeqID_63101
MKKKAKKAYITWDDNDMDSYEESENEVVNLSLMTKNYESDEE

SEQ ID NO: 154787 - protein, 93 aa, Glycine max
  Coding DNA Sequence Number=SeqID_63102
  Subcellular localization annotation: CTP_CleavageSite=44; ConfidenceScore=5.03e-01
MGALQVVLCAQRAPSSLKFLPVHWFGGGMVWIPCGQPVATCPSRASEARLTGALSKGGKMRGVATNVYLWKTSEKPKETGQKENSKFGSCIYA

SEQ ID NO: 154788 - protein, 118 aa, Glycine max
  Coding DNA Sequence Number=SeqID_63103
EEQGIKENSPNKKIEETKEHHLDEDALIPHDVSSTGACRHRIFFINGFLMLSWKMNDSGMEKEERERRGHFKEKMSLEEAHHHRRPWIRAWRKKEMNEGRGREEHEILCSKRALKSED

SEQ ID NO: 154789 - protein, 108 aa, Glycine max
  Coding DNA Sequence Number=SeqID_63104
MGYMGVRELNWRWATGDGGFMRALWMVKLPAFIVDHRVVPGDMSRGSGDLGDVRRAPGSQQIKGTKTTKQGGLWWLASCEFCVICGLWPLVIDYQGLENEVRKLREPL

SEQ ID NO: 154790 - protein, 76 aa, Glycine max
  Coding DNA Sequence Number=SeqID_63105
MDEFDTQVARPGAQPSPSGGGVHMAQEKETATDQIPELSPAPIPDDAMPSAPASEPEQPIPQDSPTAQVLDLNEHA

SEQ ID NO: 154791 - protein, 216 aa, Glycine max
  Coding DNA Sequence Number=SeqID_63106
  Homolog annotation: Hit_ID=Q2HW90; Match level="QueryCoverage=66%, HitCoverage=36%, E-value=2e-16, Identity=29%"; Hit description =Putative uncharacterized protein
MAEVSTEVIASLTQYYDQPLRCFTFGDFQLKPTVEEFEEILGCPMGGRKPYLFSGFYPSLARISKIVKISAQELDRGKVVLFPNVDGLVDLAAIDAFLTFHDRKKSPVIAILADLYDTFDQRCEKNSARIVCCTPTLYVWLVSHLFRQEERHVFPLEGHHSCPEKKEANWDRLLASKEGAFIEERLRVVEGFGDYPFADMTDLCLVPDIVIPPKFK

SEQ ID NO: 154792 - protein, 47 aa, Glycine max
  Coding DNA Sequence Number=SeqID_63107
MENNMKNKELKSMATEWRRKKNDWRCHFKEKMSQEEAHHHRKPWIRA

SEQ ID NO: 154793 - protein, 22 aa, Glycine max
  Coding DNA Sequence Number=SeqID_63108
MGVQIAPRAHLGPLQHIPPGRA

SEQ ID NO: 154794 - protein, 111 aa, Glycine max
  Coding DNA Sequence Number=SeqID_63109
MGTNQNGKRFYQVKVKGLDVTSLKELERLMGPLQRQAFRKVYGKILDLTVAEVFTEAVVSLAQYYDQPKIAAVIGDSAKELGRMKQIRNGIVGLPQKYLEGKARDMASHYK

SEQ ID NO: 154795 - protein, 119 aa, Glycine max
  Coding DNA Sequence Number=SeqID_63110
MGDTPSPLEDYTSSPSEGYTTSPSEDYTSSPSEGYASSPSEDYTSSPSEDYTSSPSEDYMSSPSKDYLSSPSRGLHALTFRGLHVLANKGLHALTFRGLHVLSIRGLHALTFRGLHVTP

SEQ ID NO: 154796 - protein, 89 aa, Glycine max
  Coding DNA Sequence Number=SeqID_63111
MLCISIGELIIMLQLSLTILAQKGSLDYPSLSLKGEGQKHLSGWRGRQVNVQRDGLRLSIFWILYPNDAKPQAVHSTEEMEPHKGAHQV

SEQ ID NO: 154797 - protein, 150 aa, Glycine max
  Coding DNA Sequence Number=SeqID_63112
MANQEEWVPFVDILALLIFGVVLFPNVDGLVDLAAIDAFFAYHHSKESPVDRRQNNQLVFSMEGRKGGSSLLVWGLPKHPIDRDKGFPMRGAPAEESLSPFLVIDFGAQSSKIIQRVHKAWEISLRRNKELRGIRSGIIGGYHEWLKVRT

SEQ ID NO: 154798 - protein, 184 aa, Glycine max
  Coding DNA Sequence Number=SeqID_63113
MRGAPTEESLSPFLVRDLNAQSLKVIQRVHKAWRNPLRKDKEFRGIRNGVIGGELSAPEEDEEVQAKKLELGKVRLAKEKFKLAATHIRKECTELQEENATTARALEQETKRARKEEYGREKFRGALWGSNNELKLRREERDRSRVHGMILKEDLVACARSKRSLAQHLEATDVLPEDGGVFCG

SEQ ID NO: 154799 - protein, 84 aa, Glycine max
  Coding DNA Sequence Number=SeqID_63114
  Subcellular localization annotation: CTP_CleavageSite=39; ConfidenceScore=5.45e-01
MPSTSQGPKNGRMSSSKDSKRMFIRITTRVFPRIIGPAASGMIQGCRMTKLGLCLSSGPPPLDDKKGADNRKVSPRIIGPAASG

SEQ ID NO: 154800 - protein, 157 aa, Glycine max
  Coding DNA Sequence Number=SeqID_63115
  Subcellular localization annotation: CTP_CleavageSite=69; ConfidenceScore=5.24e-01
MTIQNMQFQQETRASIQSLTNQMGQMATQMNQAQSQNSDKLPSQTVQNSKKVSAITLRSGNQIQVPPPVAAPAPEHVKLHSTPEKKDEIVSQKRKLPNKNFHAGGPSSINFDLQQPPIPLPFPPRAIPNKKMEEAKKEILETFRKVEVNIPLLDAIK

SEQ ID NO: 154801 - protein, 52 aa, Glycine max
  Coding DNA Sequence Number=SeqID_63116
MTGDASEFTTISPKKGHVTYGDNNRGLKHNLLSVSQLCDSYRVSFDSQKICH

SEQ ID NO: 154802 - protein, 130 aa, Glycine max
  Coding DNA Sequence Number=SeqID_63117
MVSYAAITNEAEVPEESEEVQALKVELEKTKVAKEKLKVAVTRVRKECDELKDINMTEAEALEWETKKVRKEEWCRNKFRGALLGNRNELKLRKAEREKSRMESMMLEDKLKSFQRSKRNLKEQFEPDGR

SEQ ID NO: 154803 - protein, 78 aa, Glycine max
  Coding DNA Sequence Number=SeqID_63118
MSRNVSALIGKSVPQILEKCKDPGPLQSTDVVIHLANRSVAYPVGFCRNLPFGERATRDSRDACSMKGIRAESPPTFI

SEQ ID NO: 154804 - protein, 195 aa, Glycine max
  Coding DNA Sequence Number=SeqID_63119
  Pfam annotation: Domain name=G-patch; Domain location=13-57; Score =27.7; E_value=4.1e-05; Accession=PF01585.14; Description=G-patch domain
METSPLLPCFSNAALMVARVMLRHGYEPGMGLGKDSHGNADVVDIWGNPHKYGLGYEPGKPGRRNAPSRLRADRAWPSHVSQCFTRAEIMFEEEVAAIGGEAPQIRQVSCEDRSLEDPNNEGLIIDFDREVSQTINEEEEEDVLSPELERLIAQEEREMKPHQEETELIDLETGEGKKEVKVGTGMTAPHLSAKI

SEQ ID NO: 154805 - protein, 89 aa, Glycine max
  Coding DNA Sequence Number=SeqID_63120
  Pfam annotation: Domain name=zf-CCHC; Domain location=20-37; Score =26.7; E_value=8.7e-05; Accession=PF00098.14; Description=Zinc knuckle
MERCHNFDNGKRSREGSPTLKCYKCNRPGHIKAHCPTNESWPKKKSHEERRSKKAYIAWDDNDSSDGSEKEINLLSKDYESDENISQED

SEQ ID NO: 154806 - protein, 66 aa, Glycine max
  Coding DNA Sequence Number=SeqID_63121
MEKSEKKNHSEKKLKKAYITWDENDMESSEDSENEEINLCLKAKSYESDEEKRTWHINLLLQEKLQ

SEQ ID NO: 154807 - protein, 73 aa, Glycine max
  Coding DNA Sequence Number=SeqID_63122
  Subcellular localization annotation: CTP_CleavageSite=34; ConfidenceScore=5.22e-01
MEFKGRESANSDLYWFGHTLVPTSSPQASRLRVPLSFVGSLRCLFAFNVSLDIEIPRLTDGSLLVELLWRLDL

SEQ ID NO: 154808 - protein, 102 aa, Glycine max
  Coding DNA Sequence Number=SeqID_63123
  Homolog annotation: Hit_ID=A5AV98; Match level="QueryCoverage=93%, HitCoverage=12%, E-value=2e-21, Identity=49%"; Hit description =Putative uncharacterized protein
MTVADSTKTTLPKIESVEKFMGLVGEHSQTADKSLVGTLMSTLTTMKFDGSRTMYKHVIEMKNIATRLKTLGMTMNENFLVPFILNSLPSEYGSFSNGAIIP

SEQ ID NO: 154809 - protein, 101 aa, Glycine max
  Coding DNA Sequence Number=SeqID_63124
MEGERLMPSSRMIDQGRLEVGNEGGEEQHICMQSTDEEGLGKPKPLVIYFTRDAAPQTPRYPSVVRPIPFPYQNSHTVLWRYAPPSERKEEATDISSLSAK

SEQ ID NO: 154810 - protein, 114 aa, Glycine max
  Coding DNA Sequence Number=SeqID_63125
VHLDHSVHFEHSEHSEHYVYSEHSVAGDSEHFDFEHSATNFHTENMAQPPPCERTVATYPFAGERGKVHGKPVMKNIPDSGVIFTFEEGISTFHVDKNGALAPTYPPSKKKSDL

SEQ ID NO: 154811 - protein, 100 aa, Glycine max
  Coding DNA Sequence Number=SeqID_63126
MPPIVVMTLARVKVKNLVIIIEGAIVHILNITPKEEKRIEGLKRLNNSLLAIILAKREKFHWLPLAFKGVPSIGGLPLFGNEGIHGDPPVEYWNDLKSAP

SEQ ID NO: 154812 - protein, 103 aa, Glycine max
  Coding DNA Sequence Number=SeqID_63127
EFIFLPRGLLELSSQDALLAENKLLSKQHEALTKTLSCTLCGGAHGSGLRNPTKETSHEVNYMGNQPRQNLNAGGFSGFQHGQPYQQHNQWRTHPGNQFNKDQ

SEQ ID NO: 154813 - protein, 112 aa, Glycine max
  Coding DNA Sequence Number=SeqID_63128
  Homolog annotation: Hit_ID=Q84VI1; Match level="QueryCoverage=100%, HitCoverage=16%, E-value=5e-34, Identity=68%"; Hit description =Envelope-like protein
MASSPKETSVPSSPAVPSSPHQEQPEFNIQPIQIIPGQASVPEKLIPRRQQGVKIAENPSLATSPREVDTEMDKKIRSIVSSILKDASVPDAEKDVPTSSTPSVSVPDAEKD

SEQ ID NO: 154814 - protein, 61 aa, Glycine max
  Coding DNA Sequence Number=SeqID_63129
MSVKNLVGRLGVHDKTNHTLTSQVTLTRLKGALKSGDPKAYTPKSPSGPLPPDSGPTQKTF

SEQ ID NO: 154815 - protein, 102 aa, Glycine max
  Coding DNA Sequence Number=SeqID_63130
MRTALPQLTFVLKFSNRVTRMGASRANLWRGIVMLDFKLLAHFPHHLVIQVGAVVRDNLPWRTVSADDLSLDEPDHYTPRDIGLGGRLDPLGEISIATRMKR

SEQ ID NO: 154816 - protein, 135 aa, Glycine max
  Coding DNA Sequence Number=SeqID_63131
MARGGTGLMGSMRRPSPSCYRQAQGDAPQAASAPPPPHQAGQAGAFDMEQYLRHLVRQQAANHRAHVQTHDCLYQMSLSMQSQGFASFSCPTPDQFRAEVAWPGDWPEAQAGEAPPEAPGGGEEAHEGRGDGRFA

SEQ ID NO: 154817 - protein, 47 aa, Glycine max
  Coding DNA Sequence Number=SeqID_63132
MNEADEVDDGHANRVDHDEGSWPQIRRLPRSPMVNQRQLPRGKREQE

SEQ ID NO: 154818 - protein, 97 aa, Glycine max
  Coding DNA Sequence Number=SeqID_63133
MVASFGYHKERDGSWVKKDAQSNDDEGHLLVEGDSSLLQSILDRFDGLQTYVGERFDSLECHVDTRFVEMNSRIAKVEEDVTIIHDCFDLPPPLPLV

SEQ ID NO: 154819 - protein, 49 aa, Glycine max
  Coding DNA Sequence Number=SeqID_63134
MVWRLQSSSLLLPSAAIELQEAKDSIDEEDPRPTSYTWSYIMWYQNIFV

SEQ ID NO: 154820 - protein, 245 aa, Glycine max
  Coding DNA Sequence Number=SeqID_63135
  Homolog annotation: Hit_ID=A7UQU7; Match level="QueryCoverage=62%, HitCoverage=26%, E-value=4e-16, Identity=32%"; Hit description=IMP dehydrogenase/GMP reductase, putative
MYDQLDEASRTTTQQIAGYLTLFQCWIYEHFASVHQCVTDDTYQETSPRASRWLTSKAHMKGITGAPYRVRCDALTVTNVSWLPYTEHQGVRAFELISSFQGQLRWGPMVVTARPERVVRQFGYIQSIPPPPVSAQLSHDDIDDSWMHFSEHVLPVGELCLVPRQVGDQPRDALAADPEEYIQPSSPQVPVTFDPPRHAVMIMTDMRRLHRVWSMCSTFRMVTAGTELYEIMQDCLTIARGGASA

SEQ ID NO: 154821 - protein, 137 aa, Glycine max
  Coding DNA Sequence Number=SeqID_63136
MAEQLIHDRVEMEFLEGFWETLEANERCRFRGTIRLTTTSLVHPEEPARTLQRTVECILPTPTPYRLVEPVQVIEVSSSEEDPEEDPEELPPEPAVDALDFLEDDKDPLPDVDSPEDVMSASEADSTEESGPGGTAK

SEQ ID NO: 154822 - protein, 89 aa, Glycine max
  Coding DNA Sequence Number=SeqID_63137
MGPSVATTKRAHREEHGQNKFRGALWGSNNELKLQREERDQSRVDSLILKDELKRLCETETNMLAIVSKYQEELNLATAHEHKVADEYA

SEQ ID NO: 154823 - protein, 91 aa, Glycine max
  Coding DNA Sequence Number=SeqID_63138
MERCHNFDNGKRSQEGSPTLRCYNNRPGHIKAHSPTNESWPEKNEKKTHKERRSKKAYIAWDDNDSSDGSEKEINLLSKEYESDENISQED

SEQ ID NO: 154824 - protein, 128 aa, Glycine max
  Coding DNA Sequence Number=SeqID_63139
MENNAATATVVSSAAEADPTLLAIAHHPIPNVVGRERSALGYISNPHPGYNRVAYPYGLPPNYTPPVIRDDTGHVLNPILEGEPPRQSDEVHEDRQEHAQGDIESYSPFPVEGPAPNTLPQPNLTGEP

SEQ ID NO: 154825 - protein, 132 aa, Glycine max
  Coding DNA Sequence Number=SeqID_63140
  Pfam annotation: Domain name=G-patch; Domain location=1-42; Score =14.2; E_value=0.0036; Accession=PF01585.14; Description=G-patch domain
MVARVMLGNGYEPVMGLGKNSGGRTSLISARGNRGKFGLGYKPTQADIIKSVAGRKSGSQGSQLGWKVEGGPPYHISRSFISAGLGHEGQVVAICEDDSSSGSDLVRPCPPCFRLGNWRVEERPDIYATSIM

SEQ ID NO: 154826 - protein, 288 aa, Glycine max
  Coding DNA Sequence Number=SeqID_63141
  Homolog annotation: Hit_ID=Q2HW90; Match level="QueryCoverage=34%, HitCoverage=19%, E-value=4e-11, Identity=42%"; Hit description =Putative uncharacterized protein
ELDHRKQVENGVVGIPRKYLEAKARILAGKGEWAPFIDILTLLIFGGVLFPNVDGLVDLAAIDAFLAYHDHKESPVVTMLADLYDTFDRRCEKSSTRIACCTPALYVWLVSHLFRQEEHLSTGSLDGRKEEPEFLFHAEDFQMVPLKDELAHVISRGFNKTNMETLQKVHKAWEVLQKKDKELGGNNNGPIGGYRKWLKAHVQGLDWLPSLRTAKREEVEAPEEDKEVQALRAKLEQAQIVKEREEHGRNKFRGALWGSNSELKLQREERDQSRVDSLILKDELKACS

SEQ ID NO: 154827 - protein, 72 aa, Glycine max
  Coding DNA Sequence Number=SeqID_63142
MEEMHGEDDEEQGIKLHVKLLILGFYSSIESFASRRSMAMEWRKKGGDWRCHFKEKMSQEQAHHHQKPWIKA

SEQ ID NO: 154828 - protein, 114 aa, Glycine max
  Coding DNA Sequence Number=SeqID_63143
MHHRPQMHRHHLIRLIQLGHLAWSGIYSTWFASRRPTTGGSLSLQSQGFASFACPTPDQLRAEVAWPEEIGLRPRRGGAHERAPGDAEEASWMSGVMDNSFIRFLRVGVSRTDC

SEQ ID NO: 154829 - protein, 146 aa, Glycine max
  Coding DNA Sequence Number=SeqID_63144
MSLATLFGKLQEHEMELMRLHQHEENDIKRKRIAFRASSSFIQEESDKEDLTETEEDDDDFRLFVKRFNKFLRNKRNKIKSNINTKKKEEDSSLAPSCYESNQPWHMRSDYLVFERRIEKSDKRNLKEKKAYITWEENKKNNSSSD

SEQ ID NO: 154830 - protein, 81 aa, Glycine max
  Coding DNA Sequence Number=SeqID_63145
  Subcellular localization annotation: CTP_CleavageSite=38; ConfidenceScore=5.47e-01
MSKPRTSFNHSNTKIALFFVLGTPKPLNLGLRHRFSLRMSGLGRELSKLGTPHPFLELPQFKLVGIMGFTLITNLVSWQSG

SEQ ID NO: 154831 - protein, 87 aa, Glycine max
  Coding DNA Sequence Number=SeqID_63146
MDGEELPSPVNSDVVKRYYALKSGAIERTAASKSRIVSGHGQKSRQINGRNQPRYIGTDRVGLGSRPTDRCPFPALNEQRTSLQGSP

SEQ ID NO: 154832 - protein, 64 aa, Glycine max
  Coding DNA Sequence Number=SeqID_63147
  Subcellular localization annotation: CTP_CleavageSite=20; ConfidenceScore=5.10e-01
MGGVAKKGKKNSGAVQMGPLVAAPWNEKPRGLVGKNSVGTSSEGLCGVAIVSLNSEEWKGTNHE

SEQ ID NO: 154833 - protein, 83 aa, Glycine max
  Coding DNA Sequence Number=SeqID_63148
MIITKDDDKGDDKKLKDQSKNNSSESKINQRTTQVNQRSIKEQLKRIQDSRRKFRVKNQDSRFKISRIKIKIQDSRFKNQEKA

SEQ ID NO: 154834 - protein, 69 aa, Glycine max
  Coding DNA Sequence Number=SeqID_63149
MSLATLFGKLQEHEMELLRLHQHEENDKKKKGIALKASSSIQEESDQDNDPEDDDDLSLFVRRFNKFLK

SEQ ID NO: 154835 - protein, 90 aa, Glycine max
  Coding DNA Sequence Number=SeqID_63150
MVEGSELKCSPPLLLLVLWAPQSQAPGLWRPHPFQRKKAGLLARPPMRKLLHAHNGGQAQALKALHDDGLPSMDALEHGVKHLRSENKIY

SEQ ID NO: 154836 - protein, 162 aa, Glycine max
  Coding DNA Sequence Number=SeqID_63151
MKEPLMMNPNENIHSIQKRFTHIVNHLASLGKIFPNEDLINKVLRCISREWQSKEHEMELQRLNRNEEIDKKKRSIALKASSSMQEENEEEDSNDEEDFSLIANCPSNEECPEKSDKKRYDERRTKKAYIAWDDNDSSDGSEKEINLLTRDYESDENSSQEG

SEQ ID NO: 154837 - protein, 133 aa, Glycine max
  Coding DNA Sequence Number=SeqID_63152
  Pfam annotation: Domain name=zf-CCHC; Domain location=94-110; Score =13.7; E_value=0.013; Accession=PF00098.14; Description=Zinc knuckle
MSVGEYTAKFNELLQYWPQYQDARNEEDLCAQFENGLRIFEDKMKERQARGVGGPQRNHPFRGDSNKRMKPYASNKGKQPMAASNMSQSRGTRVQCFQCGGPHLRKNCPQLQQTQENRCYVCGRWATMLENEG

SEQ ID NO: 154838 - protein, 65 aa, Glycine max
  Coding DNA Sequence Number=SeqID_63153
EGDILTTCVFAVFHLVLLFVVKEIFGLWKAKPLLDLPWSFNSGNWSDSKALDSTGLSCCAIMRNR

SEQ ID NO: 154839 - protein, 66 aa, Glycine max
  Coding DNA Sequence Number=SeqID_63154
  Subcellular localization annotation: CTP_CleavageSite=22; ConfidenceScore=5.27e-01
MWYHPQGNSLSVSTRHSHLGKLSSLGSSSSMDSFASWKMNGSGIEKEEREETPLQGEDEYRRSSPP

SEQ ID NO: 154840 - protein, 111 aa, Glycine max
  Coding DNA Sequence Number=SeqID_63155
MWAFHTGHQLDWAHLVRYRMHKALRLNAPLPYPHLITLFFCHFQIPLDSEPYVPIKRSFLIGAVVIALGSKRALNPLMKKATYQLKIIPLFFEGLWTSLMFFLMLPKGERT

SEQ ID NO: 154841 - protein, 65 aa, Glycine max
  Coding DNA Sequence Number=SeqID_63156
MERTQFSPHQESCEECCSSLDGESSSDGAKYSATWDEEEGAATLCHWDGSWKGVHGGQEEAQEGG

SEQ ID NO: 154842 - protein, 151 aa, Glycine max
  Coding DNA Sequence Number=SeqID_63157
MAILVNDKDFRSRGRLPCGRDSHLRGRCVGLQVLPYVVARGPQVYPSNLPNIRVDGRVVTGSSFLHWDELCDKLLGEVSPENARKGAALKLTWLLSILRAPFLEEPTIHQVQCKCRAYIIWSGGRLEYRATCHGDLVGYRSRIDHMESHEI

SEQ ID NO: 154843 - protein, 56 aa, Glycine max
  Coding DNA Sequence Number=SeqID_63158
  Gene Ontology: Biological process=protein localization
  Homolog annotation: Hit_ID=A7PSP9; Match level="QueryCoverage=98%, HitCoverage=3%, E-value=3e-21, Identity=78%"; Hit description =Chromosome chr6 scaffold_28, whole genome shotgun sequence
MFDTVIHSYTSCPYTWDEPCYPRRLIVEVPGERVLGSYDLDDVKEYVPVYLPSTSE

SEQ ID NO: 154844 - protein, 1736 aa, Glycine max
  Coding DNA Sequence Number=SeqID_63159
  Gene Ontology: Biological process=protein localization
  Homolog annotation: Hit_ID=A2Q3V3; Match level="QueryCoverage=51%, HitCoverage=52%, E-value=0.0, Identity=72%"; Hit description=C-5 cytosine-specific DNA methylase; Vacuolar protein sorting- associated protein
  Pfam annotation: Domain name=DUF1162; Domain location=1415-1717; Score=-94.3; E_value=0.027; Accession=PF06650.3; Description=Protein of unknown function (DUF1162)
MKEEKDSQVVLLSGNLSSPGAAVGEDCVSGPNIEVDQYSDVAMLADACFAMHYESSRTDVLCHKIFMYLNNADIHCYPHIAGLLIGFFHRLSAYSSSFEKSSASNTVDISKIFSSFGLQKFGFSNYFEFGFTDSACIPLDCFPFVTIHNSGSLGNLESALVHAIPDWRKYFILRDRKIKSSNINMRRGSKFFQVSPSKSKSDFVYSHETGIASTCDIFSTELHLFGIRAHFHDSSCIIGTIMVPTSKSSLLFCEDSMDILSSSEGLALTSSWGPQNFQDNLWGPSSPNLSPILNVRVRKGQNISSTIDLEISIGIQHVYCMLPSEYLSIIIGYFSLSDWGGASGDQCFSDEQSDTDVKNEMKITYKFEILDSNLIFPVVSNDRQFIKIEMPQLYCSFIENSGVDEVLKNIPPECLVPIHKLAKRNDCLNVFGRDLFVSFLLYKNDLLGLATVERNTEFLTSALIAPINADVWVRIPVGGKSNCKSTSSICFMTSISSCHIVAEDLGFSSVVFYSPRDSILAKCTPTSFSMSVLSISFSQSIGGKNKLDLCLSSIDIWLHLAEWTEVVKFLNHFRLHLERTPVNAITNSLSVDASNSVKKSTVQHSSSFLDSESTSAPFTSQEIENDVFIIKSENFCITFHIPVWVGEEPHVEFQHSQGLNVTPLSVSSDIVEEKDAKFLTVSFNMNGFELVIRSRDIQLTSKMEKLSSVIMIVENGRHTSCPLLDVIEVQVDAVLCKNHTNTIELNVEIACDNSNVWISHPTFHLWNAVKFDVPESGPSQYSTSGITFKFQMRKVSILLTDGRWSYNGPELEILVRNILFHTIASGKHMECSVNGDLQVNYNNIEKVSWEPFIEPWKFVLTLVREQEMSVMPNRSVSTDIILKSTTQLNINITESLVECLSRATEMFSDALGLMVLDDHEGNKLVHSPCAEYMCTRKCGAPYVLQNLTSVPLLYQVFHGLVNPDDLHDSDENHAKYVQPGSSIPIYMDENAEQQLSRFRPSHSSDSLNEPRSNGFAHHYITVQLEGTSRSSGPISMDLVGLTCFEVNFSKTYNDTAEDNSLNTSPTFVVPVVFDVSVLRHSKLIRIYSTVVLLNATSTPVELRFDIPFSVSPTLLGPIQPGQQFPLPLHLAEAGCVRWRPMGNSYLWSEAHNLTNLLSVNSKVGNFKSFMCYPSHPSSRPFRCCLSVKNISLTSSGWLKNNVPANDVKKHYIHHLILSAPLIINNYLPKEILLISESGGVGHTVRVSEVGTSVYHIDPSHDLGLEICIDGFKCSNFKFPRLETFCTMAKFTEPKFSFSETLIFEPNSSNGPVYVTVEKVMDAYSGSRELIFFVPFILYNCMGFPLCVTEATGETNEREFVIPSYFDGGENETLSYKKDGLSLLTSNRELPVEVPHNPRSYMKNHTISYREDGSANSIGNYHKNLGRQHSKIDSIFRNSSSGKLKSMLSSKIQSTWKDSGSGNHEREKVQPCIYSPSPDSSVNDAFVKVCRCFSEDAKEQLPYSLWSNPFSLLPPSGSSTILVPQLTSNSAFILAMTCNSVTEQYAGRINAITFQPRYVISNACSKEISYKQKGTDAVFYLGIGKHDHLHWTDTTRELLVSICYNESGWQWSGSFLPDHLGDTQLKMRNYVFGTSNMIRVEVQNADISMGDEKIVGNIKGNSGTNLILLSDDDTGYMPYRIDNFSKELSLNYHVNASILIPKQQQSLILLCEAGSTWITRRLLAWLKIMASGILFIV

SEQ ID NO: 154845 - protein, 376 aa, Glycine max
  Coding DNA Sequence Number=SeqID_63160
  Gene Ontology: Biological process=protein localization
  Homolog annotation: Hit_ID=Q69UI7; Match level="QueryCoverage=91%, HitCoverage=58%, E-value=4e-56, Identity=37%"; Hit description=VPS13- like protein
MVVKFMPQVVNNVVRLLTITCEEVLLENVELILDAFDYLQLPFALKQGRVGKLSIKIPWKKPWDPIIIILEDVFISASQRGDQEWSADAVEQREFAGKKAKLAAAELGKLSRRVCGSQAGQSFISHVTTKQEPNTWPHGQRDSNTMSMTISLIAFRLLCIDVGMILDSIQVDIRNFHVLYCDMQNDLGHIMFGLKFTSLTMKQNLIGSSNGRVRVGQEHKIVEVKGLEFYSRMFHGSMDLVNMNNMGNSYSANSIRSEGKHYYSILAPCDVTLILSDNRLQKLDDNTPQYSVTAELSGLVISLDEVQLQHMCLVWDYICTCRLREKYGRFRPWHCLLPRKCEGWQIFWWHYAQESVLSDVRRKLKKTSWRYLGDRL

SEQ ID NO: 154846 - protein, 69 aa, Glycine max
  Coding DNA Sequence Number=SeqID_63161
MKMKTLMATTTMDSGGNDRMHQQQGVGGARRGSENKEGGAPSGWRVRERRRERCTSIFARCMKQLPSLF

SEQ ID NO: 154847 - protein, 210 aa, Glycine max
  Coding DNA Sequence Number=SeqID_63162
MCLSFDVWEDITNVDVFDLIILRTNQMGQSIVIHRPKRIVQQFDYVKTIPLTSVVPFLSVKKIDDKWMHFSEYLAMVGQICVAPGRCAADYMEWFYMIFHPFMSLTQRGVDPSKKITLVPLEKKVPSWWNLFYISPIRKITLAPLKKKVPSWWNLFYISPIRKITLASLEKKVPSWWNLFYISPIRINPNKNSRAFGIWSPSNMDLPESN

SEQ ID NO: 154848 - protein, 1060 aa, Glycine max
  Coding DNA Sequence Number=SeqID_63163
  Gene Ontology: Mol. function=GTPase activity; Cellular component =plasma membrane; Biological process=immune response
  Homolog annotation: Hit_ID=A7QPR3; Match level="QueryCoverage=96%, HitCoverage=96%, E-value=0.0, Identity=64%"; Hit description =Chromosome chr10 scaffold_138, whole genome shotgun sequence
  Pfam annotation: Domain name=GBP; Domain location=51-314; Score =239.1; E_value=9.8e-69; Accession=PF02263.10; Description=Guanylate -binding protein, N-terminal domain
  Pfam annotation: Domain name=GBP_C; Domain location=315-614; Score =127.5; E_value=3.9e-35; Accession=PF02841.5; Description=Guanylate -binding protein, C-terminal domain
  Pfam annotation: Domain name=KID; Domain location=440-450; Score=0.7; E_value=3.5e+02; Accession=PF02841.5; Description=KID repeat
  Pfam annotation: Domain name=KID; Domain location=458-468; Score=9.5; E_value=4.8; Accession=PF02841.5; Description=KID repeat
  Pfam annotation: Domain name=KID; Domain location=526-536; Score=0.5; E_value=3.8e+02; Accession=PF02841.5; Description=KID repeat
  Pfam annotation: Domain name=KID; Domain location=707-717; Score=2.6; E_value=1.4e+02; Accession=PF02841.5; Description=KID repeat
  Pfam annotation: Domain name=KID; Domain location=742-752; Score=0.3; E_value=4.2e+02; Accession=PF02841.5; Description=KID repeat
  Pfam annotation: Domain name=KID; Domain location=875-885; Score=0.5; E_value=3.9e+02; Accession=PF02841.5; Description=KID repeat
  Pfam annotation: Domain name=KID; Domain location=932-942; Score=6.9; E_value=17; Accession=PF02841.5; Description=KID repeat
  Pfam annotation: Domain name=Tropomyosin; Domain location=585-802; Score=-112.0; E_value=0.032; Accession=PF00261.11; Description =Tropomyosin
  Pfam module annotation: Pfam domain module=GBP::GBP_C::KID::KID::KID:: KID::KID::KID::KID::Tropomyosin; Domain location=51-314::315-614::440- 450::458-468::526-536::707-717::742-752::875-885::932-942::585-802
  Subcellular localization annotation: CTP_CleavageSite=47; ConfidenceScore=5.38e-01
MLKYFNRGRDSPAADASPPSPAAATPSYSSSSASPVTGPARPIRLVYCDEKGKFRMDPEAVATLQLVKEPIGVVSVCGRARQGKSFILNQLLGKSSGFQVASTHRPCTKGLWLWSAPLKKTALDGTEYSLLLLDSEGIDAYDQTGTYSTQIFSLAVLLSSMFIYNQMGGIDEASLDRLSLVTQMTKHIRVRASGGKTSASELGQFSPIFVWLLRDFYLDLTEDNRKITPRDYLEIALRPVQGSGKDIKAKNEIRDSIRALFPDRECFTLVRPLNNENDLQRLDQISMDKLRTGFREGLDSLTKFVFERTRPKQVGATMMTGPVLVGITESYLKALNEGAVPTISSSWQSVEEAECHRAYDSATDVYMSSFDRSTPPEEVALREAHEQAKQKSMAAFNAIAIGVGSARKTYEGLLLKFFKKAFEDYRKDAFMEADLQCSNAIQSMEKRLRAACNASDAKIDNVAKVLDALLSEYEKTIQGPGKWQRLAVFLQQSFEGPVLDLVKRLIATIESEKRSHALQYRSIEEKVDLLTKRLEATEGEKSNYIKRYEDAINDKKKLMDEYKNRITDLQANRRSLDERYSSLLKTLDSTKQDSMDWKRKYEQVLSRQKAEEDQASSEIAALKSRSGAAEARLAAAKEQAQSAQEEAEEWKRKYDIARREAQSALQKAANVQERTNKQTQLREDALREEFSGTLAEKEDEIKEKTAKIEHAEKCLTTLNLELKAAESKIRSYDTEISSLRIEIKELTEKLKAENAKAQSYEREAIVFQQEKNHLEQKYHTEFKRFDEVQERCKTAEKEAARATEVADKARAEAGMAQKERSEMQRLAMERLAQIERAERRIENLGREKDNLEAELRRVRDSEKDALTRAVKLEEKVQQREKDLEALLDKDKTHRRNSAQILEQLLETEREAHAQANNRAEALSLQLQSAQAKIDSLHQELTKFRLNETALDSKLNTASHGKRMRVDDNIGDDMDVSPRIVKGTKRTRSTYSQPEDGGSIFEGAEENLSQRTSEEDYRKFTVQRLKQELTKLNYGDQLLRLKNPNKKEIIALYEKCVLQKS

SEQ ID NO: 154849 - protein, 455 aa, Glycine max
  Coding DNA Sequence Number=SeqID_63164
  Gene Ontology: Mol. function=transferase activity, transferring glycosyl groups; Cellular component=cytoplasm; Biological process =metabolic process
  Homolog annotation: Hit_ID=A2Q5W6; Match level="QueryCoverage=100%, HitCoverage=97%, E-value=0.0, Identity=68%"; Hit description=UDP -glucuronosyl/UDP-glucosyltransferase
  Pfam annotation: Domain name=Glyco_tran_28_C; Domain location=273 -434; Score=-13.2; E_value=0.00034; Accession=PF04101.7; Description =Glycosyltransferase family 28 C-terminal domain
  Pfam annotation: Domain name=UDPGT; Domain location=12-455; Score= -46.4; E_value=2.9e-08; Accession=PF00201.9; Description=UDP -glucoronosyl and UDP-glucosyl transferase
  Pfam module annotation: Pfam domain module=Glyco_tran_28_C::UDPGT; Domain location=273-434::12-455
MEKKSKAKRVHCLVLAYPAQGHTNPMLQFSKLLQHEGVRVTFVSTVFHCKNMKKLPPGISLETISDGFDSGRIGEAKSLRVYLDQFWQVGPKTLVELLEKLNGSSGHPIDCLVYDSFMPWALEVARSFGIVGVVFLTQNMAVNSIYYHVHLGKLQAPLKEEEISLPALPQLQLGDMPSFFFNYVEHPVFLDFLVGQFSNIDKADWIICNSFYELEKEVADWTMKIWPKFRTIGPSIPSMFLDKQTQDDEDYGVAQFTSEECIKWLDDKIKESVIYVSFGSMAILSEEQIEELAYGLRDSESYFLWVVRASEETKLPKNFEKKSEKGLVVSWCSQLKVLAHEAVGCFVTHCGWNSTLEALSLGVPMVAIPQEADQSTNAKHIEDVWKVGIKASVDEKHVVRREVLKRCTREVMDSERGEEMKRNAMQLKTLAANVVGEGGSSHRNITEFVNSLFHL

SEQ ID NO: 154850 - protein, 120 aa, Glycine max
  Coding DNA Sequence Number=SeqID_63165
  Homolog annotation: Hit_ID=Q2HVU8; Match level="QueryCoverage=89%, HitCoverage=18%, E-value=3e-08, Identity=30%"; Hit description =Polynucleotidyl transferase, Ribonuclease H fold
MIASPERAQLQQQQTTSWLKPPTGSLKLSIDAMLFKEFNKFGVGIFIRGDQGTFVSVKTLLLDGIPEPGEAKAIGLLHALIWAQELVYKISYLSLTVSGSDNAGGGYITVQPSPPTTNQI

SEQ ID NO: 154851 - protein, 307 aa, Glycine max
  Coding DNA Sequence Number=SeqID_63166
  Homolog annotation: Hit_ID=A2Q4P8; Match level="QueryCoverage=45%, HitCoverage=77%, E-value=3e-19, Identity=36%"; Hit description=IMP dehydrogenase/GMP reductase, related
MSAFVERWHKETSSFHLLVREVTITLPVVGAFHNFEQSRCWWSYSRSVLQMLELRPLTVTGLMCDYRDCASSRAYLLHLLGCTLFADKSATHVHLVFLDALRDLTQSAGYAWGVAALVHMYDNLNDASKSTARQLAGYITLLQYLIYEHFRWTSGKALLVATYRRRLDRLTLDAVCWIPYVSGHCSPDYLGWFYVISHPFIYLPQPGDPLRVPSIQQYEEFVDAHMYQQPMAAAAPTEAHIDQHDFGHAVEDFAAIADRLNKLLNLRILTEGTLAYTVVEECVGIARRYTGQPTVADRSRRRRHTNG

SEQ ID NO: 154852 - protein, 228 aa, Glycine max
  Coding DNA Sequence Number=SeqID_63167
  Gene Ontology: Mol. function=transporter activity; Cellular component= mitochondrial inner membrane; Biological process=transport
  Homolog annotation: Hit_ID=A7QPT9; Match level="QueryCoverage=100%, HitCoverage=75%, E-value=7e-87, Identity=69%"; Hit description =Chromosome chr10 scaffold_138, whole genome shotgun sequence
  Pfam annotation: Domain name=Mito_carr; Domain location=137-227; Score=64.6; E_value=3.4e-16; Accession=PF00153.18; Description =Mitochondrial carrier protein
  Pfam annotation: Domain name=Mito_carr; Domain location=33-125; Score= 83.7; E_value=5.8e-22; Accession=PF00153.18; Description =Mitochondrial carrier protein
  Pfam module annotation: Pfam domain module=Mito_carr::Mito_carr; Domain location=137-227::33-125
MAVEGSLFFGIYSQTKVYLQGGVQSGEPRPQVIIPSAAFSGAIISFVLGPTDLIKCRMQIQGTDSLVPKSSRYSSPLDCALKTVKAEGVKGIFRGGCATLLRESIGNAVFFSVYEYVRYHMHSNIKANSSNHRNLVDIGVGIASGGLGGVAFWLTVLPLDVAKTLIQTNPDKNCPRNPFGVLSSIYQRAGLKGCYTGLGATVSRAFPANAATIVAWELALKMLGIKRD

SEQ ID NO: 154853 - protein, 132 aa, Glycine max
  Coding DNA Sequence Number=SeqID_63168
  Gene Ontology: Mol. function=threonine endopeptidase activity; Cellular component=proteasome core complex; Biological process =ubiquitin-dependent protein catabolic process
  Homolog annotation: Hit_ID=Q45NI9; Match level="QueryCoverage=97%, HitCoverage=89%, E-value=1e-42, Identity=60%"; Hit description =Proteasome subunit
MNGVCTQQSWKHPYGVGHLVAGLDESGAHLYYNCPSGNYFEYQAFAIGSRSQAAKTYLERKSAVCTIAVVGVGEPFHILDQETVQQLIDTFEIVREEEAAPAEEEAQPAAEQDAPTDQGAAAVDQGGSPMDI

SEQ ID NO: 154854 - protein, 158 aa, Glycine max
  Coding DNA Sequence Number=SeqID_63169
MGTRQGNKPSSKKSHAAEDSISADSLSFAGLVSIQDQNSKPPIPNHTTHYYKITPADVLISNGKIKPFQPNRPVLTDPPISLRSLLAIDHANNSKMSNVQQARKYDEQRVKARIHKSKERSSSVTRTWFGHKVFRSFLSPCRKCQATQPGAVKGQSVK

SEQ ID NO: 154855 - protein, 27 aa, Glycine max
  Coding DNA Sequence Number=SeqID_63170
MGTQKLVSSHGTGSVSSSRRTKSLDTG

SEQ ID NO: 154856 - protein, 380 aa, Glycine max
  Coding DNA Sequence Number=SeqID_63171
  Homolog annotation: Hit_ID=A7QT92; Match level="QueryCoverage=29%, HitCoverage=52%, E-value=4e-08, Identity=35%"; Hit description =Chromosome chr1 scaffold_166, whole genome shotgun sequence
  Subcellular localization annotation: CTP_CleavageSite=42; ConfidenceScore=5.01e-01
MGTLEVFKGSERILLTGERANAPVLTALGVGFRGTNSSSLARSVARSSVSYDFSVYDSVTPFRVGALQMSMVDLEGKEGYRPSTEYVEDSNETLINLTDSTELLFLKLPSSNHGMRCVDFDPTMSQSAAEVRSELDLASSVMHKRAVVVGSEDVREGWQCRFVTEEDEVARTVKVFGSWLRKVMVSQGKCRGGEGERSLGEKVAGGGRQTTTVGGRRWVARINREDYGSWTESNMKGESKQREGRNQSLGSSTKRNEFFYSTAGKISRRVSTVHYSDPKELENLNSTNAKHAHGNSSGVTGTTSSRYFPMQSSGAASSKGSRQRSSLTEASEPSSISKRRHASKSKSNLSEASHGHSTGISSMSPDHSHEGKAKRRKHKE

SEQ ID NO: 154857 - protein, 1541 aa, Glycine max
  Coding DNA Sequence Number=SeqID_63172
  Gene Ontology: Mol. function=sequence-specific DNA binding; Cellular component=nucleus; Biological process=regulation of transcription, DNA-dependent
  Homolog annotation: Hit_ID=A2Q504; Match level="QueryCoverage=99%, HitCoverage=86%, E-value=0.0, Identity=58%"; Hit description=DDT; Homeodomain-related
MARTFRDNQFLPNKSAIRSDASGQFSQSHLHDLVEGSVRNPPFAHGNEHLPRIHATKGHSSRVRLLSQQDKQLIPYQSPSRDDDVAPQREMYPNIANVGKNSHFTDHQIVGPENLHALHSGQVLHNNATRIEKKRKSDDAQDVEAHEMKIRKELEKQDNLRRKSEERTRKEMERQDRERKKEEERLMRERQREEERARREQKREIERREKFLLKENLKAEKMRQREELRKERDAERRKAALEKATARRMAKESMELIEDEQLEMMELAASSKGFSSIVHLDFDTLQHLESFRDSLSVFPPKSVKLRKPFAIKPWINSENNVGNLLMIIAGIKASKFKDSRLLGEIHVALLKVIIKDIEDVARTPSTGLGANQNGAANSGGGHPEIVEGAYAWGFDIRNWHKHLNLLTWPEIFRQLALSAGYGPQLKKRSISWSYANNKDEGRNCEDIISTLRNGSAAENAVAKMHERGLLAPRRSRHRLTPGTVKFAAFHVLSLEGEKGLNVLELAEKIQKSGLRDLTTSKTPEASISVALTRDAKLFERIAPSTYCVREAFRKDPADAESILSDARKKIQIFEKGFLAGEDTDDIEREESESDEIDEDPEVDDLVNLSSANRTSEQCDDFSSNGKANLGHNVELQGEFDKDLPCFPESGSKNADAPIAVTGQPGAVEDLNVGNLGEDNMEIDESKPGESWVLGLAEGEYSDLSVEERLNALVVLVGVANEGNSIRVVLEDRLEAANALKKQMWAESQVDKVRLKDDTFSKSDFPSINGNKVEIQYSCPVMEGKQSPLIGINIGNNNNNNNNNVPSPSIAENQKAVFGAQSQSIEKHSSAQDLCTGPDNPQTQSLGQYSKRSRSQWKSYISHMAEEMYVYRSLPLGQDRRRNRYWQFVASASSNDPGSGRIFVEYLDGYWRLIDTEEAFDALLNSLDSRGIRESHLRLMLQKVESSFKENVRKNTQCSKIGSIGETCVKNEADETDSSPDRHTGSDSPSSTLCGLNSDTSETSSSFKIELGKSESDKKSALRRYQDFQKWMWKECYNSSILCAMKYGKKRCKPQVVMCDICLNPYFFEDSHCSGCHRTFPSNSGFSFSKHAFQCGDKSSKDICILDSLPLRTRLLKAMLAFIEASVLPEALKSNWTEDIRRHWSVKLSKSSSIEELLQILTLLERALKQDFLSSTFSTTGEQLGLNSMSKSAAQTSTDPESVAVLPWVPLTTSAVSLRLLEFDASIVYVPHEKPEPCEEKEDRFAFLQKLPSRYNPSKSSKVAEAADLDRDEFMKVKSAPVKIVQSNNKRGRGSRDKGRGKKLSKTKQNTGRRGAKVAGNAGQRIKKQGVGSQGQAGGRGRRTVRKRRVGKKAVEDLLMGHRDASHSSSIGRESLRSLDDDWDDEKASPMTPIHMGAANSNNSIEEVESDDNVEAMESDDNVQAMESDDKVQAMESDDNVQAAESDDNGQAVEYDQGNWEIGFNGAPSRWSRDLVGGISDEDEDEDAEASEDDNDNGIGIENNEEVDSEADAMSEEGSDGTANRIVNEESSDSDVSEDSSD

SEQ ID NO: 154858 - protein, 85 aa, Glycine max
  Coding DNA Sequence Number=SeqID_63173
MRKWALAVDKDSVDDTVCEKYDINKEKWVQFCQTRRDPLWEDVRKKAQAIQKQNTAPHMLSRAGYEYLEQKLMAENTKKKLEEVA

SEQ ID NO: 154859 - protein, 36 aa, Glycine max
  Coding DNA Sequence Number=SeqID_63174
MDRGINVSGAPGLVGGRSTNARDPIRTPQLSVLGRE

SEQ ID NO: 154860 - protein, 132 aa, Glycine max
  Coding DNA Sequence Number=SeqID_63175
MECLEGVWETLEGNARCRFRGTIRLTATSLVNPEEPARTLQRTVEWILPTPTPYLLVEPVQVIEVTSSEEDPEEDPEELPPEPTVDALDFLEGDEDPLPEVDSPEDVMSASEADSTEESGPGGIATSGGSSS

SEQ ID NO: 154861 - protein, 36 aa, Glycine max
  Coding DNA Sequence Number=SeqID_63176
MHPPPPPEPPLLIHKKVRVLPTTHDRQIGDQVQGQR

SEQ ID NO: 154862 - protein, 56 aa, Glycine max
  Coding DNA Sequence Number=SeqID_63177
MKMLSIPHDVAPCRACRPWILFINGVLWRKGDWRRHFKEKMSQEQAHHHRKPWIRA

SEQ ID NO: 154863 - protein, 58 aa, Glycine max
  Coding DNA Sequence Number=SeqID_63178
MWYHGDQSGSQCFERMLQPYGITIGLKEHSNRVTPKAYTLKSLSGPLPPDSGPTQKTF

SEQ ID NO: 154864 - protein, 245 aa, Glycine max
  Coding DNA Sequence Number=SeqID_63179
MVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMTPTRHPLDPDKSNRALGFPALITGLCQSFGVPVAPTKVIRPPITRAFIEKRPTTEHMHGPYDCLYQMSLSMQSQGFASFSCPTPDQFRAEVAWPGDWPEAQAGEAPPEAPGDGEEAHEDEEMADLLDFLGGSGDT

SEQ ID NO: 154865 - protein, 299 aa, Glycine max
  Coding DNA Sequence Number=SeqID_63180
  Gene Ontology: Mol. function=helicase activity; Biological process =viral genome replication
  Homolog annotation: Hit_ID=Q2A9E0; Match level="QueryCoverage=97%, HitCoverage=19%, E-value=9e-58, Identity=41%"; Hit description =Putative uncharacterized protein
MSHCKAMMWYDERINKDKQTNKPRFSLCCSDGKIQLPLLHEPPHPLNHLLFNNQDPKAKNFQQYIRIYNLMFAFTSPDIKFDKSYNTRKGPPTFLIHGQTHNLIGSLLPMPNNPPKFAQLYIYDTDNEIINKLSQNPLVFILMSHMMHDMLDEQIIIAIKDMLDHHNHYAQRFRMARDKLHSAVVPDLKMKLISQRQTDGRLYNLPTTTEVVALIVGDEHSADKRGIIIEKQSELLKRIHELHPAYFPLQYPLLYPKGEDGYRLNIPHKDHANIHATKRKQVTLREYFSYRLQSRTDEA

SEQ ID NO: 154866 - protein, 74 aa, Glycine max
  Coding DNA Sequence Number=SeqID_63181
MEGIISKFYKSKLGCYPFMCLESAQLIFESFWTRSCHHKRYALGGFDGDKMVPSIEVFDPRLGAWMIRGTNESS

SEQ ID NO: 154867 - protein, 68 aa, Glycine max
  Coding DNA Sequence Number=SeqID_63182
  Homolog annotation: Hit_ID=Q1SN17; Match level="QueryCoverage=85%, HitCoverage=12%, E-value=8e-08, Identity=46%"; Hit description =Transposase, putative
MAKSFVGHPYAGRLTKDKKIVVDDMTKSMVKPRKILLTLKEHNEKNYTTIKQIYNVRHACRIEWPQNN

SEQ ID NO: 154868 - protein, 62 aa, Glycine max
  Coding DNA Sequence Number=SeqID_63183
MWFCLEIAMNMLSALAALSLFIASVKILDFQMNALSGPSLSLTCQAKRHVDSAKRQSAALSA

SEQ ID NO: 154869 - protein, 110 aa, Glycine max
  Coding DNA Sequence Number=SeqID_63184
MCRSKDFDFDVLMMPYDHDVLMPYENALLKFNSRQKSKNTRYNIKKISSDLGREFQIEIAKGLAKKFKLKCLFQEIYSLVIDYQRITCKGILKDSGTLKRVAWGLDVGTR

SEQ ID NO: 154870 - protein, 121 aa, Glycine max
  Coding DNA Sequence Number=SeqID_63185
RVHLLWYKFVTENKRGCISCGSVQVEGTSTWLFKENKGGYIPCGSLLVKAEFDIPKASNVRTKKKILQTVGERWRQFISNLTSKWALAADKDSVDDNVCEKYDISKEKWAQFCQSRRDPLW

SEQ ID NO: 154871 - protein, 210 aa, Glycine max
  Coding DNA Sequence Number=SeqID_63186
MTTLTQIWMTLLLSNIQPSDHNSDLPLPKCRLVYAILTRMSIHVAQLIADAIYLFAGMAPTRHPLDPDKSNRALGFPALITGLCQSFGVPVAPSMVIRPPITRAFIEKYCTQRQAQGDAPQAVDAPPPHQAGPAGSFDTEQYLRHLVRQQAANHRAHFRAEVAWPGDWPEARAGEAPAEAPAEAPDEADEAREDEEMADLLDFLGGSRAT

SEQ ID NO: 154872 - protein, 75 aa, Glycine max
  Coding DNA Sequence Number=SeqID_63187
MKMKANKTRNELKVSDLNTYRLKNEEQMRNRGKSSQICSRKCLESVMETFRLDFSSRKHGIREVLATQRLLEVDF

SEQ ID NO: 154873 - protein, 106 aa, Glycine max
  Coding DNA Sequence Number=SeqID_63188
  Subcellular localization annotation: CTP_CleavageSite=25; ConfidenceScore=5.01e-01
MHALLGSFNSGNWSDSKVLDSTRLSCRTITRNRDSFYTCSYSHLSLHTRHLFAEITYQITQVPREFDTRFLPFYTTCAIRCTCRNPNKFLAPLSGNFFLFGKLVGL

SEQ ID NO: 154874 - protein, 290 aa, Glycine max
  Coding DNA Sequence Number=SeqID_63189
MLLRGVYADLPRAPASWLVEIWVHGRLRRDKMVDEPRSRPITCEPVSSGPIDDPLRARTLPTRPQRLGGPVNTATRSLVQVQLEWGHTEGDRPVEQERLSCGSLLRVGEKNFEERVQEYVKLKWCKRTSSKSPNGEIQAYRAGGPRVQMASSARASVRVIRRHSSWGYLSGAVGCTSRLVGRRDPLGCSVHWPLVEPAPERGLVPRCCLHGPGAAQRMRSMAVSAYTRTGLHPVSGASAFDTRPTRLETRTKESNMGDGRSYTGGPQPRGVSFSLRSGAPRAYTLGPERW

SEQ ID NO: 154875 - protein, 166 aa, Glycine max
  Coding DNA Sequence Number=SeqID_63190
  Gene Ontology: Mol. function=RNA-directed DNA polymerase activity; Cellular component=intracellular; Biological process=RNA-dependent DNA replication
  Homolog annotation: Hit_ID=A2Q2J0; Match level="QueryCoverage=53%, HitCoverage=10%, E-value=2e-11, Identity=40%"; Hit description=RNA -directed DNA polymerase (Reverse transcriptase); Ribonuclease H
APSRYHVPAGERQLGQLATFSLVPANRTVEGCYPTFEVSEVPRIVAKWIKRNRTENLAFIHERRYCAKRNHMTLLRCVDAKEANHMIEEVHEGSLETVLTNMDGQRAPTRNATNVKLSKKCQFEAFSPTAIEPKASNGHRFILVAIDYFTKWVEAAFILPMSRGMW

SEQ ID NO: 154876 - protein, 83 aa, Glycine max
  Coding DNA Sequence Number=SeqID_63191
MQEFYTGSTTTHAYIQSPSDLRSLRFLFNLVKIFTSKDPHGIHNNPGRCTLYLYHKGCTLQCVKTKFSGGKGKNQKNSQTVSF

SEQ ID NO: 154877 - protein, 176 aa, Glycine max
  Coding DNA Sequence Number=SeqID_63192
  Homolog annotation: Hit_ID=Q6WAY6; Match level="QueryCoverage=86%, HitCoverage=32%, E-value=5e-13, Identity=30%"; Hit description =Putative uncharacterized protein
MGTNQNGKRFYQVKVKSLDVTSLKELGRLMGPLQRQAFCKVYGKILDLTAPEVFTDAVVSLAQYYDQPLRCFMFRDFQMLWLEIQQKELDRMKQTRNSVVGLPQKYLEDKARDMASQEQWGPFADILALLIFGVVLFPNVNGLVDLAAIDAFLAYLHSKESPVVAILADLFDTFDR

SEQ ID NO: 154878 - protein, 149 aa, Glycine max
  Coding DNA Sequence Number=SeqID_63193
  Homolog annotation: Hit_ID=Q6WAY6; Match level="QueryCoverage=48%, HitCoverage=12%, E-value=5e-07, Identity=39%"; Hit description =Putative uncharacterized protein
MGTNQTGKRFYQVKVKSPDTTSIKELGRLMEPLQMQAFRKTYGKIIATVVKDSARGLDRIKQTRNGIAGLPQKYLEDKARGMANQGDWVPFMDVLALLIFGVVLFPNVDGLVDLAAIDAFLAYHHSKESPVVAVLADLFGTFEPKVREE

SEQ ID NO: 154879 - protein, 69 aa, Glycine max
  Coding DNA Sequence Number=SeqID_63194
MVSYPNFVRGPLLDDVRPFFGPREAHLGFLQKAVASGGSNPARLGELSSPGRAELAWASWAATTSPILL

SEQ ID NO: 154880 - protein, 38 aa, Glycine max
  Coding DNA Sequence Number=SeqID_63195
MPLQGEDKSRTSSPPQEAMDKSLKVGADEWREKERRRM

SEQ ID NO: 154881 - protein, 138 aa, Glycine max
  Coding DNA Sequence Number=SeqID_63196
TLASIATPLGLEFVPQVKKLLDEGLLHKSLNPCALLVPKIVVPMNPKRIKVIPEWPTTPTPLIECVRNHVPSWEDAQEMGVEGRSLEYEEPQDLRKLLKEVSLVMKRVCVAKLLLLKEVFSKKLLKEVFSRKLLKEAT

SEQ ID NO: 154882 - protein, 235 aa, Glycine max
  Coding DNA Sequence Number=SeqID_63197
MAKSSYARNFEALEEDEEIQALKLELGKARLAKEKFKSAATNIRKECTELREENAATAKALEQETKRARKEEHGRDKFRGALWGSNNELKLRREERDQSRVHGMILKEELATCARSKRSLAQHLEATERSMLAIIGQYKEELNQSVTHEQKLVEDFAQVYAEKEARGRVIDALHQEATMWMDRFALTLNGSQDLPRLLAKAKAIAEVCSAPEEIHGLINYCQHMIDLMAHIIRNR

SEQ ID NO: 154883 - protein, 50 aa, Glycine max
  Coding DNA Sequence Number=SeqID_63198
EGEALQTLQSVGLGLGVTRFECSFKPMLIPYGWSILAKHYDPDRSPHDIT

SEQ ID NO: 154884 - protein, 129 aa, Glycine max
  Coding DNA Sequence Number=SeqID_63199
MGDQEETQEQMKADMSALKEQMASMMEAMLGMRQLMEKNVATAAAVSSAAEVDPTLLATARHPPSNIVGRGRNTLGHDGNPHLGYNRAAYPYGLPPVLQDDAGHIASPVLEREPPQQPDEVHEDPQDYA

SEQ ID NO: 154885 - protein, 166 aa, Glycine max
  Coding DNA Sequence Number=SeqID_63200
MVEKTKKKLEEATQSESIEGVIDPLSPIKRHVKWKMVHTKKTRQMTSEASKGSFVPYGRQDLLTAAIGRSKHPSCVRAAGFGIQSQGLAFPPEPEVGPSTARVSTKGSCVDPLNDRSRHGGLRQNASLKVGVEEVKDADAPVLVPTDDVILVGQALNTFLALANTS

SEQ ID NO: 154886 - protein, 307 aa, Glycine max
  Coding DNA Sequence Number=SeqID_63201
  Homolog annotation: Hit_ID=A5B5V0; Match level="QueryCoverage=76%, HitCoverage=52%, E-value=7e-13, Identity=25%"; Hit description =Putative uncharacterized protein
MELFSNENFECFQAFENSNLIPFMSLKLPVYSELVKAFYSNLEIHVGILMSEIYGIKMVIDQSLFYDLTKLPSEGVPFEGALIDDWKFNFSVHDAHRLVCTNQADMIGRILAGSLAFESRILHYLIVRILLPRSSNLAQVSEEDLIVMWAFHKGLQIDWAHIVRYRMHKALRLNAPLPYPHLVTLFLQHFNIPLDSEPYVPIKRSFLIGASVIASFGYIKEHDGSWVKKGARNVGEEGHEGEDSSLLSKIMERFDGLQTFVGERFDTLELQVDMRFNEMESRMTKVEEDVSYIQSSFDLPPPPPPSS

SEQ ID NO: 154887 - protein, 83 aa, Glycine max
  Coding DNA Sequence Number=SeqID_63202
MEIYVSDRLGKSVCVCFLISEVVIIEKGEIVEAKLHEESRLIQRCFDDNKDDDKGDNEKLKGQSKNEFKMFKIESSTLQDSRG

SEQ ID NO: 154888 - protein, 49 aa, Glycine max
  Coding DNA Sequence Number=SeqID_63203
MLQDGESRGAAASSVESSGMIIRGGAGGDNVSSSGEAGGSTTGGYGSAD

SEQ ID NO: 154889 - protein, 51 aa, Glycine max
  Coding DNA Sequence Number=SeqID_63204
MKMLLIPHDMNGSVMEKEEREEMPLQGEDESRRSSPPLEAMDKSLEEEGDE

SEQ ID NO: 154890 - protein, 110 aa, Glycine max
  Coding DNA Sequence Number=SeqID_63205
  Subcellular localization annotation: CTP_CleavageSite=65; ConfidenceScore=5.13e-01
MARTRSPLKVRTCSPLKVRACSPTKVKAHDPLTTRTCSPLTVRIDCPFERGDNSCNLILSFLQISPGTPSEACLPPFFLFKNIDGCELLIDPYVHLRLMHGAPHCPSVRL

SEQ ID NO: 154891 - protein, 82 aa, Glycine max
  Coding DNA Sequence Number=SeqID_63206
MAVEWRRKRERRRHFKEKISLEEAHNHRRPWIRAWRKKEMNEGRGREEHEILCSKRALKSESTEATQCGKFESMSAIPCGKD

SEQ ID NO: 154892 - protein, 105 aa, Glycine max
  Coding DNA Sequence Number=SeqID_63207
  Pfam annotation: Domain name=zf-CCHC; Domain location=70-87; Score =28.8; E_value=2e-05; Accession=PF00098.14; Description=Zinc knuckle
MKKMDKKKKEFLLKTSSSIQEESDQENDPDDDDDLSLFVKRFNKFLKVRGNQRRPNFKSKRRTETSSSTLKCFECNQPGHLRVDCPSSRKRWYIDSGCSKHMKNQ

SEQ ID NO: 154893 - protein, 137 aa, Glycine max
  Coding DNA Sequence Number=SeqID_63208
MSYRMSRHHASEHADYMCPYEQIKQVNNTRELFTQFGATSPTSGGSKPGRKSTLNSVSSRSNSPCLQPSHLTTTHTPEINSEQMGSTLHNRDQLYTQEINSTHSGPTLDNSCSLRVYIAICVSGLQRLDAGGDLSSS

SEQ ID NO: 154894 - protein, 62 aa, Glycine max
  Coding DNA Sequence Number=SeqID_63209
MYPPMCWDKEFSGGEGKNQKNSQAVSPLNSLVREKRDIKEFRQLVLRSFGKGRRETQKNSGG

SEQ ID NO: 154895 - protein, 236 aa, Glycine max
  Coding DNA Sequence Number=SeqID_63210
MTTLTQIWMTLLLSNILPIDHNSDLPLPKCQLVYAILTRMSIHVAQLIADAIYIFAGMAPTRHPLDPDKSNRALGFPALITGLCQSFGVPVAPTKVIRLPITRAFIEKYCTQRQAQGNAPQAAGAPPPPHQAGPAGSFDMKQYLRHLVRQQAANHRAHVQTHDCLYQMSLSMQSQGFASFSCPTPDQFRAEVAWPGDWPEAQAGEVPPEAPGDGEEAHEDEEMADLLDFLGGSGAS

SEQ ID NO: 154896 - protein, 79 aa, Glycine max
  Coding DNA Sequence Number=SeqID_63211
  Subcellular localization annotation: CTP_CleavageSite=30; ConfidenceScore=5.03e-01
MYPLLVSVTTTQVDVPSTCTTKDVPSNVLRQSSQADSPLKLCEGETKDISGGRRETQKNSQAVSPSFFWKREKRDTKRI

SEQ ID NO: 154897 - protein, 153 aa, Glycine max
  Coding DNA Sequence Number=SeqID_63212
MAPTRHPLDPDKSNMALGFPALITGLCQSFGVPVTPSKVIRPPITRAFIEKYCTQRQIQGDAPQAADAPPPHQAGPARSFDTEYLQSQGFTSFPCPTPDQFGAEVAWPGDWPEAQAGEPPAGARAEAPDEADEAREDEEMTDLLDFLGGSGAT

SEQ ID NO: 154898 - protein, 126 aa, Glycine max
  Coding DNA Sequence Number=SeqID_63213
MAAQLIHDRVVMECLEGVWETLEGNESTSGGTHTHTSAACGLPTPTPYRLVEPVQVIEVSSSEEDLEEDPEELPLEPDMDALDLPEDDEDPLPDVDYPEDIMSASEADSTEESGPGGIANSDDSSS

SEQ ID NO: 154899 - protein, 237 aa, Glycine max
  Coding DNA Sequence Number=SeqID_63214
MERSMIDAASGGTLGDMTPAEAKNDAIVIRGVHEVATNSSSSAETKKLEAYAANIYNRPPQPQQQNQPQQNNYDLSSNRYNPGWRNHPNLRWLNPSQQQQQQPYFQNAVGPSRPYIPPLIQQQQQQPQKQQIVEAPPQPSLEELVRQMTMQNMQFQQETRASIQSLTNQMGQLTTQLNQQQSQNSDRLPSQSVQNPKNVSAITLRSGKQCQEPQPANEPAQPHSTPEKDDAKNENVK

SEQ ID NO: 154900 - protein, 28 aa, Glycine max
  Coding DNA Sequence Number=SeqID_63215
MREGLSNGIRSRKRQLVSKWKEQRMGSM

SEQ ID NO: 154901 - protein, 157 aa, Glycine max
  Coding DNA Sequence Number=SeqID_63216
  Homolog annotation: Hit_ID=Q6WAY4; Match level="QueryCoverage=54%, HitCoverage=15%, E-value=1e-07, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEPTYMTPSTEDVKKAMQGLFAVLQLSMWGWFHTFFTKKVGPSIRYKVTARASKKERRIGTNSWLAWGGVC

SEQ ID NO: 154902 - protein, 86 aa, Glycine max
  Coding DNA Sequence Number=SeqID_63217
MTDLFGVDFNTPNSVASYLATLQQFDAPHLFGEQGQSSSTATTNIENTNTEQQHHHDVGEPVILERRNLRRNRRPPPCGTGHRLGH

SEQ ID NO: 154903 - protein, 110 aa, Glycine max
  Coding DNA Sequence Number=SeqID_63218
MTPESGIFFMTGFLWFFLRFPFNKRWGRLCAFSSFGRRTREPRLAHPQKDDDKGDEQKAQRSKNNSNESRTSQEFKNQEEFKTQEESLESRFKIQDLKNQDQDSRLKIQE

SEQ ID NO: 154904 - protein, 127 aa, Glycine max
  Coding DNA Sequence Number=SeqID_63219
MAQSNSSRLEFPALITTLCMARGVISDSLTFESLNPTINLAYIKKNCWNLDDPTISFPGTRTRGSEGPSSAAPQTSIAPAPIPSAQVPATSNPSAQSTDLMMVMLQSIHQGQYLVMQSLHSLAQHQL

SEQ ID NO: 154905 - protein, 53 aa, Glycine max
  Coding DNA Sequence Number=SeqID_63220
MLKRSKNNSSESRTSQEFKNQEEFKTQEESLQSRIKIQDLKNQDQDSRLKIQE

SEQ ID NO: 154906 - protein, 270 aa, Glycine max
  Coding DNA Sequence Number=SeqID_63221
LLGYPLVLEEGQECEYGQRRNRSDGFDEEAIAQLVCIPGQDFAWTAAGRRVQIMRTNMTTLTQILMTLLLSNIQPSDHNSDLPLPKCQLVYAILTRMNIHVAQLIADAIYIFAGMAPTRHPLDPDKSNRALGFPALITGLCQSFGVPVAPSKAADAPPPHQAGSAGSFDTEQYLRHLVCQQAANHRAHVQTHDCLYQMSLSLQSQGFTSFPCPTLDQFRAEVAWPGDWPEARAGEAPAEAPAEAPDEADEAREDEEMADLLDFLGGSRAT

SEQ ID NO: 154907 - protein, 39 aa, Glycine max
  Coding DNA Sequence Number=SeqID_63222
GDVMQSYPPRALDRRLQEHWARDAREDPRVLMSHKGSIE

SEQ ID NO: 154908 - protein, 189 aa, Glycine max
  Coding DNA Sequence Number=SeqID_63223
MVIGQSLFYDLTQLSSDGVPFEGALDDDWKFDFSVHDARQLVSEEDLIVMWAFHTGQQIDWAHLVRYHMHKALQLNAPLPYPHLVTLFLQHFNIPLDSEPYVPIKRSFLIGVVVVASFGYRKESDGSWVKKGAQPNDDEGHLPVEEDSSLLQSILDRFDGLQTYVGERFDSLERQVDTRFEEMNSRTAK

SEQ ID NO: 154909 - protein, 145 aa, Glycine max
  Coding DNA Sequence Number=SeqID_63224
VAVSPPKPPPKPDLEVDDPLYLMTLTIPELFLRPYQVRWDATVFGIVNPDFPLYIKHEDSPKSHTSSQRDVYLGAYLNGPDNYLKGIINSAIKGLDDAPQPKSKAPARWIVVKCNRQKGTTECGYYVMHWMSTIILGSFRNNWEA

SEQ ID NO: 154910 - protein, 56 aa, Glycine max
  Coding DNA Sequence Number=SeqID_63225
MPKDRGRIVIIKKGEIVDKESSRADVLMMPKDHMHLKDLFKTKQWKIYKINDQDSL

SEQ ID NO: 154911 - protein, 76 aa, Glycine max
  Coding DNA Sequence Number=SeqID_63226
MMGDASKFTHISPKKSVHMSYGDNNKGRILGVRKIGGFVRAHALSEIMIRLAHISEFCLSALFSLSGWAEVVRLMR

SEQ ID NO: 154912 - protein, 139 aa, Glycine max
  Coding DNA Sequence Number=SeqID_63227
MWLSLLLTPSIYLQSFGVPVTPSKVIRLLITRAFIEKYCTPRQAQGDAPQAADAPPPPHQADPAGSLGMERYLQHLGQGFVPFACPTLDQFRAEVAWPRDWPEAQAGEAPAGSPSDVEEARMDEEMTNLLSFLGGSGAT

SEQ ID NO: 154913 - protein, 115 aa, Glycine max
  Coding DNA Sequence Number=SeqID_63228
  Homolog annotation: Hit_ID=A5BLR1; Match level="QueryCoverage=91%, HitCoverage=13%, E-value=2e-12, Identity=33%"; Hit description =Putative uncharacterized protein
  Pfam annotation: Domain name=zf-CCHC; Domain location=80-97; Score =23.2; E_value=0.00046; Accession=PF00098.14; Description=Zinc knuckle
MELLGLDRHEENDKKKKGIALKALSSIQEESDKEDLNETEEDDDFSFFVKSFNKFLRSKGNQRRTNFNPKKKGEDSSYVPQCYECNQPRHLRVDCPSFKKRMEKFDRKILLQSYY

SEQ ID NO: 154914 - protein, 87 aa, Glycine max
  Coding DNA Sequence Number=SeqID_63229
ALLRGFELASGVNINFGKTQFGIIGGGVNWALKAANILHCRQLDYPFFFGRQKYWKWYMFHQPEQLWNRILISKYQGWRGLDQGPHK

SEQ ID NO: 154915 - protein, 129 aa, Glycine max
  Coding DNA Sequence Number=SeqID_63230
SAKRNTARLCARKNPKDDELYRFAERIAPGHQAHRFSSSAKREKCAKPKSKLCMSRVSRERKVQVPESFERFCCVKICRDQSLKQKPASYYGKLNPLLDLPWSFNSGNWFDSKVLDSAGLSCRAFTRNQ

SEQ ID NO: 154916 - protein, 106 aa, Glycine max
  Coding DNA Sequence Number=SeqID_63231
MELIENMDASDHAILRDRTHYPTKKSLLELSSQDALLVIGCTLCGGAHESGYYMPTEESTHEVNYMGNQPRQNFNAGGFSGFQQGQHYNQQQNQWRIHPSNQFHKD

SEQ ID NO: 154917 - protein, 183 aa, Glycine max
  Coding DNA Sequence Number=SeqID_63232
KLLAKKTKKKLEEVAQSRSIDGVIDPPSPIRCHVKWKMAHTKKTGEMTIKAAQEIAEKIASQGSFIPHRRQDVLTVAIGRPEHPGRVRAARAGVTVKQYFGSAPRMSRSYSSLPPKELQQLAQQIRDQLEESITKKVTRQLMASFSQMQSQFQSQMQSQGLALPPEPLGWSLRSSSKHKGELC

SEQ ID NO: 154918 - protein, 178 aa, Glycine max
  Coding DNA Sequence Number=SeqID_63233
MAPRKLASKRSRKDKAAEGTNSAPEYDSHRFRSAVHQQRFEAIKGWSFLRERRVQLRDDEYTDFQEEIGRRRWTSLVTPMAKFDPEIVLEFYANAWPTEEGVRDMRSWVRGQWIPFDADAIGQLLGYPLVLEEGQECEYGQRRNRSDGEASANHAHQHDHPDPDMDDVAPQQHPAQRS

SEQ ID NO: 154919 - protein, 115 aa, Glycine max
  Coding DNA Sequence Number=SeqID_63234
MERSMIDAANGGTLGDMTPAEARNLIEKMASNSQKFNARNDAIVLRGVHEVATDSSSSVENKKIEGKLNALVNLQSGVNEQPKAYAANTYNRPPPQQYQQQQNNYDLSSNRYNLG

SEQ ID NO: 154920 - protein, 138 aa, Glycine max
  Coding DNA Sequence Number=SeqID_63235
MSRNFTDYTTIPSLTSGMLWNFMDCAIMLPFDSRHVTELHGLPNDGCQVPRSGQVKVASHQTNGPLYLSFIGDKWERNLSSERKENASKASTNFSVLKTTKLDNHDTSLLSYPNFVRGPLLDDMRPFFGPCEVLGTHH

SEQ ID NO: 154921 - protein, 82 aa, Glycine max
  Coding DNA Sequence Number=SeqID_63236
AFASFASNHHDHHQNIKVICFYRPHSHSREKERKPQEANINLSYFHGKNNVEAYLDWEIKVEQQLKRMSTLKSYGKDQKINE

SEQ ID NO: 154922 - protein, 60 aa, Glycine max
  Coding DNA Sequence Number=SeqID_63237
MKVWRFRDEGGTRRSFGYAARLVYGQEGFHNQKVVASSIRFVHNNCRQKYILLDKWPHIS

SEQ ID NO: 154923 - protein, 49 aa, Glycine max
  Coding DNA Sequence Number=SeqID_63238
MEKSDKRNFKEKKTYITWEDNDMDSSSDSENEIINLGLMAKDDYERREK

SEQ ID NO: 154924 - protein, 68 aa, Glycine max
  Coding DNA Sequence Number=SeqID_63239
MPLQGRIASLCQSFGVPVAPSKRPAQGDAPQATDALPPHQAGPARSFDSEQYLWHLVRQQAANHRAHV

SEQ ID NO: 154925 - protein, 231 aa, Glycine max
  Coding DNA Sequence Number=SeqID_63240
  Pfam annotation: Domain name=G-patch; Domain location=108-152; Score =11.5; E_value=0.0078; Accession=PF01585.14; Description=G-patch domain
MVVRAFDRSRREVMGEIDIPIPDRPPHLQCGFPSDGHKSRLQLPFGEAMDPRTRSGPLDASPKTKIRSWWTLGHSVGQRGYVGKLPLLGTICKGSRGIIGNNFPILRGALMVAQVMLRHCCEPGMGLGKDNHGNADVVDIRGNPHKYGLGYEPGKPGRRNAPSRLWADRAWPDHVSQCFTSVGIMFEEEVAAIGGEAPQDPPSFVRPCHPNFQLGNWHVTSQLEVYTVDSM

SEQ ID NO: 154926 - protein, 38 aa, Glycine max
  Coding DNA Sequence Number=SeqID_63241
MKKQQWKKRCSGRQRRRGERRRHPLGNKPWKEGTSPPR

SEQ ID NO: 154927 - protein, 140 aa, Glycine max
  Coding DNA Sequence Number=SeqID_63242
MPWNEKPRRPKRKNTCQQSFEGLYRAAILSETEGNMWAIIDECKEKLNLAATHEQRLEDEYAKISAEREARERVIGSLHQEATMWKDRFALTLNRSQELHRLLAKAKAVADTYSAPKEIHGFLSYCQHMIDLMDHMIRNR

SEQ ID NO: 154928 - protein, 227 aa, Glycine max
  Coding DNA Sequence Number=SeqID_63243
MTTLTQIWMTLLLSNILPTDHNSDLPMPKCQLVYAILTRMSVHVAQLIADAIYIFASMAPTRHPLDPDKSNRALGFPSLITGLCQSFGVPVAPTKVIRPPITRAFIEKYCTQRQAQGDAPQAAGTPPPPHQAGQAGAFDMEQRPTHKAHVRTNETLYQLSLSMQSQGFASFSCPTPDQFRAEVVCPGDWPEAQAGEAPPEAPDDGEEAHEDEEMADLLDFLGGSGAT

SEQ ID NO: 154929 - protein, 146 aa, Glycine max
  Coding DNA Sequence Number=SeqID_63244
MEAIKEQMATMIKAMMSMKKIMEANAVIVAAISAVAKCEPDVPIRPQANESSNLKYANFEPWLGYATEGQAVGGIPLENTPEGPQYHPQLHLLHSTISKNPRTMAEMGKLDHLEERLKAIKGGEDYAFVILEELFLVPNIITPHKF

SEQ ID NO: 154930 - protein, 16 aa, Glycine max
  Coding DNA Sequence Number=SeqID_63245
MAETSQNNTKKGVKDK

SEQ ID NO: 154931 - protein, 139 aa, Glycine max
  Coding DNA Sequence Number=SeqID_63246
MNQKSTPVARVYGLCSSIDHHTDLCPSLQQSGVNEQPKAYDANIYNRPPQQQNQQQQNNYDLSSNRYNPGWRNHPNLRWTSPPQQQQSIPPFQNAAGPSKPYVPPPIQQQQQQQSQQRQQATEAPPQPSLEELVRQMTI

SEQ ID NO: 154932 - protein, 52 aa, Glycine max
  Coding DNA Sequence Number=SeqID_63247
MSFSRDFLSSNRLPNAPSPCVIDYTQMVINYQCPITLCNQLHTLGNRLPKAI

SEQ ID NO: 154933 - protein, 129 aa, Glycine max
  Coding DNA Sequence Number=SeqID_63248
EEGPNVKTNPLASHGGASVNAVKEDGPSRTKRLGEVATSRRFIYQSLQAACMVSRGGGGRMSIISPRGRYPRSTMKPVPQWKLHASALLRASRLESGGIESGLRKGKFEYAANMPRQADRRALTPSRGP

SEQ ID NO: 154934 - protein, 72 aa, Glycine max
  Coding DNA Sequence Number=SeqID_63249
  Subcellular localization annotation: CTP_CleavageSite=27; ConfidenceScore=5.14e-01
MGLTRSCNSVILSHQVAILAYRGQLVRCLTVVSIGPPSSRMRGESVALVSLVKEQWLTFMETANASTNHVIL

SEQ ID NO: 154935 - protein, 50 aa, Glycine max
  Coding DNA Sequence Number=SeqID_63250
MSCGSVQVEGTSTWGFKENKGGYIPCGSLARKGFYKVERNQKDRRSLGTG

SEQ ID NO: 154936 - protein, 276 aa, Glycine max
  Coding DNA Sequence Number=SeqID_63251
TAYRPQAQYDSRRFQSLEAWNQYTDNILDWRILPERNVKIYHTEFDEFKAKLKRRNLHKRLANLQEGSIDVAVDKELYANLYSPENQSPKQVRVRGHLIRIGANSLNSFLETPVVLEKGETLPTYSSNLTPTSHTSDLNMDRARLVYGLVTRMDMNIGGKISGQITIMAQSNSSLLGFRTLITALCRSRGVGSDALTSYKSLRPVINLAYIKRKCWDVNDQAVNFPRARKTRSRAAGVASSSAPAVDIPSYSTPAPPPTSTTPSAQSSQTSDAKLQ

SEQ ID NO: 154937 - protein, 85 aa, Glycine max
  Coding DNA Sequence Number=SeqID_63252
MGHLRFVILFGRNNQYENTEKGVEGRSQEYEEPRDLRSNPFQGGGNDAILSRKGIGRRIQVDWARDPREGPRILMSLRVDFEPMG

SEQ ID NO: 154938 - protein, 44 aa, Glycine max
  Coding DNA Sequence Number=SeqID_63253
LGSSSSMDSFASWKMNDNGMEKEEREEKILGLQAPMELTSLKLT

SEQ ID NO: 154939 - protein, 94 aa, Glycine max
  Coding DNA Sequence Number=SeqID_63254
GQGRPARRWGISFIVERETARGEQLRPLNDGGGDKGGRGAETTRRAKRYAEAVGCKNESVGERSTLEGRTRVSIVGRSGSEKCRLETSDQPKGG

SEQ ID NO: 154940 - protein, 92 aa, Glycine max
  Coding DNA Sequence Number=SeqID_63255
  Subcellular localization annotation: CTP_CleavageSite=68; ConfidenceScore=5.08e-01
SRSLAFVDRTAFRYHDPKAGSPRRHLTVIRTSSFSDPKCDLMQAPLELVGLGSSSSMDSFASWKINGSGMEKEEREETPLQGEDESRRSSPP

SEQ ID NO: 154941 - protein, 159 aa, Glycine max
  Coding DNA Sequence Number=SeqID_63256
MGSSQMPSLKKRFYQVKVKSLGITSLKELEQLMGQPQRQAFRKAYGRGEWAPFIDILALLIFGGVLFPNVDGLVDLVAIDTFLAYHDHKESPVVAMLADLYDTFDRKCEKSSTGIVLLYPSSLCMVGFAPFSPRGEACLPARKPPFMHREKRGKFGTNF

SEQ ID NO: 154942 - protein, 132 aa, Glycine max
  Coding DNA Sequence Number=SeqID_63257
  Homolog annotation: Hit_ID=Q2HW90; Match level="QueryCoverage=47%, HitCoverage=13%, E-value=7e-09, Identity=41%"; Hit description =Putative uncharacterized protein
MGPLQRQSFRKVYGKILDLTAAEVFTEAIVSLAQYYDQPLRCFTFGDFQMVPTIEEFEEILGCPLGGRKPYLFSEFLPSLSKIADVVGDSARELDRMKQTHNGIVGPATEILGRQGKGYGETREVGAVLRIY

SEQ ID NO: 154943 - protein, 140 aa, Glycine max
  Coding DNA Sequence Number=SeqID_63258
MVSRGGGKRDECLFHLGESHDMETCPTVEELLQRLMDCGQLEVSIGGREEPQICMQSEEKKVPLTPKALVICFTRKGTGSTPIYPRAAPKPMPFAYQSNKAVPWKYTPPAFSERIATEVDSLSAKVTNITGLSGVTRSGR

SEQ ID NO: 154944 - protein, 127 aa, Glycine max
  Coding DNA Sequence Number=SeqID_63259
  Gene Ontology: Mol. function=aspartic-type endopeptidase activity; Biological process=DNA integration
  Homolog annotation: Hit_ID=A5AP37; Match level="QueryCoverage=99%, HitCoverage=6%, E-value=6e-16, Identity=38%"; Hit description =Putative uncharacterized protein
MDSRTISCYFVGYAERSWGYKFYNPTLRSFFETGNVRFLEEVEFEKEENIMNVVFEEKLVIYNNQVLVPISVQDTTPAIKDNVQTIDIVPEQDNNEVLSQIPLEQPQQPQEVSSRRSIKERRSAISK

SEQ ID NO: 154945 - protein, 240 aa, Glycine max
  Coding DNA Sequence Number=SeqID_63260
  Homolog annotation: Hit_ID=Q5XM22; Match level="QueryCoverage=29%, HitCoverage=56%, E-value=8e-13, Identity=44%"; Hit description =Resistance-like protein HAAS-2
GELTITLDDVSSLLHLPISGAFHSYEALSVDETIFLLMELLEVSDEMPDTTMDCSSSCLSPAPEAFRDLGQSGGYAWGATALVHMYDQLDEASRTMTRQIGGYLTLLQEHFPSVHQCVIDDAYEETSPRASRWLTTKAYMKGIAGVPYWACCDALIVTNGAIQSIPPPPVSASLSYDDIDDRWMHFSDHVAAVGDFCIVPGQVSADYMEWFFQISHPFIIPTQAGDQPRHPPAPDHEDYI

SEQ ID NO: 154946 - protein, 176 aa, Glycine max
  Coding DNA Sequence Number=SeqID_63261
MMLAAWSAMIRLTFDNRIMHYIIVRILLPRSSNLAQASEEDLTLMWAFLTGRQIDWAHLVRYRMHKALRANAPLPYPQLITLFLRHFQIPLDDEPFVQVKRSFAIGAGAVTSFGYRKDRNGQWLKKDALPPQDERTPSPPPQREDSALLNEVPCRITRDCHHLKGGDCRQRIKPMF

SEQ ID NO: 154947 - protein, 72 aa, Glycine max
  Coding DNA Sequence Number=SeqID_63262
MEHEHSFKKSNYNMILVGFSNIPLPFVYDKLSYFPYTLMSGSPGKDINFSFENYFRKFPKTPTTDGGFGGRL

SEQ ID NO: 154948 - protein, 241 aa, Glycine max
  Coding DNA Sequence Number=SeqID_63263
MDRARSKGVISDSLAFERLSPIINLAYIRKNCWNPDDPTVIIRGTRRPRARPAKVPATSAAPPPSRMTAAPSTLPPTDFQRFEAMLRSIHQGHIILLQRLQLVAPLDSIPTVEQFNEWVAWLGTQPPFHREDEDPATQVPHQSEDESSESSTPEPLIRKMRVVVTQKAAATSEKSLEATPELPAPVANTTSPQQAVDPSTPEDQTTPVLSLNTSPVATPVLHLSKEEEGQTQDTQDQSQDI

SEQ ID NO: 154949 - protein, 132 aa, Glycine max
  Coding DNA Sequence Number=SeqID_63264
  Homolog annotation: Hit_ID=Q2HV58; Match level="QueryCoverage=92%, HitCoverage=32%, E-value=4e-08, Identity=27%"; Hit description =Putative non-LTR retroelement reverse transcriptase, related
MPSYSCPLCDHEEESIYHLMFNCEKTRSLWWETMRWVNRVGPHSIDPKNHFLQFTQWNSKARTNKRWEFLWLTLSFSIWYHRNAMLFKNQPFTPEKVMDDALFHTWSWLKCVEKDFNMHFTFWSTNLKDVFS

SEQ ID NO: 154950 - protein, 97 aa, Glycine max
  Coding DNA Sequence Number=SeqID_63265
MTNAVARKEEERTEIETHQESICQVTSLHHQLTNEEETPKVSNTPEYPYLAIVGYVGGKDKGRLKLNIEDKEISFYLFLAMKHPDMGDAYFEEEEVE

SEQ ID NO: 154951 - protein, 119 aa, Glycine max
  Coding DNA Sequence Number=SeqID_63266
MSPSPLGSHNHSQTHLKLSERLPLRALISTDLHTTKSLKTLWNLDLSLPRTSYTCKSFKPSPDSRACCHTLISSGDHCLMACNLCLTASRYWAPCVAQYVKFRDMPEIKRKHCYTIREI

SEQ ID NO: 154952 - protein, 32 aa, Glycine max
  Coding DNA Sequence Number=SeqID_63267
MAAEWRRRRVERRRHFKEKMSQEEAHHHKMQA

SEQ ID NO: 154953 - protein, 98 aa, Glycine max
  Coding DNA Sequence Number=SeqID_63268
MNQKSAPVARFCGLCSSSDHHTDLCPSLQQSGVNEQPEAYAANIYNRPPEQQNQQRQRVLILSSNRYNPARDKSLHSESDKSDGAYGYSVGPSSVPKF

SEQ ID NO: 154954 - protein, 77 aa, Glycine max
  Coding DNA Sequence Number=SeqID_63269
MSLHVLYLYAFSGFPPGISRLLYLSLQSFKEMNGQDHLELPSGVRTKCGQQKPIKVLRNGCKWGWGHDRLIVALSLR

SEQ ID NO: 154955 - protein, 51 aa, Glycine max
  Coding DNA Sequence Number=SeqID_63270
  Subcellular localization annotation: CTP_CleavageSite=45; ConfidenceScore=5.11e-01
LSLAHQWAKRASTAKRSFSALSTTEESDRASASRSCAKREISALSAAVVFS

SEQ ID NO: 154956 - protein, 93 aa, Glycine max
  Coding DNA Sequence Number=SeqID_63271
MLMMLEMHVVYVRWGCIDLVKCPWWEKIEWLKSLNISEGMFRIFNSSMVFVLDGAHGVHHLVGNSLVAQADHRGGELRCTTRWPRQLQHSFPK

SEQ ID NO: 154957 - protein, 148 aa, Glycine max; identical to SEQ ID NO: 104685
  Coding DNA Sequence Number=SeqID_63272

SEQ ID NO: 154958 - protein, 122 aa, Glycine max
  Coding DNA Sequence Number=SeqID_63273
MTRRDKIWSFCTLVSSRGSGPDDMRRYLTVIRHPFVIPEAAGPMTRRDKIWSFCTLVSSRGGGPDDTRRYLTEQRCIYMRKFLRYPATRSAERNEISAGPMTRGDTLRVIRTLLSSRGGGAR

SEQ ID NO: 154959 - protein, 68 aa, Glycine max
  Coding DNA Sequence Number=SeqID_63274
MGDQEETQEQMKADMSALKEQMASMMEAMLGMKQLMEKNAATAAAVSSAAEADPTLLATTHHPPSGIL

SEQ ID NO: 154960 - protein, 163 aa, Glycine max
  Coding DNA Sequence Number=SeqID_63275
METCPMVEELLQRLMDCGQLEVFIEGKEEPQICMQSEEKRVPLTPKALVICFTRKGTGSTPIYPRAAPKPTPFAYQSNKAVPWKYTPPTSSERVVTEVGSLSAKVTNITGLSGETRSGRVFASPHPVELPSKGKAPMVQEPTDIATPSKEVDPPVARGAEKKE

SEQ ID NO: 154961 - protein, 130 aa, Glycine max
  Coding DNA Sequence Number=SeqID_63276
MDLEERSRIFAKIGEKLAAQLAQASKLSKKLRKLTDCAKTPLFDFRHITDFHGSRNPASFRFLRPLGTSFIVQQRTPNISKRLTKGCMSSSNNPRTKLGYDSKLLVKWLVYTTIAFIISKFMLFILKFRD

SEQ ID NO: 154962 - protein, 155 aa, Glycine max
  Coding DNA Sequence Number=SeqID_63277
  Homolog annotation: Hit_ID=A5AYU6; Match level="QueryCoverage=47%, HitCoverage=13%, E-value=4e-10, Identity=38%"; Hit description =Putative uncharacterized protein
GTSAWVIVNENKRGYISYGSVQVEGTSTWFFKENKGGYIPCGSLLVKDFTRLKEISRTGGCLGTGCRHRLLPNQNRSFQNHDEDQVNLCLMTKSHENNKEESVRKKWYIDSGCSKYITGDVSKFTTISPKKSGHVTYGDNNISKISKEVTSKPSL

SEQ ID NO: 154963 - protein, 182 aa, Glycine max
  Coding DNA Sequence Number=SeqID_63278
MSIHVAQLIADAIYIFAGPWEFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAEVAWPGDWPGAQAGEAPPEAPGDGEEAHEDEEMADLLDFLGGSGDT

SEQ ID NO: 154964 - protein, 197 aa, Glycine max
  Coding DNA Sequence Number=SeqID_63279
  Homolog annotation: Hit_ID=Q6WAY6; Match level="QueryCoverage=88%, HitCoverage=35%, E-value=5e-22, Identity=31%"; Hit description =Putative uncharacterized protein
RIATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDRRIDWDQLLAGIGGRTISWFPRWKEGKEGVLFSCGRYPNIPLVGTRGCINYNPTLAIRQLGYPMRGAPTEESMSPFLVRDLGAQNSKTIQRIPKAWET

SEQ ID NO: 154965 - protein, 215 aa, Glycine max
  Coding DNA Sequence Number=SeqID_63280
  Pfam annotation: Domain name=zf-CCHC; Domain location=17-34; Score =30.0; E_value=8.9e-06; Accession=PF00098.14; Description=Zinc knuckle
MTSKESDTPKPKIKPKITCYNCGKQGHISKYCRLKRKLRNLNLEPTIEEQINNLLIETLEEETKTSSSTFSEENLNIIKQDDQPSSTDDDEREINTLTREQDLLFEANNSIPDPQEKKVFLEKLKKTLETKPRPKDFITNNKFDVSNIFKRLENTSAKSTTIQDLQIEINNFKKEVKERRQQQEIHQIILSQLEENSDSESIEKNGLIQTAFWKD

SEQ ID NO: 154966 - protein, 360 aa, Glycine max
  Coding DNA Sequence Number=SeqID_63281
  Homolog annotation: Hit_ID=Q6WAY6; Match level="QueryCoverage=75%, HitCoverage=45%, E-value=2e-26, Identity=31%"; Hit description =Putative uncharacterized protein
MGQLQRQAFRKAYGKIWDLATLVPTVEEFEEILGCPLGGRKLYLLLRFYPSVVRVAKVVKILAQELDQVKQNWNGVVGVPRRCLEEKAKALANQGEWTSFIDILAFLIFGVVLFPNVEGLVDLAVIDAFLVFHHGKESPIVSIFADMSNMFDRRCEKSGTRIVCYIPALYVWLVSHLFRQEGRPVCSLQGHRSCAEKGKANWDQLLASMEGASDNWFPCWKEGRTRILSSCEGFPNVPLMGTRGCISYNTILVIRQLGYPMRGVPSEESIVPFIAWGFSDPNARVLQGVHKAWDVLRAAREEEAEAQEESEEVQALKTELEKAQAVKEKFKSATIKVRKEYDKLKDINMATARSFGIGNC

SEQ ID NO: 154967 - protein, 73 aa, Glycine max
  Coding DNA Sequence Number=SeqID_63282
  Homolog annotation: Hit_ID=A5ACR1; Match level="QueryCoverage=98%, HitCoverage=4%, E-value=5e-10, Identity=39%"; Hit description =Putative uncharacterized protein
MAEYEACALGIQAAIDFDVKLLKVYGDSALEEQDGKPWYFDIKQYVENKEYPPGISDNDKRTLRRLATGFFVS

SEQ ID NO: 154968 - protein, 80 aa, Glycine max
  Coding DNA Sequence Number=SeqID_63283
MKMLDAWVILQKRVAPLNTFIIPSIIGIWCLIIPILGTNKVQGVYALTNQTLIQQLIYLRNNLKLKRYGSVLRDVSFDRR

SEQ ID NO: 154969 - protein, 217 aa, Glycine max
  Coding DNA Sequence Number=SeqID_63284
  Homolog annotation: Hit_ID=Q6WAY4; Match level="QueryCoverage=87%, HitCoverage=36%, E-value=3e-17, Identity=32%"; Hit description =Putative uncharacterized protein
GLDVTSLKELGRLMGPLQRQAFRKVYRKILDLTAAEVFTEDVVSLAQYYDQPLRCFTFGDFQIVPTVEEFEEILGRPLGGGGRKPYLFFGFLPSLSKIAAVVGDSARELDCMKQTRNSVVGLPRKYLEGKARDMANQEEWVPFADILALLIFGVVLFPNVDGLVDLAAINAFLAYHHSKGSPVEGKGGVLFSCGDYPNVPLRGMRGCINYNPTLAIR

SEQ ID NO: 154970 - protein, 72 aa, Glycine max
  Coding DNA Sequence Number=SeqID_63285
MEEIHGEEYEEKIIKLHVELVGLESSSSMKSFTSCRSMKVGWRRSKDDWRCHFKEKMIREQAHHHRKPWIRA

SEQ ID NO: 154971 - protein, 127 aa, Glycine max
  Coding DNA Sequence Number=SeqID_63286
  Homolog annotation: Hit_ID=A7Q8B9; Match level="QueryCoverage=36%, HitCoverage=14%, E-value=2e-12, Identity=68%"; Hit description =Chromosome chr14 scaffold_63, whole genome shotgun sequence
MVGAGLKKDLRVSRVVPGGSLNAFPFLLIGVISQRLAMESIDSLPIGWTVGAMIYFTGEVSAQLVELRSCNWVVAITEDRNMPLKDSTETKTGCQERRGGFPHLGSWGRGSSWPIKLIDTVDLEGGP

SEQ ID NO: 154972 - protein, 120 aa, Glycine max
  Coding DNA Sequence Number=SeqID_63287
MAAEWRRKRERRRHFKEKMSLEEAHHHRRPWIRAWRKKEMNEGRGREEHENLCSKRALKSELLFNPLIQDQFQDSPLGVLRCHETSYGLEIYPKAHENPSAFSYIFGPIFLESSIQCPWR

SEQ ID NO: 154973 - protein, 227 aa, Glycine max
  Coding DNA Sequence Number=SeqID_63288
  Homolog annotation: Hit_ID=Q652R5; Match level="QueryCoverage=34%, HitCoverage=31%, E-value=2e-23, Identity=69%"; Hit description =Putative uncharacterized protein P0603C10.50
  Subcellular localization annotation: CTP_CleavageSite=51; ConfidenceScore=5.10e-01
RPPRPPTHRGLVLAPTAGAQLGTVTQLPVHPASPVLLTKNGPLGALDSMARLNRAAAPYPEGNFGGNQLLDGSISLSPLYPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 154974 - protein, 83 aa, Glycine max
  Coding DNA Sequence Number=SeqID_63289
  Subcellular localization annotation: CTP_CleavageSite=41; ConfidenceScore=5.30e-01
MIKLRAMLSIIFGMTPICGSCAVTRGQLARCLTAVCTGPPSSRMRGESVALVSLVREQAAHLYGDRKCLNNLCYSVRCLMSGV

SEQ ID NO: 154975 - protein, 137 aa, Glycine max
  Coding DNA Sequence Number=SeqID_63290
  Pfam annotation: Domain name=G-patch; Domain location=4-41; Score =4.8; E_value=0.049; Accession=PF01585.14; Description=G-patch domain
STLEDPTHGYEPGMGLGKDSHGNADVVDIRGNLYIYGLGYEPGKLGRRNAPSRLWADRAWPGHVSQCFTSAGIMFEEEVAAIGEEAPQDPPSFVRPCHPNFQVGNWHERKRTSFTRVGEIDRSRRTRNEAFTKRKPN

SEQ ID NO: 154976 - protein, 117 aa, Glycine max
  Coding DNA Sequence Number=SeqID_63291
MILRGQDIYSSQDKATNSPSSSESEKAKGGESSEEIYPQEEGQPLVVKEKCKEVSVSSKSDQRVPMNPKRIKVIPEWLTPPTPLIELVRNHVPSWEDAQEMGFQTLPYFNIPNTTNT

SEQ ID NO: 154977 - protein, 88 aa, Glycine max
  Coding DNA Sequence Number=SeqID_63292
MRSSFPFPSVSGGGPLTDRNIVCVGWLRGSPMMLGCGSALGAAPSVGHGDKDPQGMYPPLFSLNLVDVPSTRTDPQEMYPLLFSVKPK

SEQ ID NO: 154978 - protein, 45 aa, Glycine max
  Coding DNA Sequence Number=SeqID_63293
GVSSLSSFSIPLTFIFQEVKESIDEEDPRPTSSNGAYINLVTTAL

SEQ ID NO: 154979 - protein, 66 aa, Glycine max
  Coding DNA Sequence Number=SeqID_63294
  Subcellular localization annotation: CTP_CleavageSite=42; ConfidenceScore=5.03e-01
MWFRKWPQGSLPQRDPGKTRRLKEPVPLPNMTAIVLGPLSTSSALRPSKDGHSSGRDVSSSGRRVY

SEQ ID NO: 154980 - protein, 256 aa, Glycine max
  Coding DNA Sequence Number=SeqID_63295
GQECEYDQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYFTAFGFASRRPTTEHIPVQGRGLHGPEIGPRPKQDPPPPEAPGDGEEAQEDEEMADLLDFLGGSGD

SEQ ID NO: 154981 - protein, 83 aa, Glycine max
  Coding DNA Sequence Number=SeqID_63296
MWDTLQLTHEGTTDVKREWQPKVTAISESKDLSSMSLATLFGKLQEHEMELQRLNQNEENEKKKRSIALKASSSIQEENEEED

SEQ ID NO: 154982 - protein, 300 aa, Glycine max
  Coding DNA Sequence Number=SeqID_63297
MAPRKLASKRSRKDKAAEGTSSAPEYDSHRFRSVVHQQRFEAIKGWSFLRERRVQLKDDEYTDFQEEIGRRRWAPLVTPMAKFDPEIVLEFYANAWPTEEGVRDMRSWVRGQWIPFDADAISQLLGYPMVLEEGPGMRVWTEEEPDFARTAAGRRVRIMRTSMTTLTQIWMTLLLSNILPTDHNSDLPMPKCQLVYAILTRVSIHVAQLIADAIYIFAGMAPTRHPLDPDKSNRALGFPALITGLCQSFGVPVAPTKVIRPPITRAFIEKYCTQRQGQGDAPQAAGAPPPPHQAGQAGAF

SEQ ID NO: 154983 - protein, 163 aa, Glycine max
  Coding DNA Sequence Number=SeqID_63298
  Homolog annotation: Hit_ID=Q9SJS1; Match level="QueryCoverage=52%, HitCoverage=12%, E-value=5e-08, Identity=38%"; Hit description =Putative Athila retroelement ORF1 protein
MHRSSTGNLAPLDLEIKAALRRNKAERRRKLLQDRIVASILEEETHFSDLLSPDSPSSRESATQLPKAITMVEEHDQRITLEDYSSSSVPQFFTSIARPEVQANNINYPHSLIHLIQGNLFQGLPNEDPYAHLAMFIEICNTVKIAGVPKRSYPLKSKIILSS

SEQ ID NO: 154984 - protein, 140 aa, Glycine max
  Coding DNA Sequence Number=SeqID_63299
  Homolog annotation: Hit_ID=A5AZ88; Match level="QueryCoverage=50%, HitCoverage=6%, E-value=3e-08, Identity=40%"; Hit description =Putative uncharacterized protein
MEEGFSKGSVPIILGRPFMKTARTKIDVYAGTLSMEFGDITVHFNILDAMKHPSEDLSVFRVEIIDHIIDEYMTDLHSNLHVCHSSCIESEFVLDHMSEFDAESESEFDIDYMAADVLPLEIAFIESDRTNHVSGKYTYL

SEQ ID NO: 154985 - protein, 142 aa, Glycine max
  Coding DNA Sequence Number=SeqID_63300
MWPFIPADKLIGHTLSVTLFLQHFNILLDSEPYVPIKRSFLIGVVVVASFGYRKERDGPWVKKGAQPNDAEGQLPVEGDSSLLQSILDRFDGLQTYVGERFDALERQVDTRFDEMDSRITKVEEDVTIIHDCLDLPPPPPSV

SEQ ID NO: 154986 - protein, 113 aa, Glycine max
  Coding DNA Sequence Number=SeqID_63301
  Homolog annotation: Hit_ID=A5AWV0; Match level="QueryCoverage=61%, HitCoverage=5%, E-value=2e-11, Identity=48%"; Hit description =Putative uncharacterized protein
YIEKAKPIGLLEYRHEERVGRKGSRGLHVITPTVRESGMLLNIQGKTKDGLNTRQDLAKIGIRLKLHRSKVLYPVKLDELENKAAIILCQLEMHFPTAFFDIMVHLFAVDVAG

SEQ ID NO: 154987 - protein, 241 aa, Glycine max
  Coding DNA Sequence Number=SeqID_63302
MQSWVRGQWIPFDADALDQFLGDPLVLEEGQECEFSQRRNRADGFDEEAIAQLLCTPRQDFAQTAAGRRTRIIKSNRALGFRALIRGLCQSFGVPITPSKVIRPPIIQAFIEKYCTPRQAQGDAPQAADAPPPPHQADPVGSLGMEQYLQHLVRQQAANHRGQVRIHECLYQLSLSQQGQGFAPFACPTPDQFRAEVAWPGDWPEAQAKEAPAGAPGDAEEACMDEEMTNLLGFLGGSGAT

SEQ ID NO: 154988 - protein, 21 aa, Glycine max
  Coding DNA Sequence Number=SeqID_63303
MNPSFPNKGNPPIEGIPLKAK

SEQ ID NO: 154989 - protein, 199 aa, Glycine max
  Coding DNA Sequence Number=SeqID_63304
MKLEQAQAVKEKFKSAVARIRKENAELRDINIATTKALVQKTKRARKKEHGRNKFRGEERDQSRVDGMILKDELKTCLRSKRSLSQQLCETETNMLAIISKYKEELDLATAHEHKVADEYARVYAEKEARGRVIDSLQQEATMWMDWFAFTLNGNQDLPRLLAKAKVMADAYFAPEEIHVLLSYCQHMIDLMAHIIRSH

SEQ ID NO: 154990 - protein, 198 aa, Glycine max
  Coding DNA Sequence Number=SeqID_63305
  Gene Ontology: Mol. function=protein disulfide isomerase activity; Cellular component=periplasmic space; Biological process=cell redox homeostasis
  Homolog annotation: Hit_ID=A4WE44; Match level="QueryCoverage=85%, HitCoverage=71%, E-value=8e-81, Identity=88%"; Hit description =Thiol:disulfide interchange protein precursor
MSRRNACGSYTNSTTLVRECRQIVTGSTMKKSFALFTLLAASFTGFAHADDAAIKQSLAKLGVTSSDIQSAPVAGMKTVLTNSGVLYVTEDGKHMIQGPPMYVSGAQPVNVTNQLLMKNLNALEKEMIVYKAAQEKHVITVFTDITCGYCHKLHEEMKDYNALGITVRYLAFPRAGVQSQPEKDMKAIWWCERPQQSV

SEQ ID NO: 154991 - protein, 258 aa, Glycine max
  Coding DNA Sequence Number=SeqID_63306
  Homolog annotation: Hit_ID=A5AZ88; Match level="QueryCoverage=58%, HitCoverage=15%, E-value=9e-11, Identity=31%"; Hit description =Putative uncharacterized protein
MYDYHEKESPPDLEIILADFMTYQARSKGYCYFMQQQGTQFERNQSSAGYQWESYRKSDYHNKAEGVLNLDDLLMQFKDTVESIQEAFRRTETQIKEKPEVSSTPEYPYLATVGYVGGKNKDRLELSVEDQKISFDLFKAMKHSDMGDSYFEEEEVEQEIALLASTMVLQSPLEKEPGYGRDCLACDEELDDSKDSCVDQVAFEELEKLRPVEKPKAQLKTLPAHLKYVFLEEDETKLVIISNSLKKEEEDQLVQILK

SEQ ID NO: 154992 - protein, 43 aa, Glycine max
  Coding DNA Sequence Number=SeqID_63307
MVHASYDTGNSINCGSMYFVLGGVSLGYFLGIGYGTYRIASES

SEQ ID NO: 154993 - protein, 338 aa, Glycine max
  Coding DNA Sequence Number=SeqID_63308
  Subcellular localization annotation: CTP_CleavageSite=31; ConfidenceScore=5.10e-01
MAEPSKKRKGSSSWSQWHSETQETLIPSSISSSSLFSSKEQRIQYTNLFSSRSIIDPKFIDMDFFSNESFACIQAFENSNLIPFMSLKLPVYSDLVKAFYSNLEIQEGTLISEVYGIKMVIDQFLFYDLTQLSSEGVPFEGTLIDDWKYEFSVHDARRLVCTNQADMTRRLLAGSLAFESRILHYLIVRILLPRSSNLAQALRLNAPLPYPHLVTLFLQHFNIPLDFEPYVPIKRSFLIGAAVIASFGYRIEHNGSWVKKGAQPIDEEGHLHGGEDSSLLQKILDRFDGLQTFVGERFDTLELQVDMRFNEMESRITMVEKDVSYIRTSFDLPPPPPP

SEQ ID NO: 154994 - protein, 139 aa, Glycine max
  Coding DNA Sequence Number=SeqID_63309
MEPSKKRKGTSSRSQRHSGSQETPIPSSISFGSLFSSEEQWIRYTNLFSYRSIIDPKFIDMDFFSNESFECFQAFENSNLIPFMSLKLPVYSDLVKAFYSNLEIQEGTLMHEVYGIKIVIDQSLFYDLTQLPSEGVPFE

SEQ ID NO: 154995 - protein, 45 aa, Glycine max
  Coding DNA Sequence Number=SeqID_63310
MEKDVDAILPRKGPITRTMSKRLQEDWVRAAEEGPRVLMNLRVDF

SEQ ID NO: 154996 - protein, 31 aa, Glycine max
  Coding DNA Sequence Number=SeqID_63311
MARECFPNEYLMWNCPSRVGNGPEEARLKEI

SEQ ID NO: 154997 - protein, 310 aa, Glycine max
  Coding DNA Sequence Number=SeqID_63312
  Gene Ontology: Mol. function=transporter activity; Biological process= transport
  Homolog annotation: Hit_ID=Q0BAX0; Match level="QueryCoverage=48%, HitCoverage=28%, E-value=1e-12, Identity=32%"; Hit description=Outer membrane efflux protein precursor
MKNNNMHRRAAARRLSLLAGCITVMMAPAISVMADSTSELMMFAEMSGHRPAAPAAAPVRSAPVQRVPVAPVQRFATAPAPQPMFTQSQAAPVAPPIAAPRAQPAPTPTPSPAPAPAAPIAPPPVQPVQGGGFLTEEQRQPEPKQTNPLLKSVRTFNSQQPAPVPVNEAEVKAQSEFSYVSPPVAETRITAADAAVARSPVSLSGAVDETVAESELRQKFLSAARITWRISPALKSSVAQTDAAAASVDEAKGQRWPQLDVSASSATKEFGGGVKSDGSQSNVPALGVSMATNLIDFGQTSRTIESREER

SEQ ID NO: 154998 - protein, 56 aa, Glycine max
  Coding DNA Sequence Number=SeqID_63313
MDKSLKVGEDEWRERERGEQNFERKKRENELWFNRLIQEIQDSPLSVLRCHETCKA

SEQ ID NO: 154999 - protein, 83 aa, Glycine max
  Coding DNA Sequence Number=SeqID_63314
MSETIKIGMVYFKCMRWPRGNLPQRDPGRIKRPKEPVPLPSMTVIALGVRNTSSASRPSRDGHFFGSDASSSGTMSIPISRKR

SEQ ID NO: 155000 - protein, 106 aa, Glycine max
  Coding DNA Sequence Number=SeqID_63315
MPLWWEFNSWVREDRVLHCRPMDNFLQHSSIAASKVSNKRRKIWWIIATRSIWKLRNDIIFHNQPLHISKLVDNRNFLTWSWLRGREKDFNVPFHQWSSAMSMAFN

SEQ ID NO: 155001 - protein, 142 aa, Glycine max
  Coding DNA Sequence Number=SeqID_63316
MKLDRFKCRCCYWWRHLNLVARTQGSEWRLLSLAEIAYSGWSFVSLTLLRKVEEGPQLLVVFVVTAIFALEKEHKACLGQQHSEKEGQVVVVVEDLSISDLDDSSNLDCICCLKGHNYSVVVGFSTEEVYYKCLQHKLQVAH

SEQ ID NO: 155002 - protein, 146 aa, Glycine max
  Coding DNA Sequence Number=SeqID_63317
  Pfam annotation: Domain name=Transposase_23; Domain location=6-70; Score=-11.8; E_value=0.023; Accession=PF03017.5; Description =TNP1ENSPM transposase
STLEDPTDSDRCGLYIEADPARLVAVGRVYEGSTLVHNTPLLPGQVKVSVDEVKDADAPVPVPTAEVVVSPPKPPPKLDPEVNDPLYLMTLTIPELFLRPYQVRWDATVFGVVNPDFPLYIKHEDLSEIAHGCQCLSISVLRLWIL

SEQ ID NO: 155003 - protein, 144 aa, Glycine max
  Coding DNA Sequence Number=SeqID_63318
  Gene Ontology: Mol. function=transporter activity; Cellular component= integral to membrane; Biological process=transport
  Homolog annotation: Hit_ID=A7MEZ7; Match level="QueryCoverage=97%, HitCoverage=26%, E-value=4e-65, Identity=83%"; Hit description =Putative uncharacterized protein
MQGFFGGGLQPTQQSVLLDYFKPEDRGKAFGLSSIAIIVAPVLGPTLGGWITDNYSWRWVFFINIPVGIVTVLAIYQLLEDPPWESKSKEKLTIDWTGIGLIALGLGCLQVMLDRGEDEDWFYSNFIRTFAVLTLIGIIGAFTG

SEQ ID NO: 155004 - protein, 227 aa, Glycine max
  Coding DNA Sequence Number=SeqID_63319
MGDPISRLSFPENTETFSSLTSYPELRRSEFLIGGYVGARASLLSTTPPFVAMTQELTKFGHPAHMIRGDTLRLSAPLCYLDTVVVRWHAETKFGHSAHMIRGDTLRLSAPLCYLDTVVVRWHAETKFGHSAHMIRGDTLRLSAPLCYLDTVVVRWHAETKFGHSAPKIRGDTLRLSAPFCHPEAAGPMTSRDQVWSFCTQDTRRYLTVIRTLLSSRGGGPDDKQRP

SEQ ID NO: 155005 - protein, 71 aa, Glycine max
  Coding DNA Sequence Number=SeqID_63320
GPQLLAVSGVVAVVGLVEECMAGPSEVRVIPPSRVVSVAGEATQLLQVAAWKGKGLYGGQQMSTNHKPLQQ

SEQ ID NO: 155006 - protein, 202 aa, Glycine max
  Coding DNA Sequence Number=SeqID_63321
  Gene Ontology: Mol. function=nucleoside-triphosphatase activity; Cellular component=chloroplast
  Homolog annotation: Hit_ID=Q2PMM5; Match level="QueryCoverage=99%, HitCoverage=9%, E-value=1e-111, Identity=87%"; Hit description =Protein ycf2
MGSHPYGLVENNSDLVHGLLEVEGALVGSSRTEKDCSQFDKDRRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKH

SEQ ID NO: 155007 - protein, 126 aa, Glycine max
  Coding DNA Sequence Number=SeqID_63322
MGSDHRLPSTREGGSADGTDIDDRWVQFADHVAPTGELCVVPGQVAPDYMEWFFQISHPFVTPTEDTAEPRPAPSLPTHDDDFVEPPVAQVPVTSDPPAHSMVDCTTCVRMGRIAEHLKHVINLRM

SEQ ID NO: 155008 - protein, 100 aa, Glycine max
  Coding DNA Sequence Number=SeqID_63323
MLLYPYGEQDVVLRLPPRPICDELLEPTPSSPGSSPASRLRPAPSSNACAGNLVQPSPTLAIRPVREATRQLQTPSVPSYYYRLSNWSSPSYYIIALSRR

SEQ ID NO: 155009 - protein, 178 aa, Glycine max
  Coding DNA Sequence Number=SeqID_63324
MAPRKLASKRSRKDKAAEGTSSAPEYDSHRFRSAVHQQRFEAIKGWSFLWERRVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGEASANHAHQHDHPDPDMDDVAPQQHPAHRS

SEQ ID NO: 155010 - protein, 178 aa, Glycine max
  Coding DNA Sequence Number=SeqID_63325
MAASDIAILRDRAHVPTKKCLLELTSQDALLAQNKLLSKQLEALTETLKHPTHEVNYMGNQPRNNLNVGGFSGFQHGLQYNQQQGQWRNHPRNQFNRDQGGPSTRPQQQGPSLYDRTTKLEETLAQFMHVSMSNQKNTESAIKNLEVQVGQLAKQLAVDHQVVLQLIQRKIPRRNVKL

SEQ ID NO: 155011 - protein, 90 aa, Glycine max
  Coding DNA Sequence Number=SeqID_63326
MEVKQNFAQVQKNAYVWLAVESLVQNEFWMFASRSQRLQRIDGDPVLRETRIWATWEYVSSVEGGQQGMVGLCAHCGCGKLVVHHRPTTT

SEQ ID NO: 155012 - protein, 88 aa, Glycine max
  Coding DNA Sequence Number=SeqID_63327
MSPVESPTVATYPSAGGRRVTRGMHVPRKEYARSRHQRLFEENIGKTGKGAIYELLSERFGSCIYARGRGDHFKALDLENDPFYLVRN

SEQ ID NO: 155013 - protein, 67 aa, Glycine max
  Coding DNA Sequence Number=SeqID_63328
HGDAVVDGGDIGFDRRIRCPAQPVGWQADEEDQPDLSARLNDRAAAQARESAAVAARVRESVADRSG

SEQ ID NO: 155014 - protein, 135 aa, Glycine max
  Coding DNA Sequence Number=SeqID_63329
MWMTLLLSNVLPSDHNSDLPLPKCQLVYAILTRMSVHVAQLIADAIYLFAGGQPSGLVQIHECFYQLCLSQQGQGFVPFACPTPDQFCAEVAWPGDWPEAQAGEAPAEAPGDAEEARMDEEMTDFLGFLGGSGAT

SEQ ID NO: 155015 - protein, 88 aa, Glycine max
  Coding DNA Sequence Number=SeqID_63330
MPLRHNQIKFSVEEVRDEDSPIPVPTQEEKPVDRLNHDVDDPLYLMALTIPHLFLKSLQIMWDATTYDQTSIRAGNVDVYGFLKPRSI

SEQ ID NO: 155016 - protein, 81 aa, Glycine max
  Coding DNA Sequence Number=SeqID_63331
MRVHYYQASRRPSDVILYSFTSTPYVPMDPVPSGVANCRNLPFGERATRGSRVHLPWEEMHGVATNVYSRKTSEKLERCGL

SEQ ID NO: 155017 - protein, 244 aa, Glycine max
  Coding DNA Sequence Number=SeqID_63332
MKEREMITIMVDTLPTFYYEKLIGYMPANFADLVFAGERIESGLRKGKFEYASNMAPNNNRRAPMVGARKKEGDTHTVTTAPTWMKAPQNVQNSYQHNPPNFSIRARSSLLTQVKGPSRNRKNVCPTQLQPLPGQPIIQLLARAIIMHAPPPPPREKIFLLFPWHTPSWGLYYWKNIWGGPPPGRSSNHCTPRGTTRMPRGHTKGELPETKLTPACRSSIRGNTQKMPGGYHSKRRAPTLKPTH

SEQ ID NO: 155018 - protein, 123 aa, Glycine max
  Coding DNA Sequence Number=SeqID_63333
LCQSFGVPVTPSKVIRPPITRAFIEKYYTQRQVQGDASQAADAPPPHQAGPAGLFDTEQYLRHLMSLGLQSQGFTSFPCPTPDQFRAEVAWPGDWPEDRAGEAPARAPAEAPDEVDQAREDER

SEQ ID NO: 155019 - protein, 92 aa, Glycine max
  Coding DNA Sequence Number=SeqID_63334
  Subcellular localization annotation: CTP_CleavageSite=45; ConfidenceScore=5.33e-01
MNCVFFHVSSTHFEFGAMRSDCLVQFSILNPFFGASMNCGFVHVSSTPEFGAMRSDCLVQFSILNPFFGAPLIVFSFMCPIPSSLEPGVVIA

SEQ ID NO: 155020 - protein, 240 aa, Glycine max
  Coding DNA Sequence Number=SeqID_63335
  Gene Ontology: Mol. function=hydrolase activity, hydrolyzing O -glycosyl compounds; Cellular component=cytoplasm; Biological process= carbohydrate metabolic process
  Homolog annotation: Hit_ID=A4WCH4; Match level="QueryCoverage=99%, HitCoverage=51%, E-value=1e-129, Identity=92%"; Hit description =Glycoside hydrolase, family 1
  Pfam annotation: Domain name=Glyco_hydro_1; Domain location=1-236; Score=-4.9; E_value=1.9e-18; Accession=PF00232.9; Description =Glycosyl hydrolase family 1
MLLGGVMYPLTCKPEDVLETLQENRTWQFFGDVQCRGAYPGYMQRFFRDNGIQLEVTDADREALKSTVDFISFSYYMTGCVTADDALNQQARGNILSMVPNPHLASSEWGWQIDPIGLRTLLNVLWDRYQKPLFIVENGLGAKDKPDADGTVQDDYRISYLNDHLVQVREAIEDGVEVMGYTSWGPIDLVSASKAELSKRYGFIYVDRDDSGKGTLARSRKKSFYWYKEVIATKGASLKV

SEQ ID NO: 155021 - protein, 176 aa, Glycine max
  Coding DNA Sequence Number=SeqID_63336
MSLHSSSSVNGKHYTPKDPLYKILDELRSLKLWKEKQERKENGKKRVEEISQDERKKIREEERRKIMKEMKREKHASYSSHNSCKSLSEELRDYYEGRHRSHLRPHSYRRENERKPQEANINLPYFHGKDNVEAYLDWEIRVEQNSDQGVPMKPKRIKVIPEWPTPPSIKKNLGLP

SEQ ID NO: 155022 - protein, 20 aa, Glycine max
  Coding DNA Sequence Number=SeqID_63337
MGDANSTQAHLGPPEDSSRS

SEQ ID NO: 155023 - protein, 77 aa, Glycine max
  Coding DNA Sequence Number=SeqID_63338
MDISEDTDIPVILGRPFMLTTSLLQNTMFAYSPFAKRQPRAKRISVHALNCESQALSAQTLHLKLIWSAKLAKVELS

SEQ ID NO: 155024 - protein, 112 aa, Glycine max
  Coding DNA Sequence Number=SeqID_63339
MAHSSINEDFKGLEVVHQESQHAKLYLQVTKDTTFLRNLTFMKQDNDASDVGPLQSSSVDRHQEYALYRQRCLVMYNPLRTFEKKEEKMSLKKRITKEGYKNNHGFRFMRVF

SEQ ID NO: 155025 - protein, 75 aa, Glycine max
  Coding DNA Sequence Number=SeqID_63340
MEETSFTACHMLDGLFRKDDKQHWYGPHPLQRFKAKFGSPSKEICTLCLRNPFSLAVSPPSMVEKSLLISMLDDI

SEQ ID NO: 155026 - protein, 159 aa, Glycine max
  Coding DNA Sequence Number=SeqID_63341
  Homolog annotation: Hit_ID=A7PV16; Match level="QueryCoverage=100%, HitCoverage=43%, E-value=3e-37, Identity=48%"; Hit description =Chromosome chr4 scaffold_32, whole genome shotgun sequence
  Pfam annotation: Domain name=PQ-loop; Domain location=29-95; Score =69.4; E_value=1.2e-17; Accession=PF04193.5; Description=PQ loop repeat
MPPSYCVKERKPCVRWVEKYFKDCLCNLKDEISFSFGLTSLVFWGVAEIPQIITIFRTKKSHGVSLVFLLTWVAGDICNLTGCILEPATLYTITTIVLLLLIVYYDYISRWYKHRQKVNLKRDHEEEKKPLKPPKPTSKSGIPIPNGTPKAAPRQEHYY

SEQ ID NO: 155027 - protein, 27 aa, Glycine max
  Coding DNA Sequence Number=SeqID_63342
MVYMGGWRVEEFGLQISGVGVVECCVN

SEQ ID NO: 155028 - protein, 365 aa, Glycine max
  Coding DNA Sequence Number=SeqID_63343
  Gene Ontology: Mol. function=dimethylallyltranstransferase activity; Cellular component=chloroplast; Biological process=carotenoid biosynthetic process
  Homolog annotation: Hit_ID=A7PV07; Match level="QueryCoverage=99%, HitCoverage=99%, E-value=1e-124, Identity=64%"; Hit description =Chromosome chr4 scaffold_32, whole genome shotgun sequence
  Pfam annotation: Domain name=polyprenyl_synt; Domain location=101 -361; Score=409.1; E_value=6.4e-120; Accession=PF00348.8; Description= Polyprenyl synthetase
  Subcellular localization annotation: CTP_CleavageSite=54; ConfidenceScore=5.72e-01
AVNLNTWPRPSFILNQTATRRSRSSPTSHFFHGVNKLPSPISSLTVAKRSFTLSAVLTKEDTVETEEKPPIFDFKNYMVSKASAVNKALDDAVSLREPQKIHEAMRYSLLAGGKRVRPVLCVAACELVGGEEATAMPAACAIEMIHTMSLIHDDLPCMDNDDLRRGKPTNHKVFGEDVAVLAGDALLAFAFEHIAASTRGASPGRIVRAIGELARSIGSEGLVAGQVVDINSEGLADVDLERLEFIHVHKTAALLEGAVVLGAILGGGTDDEVEKLRKFARYIGLLFQVVDDILDVTKSSQELGKTAGKDLVADKVTYPKLLGIEKSKVFAAKLNKDAQDQLVGFDPVKAAPLIALANYIAYRQN

SEQ ID NO: 155029 - protein, 19 aa, Glycine max
  Coding DNA Sequence Number=SeqID_63344
MASCGALQVKVYLVLYLQA

SEQ ID NO: 155030 - protein, 621 aa, Glycine max
  Coding DNA Sequence Number=SeqID_63345
  Gene Ontology: Mol. function=protein binding; Cellular component =nucleus; Biological process=regulation of transcription
  Homolog annotation: Hit_ID=A7PUZ1; Match level="QueryCoverage=81%, HitCoverage=92%, E-value=1e-113, Identity=48%"; Hit description =Chromosome chr4 scaffold_32, whole genome shotgun sequence
  Pfam annotation: Domain name=GRAS; Domain location=147-453; Score =281.2; E_value=2.2e-81; Accession=PF03514.5; Description=GRAS family transcription factor
  Subcellular localization annotation: CTP_CleavageSite=43; ConfidenceScore=5.38e-01
MRVPSSPQPNNNHSPTSNLVLHTNNNPTTTFTYEPTSVLDLCRSPSPEKKLTVPKPEPQHNNNNNNLNLDLDDHVLPNSDWWESIMKDLALPEDSPTPLLKTNINPSCIPDFPPSSQDPPFDHPQDFTSLSEIYNQNLPYNYPTNTLEHSFYDLSHNHHHNNNNNVNNNNWDFIEELIRAADCFDSSHFQLAQAILERLNNRLLRSPMGKPLHRAAFHFKDALQSILAGSNRTSSNRLSSMAEIVQTIKTYKAFSGISPIPMFSVFTTNQALLETLNGSSFVHVIDFEIGLGIQYASLMKEIAEKAGAGASPLLRITAVVPEEYAVESRLVRENLNQFAQDLGISAQVDFVPLRTFETVSFKAVRFVDGEKIAVLLSPAIFSRLGSNGGSVGAFLADVRRVSPGVVVFVDGEGWTEAAAAASFRRGVVSSLEFYSMMLESLDASVAAGGGGEWVRRIEMMLLRPKIFAAVEGARRRTPPWREAFYDAAMRPVQLSQFADYQAECLLAKVQIRGFHVDKRHAELVLCWHERVMVATPALTLTLTLQSRDSSLPHDPDSPPSLAKLVLENVLSKNHLCFVFENVLVDLDVIASCLSVFTYCIVHNGWSSCLKLIMVLNATKPS

SEQ ID NO: 155031 - protein, 407 aa, Glycine max
  Coding DNA Sequence Number=SeqID_63346
  Gene Ontology: Mol. function=catalytic activity
  Homolog annotation: Hit_ID=Q9SUK9; Match level="QueryCoverage=70%, HitCoverage=73%, E-value=4e-94, Identity=62%"; Hit description =Putative uncharacterized protein
  Pfam annotation: Domain name=PP2C; Domain location=102-360; Score= -71.4; E_value=0.089; Accession=PF00481.12; Description=Protein phosphatase 2C
  Pfam annotation: Domain name=SpoIIE; Domain location=135-391; Score= -15.1; E_value=0.0043; Accession=PF07228.3; Description=Stage II sporulation protein E (SpoIIE)
  Pfam module annotation: Pfam domain module=PP2C::SpoIIE; Domain location=102-360::135-391
MAAPASNAVLLGDVHFDDVAAKPCGVHFRGETRRGALRATVNLRKPKTLSGILNFGCSTSDASWRSWNPSSLHRNSSFACCSAETTPHVQHLATSTFSIDQTNFGGERLKLFSGSCYLPHPDKEDTGGEDAHFICTDEQAIGVADGVGGWADVGVNAGLFARELMSHSVRAIEEEPKNSINPARVLEKAHSCTKAKGSSTACIITLTDTGLHAINLGDSGFIVVRDGCTIFRSPVQQHGFNFTYQLESGNGGDLPSSGEKKEKGEGSENGEALILPCWYMVGRVKNERLTHLSQSHIQVFTIPVAPGDVVVAGTDGLFDNLYNDEVTEVVLHSVRAGLEPQVTAQKIAVLARQRALDRNRPTPFSTAAQEAGFRYYGGKLDDITVVVSYITGSTCGLGCQPCLSFLT

SEQ ID NO: 155032 - protein, 256 aa, Glycine max
  Coding DNA Sequence Number=SeqID_63347
  Gene Ontology: Mol. function=transporter activity; Cellular component= intracellular; Biological process=transport
  Homolog annotation: Hit_ID=A7PUV5; Match level="QueryCoverage=76%, HitCoverage=67%, E-value=2e-89, Identity=80%"; Hit description =Chromosome chr4 scaffold_32, whole genome shotgun sequence
  Pfam annotation: Domain name=CRAL_TRIO; Domain location=148-256; Score=-31.9; E_value=0.032; Accession=PF00650.11; Description =CRALTRIO domain
  Pfam annotation: Domain name=CRAL_TRIO_N; Domain location=66-135; Score=28.6; E_value=2.3e-05; Accession=PF03765.6; Description =CRALTRIO, N-terminus
  Pfam module annotation: Pfam domain module=CRAL_TRIO::CRAL_TRIO_N; Domain location=148-256::66-135
MTLAQTKSHETDQRCREKRENRVLIPVLTFSCVNGSVSEERKQTKLGWELVPLVVTMFLLRRQTQNHHENDSSYQDTKVAELKTALGPLSGRQLKYCTDACLRRYLEARNWNVDKTKKMLEETLEWRATYRPEEIRWAEIAHEGETGKVSRANFHDRHGRAVLIMRPGMQNTTSAEDNIRHLVYLLENAILNLSEGQEQMSWLIDFTGLSLSTNISVKTSRDIIHILQNHYPERLAIAFLYNPPRIFQAFWKLGKI

SEQ ID NO: 155033 - protein, 260 aa, Glycine max
  Coding DNA Sequence Number=SeqID_63348
  Gene Ontology: Mol. function=membrane alanyl aminopeptidase activity; Biological process=proteolysis
  Homolog annotation: Hit_ID=A7P4P1; Match level="QueryCoverage=51%, HitCoverage=19%, E-value=3e-37, Identity=50%"; Hit description =Chromosome chr4 scaffold_6, whole genome shotgun sequence
PEEDLEELPPEPAVDALDFLEGDEDPLLEVDSPEEVMSASEADSTEDSGPREMAISGGSSSYHWIVPITLCFGSYDVRKSFLLQSKFETHDVKDFLGSTHKVEKQLLSASDRFGILDDSFALCMARQESLTSLINLMGSYREEVNYTVLSNLMTTSLKVQRIAADAIPDFLEYFMQFFINLFQYSAERLVVVCCGLVWVKLMKATAIEIALSGYPRNTRVDEAQPVPAMVEVEAVASEVVVVDVAAGVDVDDEQSKAESQ

SEQ ID NO: 155034 - protein, 171 aa, Glycine max
  Coding DNA Sequence Number=SeqID_63349
  Gene Ontology: Mol. function=carbon-sulfur lyase activity; Cellular component=vacuole
  Homolog annotation: Hit_ID=A7QX60; Match level="QueryCoverage=98%, HitCoverage=55%, E-value=3e-32, Identity=50%"; Hit description =Chromosome undetermined scaffold_213, whole genome shotgun sequence
  Pfam annotation: Domain name=Alliinase_C; Domain location=30-170; Score=-147.9; E_value=3.6e-06; Accession=PF04864.4; Description =Allinase, C-terminal domain
  Pfam annotation: Domain name=EGF_alliinase; Domain location=6-63; Score=114.5; E_value=3.2e-31; Accession=PF04863.4; Description =Alliinase EGF-like domain
  Pfam module annotation: Pfam domain module=Alliinase_C::EGF _alliinase; Domain location=30-170::6-63
MGQWEPTWSTRAAEEAEVVAAIPCSGHGRAYLDGLILKDMNKSLCECNSCYAGSDCSQFLSDCPANADGKVHRIWKWLNPLLNAAVYALSPYSSMFPAKVVATAPYYPFVTSPNNPDGKLNKGVLKGSDVKTIYDRAYYWPHFTAISSPADDDLMVFTISKLTGHAGSRFW

SEQ ID NO: 155035 - protein, 247 aa, Glycine max
  Coding DNA Sequence Number=SeqID_63350
  Gene Ontology: Mol. function=protein binding; Cellular component =membrane coat; Biological process=intracellular protein transport
  Homolog annotation: Hit_ID=Q8VZ37; Match level="QueryCoverage=26%, HitCoverage=39%, E-value=7e-23, Identity=78%"; Hit description =Putative clathrin coat assembly protein
  Pfam annotation: Domain name=AFT; Domain location=34-125; Score= -46.2; E_value=0.058; Accession=PF08731.2; Description=Transcription factor AFT
  Pfam annotation: Domain name=Clat_adaptor_s; Domain location=159-247; Score=-53.8; E_value=0.0094; Accession=PF01217.11; Description =Clathrin adaptor complex small chain
  Pfam module annotation: Pfam domain module=AFT::Clat_adaptor_s; Domain location=34-125::159-247
MSEEVNMNYENEEECDVNVPHVDCSEAFNTSQVFDSRGDVLRWAQSIAYENGFVAVIVRFDTYRGSRGRTSFVLIGCERSGEYRCRKKEFVRRDTRTRKCECPFKFRGKPVDGEQGWMENTVHPIGDRRLNWCGQFNFRKKQDDKSSAGVEHGGEASSRQILPISDQSVEKQHEAIRNVFSVLCCRPEHVSNFVDAESFFGPDSRLVYKHFATLYFMFIFDSSENELAMLDLIQGRLWYYLTIYCIV

SEQ ID NO: 155036 - protein, 94 aa, Glycine max
  Coding DNA Sequence Number=SeqID_63351
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A7NWX1; Match level="QueryCoverage=56%, HitCoverage=6%, E-value=2e-20, Identity=79%"; Hit description =Chromosome chr5 scaffold_2, whole genome shotgun sequence
MSPRVHETLSRSPLSSVVVDALQVLTRAPSFALHHDAKVVMVEFLKKFADTKRLNWGQWGICIGLALVSWPIGWVVKLIPIPNKPFLSFLSKKK

SEQ ID NO: 155037 - protein, 1526 aa, Glycine max
  Coding DNA Sequence Number=SeqID_63352
  Gene Ontology: Mol. function=histone-lysine N-methyltransferase activity; Cellular component=intracellular; Biological process =chromatin modification
  Homolog annotation: Hit_ID=A7PV29; Match level="QueryCoverage=100%, HitCoverage=100%, E-value=0.0, Identity=55%"; Hit description =Chromosome chr4 scaffold_32, whole genome shotgun sequence
  Pfam annotation: Domain name=Pre-SET; Domain location=1251-1384; Score=49.5; E_value=1.2e-11; Accession=PF05033.7; Description=Pre -SET motif
  Pfam annotation: Domain name=SET; Domain location=1386-1510; Score =144.0; E_value=4.1e-40; Accession=PF00856.19; Description=SET domain
  Pfam annotation: Domain name=zf-C2H2; Domain location=1000-1023; Score=15.0; E_value=0.27; Accession=PF00096.17; Description=Zinc finger, C2H2 type
  Pfam annotation: Domain name=zf-C2H2; Domain location=865-888; Score =7.1; E_value=1.9; Accession=PF00096.17; Description=Zinc finger, C2H2 type
  Pfam annotation: Domain name=zf-C2H2; Domain location=899-922; Score =20.5; E_value=0.0065; Accession=PF00096.17; Description=Zinc finger, C2H2 type
  Pfam annotation: Domain name=zf-C2H2; Domain location=933-956; Score =4.1; E_value=4.1; Accession=PF00096.17; Description=Zinc finger, C2H2 type
  Pfam module annotation: Pfam domain module=Pre-SET::SET::zf-C2H2::zf -C2H2::zf-C2H2::zf-C2H2; Domain location=1251-1384::1386-1510::1000 -1023::865-888::899-922::933-956
MEVLPCSGVQYAGGSDCSQSSSGTMFVNQGESGGQAKLEDDRLNDSLQTEGPQIERQGQTQQNICEPLINIACQCGGASCCDCQVEGQKESISFRDVEDDGINEPCLAFENLVSIADTNESESPNGSREVELSFSEPTWLKGDEPVALWVKWRGSWQAGIKCAKVDWPLSTLKAKPTHDRKKYFVIFFPHTRNYSWADMLLVRSIYEFPQPIAYKTHQAGLKMVKDLTVARRFIMQKLTIGVLSIVDQLHPNALLETARDVMVWKEFAMETSRCNSYSDFGRMLLELQNEVPCRLRQFFGCNTVGQLHLVPIGFKLKSNMVSEPIGEVLGSPASTASILRSIVKHYTDADWIQHSSYSWAERCQNANSAESVELLKEELFDSILWNDVNALWDSLVQSTLGSEWKTWKHDVMKWFSTSPSFSSSKDMQHMTSDGLFQVSLQVGRKRPKLEVRRADTHATLVETNGSDQPITLKTDPGFYRNQDTLNTLESETSTLKDIKEVPVATDLPSNLTNKWNEIVVEATDSEILHGNGTQSTPMNEMAGKKVVEPGAKNRQCIAYVEAKGRQCVRLANNGEVYCCAHLSSQFLGNSGKAEKPVSVDTPMCGGTTVLGTKCKHHALPGSSFCKKHRPHAETNEISNLTHNTLKRKHKENHIGSGGLISKGMVLINAESSLQVEPVPAIDGNSFLERSNLDERPALSGNDQIAMEALHCIGSPPYDDKDPCLEAPKRYILYCEKHLPSWLKCARNGKSRIISKEVFTEILRDCCSWKQKVHLHKACELFYRLVKSILSQRSPVSKEVQFQQALTEASKDTSVGEFLTKLVHSEKERIKLIWGFNDDIDVSSLLDGLPLVPSTDNDSFDNENVIKCKICCAKFPDDQTLGNHWMDNHKKEAQWLFRGYACAICLDSFTNKKLLETHVQERHHVQFVEQCLLLQCIPCGSHFGNMEQLWLHVLSVHPVEFKPLKAPEQPLPCEDTSEKLEQGNSAFLENNSKNPGGLRRFVCRFCGLKFDLLPDLGRHHQAAHMGRNLGTSRSTKRSVCYYTHRLKSGRLGRPRFKNGLAAASSRIRNRANANLKRQIQATKSLDMVETTIKPHVNETENIGKLAEYQCSAVAKILFSEIQKTKLRPNNFDILSIGRSACCKVSLKASLEEKYGILPERLYLKAAKLCSDHNIQVSWHQDGFICPRGCKVLKDQRHLSPLASLFNGFLKPKSVILSDPASDELEVDEFHYILDSHHLKVGSLQKVTVLCDDISFGKESIPVICVVDQDILNSLLRHGSDEEDINLSRPWESFTYVTKPILDQSLSLDSESLQLRCACSFSACCPETCDHVYLFDNDYDDAKDIFGKPMRSRFPYDENGRIILEEGYLVYECNQMCKCYKTCPNRILQNGLRVKLEVFKTEKKGWALRAGEAILRGTFVCEYIGEVLDTREAQNRRKRLIEGQAHYVIDTTRFGNVSRFINNSCSPNLVSYQVLVESMDCERAHIGLYANRDIALGEELTYNYHYELVPGEGSPCLCGSTKCRGRLY

SEQ ID NO: 155038 - protein, 201 aa, Glycine max
  Coding DNA Sequence Number=SeqID_63353
  Subcellular localization annotation: CTP_CleavageSite=43; ConfidenceScore=5.09e-01
NLQDSGTINRVAWGLDVGIRMASKKRKAPSTPTQARFDRSKFTSQEAWERYTDIMVRRKLLPERNVVIYYTEFDEFKEELKRCHWDKKLTDFYDSSIDITIMKELYANLYDLDDKSPMQVKVGGHIVKFDEDTLNTFLKTPVVLEGGENLCTYSICALLRLDPQELATKLCIPGRGFELNADGQPLKILRKNMTTLAQTWS

SEQ ID NO: 155039 - protein, 67 aa, Glycine max
  Coding DNA Sequence Number=SeqID_63354
MGIADQKINFDLFHEDKHLLSQSVCSEVNEGWKEMVLKGLAERALCAKPKNFSGISSFGIRLSESSR

SEQ ID NO: 155040 - protein, 43 aa, Glycine max
  Coding DNA Sequence Number=SeqID_63355
HGPEIYPKAYENPRAFSCIFGPIFLESSIQYPWGVGLHQLGDK

SEQ ID NO: 155041 - protein, 37 aa, Glycine max
  Coding DNA Sequence Number=SeqID_63356
MPGRSSTRQFPSWKSGGHGRTKSNGGLPSLSCLNREL

SEQ ID NO: 155042 - protein, 150 aa, Glycine max
  Coding DNA Sequence Number=SeqID_63357
ELTDLRSNPLQGEGDDAILPRKGPVTRTMSKRLQEDWARAAEEGPRVLMNLRSTKFGALLLPLPSFISFFPPSSYPWPPMVESIDEEDPRPTSSNGAYIKVAPPMTKREMITMIVDTLTVFYYEEWWVTHLQVLGIWSSPANGLMWVRKE

SEQ ID NO: 155043 - protein, 243 aa, Glycine max
  Coding DNA Sequence Number=SeqID_63358
  Homolog annotation: Hit_ID=A5BY33; Match level="QueryCoverage=81%, HitCoverage=11%, E-value=6e-08, Identity=24%"; Hit description =Putative uncharacterized protein
MDFFSNESFECIQAFENSNLIPFMSLKLPVYSDLVKAFYSNLEIQEGTLISEVYGIKMVIDQSLFYELTQLSNEGVPFEGTLIDDWKYEFSVHDARQLVCTNQADMTGRLLVGSLAFESRILHYLIVCILLPRSSNLAQVSEEDLIVMWTFHKGLQIDWEHLVRYRMHKALRLNAPLPYPHLVTLSLQHFNIPLDSEPYVPIKRGYISCGSILVEGTSTWLFKENKGGYIPCGSLLVKRFLEG

SEQ ID NO: 155044 - protein, 151 aa, Glycine max
  Coding DNA Sequence Number=SeqID_63359
MSQGSEDLGDVRRAPGSQQIKGTKTTKQGGLCGGWPAVNFEFIWDVASGNRLPMVGLKTRSGSYEGFWPLVIDYQSGVIDYTEEWVTGNRLPGMKSLEIPLLLACSGHETHCVAAYGDGVPRGSLGDPRRQHEVPISGHYSIHGYFFGASG

SEQ ID NO: 155045 - protein, 135 aa, Glycine max
  Coding DNA Sequence Number=SeqID_63360
MSEFDAESDIDCMSGGGVLPLEIDFIESDRTNHVSGSTHTSDFLYVVKAEKPSPSTTVQPTTPELKPLPSNLKYAYLDDSKSFPVIISASLADEQEEKLLIASRSIPPPSSGTRLADNPWFELMCDASNKFRGWS

SEQ ID NO: 155046 - protein, 85 aa, Glycine max
  Coding DNA Sequence Number=SeqID_63361
  Homolog annotation: Hit_ID=A5BTR2; Match level="QueryCoverage=88%, HitCoverage=3%, E-value=2e-09, Identity=46%"; Hit description =Putative uncharacterized protein
  Pfam annotation: Domain name=zf-CCHC; Domain location=49-66; Score =28.7; E_value=2.1e-05; Accession=PF00098.14; Description=Zinc knuckle
MCVQEEERLIMEEGEKVNLTTFTSGKDRKKSVGTNKGKIPTQPTIKKESKCFFCKKKGHMKKDCPKFKSWFENKGYGKPKEASGK

SEQ ID NO: 155047 - protein, 41 aa, Glycine max
  Coding DNA Sequence Number=SeqID_63362
MTSNSVEEEEADDVHANRPWLLHLPRLLLVFLLLDKWPQIS

SEQ ID NO: 155048 - protein, 192 aa, Glycine max
  Coding DNA Sequence Number=SeqID_63363
  Homolog annotation: Hit_ID=A2Q1D6; Match level="QueryCoverage=32%, HitCoverage=10%, E-value=1e-08, Identity=48%"; Hit description =Ovarian tumour, otubain, related
MSFSAGFAYLEGERVNNIVWDLERFRGLFLRNDRLPILIATNRDLALMNVVKTVFPECTNLLCRVESAHWALKRVLQNSLGDLCSVWDAMNNMITLQHVEIKASFETSTHVVGHLSRYTAGSISVYSVHMFWRRLCFSYQGLCEVEVSIKEEIETISKRFEELDVCGKLTLKSKLRDIAYPDHNSMWPPPSK

SEQ ID NO: 155049 - protein, 51 aa, Glycine max
  Coding DNA Sequence Number=SeqID_63364
MTRASARKAKEALQQVLSILFEYKPKFQGEKSKVASAFWETKWWLIDGYWG

SEQ ID NO: 155050 - protein, 300 aa, Glycine max
  Coding DNA Sequence Number=SeqID_63365
MAEPSKKRMGSSSRSQTALGGSGYSNSSLLFLILIVLIERTPYTVYGIKMVIDQSLFYDLTQLSSEGVPFEETLDDDWKFNFSLHDAHRLVCTNQADTTGRLLAGSLALGSCILHYLIVRILLPRSSNLAQVSKEDLIVMWAFHTGRQIDWAHLVRYRMHKALRLNAHLPNPHLVTLFLQHFNFPLDSELYVPIKRSFLIGAAVVASFGYRKERDGSWVKKGAQPNDDGGHLSVEGDSSLLQSILDRFDGLQTYVGERFDSLERQVDTRFEEMNSRIAKVEEDVTTIRDYLDLPPPPPSV

SEQ ID NO: 155051 - protein, 82 aa, Glycine max
  Coding DNA Sequence Number=SeqID_63366
  Gene Ontology: Mol. function=RNA-directed DNA polymerase activity; Biological process=regulation of transcription, DNA-dependent
  Homolog annotation: Hit_ID=A7P5J6; Match level="QueryCoverage=92%, HitCoverage=6%, E-value=3e-11, Identity=42%"; Hit description =Chromosome chr4 scaffold_6, whole genome shotgun sequence
MGIDAAILMCLRDIRHNKFEDSLIGTVETSLGQVSLMDKNILDSLFLNIHFHGLDMKEGSIPIALIYRIQYKVMYTCASRVL

SEQ ID NO: 155052 - protein, 16 aa, Glycine max
  Coding DNA Sequence Number=SeqID_63367
MMNYQVQGSTVLAGTE

SEQ ID NO: 155053 - protein, 104 aa, Glycine max
  Coding DNA Sequence Number=SeqID_63368
NRDEKRRKLLQDRTIASILEEETHFSDSLSPDSPSSRESATQFPETSIMADEQHQVITLKDYSSSSVLQFFTSIGRPEVQAHNINYPHSLIHLIQGNLFQGLPK

SEQ ID NO: 155054 - protein, 102 aa, Glycine max
  Coding DNA Sequence Number=SeqID_63369
MKATIPEPFVIGEEAEETHVRQVAVATPERSLEATSEPSAQGEDIPSPQPAADPSTPLLEMLEDPTTSVLAMDTSPPATPVLHLTYEEDVQTQDTQGQSREF

SEQ ID NO: 155055 - protein, 68 aa, Glycine max
  Coding DNA Sequence Number=SeqID_63370
MGPSVATACSRSKKSLSQRLCETETNMLAIITKYQEELNLATAHEHRVAEEYAQVYAKKELARGRPFD

SEQ ID NO: 155056 - protein, 185 aa, Glycine max
  Coding DNA Sequence Number=SeqID_63371
MMLWWKGSDDEYKETTMDNHALLLSNYVIATEVELFVECVGGNEGVMDNNFSVDKAGGGKKATSGDVPSTCTTKDVPSNVLRQKSQAVKPLILCELGYKRILRREKGDTKEFRQLVLRSFGKGRRETQKEFRRLVLGEFFLAKGEENEKMNSISFQGLENQKTLESFWHKEEEEEVQRDSRLVKD

SEQ ID NO: 155057 - protein, 78 aa, Glycine max
  Coding DNA Sequence Number=SeqID_63372
MEALKKFKWSLLFTRMFDSGISHIQTLEIEQRKLSRNSNGHNFSHGCPIKVIRARNMSEMLGIEFVDHLEALENSNGH

SEQ ID NO: 155058 - protein, 120 aa, Glycine max
  Coding DNA Sequence Number=SeqID_63373
  Gene Ontology: Mol. function=aspartic-type endopeptidase activity; Biological process=proteolysis
  Homolog annotation: Hit_ID=A5APW4; Match level="QueryCoverage=89%, HitCoverage=7%, E-value=1e-10, Identity=38%"; Hit description =Putative uncharacterized protein
  Subcellular localization annotation: CTP_CleavageSite=42; ConfidenceScore=5.23e-01
MTMQNMQFQQETRASIQSLTNQMGRLATQLNQQQSQNSDKLPSQSVQNPKNVSVISLRKVEVNIPQLDAIKQIPRYAKFLKELCTNKRKLKGSERISMGRNVSALIGKSVPQIPEKCKDP

SEQ ID NO: 155059 - protein, 99 aa, Glycine max
  Coding DNA Sequence Number=SeqID_63374
MVVPKSERCKDKLKITRNKHGIMVTSKEMKGQIRVSFSIEIASQVGRFRFGRRVPLSMGLQRRTTMVCGGEWWLWVMEKVLGTLEMALEERKEKKWDIS

SEQ ID NO: 155060 - protein, 261 aa, Glycine max
  Coding DNA Sequence Number=SeqID_63375
MVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGPAGAFDMEQYLQQLLSLSMQSQGFASFSCPTPDQFRAEVAWPGDWPEAQAGEAPPEAPSDGEEAHEDEEMADLLDF

SEQ ID NO: 155061 - protein, 210 aa, Glycine max
  Coding DNA Sequence Number=SeqID_63376
  Homolog annotation: Hit_ID=Q2HSV3; Match level="QueryCoverage=83%, HitCoverage=29%, E-value=3e-16, Identity=31%"; Hit description=IMP dehydrogenase/GMP reductase, putative
MYDQLNDASMSHSRQLSGYITLLQDYDEASPRACRWIATKKTVKSIRTPSYRERLNRLRISDVCWILYGEHREVQDFHVRSCYSGLLHWGLVAVYYRPEKVVRQFGYTPAIPAPPVDSWVSYDDIHDRWMHYEGHIVPVGEVCVVLGACSSDYIEWFFRISHPFMTPGHAVDPLPHGHAPQPRVVPQAPQTDIPRVTEPGASSTSAEGIL

SEQ ID NO: 155062 - protein, 55 aa, Glycine max
  Coding DNA Sequence Number=SeqID_63377
MAHQRREGLWVRLPREEGTRSRHQRLFEENVGKTEMCGLPTLSVKGSGIVFTHGE

SEQ ID NO: 155063 - protein, 389 aa, Glycine max
  Coding DNA Sequence Number=SeqID_63378
  Gene Ontology: Cellular component=periplasmic space; Biological process=polysaccharide biosynthetic process
  Homolog annotation: Hit_ID=Q46636; Match level="QueryCoverage=98%, HitCoverage=52%, E-value=9e-60, Identity=37%"; Hit description =Amylovoran biosynthesis protein amsF precursor
MCTNVQPFFENTCIEGTTLNIYCFRAQNSGGTVIKALDTLDSKFDQIYTLWTYGRVFDIGWSNSPNGKWDHSTAIEICNCNFQTGYGDATLYMPRVTQGIMRNVWIEHTRNPGDLSDGAWSIDTLNIEDCGTPFNLNNARVIMRQIGLQSGAKISNDMAGTRWLSTFDYGYRREEHHGTLITGSFRAGYYSGHKVTNNTDTDNWYRLGQLFFPTANQQWVMELIGKADATQPTGTAASPVNLAGTGKTWINLQRLETVWADACHMGQPAVLDIRYSRVGTTYAVVWVKLRANSGDTLINLKTTGPTRFEAGSCSLFQPDFSVVTDTTKMGTLKPAARFGLHNGVAGIGANEKGVLTVATAAGTPTNKTTPTGFVLVNINGVDRKLPYYD

SEQ ID NO: 155064 - protein, 36 aa, Glycine max
  Coding DNA Sequence Number=SeqID_63379
MHKNERDGKWKNGLKVRVDMRRIFKLKLREKRCNGG

SEQ ID NO: 155065 - protein, 161 aa, Glycine max
  Coding DNA Sequence Number=SeqID_63380
MERIIRGVHEVATNSAASSKTKKLEGKLDALVNLVTQLALNQKSVHVARVCGLCSSADHHTDLCPSMQQPGAIEQPEAYAANIYNRPPQPQQQNQPQQNNYDLSSNRYNPGWRNHPNLRWSSPQQQQQQPAPSFQKCCWPKQTIHSSTNPTIATTPETTNS

SEQ ID NO: 155066 - protein, 127 aa, Glycine max
  Coding DNA Sequence Number=SeqID_63381
DSIENIIDVKTYGNCGYRAIAALLGIGEESWSLVRNHLHKELTSWSKVYINLVGGIEKFEELKCSLLVDDLSKVLLRDHCPLPPVALLWSTHCHYRAKQWLTLYIARMQHYTTLSRLNTEFVDLGEP

SEQ ID NO: 155067 - protein, 143 aa, Glycine max
  Coding DNA Sequence Number=SeqID_63382
MAAQLIHDREVMECLEGVWETLEGNERCRFRGTIRLTATSLIHLEEPACTLQQPVEWILPTPTPYRLVEPVQVIEVSSSEEDLEEDPEELPPRPAVDALDLPEDDEDPLPDVDSPEDIMSASEGDSTEESGPRGTANSDDSSS

SEQ ID NO: 155068 - protein, 74 aa, Glycine max
  Coding DNA Sequence Number=SeqID_63383
MGLRKKCGEWRIGEQRYAVTSRGSRLDGGGCMNSVLGNKFMELRIKWRMENWRTALRNNFTGLQTRWWRTHEQR

SEQ ID NO: 155069 - protein, 25 aa, Glycine max
  Coding DNA Sequence Number=SeqID_63384
MKNEKVNKVKSLECTHTRRIISNWA

SEQ ID NO: 155070 - protein, 56 aa, Glycine max
  Coding DNA Sequence Number=SeqID_63385
MASNSQHREEWRNHPRNQFNRDQEKNPKEECKAVMTRSRRAIHVGESETEKKMEKH

SEQ ID NO: 155071 - protein, 126 aa, Glycine max
  Coding DNA Sequence Number=SeqID_63386
MNLLSEHVALSEFINTHCRIAKPRKRKSIGTRLTSQYDTRRFSSLDAWTRYTDNVLGMNILPERKVKLYHTKLDDFKAELERRNFHKRLTNLVDGSIDLAFVKEFYAIHTVLRIVHQSSPELEVIW

SEQ ID NO: 155072 - protein, 128 aa, Glycine max
  Coding DNA Sequence Number=SeqID_63387
MHKALRLNATLPYPHLVTLFLKHYNIPLDSEPYVPIKRSFLIGATMIASFGYRKEHDGSWVKKGAQPIDEEGHLHGGEDSSLLQKVDGLELQVDMQFDEMESRITKVEEDVSYIRTSFDLPPPPPPSS

SEQ ID NO: 155073 - protein, 60 aa, Glycine max
  Coding DNA Sequence Number=SeqID_63388
MWVQTIGQFAQATYAPEFGTSKTVQSEITRLAHWWGCQRSELSRIGCWTNGLSYLKKKGG

SEQ ID NO: 155074 - protein, 258 aa, Glycine max
  Coding DNA Sequence Number=SeqID_63389
  Gene Ontology: Mol. function=phosphogluconate dehydrogenase (decarboxylating) activity; Biological process=pentose-phosphate shunt
  Homolog annotation: Hit_ID=A7MJP1; Match level="QueryCoverage=100%, HitCoverage=93%, E-value=2e-81, Identity=57%"; Hit description =Putative uncharacterized protein
  Pfam annotation: Domain name=3Beta_HSD; Domain location=20-227; Score= -131.2; E_value=0.037; Accession=PF01073.10; Description=3-beta hydroxysteroid dehydrogenaseisomerase family
  Pfam annotation: Domain name=Epimerase; Domain location=8-197; Score=- 10.2; E_value=2.1e-06; Accession=PF01370.12; Description=NAD dependent epimerasedehydratase family
  Pfam annotation: Domain name=RmlD_sub_bind; Domain location=6-254; Score=-180.0; E_value=0.03; Accession=PF04321.8; Description=RmlD substrate binding domain
  Pfam module annotation: Pfam domain module=3Beta_HSD::Epimerase::RmlD_ sub_bind; Domain location=20-227::8-197::6-254
MALSARGWQVTGSKTSPDGVDAARRCGIDASQLVLSPELECEADDLAALMAVDALVVTLPASRTVQGGEDYMQAVQNVVDTALANKVPRIIFTSSTSVYGSGDGVRKESSALQPETVAGKTLVELENWLHDLPGTSVDIVRLAGLVGPNRHPGRFLAGKTNLENGAHAVNLVHLDDVVDAIVLLLQTPKGGHVYNLCAPKHPSRDSFYPSVSKQLGLVPPTFVAEPVRASGKVIDGSKICHELGFDYSYDDPMKMPLE

SEQ ID NO: 155075 - protein, 123 aa, Glycine max
  Coding DNA Sequence Number=SeqID_63390
MADLHIAQLRKGAQQLGPDQRLDVFRFARPIHHAAAVQQAVVGSQAEVIQQIVTIFHTVVIGHQPQRLIAAQRLGGDDLRAARHAFAPQPRFQLRGQIGVAGKNHKGGADFTLRGFDPVGCAV

SEQ ID NO: 155076 - protein, 115 aa, Glycine max
  Coding DNA Sequence Number=SeqID_63391
MTRGNPFDLQPFDPEIDRTFHRLVRHSVHPDHSVHFEHSEYSVASDSEYSDFEHSTANFYTENMAQPQPHERTLREMDAPNFTYESLCIQYPDKGVPYVFKTGLIHLLPKFHGLA

SEQ ID NO: 155077 - protein, 201 aa, Glycine max
  Coding DNA Sequence Number=SeqID_63392
MDNEEGVQEQMKADLSALKDQMASITEAMLKLQKTIEDNATVTASNATREAEPVLQPAINLGRDRNTTVFGRRYNPQAYPYGLPPNFTPRATLEDLSQAPTFEGKLPPYADYPLQEDDEGDTHLGPLLPLKDPAPHELPQPNIVRHVPSSPAPVKESVPFAEDKGKINSLEERLRAVEGLGNYPFSDLADLCLVPDIVIPP

SEQ ID NO: 155078 - protein, 77 aa, Glycine max
  Coding DNA Sequence Number=SeqID_63393
  Gene Ontology: Mol. function=peptidase activity
  Homolog annotation: Hit_ID=A5AII0; Match level="QueryCoverage=94%, HitCoverage=41%, E-value=9e-12, Identity=39%"; Hit description =Putative uncharacterized protein
MASSNFPFLEGNSINRPLMFNGEGYHYWKTRMQILIEAIDLNIWEAIEVSSFIPTKVVGNATIEKPREEWNDDERRK

SEQ ID NO: 155079 - protein, 351 aa, Glycine max
  Coding DNA Sequence Number=SeqID_63394
  Gene Ontology: Mol. function=transporter activity; Cellular component= cell outer membrane; Biological process=transport
  Homolog annotation: Hit_ID=A1ZHY4; Match level="QueryCoverage=92%, HitCoverage=40%, E-value=8e-78, Identity=46%"; Hit description=TonB -dependent receptor
  Pfam annotation: Domain name=Plug; Domain location=7-101; Score=26.4; E_value=0.0001; Accession=PF07715.6; Description=TonB-dependent Receptor Plug Domain
MDLNQILNYAAPSFTSNSTTVADGTDHIDPAQLRGLGPDQVLVLLNGKRRHTSSLVNVNGSPGRGSVGTDLNALPAFAIERLEVLRDGASAQYGSDAIAGVINVIMKKNTNAFTSAITAGGFNSKGSNDHSGGWDGENEMAYRGLARNDFNMRVGQSRLTSGQFFMNSEFDLASSVKGYAFGGISYRSGNAGGFFRRPYESRASTSIYPNGFLPEIASDVIDLSLATGFKGKIGNINYDISNTYGRNTFDYTIKNTANASMLYPSKTEFKAGGLNFSQNTVNADFDTKVDWLQGFNIAFGGEARFERYKIQSGEQDSWALYDINGNVQDVSTPANLKPTDFFGAVRPGGAQ

SEQ ID NO: 155080 - protein, 90 aa, Glycine max
  Coding DNA Sequence Number=SeqID_63395
MSNTIRIEKFNGKNSFDLWRIKMRALLKEQRVWAPVASASLKKEMASESKEKASVMQSYPLRVLDRRLLEAWARATKEGPRVLMNLRVDF

SEQ ID NO: 155081 - protein, 79 aa, Glycine max
  Coding DNA Sequence Number=SeqID_63396
  Homolog annotation: Hit_ID=Q84VH6; Match level="QueryCoverage=67%, HitCoverage=3%, E-value=5e-07, Identity=55%"; Hit description=Gag -pol polyprotein
MKEKKMSMTWILMKFNKVLNRKTGGPVKPPILDRNPMNTGKQGWWPSSNHWIAATWKAVIKGWEHPKMLDTEAKASLMN

SEQ ID NO: 155082 - protein, 104 aa, Glycine max
  Coding DNA Sequence Number=SeqID_63397
EYVDAFHSVQSSNSPVKRSASCSEPPQPTRIIPMLDQFAPFIQGFIRDVVDVKADGNCGYRSIAALLGMGEDLWPLVHEEMNLFGGTERFEQLKLSLLVDGFSK

SEQ ID NO: 155083 - protein, 98 aa, Glycine max
  Coding DNA Sequence Number=SeqID_63398
ARHRSLPDGHAAQPRVVPQVLETDIPHVSEPRAPSTSARPTMQEPKHAVVGAPSEPKGVTSGSSTHEVIEECLRMVRSVTQDQLVYVRSRRKRCTDQA

SEQ ID NO: 155084 - protein, 520 aa, Glycine max
  Coding DNA Sequence Number=SeqID_63399
  Gene Ontology: Mol. function=lactate transmembrane transporter activity; Cellular component=membrane; Biological process=lactate transport
  Homolog annotation: Hit_ID=A8GIL0; Match level="QueryCoverage=80%, HitCoverage=78%, E-value=0.0, Identity=86%"; Hit description=L -lactate transport
  Pfam annotation: Domain name=Lactate_perm; Domain location=1-419; Score=327.3; E_value=2.7e-95; Accession=PF02652.5; Description=L -lactate permease
  Pfam annotation: Domain name=Voltage_CLC; Domain location=2-382; Score=-179.7; E_value=0.051; Accession=PF00654.11; Description =Voltage gated chloride channel
  Pfam module annotation: Pfam domain module=Lactate_perm::Voltage_CLC; Domain location=1-419::2-382
  Subcellular localization annotation: CTP_CleavageSite=51; ConfidenceScore=5.19e-01
MTIGWAFAFMIEGASGFGTPAAIAAPILVGLGFNPLRVALLTLVMNSVPVSFGAVGTPTWFGFANLGLSDASLLEIGRQTALIHFVAGFVIPLLALRFIVSWQDIRRNLPFILLSVLSCTVPYLLLAQVNYEFPALVGGAIGLALSVLLARCGIGLTRSDKSQSAGQAVPFLQVVKAMTPTLLLIAILIVTRIHQLGLKALLNNTALLWQENLGWLGELRISRALIVELQQVLGTSAAAGYKTLYVPALIPFLLVVLLCIPLFRLNGDQVRQMFSETGGRVARPFIALFGALVMVNLMMQGGDNAPVILIGKALAALTGESWLLFSSFLGALGSFFSGSNTVSNLTFGGIQQSIAQSSGLDVNLTLALQSVGGAMGNMVCLNNIIAVCSILGIGNAEGKIIRKTVLPMLAYGGIAAARQEGKHYDHLRVNRLPGRRPGQTATVSVSLHRRRGLRGAYAEAQYRRSGRYCPAPARAAQYVRTQPADHAVRRAAGDAGGAGAGGADRHVRPPRRSTGRARRG

SEQ ID NO: 155085 - protein, 147 aa, Glycine max
  Coding DNA Sequence Number=SeqID_63400
MVIDQSFFCDLTQLSSAGVPFEGTLDDDWKFDFSVHDARRLVCTNQADMTGRLLTGSLALESRILYYLIIRILLLRSSNLAQRSFLIGAAVVASFGYRKERDGSWVKKGSMDSKHMFMKGLMLWNNKWTCDSMQWTQGSQRLKKMPP

SEQ ID NO: 155086 - protein, 29 aa, Glycine max
  Coding DNA Sequence Number=SeqID_63401
MVTTTKVESLELALSTACLALVNYVTKAI

SEQ ID NO: 155087 - protein, 108 aa, Glycine max
  Coding DNA Sequence Number=SeqID_63402
MASNTINSRDNGGTTLEINSIEIKVSMSNQKSTESAIKNLEVQVGELAKQLADRSSSSFTANTEKNPKEECKAAMTRSRMAIHVDESEAEKKMKEHKPQLAPKPALEP

SEQ ID NO: 155088 - protein, 79 aa, Glycine max
  Coding DNA Sequence Number=SeqID_63403
VAEGPAKPVDMSDPDIDPLYLMTLIIPQLFLKSLQVSWDASVFGVYNDNFPLYIKHEDLSKIVHGGECLSISVIQLWIL

SEQ ID NO: 155089 - protein, 102 aa, Glycine max
  Coding DNA Sequence Number=SeqID_63404
  Gene Ontology: Cellular component=mitochondrion
MDPSTTNWGEEVDLPTEDQNDTINDLRDKCAILLESFSKNQSRDRFTWQDIAQRLVLEGKGTTAEVGATREDFQRLLGELKNPGESDVVYLRVLKALEKHRR

SEQ ID NO: 155090 - protein, 106 aa, Glycine max
  Coding DNA Sequence Number=SeqID_63405
MSLEEAHHHRRPWIRAWRKKEMNEGRGREEHKILCSKRALKSKLWFSPLIQDQVQDSPLSVLRCHEACSYLAHGPKSTLSLMRTLGPSLASLTQSSWSLLSNALAG

SEQ ID NO: 155091 - protein, 113 aa, Glycine max
  Coding DNA Sequence Number=SeqID_63406
MGSCVDPSPTDPNTGDSDKCEFGSQHPLLHGQVKVGDKEVKDAEAPVSVPTDEAAVSPAKPPYRLDHEVDDPLYLMTLTIPQLFLKRLLVMWDATVFGVFNEHFPLYIKHEDL

SEQ ID NO: 155092 - protein, 32 aa, Glycine max
  Coding DNA Sequence Number=SeqID_63407
MGSRIVLGHSQKSRQVNGGNQPRYLGMEANGG

SEQ ID NO: 155093 - protein, 137 aa, Glycine max
  Coding DNA Sequence Number=SeqID_63408
  Gene Ontology: Mol. function=oxidoreductase activity, acting on NADH or NADPH; Cellular component=plasma membrane; Biological process =mitochondrial electron transport, NADH to ubiquinone
  Homolog annotation: Hit_ID=O85274; Match level="QueryCoverage=100%, HitCoverage=68%, E-value=4e-52, Identity=71%"; Hit description=NADH -quinone oxidoreductase subunit B
  Pfam annotation: Domain name=Oxidored_q6; Domain location=1-90; Score= 73.5; E_value=7.1e-19; Accession=PF01058.13; Description=NADH ubiquinone oxidoreductase, 20 Kd sub
MVTSFTAVHDVARFGAEVLRASPRQADLMVVAGTCFTKMAPGIQRLYEQMLEPKWVISMGACANSGGIGCIHPGLPAASGSLYAGADAAAGIYGKERRPLSWVVGDQGVYRANMQSERERKRGERIAVTNLRTPDEI

SEQ ID NO: 155094 - protein, 112 aa, Glycine max
  Coding DNA Sequence Number=SeqID_63409
  Pfam annotation: Domain name=G-patch; Domain location=1-42; Score =10.1; E_value=0.011; Accession=PF01585.14; Description=G-patch domain
MVARVMLRNRFEPGMGLGKDCLGNADVVNIKGNPYKYGLGYEPGMPGRRNVPSRFRADRVWPGRISQCFTSAGMVSEEEVATIEEELPQDPPSFMQPCHPDSQVGNWRVISQ

SEQ ID NO: 155095 - protein, 107 aa, Glycine max
  Coding DNA Sequence Number=SeqID_63410
MDLYFKWEYLFRSINQGIWCCPSRSSYRSSVSINDLPRESLPTNQLPLYESDIYTPRDIGVGSCFDPFGEIIYCHENEAMTVRILGFDGPYDVYPPHGKRPRGGHDI

SEQ ID NO: 155096 - protein, 55 aa, Glycine max
  Coding DNA Sequence Number=SeqID_63411
MGKRKLELGFEDQKIDFDLFVEDKPAPEHNVCLQGNGRRSRGFEGENQNMRFPQR

SEQ ID NO: 155097 - protein, 60 aa, Glycine max
  Coding DNA Sequence Number=SeqID_63412
ESSTTRDPLVQAPLELIGLGSSSAMDSFAPWKINGSGMEKEEREETPLQGEDESRRSSPP

SEQ ID NO: 155098 - protein, 107 aa, Glycine max
  Coding DNA Sequence Number=SeqID_63413
MLGNDRNLAGDEVAQIHVHLHDNAINQLGPIHCDVRSVGGRDQVGRLTISIQFKSPPQDAELSSQLLRIRPQECKSRYMMQSYPARALDRRLQVDWPEIQGKALGFS

SEQ ID NO: 155099 - protein, 182 aa, Glycine max
  Coding DNA Sequence Number=SeqID_63414
MTTLTQIWMTLLLSNILPCDHNSDLPLPKCQLVYAILTRMSVHVAQLIADAIYLFAGMAPTRHPLDLDKSNRALGFPALITGLCQSFGVPVAPTKVIRSPITRAFIEKYYTQRQAQGDAPQAAGAPPPHQADQFRAEVACPGDWPEAQTGEAPPEAPDDGEEAHEDEEMTDLLDFLGGSGAT

SEQ ID NO: 155100 - protein, 176 aa, Glycine max
  Coding DNA Sequence Number=SeqID_63415
MLGYDYEPGMGLGKNNGGRTCLVSTRGNRGKFGLSYKPTQVDIRKSISERKNRGQGSRLGQQAEGAPPCHISRSFISAGLRYDGQVATICEDDSPRRSDLVRSCPPGFGLGNWRVKERPDFYATSIISDDKSLEGTNTRDPAVDFEQEAGRMKSEEDEDVGLPPKLERIIAQEDRK

SEQ ID NO: 155101 - protein, 275 aa, Glycine max
  Coding DNA Sequence Number=SeqID_63416
MVLEEGQECEYGQRRNRSDGFDEEAIAQLLCIPGQDFARTAAGRRVRIMRTNMTTLTQIWMTLLLSNILPTDHNSDLPMPKCQLVYAILSRMSIHVAQLIADAIYIFAGMAPTRHPLDPDKSNRALGFPALITGLCQSFRVPVAPTKVIRPPITRAFIEKPQARPHHLIRLARLGHLNMEQYLRHLVRQQAANHRAHVQTHDCLYQMSLSMQSQGFASFSCPTPDQFRAEVAWPGDWPEAQAGEAPPEPPGDGEEAHEDEEMADLLDFLGGSGDT

SEQ ID NO: 155102 - protein, 103 aa, Glycine max
  Coding DNA Sequence Number=SeqID_63417
MAAQLIHDCVVMECLEGVWETHEGNERCQFRGTIRLTTTSLPVEWILPTPTPYRLVEPAQVIEDDEDPLPDVDSPKDIMSASEADSIEESDPRGTASSEDSSS

SEQ ID NO: 155103 - protein, 152 aa, Glycine max
  Coding DNA Sequence Number=SeqID_63418
  Subcellular localization annotation: CTP_CleavageSite=15; ConfidenceScore=5.14e-01
MCQATKNHDFDSLKRCNNVSPSCGPFGQVAGGSFTKPNLDYVNNDDVTSVLSELVRRKNTVIVGEGVANAEGVAREVMERFEVTFFSDFQAQERSKVFFKDVAFEDRIVVRNRLTCCKDCFINFQKEAQTITNCTSNKVCTASSLPNQTKPI

SEQ ID NO: 155104 - protein, 266 aa, Glycine max
  Coding DNA Sequence Number=SeqID_63419
  Subcellular localization annotation: CTP_CleavageSite=70; ConfidenceScore=5.06e-01
DKGILKEDFSGFQVGFPPYNQQGQWRTHPGNQFNKDQSRPSNKPIQQGPNIFQRTTKLEETLTQFMQVTMSNHKSTESALKNLEVQMGQLSKQIADKSSKSFVANIEHNPKEECKAMMTRSKRFVEVEDEQSVVHKEKAAEKKGTEVKKNDVRGEGNQEKGKQIMVQDKELKDQEKETEVEKEIENEKKMKKKKKIRMQRRVEVKKLWMKVWKYHILWYLQRRKRSLSSEIFRYFQETGNNHALRRSFAADATLLQILEGYVNKET

SEQ ID NO: 155105 - protein, 248 aa, Glycine max
  Coding DNA Sequence Number=SeqID_63420
LDEFKGELERRNFHKRFTNLADSSINLMLVKEFYDNLYSPEGPSPKQVRIWGHLIRIDANSLNAFLETLMVLVEEGHPGKILRKDLITLAQVWSVLSYSNLAPNSHTSDLTVDRARFLALITALCRTRGVASDSLVFERLSPVINLAYIRKNCWNPDDPKIIIRGARRPRARPAEAPSTSAAPHLASTSAAPPPTRIAAAPSTLPPAYFQRFEAMLQSIHQGQIIFLQSLLLVAPPDSIPTVEQFNEW

SEQ ID NO: 155106 - protein, 136 aa, Glycine max
  Coding DNA Sequence Number=SeqID_63421
  Subcellular localization annotation: CTP_CleavageSite=42; ConfidenceScore=5.14e-01
MSPSPLGSHNHSQTHLKLSKQLPLQALVSADLHVEAMSSKVVLMMPKNQESSKIQDSRIKLQESRFKNNQDQDSRLKILETREDSIKIMSQPTLRREGDARLAGCVFHERNTRGVATNVYLRKTSEKPEKTRSTNF

SEQ ID NO: 155107 - protein, 34 aa, Glycine max
  Coding DNA Sequence Number=SeqID_63422
MDPLGGSRSLYAPPKIEICSRGTFGYRIGRRRHF

SEQ ID NO: 155108 - protein, 137 aa, Glycine max
  Coding DNA Sequence Number=SeqID_63423
MTVTALGALYTSSASRPSRDGHFSGSDASSLGMTKEGVRDMRSWVRGQWIPFDADAIGQLLGYPLVLEEGQECEYGQRRNRSDGFDEEAIAQLLCIPGQDFARTTAGRRVRIMRTNMTTLTQIWMTLLLSNILPHRS

SEQ ID NO: 155109 - protein, 125 aa, Glycine max
  Coding DNA Sequence Number=SeqID_63424
  Subcellular localization annotation: CTP_CleavageSite=43; ConfidenceScore=5.62e-01
MKTWEEWMTSTMPPSSTKFFWNTKSSMSSKEGMMTASSPLSTRAASSLDNNTSVLQKKLAKAIANKDKALETFGLAMKVKRILREQKGKVQTKKPAHQQKEEEKIVIEEQRMKKKHEVPRPSLPV

SEQ ID NO: 155110 - protein, 98 aa, Glycine max
  Coding DNA Sequence Number=SeqID_63425
MFNFEGLAHCGVDTTHAYTTSSSGARPIDEVTSSEEDPEEDPKELPPEPAVDALDFLEGDEDPLPEVDSPEEVMSAFEADSTEDSGPGEMAISGGSSS

SEQ ID NO: 155111 - protein, 191 aa, Glycine max
  Coding DNA Sequence Number=SeqID_63426
MSWKRTHYFSMSHQENHMIMRSQDIYSSQDEATTSPSSSESEEAKGEESSEEIYPQEERQPLMFKEECKDVSVSSKSLAKWERHFEIKINIKEISPLRQPPHFILRKKTLVSIAPPLGLEFISQVKELLDEGLIRKSLNPCTLLVPKIGIIRHQIPKIGGMMNVLSGATLFCKITRASNIFMICVHRDSLG

SEQ ID NO: 155112 - protein, 93 aa, Glycine max
  Coding DNA Sequence Number=SeqID_63427
MGTRVERNEDMGYVGVRELSWRWATGDGGFMRDLLTWKTCCAPSPDRHLVPHVMEWYLEICRGGQETLGTSGGVLLPKTKLDQSRPNLGIVGQ

SEQ ID NO: 155113 - protein, 228 aa, Glycine max
  Coding DNA Sequence Number=SeqID_63428
NFEAPEEDEEVRALKLELGKARLAKEKFKSAATHIRKECTELQEENAATARALEQETKRARKEEHGREKFRGALWGSNNELKLRREERDRSRVHGMILKEELVACARSKRSLAQHLEATEQSMLAIIGQYKKELNQSMAHEQKLVEDFAQVYAEKEAKGRVIDALHQEATMWMDRFALTLNGSQDLPRLLLAKAKAMAEVCTAPEEIYRLINYCQHMIDLMAHIIRNR

SEQ ID NO: 155114 - protein, 132 aa, Glycine max
  Coding DNA Sequence Number=SeqID_63429
  Homolog annotation: Hit_ID=A5AK77; Match level="QueryCoverage=47%, HitCoverage=7%, E-value=4e-07, Identity=42%"; Hit description =Putative uncharacterized protein
MTRGNPSDLQPLDPEIDRTFHKLVRHHLVPFEHPEHSVIGDFEHYSFEHSDFEHSENMALPPPRERTLREMAAPDFTYESLCIQYPDEGVPYVLKTGLIHLLPKFHGLAGEDPLKHLKEFHIVCSTMKPPDV

SEQ ID NO: 155115 - protein, 66 aa, Glycine max
  Coding DNA Sequence Number=SeqID_63430
  Subcellular localization annotation: CTP_CleavageSite=26; ConfidenceScore=5.37e-01
GQDHLELPSGVGTKCGRQKPIKGRMQVGMVSRPTDRRPFSARNKQRTSLQGSPVSFVFAVFFYYLF

SEQ ID NO: 155116 - protein, 48 aa, Glycine max
  Coding DNA Sequence Number=SeqID_63431
GVEEWRSICGHAGSLTRLIIVKSHLEFSSFGDALSLIVPFAPVYYLRG

SEQ ID NO: 155117 - protein, 65 aa, Glycine max
  Coding DNA Sequence Number=SeqID_63432
MDSFASWKINGSGMEKEEREETPLQGEAHHHRRPWIRAWRKKEMNEGRGREEHEILCSKGALKSE

SEQ ID NO: 155118 - protein, 90 aa, Glycine max
  Coding DNA Sequence Number=SeqID_63433
MHRSPTSNLVPLDLEIKATLRRNRAERRKKLLQDGTVVSILEEETHFSDSTSSDSPSSRESATYLPEVVSMADEHQQRVTLKDYSSSSVL

SEQ ID NO: 155119 - protein, 158 aa, Glycine max
  Coding DNA Sequence Number=SeqID_63434
MAPRKLASKRSRKDKLAEGTSSAPEYDSHRVRSAEHQQRFEAIKGWSFLQERRAQLRDDEYTDFQEEIVCRRWASLVTPMAKFDPDIVLEFYANAWPTEEGVRDMRSWVRGQWISFDADAISQFLGYPLVLEEGQECEYGQRRNRSDGFNEEAIAHLL

SEQ ID NO: 155120 - protein, 187 aa, Glycine max
  Coding DNA Sequence Number=SeqID_63435
  Gene Ontology: Mol. function=helicase activity; Biological process =viral genome replication
  Homolog annotation: Hit_ID=Q2A9I1; Match level="QueryCoverage=97%, HitCoverage=13%, E-value=2e-34, Identity=35%"; Hit description =Putative uncharacterized protein
MAHKIRYVSAPEACWKIFAFPMHGRALAVEHLYFHLENQQPVYWKDSQEIGTVLAKSTIKESICWKPRKQGNTIGRLIWVPLSSGELFYMRMMLSSTKGSQCYEDIRIVENVVYHTFREACFAKGFLGSDQEFVGALREANTWGTPHYLRKLFVKLLFMNTMDRPEYVWKQTWQWMADDIVFNHKRQ

SEQ ID NO: 155121 - protein, 82 aa, Glycine max
  Coding DNA Sequence Number=SeqID_63436
AVQPAHSSVMHIGGCNICGGGYESGMCMVSLSNPKSTESAIRNLEVQVGQLAKQLAIASTNSFEANTEKNPKVECKVIFTKS

SEQ ID NO: 155122 - protein, 136 aa, Glycine max
  Coding DNA Sequence Number=SeqID_63437
  Homolog annotation: Hit_ID=A2Q6B4; Match level="QueryCoverage=86%, HitCoverage=59%, E-value=1e-11, Identity=28%"; Hit description =Ribosomal protein L33; Nucleic acid-binding, OB-fold
MDLKENCTYVMHNFKVLKNNGQYRVCDHQFKLVFIGVTIVADQFKPGLLVDVIGVVEEVVFRQVSGKGRRVVFKLKDLSQQLLSCILWDDYCSQFLKFLDDYEGDGPITVLLSHCRIKEAHGSYPTSINNSFKASS

SEQ ID NO: 155123 - protein, 296 aa, Glycine max
  Coding DNA Sequence Number=SeqID_63438
  Homolog annotation: Hit_ID=Q84VH5; Match level="QueryCoverage=87%, HitCoverage=37%, E-value=2e-80, Identity=65%"; Hit description =Envelope-like protein
  Subcellular localization annotation: CTP_CleavageSite=21; ConfidenceScore=5.10e-01
MATSPKETSSPGSPSVPSSPSSTKAPSNQEQPEFHIQPIQMIPGQAPVPEKLIPKRQQGVKISENPSLATSPREVDPEMDKKIPQYCEQHLKNASVPDADEDVPTSSTPNVSVADADKDVPTSSTPNAEVLSSPSKEESTEEEDQATEETPAPRAPEPAPGNLIDLEEVESDEEPIANKLAPGIAERLQSRKGKTPIKRSRRIKTMAQKKSTPITPTTSRRSKVAIPSKKRKEISSSDSDDDVELDVPDIKRTKTSGKKTCLGKRTGKRCLGLQGDHGPHQGCWTAENCHQVGRVL

SEQ ID NO: 155124 - protein, 61 aa, Glycine max
  Coding DNA Sequence Number=SeqID_63439
MMITKDDDKVDDKKLKDRIKNTSRFKRKVEFKNQESRFKRSRFKTQDSRIKRRLNPDKYEK

SEQ ID NO: 155125 - protein, 110 aa, Glycine max
  Coding DNA Sequence Number=SeqID_63440
  Gene Ontology: Mol. function=2-oxoglutarate decarboxylase activity; Cellular component=chloroplast; Biological process=menaquinone biosynthetic process
  Homolog annotation: Hit_ID=A7PNB6; Match level="QueryCoverage=91%, HitCoverage=17%, E-value=4e-35, Identity=68%"; Hit description =Chromosome chr1 scaffold_22, whole genome shotgun sequence
LDHANELSNSLKESANINTVWASLIVEECTRLGLMYLCIAPGSRPSPVVVAAASHKLITCILCFDEHSLAYDAVGYGRGSHIPAVAITSSGTAISNLLPAVCFIIFMNLF

SEQ ID NO: 155126 - protein, 30 aa, Glycine max
  Coding DNA Sequence Number=SeqID_63441
RKGEEEELKRDATSRRCGIKKKLTTIGSHG

SEQ ID NO: 155127 - protein, 101 aa, Glycine max
  Coding DNA Sequence Number=SeqID_63442
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=95%, HitCoverage=43%, E-value=3e-40, Identity=79%"; Hit description=MADS -box protein GmNMH7
  Pfam annotation: Domain name=K-box; Domain location=44-101; Score= -6.0; E_value=0.0015; Accession=PF01486.8; Description=K-box region
  Pfam annotation: Domain name=SRF-TF; Domain location=1-35; Score =24.1; E_value=0.00053; Accession=PF00319.9; Description=SRF-type transcription factor (DNA-binding and dimerisation domain)
  Pfam module annotation: Pfam domain module=K-box::SRF-TF; Domain location=44-101::1-35
IENTTKKANELTVLCDAKVSIIMFSSTGKLHKIEQSTKQFFDQYQMTLGVDIWNSHYENMQENLKKLKERMGDCLNELGMEDLRLLEEGMDKAAKVVRERK

SEQ ID NO: 155128 - protein, 208 aa, Glycine max
  Coding DNA Sequence Number=SeqID_63443
  Gene Ontology: Mol. function=transporter activity; Cellular component= integral to membrane; Biological process=nickel ion transport
  Homolog annotation: Hit_ID=A6TFA4; Match level="QueryCoverage=86%, HitCoverage=57%, E-value=6e-88, Identity=87%"; Hit description =Nickel transport protein
MLKYLLRRLLPLPLMLLAASAIIFLLLRLGAGDPALDYLRLSNVPPTSEMIAATREQLGLNQPLALQYLHWLWRALHLDFGVSYASQRPVLDDLLHFLPATLQLTGAALVIILLTSLPLGIWAARHRDRLPDFAVRLIAFLGVSMPNFWLAFLLVMLFSVHLRWLPAMGYGGWRHLLLPAFSIALMSLAINARLLRASMLEVSSQRHV

SEQ ID NO: 155129 - protein, 78 aa, Glycine max
  Coding DNA Sequence Number=SeqID_63444
MYSIFSGQINLDHPDEDMTKSKGKGPLEGLGGPMTRARARKAKEALQQVLSILFEYKPKFQGEKSKVVSCIMAQMEED

SEQ ID NO: 155130 - protein, 46 aa, Glycine max
  Coding DNA Sequence Number=SeqID_63445
MCSKSWLWNSESAGSRAIEESTLTNKIESNDEGGSLGRSITPHLQD

SEQ ID NO: 155131 - protein, 265 aa, Glycine max
  Coding DNA Sequence Number=SeqID_63446
  Gene Ontology: Mol. function=RNA-directed DNA polymerase activity; Biological process=regulation of transcription, DNA-dependent
  Homolog annotation: Hit_ID=A5AWY3; Match level="QueryCoverage=100%, HitCoverage=66%, E-value=2e-48, Identity=39%"; Hit description =Putative uncharacterized protein
FSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYESLSYGQLISYVQKVALKICQDDKIQRQLAKEKAQTKRDLETSKEETETETSSSVLSDENLNLIQQDDQLSSTNDDGQINTLTREQDLLFEAINSIPDPQEKKVFLEKLKKTLEVKPRQKDFITNNKFD

SEQ ID NO: 155132 - protein, 112 aa, Glycine max
  Coding DNA Sequence Number=SeqID_63447
MKDVVTSRWFILKAHDVEACPMAEDLLQGIMDQGRFEIGKKPVPFPYKSYKAVPWKYASQKPDGRKDESIRDDLSSAKVTNISGMSGVTRSGQIFAAPNPLVWSKDMKGKAK

SEQ ID NO: 155133 - protein, 81 aa, Glycine max
  Coding DNA Sequence Number=SeqID_63448
MASSSSSSSNIKIKSGPIDGDVLWMQAKHVSEHVWNGEEDRKLHIRRAVPTYQGEEEIPEETIPLLRQCGFYWIIKMGYLK

SEQ ID NO: 155134 - protein, 172 aa, Glycine max
  Coding DNA Sequence Number=SeqID_63449
  Homolog annotation: Hit_ID=A5BZH4; Match level="QueryCoverage=63%, HitCoverage=17%, E-value=1e-07, Identity=33%"; Hit description =Putative uncharacterized protein
  Pfam annotation: Domain name=zf-CCHC; Domain location=129-146; Score =8.6; E_value=0.076; Accession=PF00098.14; Description=Zinc knuckle
MPHIVVITLARRKKENTKIVTIMKKDIGHILDLTPIGKKKKESLKRLTLTSHTPIGKKKKESLKRLTLRVEQQLKRKSTSKSYGSHSYPKKDQGQGILGVTPSKPKDDKGKTIEKQPLKASMKEKGSSMKWFNCLGRGHITSQCPTNKTMIVRGQDIYSSQDEATTSPSSSE

SEQ ID NO: 155135 - protein, 80 aa, Glycine max
  Coding DNA Sequence Number=SeqID_63450
  Pfam annotation: Domain name=zf-CCHC; Domain location=24-41; Score =29.0; E_value=1.8e-05; Accession=PF00098.14; Description=Zinc knuckle
  Subcellular localization annotation: CTP_CleavageSite=45; ConfidenceScore=5.02e-01
MEGKGKTIEKPTPKTSSQSRTSNIKCFKCLRRGHIASQCPTKKTRIMRVQDIYSRQDETTSSPSSSGSEDEARGAESSEE

SEQ ID NO: 155136 - protein, 202 aa, Glycine max
  Coding DNA Sequence Number=SeqID_63451
  Homolog annotation: Hit_ID=Q2HW87; Match level="QueryCoverage=78%, HitCoverage=16%, E-value=3e-07, Identity=25%"; Hit description=RNA -directed DNA polymerase (Reverse transcriptase); Zinc finger, CCHC -type; Peptidase ...
  Homolog annotation: Hit description=aspartic, active site; Retrotransposon gag protein
  Pfam annotation: Domain name=zf-CCHC; Domain location=51-68; Score =18.7; E_value=0.0022; Accession=PF00098.14; Description=Zinc knuckle
  Pfam annotation: Domain name=zf-CCHC; Domain location=71-88; Score =14.7; E_value=0.0091; Accession=PF00098.14; Description=Zinc knuckle
  Pfam module annotation: Pfam domain module=zf-CCHC::zf-CCHC; Domain location=51-68::71-88
MKNKNNETRHRLKPYSTPPKQYGNRPNNQRTIALGFVGGSGSKPNTFPTQITCYKCGKPRHISSNYTDKGVTYFNCRQKGHVQRDCPYPNKEQNGGGLNDQTGHLKATGKVFTLNGAEASKSKDLIQVSKNMIFISANQVVTSLKENAQVYMILFDLEIETKVSMCDLSVVKEFPEVFPEDISGLPPERERERFFHRLSTRC

SEQ ID NO: 155137 - protein, 100 aa, Glycine max
  Coding DNA Sequence Number=SeqID_63452
YIYLGLTENKRGYISCGSVLVEGTSTRFKENKGGYIPCGSLLLAEKSSNSFGANTEKNPKEVCKVVMTRSRKLVAAEDEDIVALKEQVVSKDTTDKKSDE

SEQ ID NO: 155138 - protein, 182 aa, Glycine max
  Coding DNA Sequence Number=SeqID_63453
  Homolog annotation: Hit_ID=Q6UUU1; Match level="QueryCoverage=47%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAATASYLGSKSGSSETSKTACR

SEQ ID NO: 155139 - protein, 234 aa, Glycine max
  Coding DNA Sequence Number=SeqID_63454
EVQALKSELGKANLAKRKFKLAATHVRKECAGLREENANTARALEQETKRARKEEYGRNKFRGALWGSNNELKLRREERDQSRAHNMVLKEELIACSRSKRSLSQRLCETETNMLAIIAKYEEELGLATAHEHRIADEYAQVYAEKEARGRVIDSLHQEATMWMDRFALTLNGSQELPRLLAKAKAMADTYSTPEEIHGLLGYWKNTITKRAARDPYRTRSKSRTMGDQEETQE

SEQ ID NO: 155140 - protein, 86 aa, Glycine max
  Coding DNA Sequence Number=SeqID_63455
MMTTKDDDKSDEQKAQVNQRTSISSESKNIHLKRIKNKSRVQESRKIQDSRRKPTIKIQDSRSPKSRSRFKTQDSRMKKKLNQDKY

SEQ ID NO: 155141 - protein, 29 aa, Glycine max
  Coding DNA Sequence Number=SeqID_63456
MVTTTKVEFLEWVLSTACLALVNYVTKAI

SEQ ID NO: 155142 - protein, 162 aa, Glycine max
  Coding DNA Sequence Number=SeqID_63457
MWAFHKGLQIDWAHLVRYCMHKALRLNAPLPYPHLVTLFLQHFNIPLVCEPYVPIKRSFLIGVVVIASFGYQKEHDGSWVKKGARHVDEEGHLHGGEDSSLLQKILDRFDGLQTFVGERFDTLELQVDMRFNEMESRITKVEEDVSYIRTSFDLPPPLPPSS

SEQ ID NO: 155143 - protein, 124 aa, Glycine max
  Coding DNA Sequence Number=SeqID_63458
MEEVLIPSSNVNTTPELRIFILTGFLRFFRHFPQINVGGDSAHLSSFGKRTREPRLARPQRPVASGGSWDSLGSYFCESSPYFADCEIGGGVKKKKVVFLALLCLSKLLRKIISVKKIQAEALP

SEQ ID NO: 155144 - protein, 150 aa, Glycine max
  Coding DNA Sequence Number=SeqID_63459
RTTRPRLERTTRPRHQRTTCPRHQRTACPHHQRAARPHLQRTISPRLERTTRPHHQRAARPHLQRTTCPRLERAARPHFGYWLPSPLRGLHVLALRGLHVLTIRGLHALTSRGLHVLALRGLRPRPWVLVTLTVQRTTRPHLQRTTRPHL

SEQ ID NO: 155145 - protein, 156 aa, Glycine max
  Coding DNA Sequence Number=SeqID_63460
MSWGRNILPERKVELYHTELDDFKTELERRNFHKRLTNLVDGSIDLALVKEFYANLYSSEGPSPKQSRVRGHLVKIDADSLNTFLETPVVLAEGRGFILNTEGHPGKILRKDLTTLTRVWSVLSYSNLAPTSHTSDLTVDKARLIFGLVSRMVMNI

SEQ ID NO: 155146 - protein, 72 aa, Glycine max
  Coding DNA Sequence Number=SeqID_63461
MDNLKRRLLGGSMNPPVVGKFYMRKILIPRLMVCHLAKPIHHHKDRVYTSLGSRKPKNKVHTNVYRGCKWDE

SEQ ID NO: 155147 - protein, 22 aa, Glycine max
  Coding DNA Sequence Number=SeqID_63462
MKKDPRPTSSNGACISGNTFLK

SEQ ID NO: 155148 - protein, 38 aa, Glycine max
  Coding DNA Sequence Number=SeqID_63463
MVFDGFGDMTKSKGKDPLEGLGGPMTRARARKSKKALQ

SEQ ID NO: 155149 - protein, 97 aa, Glycine max
  Coding DNA Sequence Number=SeqID_63464
  Homolog annotation: Hit_ID=A5AZ88; Match level="QueryCoverage=78%, HitCoverage=7%, E-value=3e-11, Identity=38%"; Hit description =Putative uncharacterized protein
IKHLIFPADFIVIDIEEDADIPLILGRPFMYTTSYMVDMEKKILQMGIEDQKISFDLFQEDKDPPHQNVYFKVHELFWILDNKTMRQASDVKRALTG

SEQ ID NO: 155150 - protein, 84 aa, Glycine max
  Coding DNA Sequence Number=SeqID_63465
MKDKRDEEEKQKKKKDSKALSSKAKGKEKEEKDSSKKIVNMENHVATKGDIKRALLLKQSFYLLLSRETSLSTAIPLELEVIPQ

SEQ ID NO: 155151 - protein, 54 aa, Glycine max
  Coding DNA Sequence Number=SeqID_63466
MGSYLAHGPKIYPKAHENPIAFSYISGPIFLESSIQYPWGVLRKKAQSFKNLGI

SEQ ID NO: 155152 - protein, 253 aa, Glycine max
  Coding DNA Sequence Number=SeqID_63467
MLEEGQECEYGQRRNRSDGFDEEAIAQLLCIPGQGFARTAAGRRVRIMRTNMTTLTQIWMTLLLSNILPTDHNSDLPMPKCQLVYAILTRMSIHVAQLIADAIYIFAGMAPTRHPLDPGKSNRALGFPALITGLCQSFGVPVAPTKVIRPPITRAFIENIYGIWVRQQAANPRAHVQTHDCLYQMSLSLQSQGFTSFPCPTPDQFRAEVAWPRDWPEARAGEAPVEAPDEADEAREDEEMTDLLDFLGGSGAT

SEQ ID NO: 155153 - protein, 56 aa, Glycine max
  Coding DNA Sequence Number=SeqID_63468
MGHHRFVILFGRNNQYENTEKGVEGRSPEYEEPRDLRSTPFQGGGNDAILPRKGIG

SEQ ID NO: 155154 - protein, 188 aa, Glycine max
  Coding DNA Sequence Number=SeqID_63469
MLDFKLLAHFPHHLVIQVGAVVRDNLPWQTISADDLSLNEPDHYTPRDIGIGGRLDPLGEIIYRHEDEAMTIRGLGLNGPDDIYSLHGERPRGGHDIQRMRWSIDIVCERLTFVAFPYMDTTITFHACPLACVPNEPSWTSSIMCDASSIGACRPRIFFINGFLCFLEDKWQQNGEGRERGDATSRRR

SEQ ID NO: 155155 - protein, 64 aa, Glycine max
  Coding DNA Sequence Number=SeqID_63470
MKAQRQRRTFWHLIKFGESFSLSSLLNQSQTYEGNPCGVYPDLSSFTGSGVIQNSIACIKRSAP

SEQ ID NO: 155156 - protein, 44 aa, Glycine max
  Coding DNA Sequence Number=SeqID_63471
MASKSEDEGYEEDEGGRMNERYRERRNHRRYEGRQREEGIEGVK

SEQ ID NO: 155157 - protein, 52 aa, Glycine max
  Coding DNA Sequence Number=SeqID_63472
MNKCLGSSSSMDSFASWKMNGSGMEKEEREETPLQGEDESRRSSPPYIGGHG

SEQ ID NO: 155158 - protein, 107 aa, Glycine max
  Coding DNA Sequence Number=SeqID_63473
MSHLSEHVSITDKVFPTLSWNSSYDGSPEINGNQPKHKQQTHTGMKNLVGRLGVHDRTCLTMGRPVKVTLFCENAPTMWDRHRLKGALKLDDPQGLHSEQSVRASPS

SEQ ID NO: 155159 - protein, 59 aa, Glycine max
  Coding DNA Sequence Number=SeqID_63474
ELRCSTPITTQSKGSLSVLIKNTKGYQGRGKRGLLLDFSRPQLAHASIWLAWAMELPLG

SEQ ID NO: 155160 - protein, 117 aa, Glycine max
  Coding DNA Sequence Number=SeqID_63475
  Homolog annotation: Hit_ID=A5BMB6; Match level="QueryCoverage=75%, HitCoverage=23%, E-value=1e-08, Identity=34%"; Hit description =Putative uncharacterized protein
MWDTLQLTHEGTTDVKRSRVNTLTHEYELFRMNPNENIHTLRCLSKEWQPKEHEMELQSLNQNEEIDKKKRSITLKAYSSTQEENEEDFSLFVKKFKKFVKKRRIERSQNFNNGKKI

SEQ ID NO: 155161 - protein, 53 aa, Glycine max
  Coding DNA Sequence Number=SeqID_63476
MVQKRDKKLRGSSNGPIGGYHRWLKAYAQGLDWLPNLRTTKGLEFETPEEDDE

SEQ ID NO: 155162 - protein, 105 aa, Glycine max
  Coding DNA Sequence Number=SeqID_63477
  Homolog annotation: Hit_ID=A5B1P9; Match level="QueryCoverage=100%, HitCoverage=8%, E-value=2e-10, Identity=35%"; Hit description =Putative uncharacterized protein
MTIEESIHVSFDETNIISPRKEFLDNIADSLEDMYNQEKNLKRKRNEENKDVQDDIAQENDDLSKEWKTSRNHPLDNIIRDISKGVTTRHSLKDLCNNMAFVSMI

SEQ ID NO: 155163 - protein, 58 aa, Glycine max
  Coding DNA Sequence Number=SeqID_63478
MYPPMCWDKEFSGGEGKNQKNSQAVSPLNSLGKREGRHKRIQVVSPSILLAKGEEKKR

SEQ ID NO: 155164 - protein, 203 aa, Glycine max
  Coding DNA Sequence Number=SeqID_63479
  Homolog annotation: Hit_ID=Q6WAY6; Match level="QueryCoverage=75%, HitCoverage=27%, E-value=1e-17, Identity=32%"; Hit description =Putative uncharacterized protein
MGRLQQQAFRKAYGKIWDLAMVEVFTEAISSLAQYYDQPLRCFTFGDFQLSPMVEEFEEILGCPLGGRKPYLFSGFYPSLARISKIVQIPVQELDHRKQVENGVVGIPRKYLEAKARILVGKGEWAPFIDILAMLIFGGVLFPNVDGLVDLAVIDAFLAYHNHKESPVVAMCRNLPFGGRATRDSRDACSTKGIRAESPPTFI

SEQ ID NO: 155165 - protein, 167 aa, Glycine max
  Coding DNA Sequence Number=SeqID_63480
AWETPLRKDQELRGIRNGIIGGYHEWLKVRIRGLDWLAKLKVVSEENFEAPEEDEEVQALKSELGKAKLAKEKFKLAATHIRKECAGLREENAITAKALEQETKRARKEEYGRNKFRGALWGSNNELKLRREERDQSRAHSMVLKEEFVQSPKEACLSVYARRRPTC

SEQ ID NO: 155166 - protein, 37 aa, Glycine max
  Coding DNA Sequence Number=SeqID_63481
MILMAAEWRRKRERRCHFKEKMSLEEAHHHRRPWIRA

SEQ ID NO: 155167 - protein, 70 aa, Glycine max
  Coding DNA Sequence Number=SeqID_63482
MATVQHLMIANRKRKPIICKINPDLNKDSKETTKAIEALLTTLMQIFQIGVHNNNDNKLSRIVSQRWKIL

SEQ ID NO: 155168 - protein, 57 aa, Glycine max
  Coding DNA Sequence Number=SeqID_63483
MAEALAHAPSDVEQLRHAVEACQAKAERLEQLLNLRIVTKGTETYNVMQDCLRIASV

SEQ ID NO: 155169 - protein, 78 aa, Glycine max
  Coding DNA Sequence Number=SeqID_63484
MDKVDIFVPHPLTNACLLIQLPPECECKPLVCLLKQPALGQPFPCVQESSTTRDPRSLNPFSEIRRREEEVSRKKGRL

SEQ ID NO: 155170 - protein, 97 aa, Glycine max
  Coding DNA Sequence Number=SeqID_63485
MWRSKWDNLQNSWRIGRQAALVLTLKKNPKEECKAVMIRSRMETHVDERKAEKKIEEHKQQLADELPLEPVDDLVELEEIVEEVEGDEEGEIPIKDC

SEQ ID NO: 155171 - protein, 112 aa, Glycine max
  Coding DNA Sequence Number=SeqID_63486
  Subcellular localization annotation: CTP_CleavageSite=52; ConfidenceScore=5.76e-01
LKNFDILTFRNTRKVATPLKKARLWLRGGGGSSRSTSASSSGGGSSGKQNVRVVAGRSSRRDEVVQAIVGVLGFWRDGVPTSTVFDDFHQNYNDRVIDKCRCTTNAPHKKLI

SEQ ID NO: 155172 - protein, 113 aa, Glycine max
  Coding DNA Sequence Number=SeqID_63487
MAETGKLDHLEERLNAIEGGEDYAFVNLEELFLVPNIITPPKFKVSDFDNFSKKPVEKASQRSHEEASGGILLMKLLEKATCSYLGKNASQPSLTVGSSRNLALNFTRHLSMI

SEQ ID NO: 155173 - protein, 39 aa, Glycine max
  Coding DNA Sequence Number=SeqID_63488
MVCHRRRVKPIALKARSSWETFSWCYWWLVHLPGGRTVP

SEQ ID NO: 155174 - protein, 74 aa, Glycine max
  Coding DNA Sequence Number=SeqID_63489
MKLFLIPHDVASCGACRPWIFFINRVICFLKINGSRIEKEERLIRQALKIAIFHLLAKPICWLSERPLSATLMG

SEQ ID NO: 155175 - protein, 160 aa, Glycine max
  Coding DNA Sequence Number=SeqID_63490
  Homolog annotation: Hit_ID=Q6WAY6; Match level="QueryCoverage=98%, HitCoverage=25%, E-value=3e-19, Identity=39%"; Hit description =Putative uncharacterized protein
MDGLVDLAAIDAFLAYHNHKESPVVTILADLYDTFDRRCEKSNTRIVCCTPALYVWLVSHLFRQEVRHACPLESHCSCTEKGRANWDQLLASKEGASINWFPRWKEGRTGVLISCGGFPNVPLMGTRGCISYNPVLAIRQLGYPMRGAPLEEEIVPVVSR

SEQ ID NO: 155176 - protein, 73 aa, Glycine max
  Coding DNA Sequence Number=SeqID_63491
MTRMMEAMMSMRKMMEDNTAIVIAASQEGEVVKNAYGPHHVQVQSKHFFPPYGLPPNYTPPTVICWIKWPQNN

SEQ ID NO: 155177 - protein, 290 aa, Glycine max
  Coding DNA Sequence Number=SeqID_63492
GQWIPFDADAISQFLGYPLVLEEGQECEYGQRRNRSDGFDEEAIAQLLCIPGQDFARTAAGRRVRIMRTNMTTLTQIWMTLLLSNILPSDHNSDLPLPKCQLVYAILTRMSVHVAQLIADAIYLFAGMAPTRHPLDPDKSNRALGFPRTDHRTLPVVRSPRCTYQGDSAAPSPGLLLRKYCTQRQAQGDAPQATGAPPPPHQAGPAGSFDMEQYLRHLVRQQAANHRAHGFASFSCPTPDQFRAEVAWPGDWPEAQAGEAPPEAPGDGEEAHEDKEMADLLDFLGGRGAT

SEQ ID NO: 155178 - protein, 232 aa, Glycine max
  Coding DNA Sequence Number=SeqID_63493
  Homolog annotation: Hit_ID=Q6WAY4; Match level="QueryCoverage=35%, HitCoverage=15%, E-value=8e-07, Identity=35%"; Hit description =Putative uncharacterized protein
MGSSQMTSLKKRFYQVKVKSLGITSLKELGQLMGQLQRQAFRKAYSKIWDLAMAEVSTEAIASFAQYYDQPLRCFTFGNFHLSPMVEEFEGILGCPLGGRRPYLFSGHSRTIDLRRSPLSECGWVGYPMRGAPLKEELAPIIARGFNKTNVEALQKVRKAWEMVQKKDKEFRGSNNGPIDGYRKWLKAHMQGLDWLSSLRTTKGEEVEAPEEDKEVQALRAELEKAQTFKER

SEQ ID NO: 155179 - protein, 157 aa, Glycine max
  Coding DNA Sequence Number=SeqID_63494
MNSIITVLYFNGRVYEDNDGVIFEGSKKAIQIKRKYIALQICDDEDVETMLESFKQQDQMSVLELYIEKDVAGGSMFHSANSLTSCGNYLSNDETQLATNMSNLHIDEDDDDDDDYLVSNSYVEESVDEDDSVDGISETDDEVTDIPQPVRIVHPAE

SEQ ID NO: 155180 - protein, 36 aa, Glycine max
  Coding DNA Sequence Number=SeqID_63495
MAALEREGSDGLGSTSKDWKAVSNDSSAASTYGAED

SEQ ID NO: 155181 - protein, 300 aa, Glycine max
  Coding DNA Sequence Number=SeqID_63496
MGKDWGPGAADAWYTDKSSHSTALGPYDWPPTGHPNAACRVPSSACEQRWTLEMVATIEVAVVHLWLAATAVLFYEGLVNGRPDELRGCNWHPIELAEICDQGQKSQCSVGLFQVHWGKIRIMIARKNVAEEQRHPNLCQGGHASAHDLHPSSYHTACKVLSRNAQQLAYGLLVKSRSLAPLFTKLATLSLFQDQWMPQELINGIFIKGDPLASHSRALIPDSFLCGPCISIEFHDYFWVIFSHGPCELSPLPLGNFLLELSVFSLSQSDPSLLEERPTLDCFKATLVFLTSESMSVKFY

SEQ ID NO: 155182 - protein, 42 aa, Glycine max
  Coding DNA Sequence Number=SeqID_63497
MDKSLKVGEDEWREREKGSTKFCASNEPTNPRSSPRFSTKCT

SEQ ID NO: 155183 - protein, 112 aa, Glycine max
  Coding DNA Sequence Number=SeqID_63498
  Pfam annotation: Domain name=G-patch; Domain location=1-42; Score =14.8; E_value=0.0031; Accession=PF01585.14; Description=G-patch domain
MVARVMLRNGSEPGMGLGKDSLGNADVVNIKGNPYKYGLGYEGQFFEDPNNEGLTIDFDRDISQTINEEEEEDVLSPELERLVAQEEREMKPHQEETELVNLGTTEEKKEVR

SEQ ID NO: 155184 - protein, 130 aa, Glycine max
  Coding DNA Sequence Number=SeqID_63499
MRLKLRKKVMRAAIVSSSSEEVKGIITSQRHDLEGRAKGNMWAIIDKCKEKLNLAATHEQRLEDEYAKISAEREARERVIDSLHQEATMWTDRFALTLNRSQELPPLLAKAKAVADTYSAPEEIHGLLSY

SEQ ID NO: 155185 - protein, 303 aa, Glycine max
  Coding DNA Sequence Number=SeqID_63500
  Homolog annotation: Hit_ID=Q6WAY6; Match level="QueryCoverage=98%, HitCoverage=49%, E-value=2e-26, Identity=29%"; Hit description =Putative uncharacterized protein
MGSSQKPSLKKRFYQVKVKSLGITNLRELGQLMGQLQRQAFHKAYSKIWDLAIAEVFTKAIASLAQYYDQSLRCFTFGDFRLSPMVEEFEEILGCPLGGRKPYLFSGFYPSLARISKIVQISVQELDHRKQVENGVVGVPRKCLEAKVRILAGKGEWAPFIDILALLIFGGVLFPNVDGLGDLAAIDAFLAYHDRKESPVIAILANLYDTFDRRCEKSSTRIVCFTPALYVWLVSHLFRQEVRHACPLEGHRSWTEKGGANWDRLLASKEVASVNWFPRWKEGRTGILISCGGFSNVPLIGTR

SEQ ID NO: 155186 - protein, 397 aa, Glycine max
  Coding DNA Sequence Number=SeqID_63501
  Gene Ontology: Mol. function=dihydropteroate synthase activity; Cellular component=integral to membrane; Biological process=folic acid and derivative biosynthetic process
  Homolog annotation: Hit_ID=Q1H0Y8; Match level="QueryCoverage=96%, HitCoverage=80%, E-value=1e-134, Identity=61%"; Hit description =Protein involved in biosynthesis of tetrahydromethanopterin, Orf20
  Pfam annotation: Domain name=Pterin_bind; Domain location=33-203; Score=-23.0; E_value=1.7e-05; Accession=PF00809.13; Description =Pterin binding enzyme
WGVPVERGPKDLKDLPQYFGQQGKAPDLTQHSVTIFAEIVDAPDLSIEQIIAKATHFKQQGADVIDLGCLPGKTFSHMTDAVQALKAEGFNVSVDSMREDDLLAAGKAGADYLLSLHEKSLWIADEVPSTPILIPAKPGSLSSLQRAIDHCLKRGKAFIADPILDPIHFGLTDSIVRYHKLRKKYPDIAIMMGVGNLTELTDADTTGVNAMLFGMISELNINAVLATSVSPHASEAVAEADVARRVMYRAQQDKRLPRGYSNGLLGLHDRKPFPYTAQEIVEMAGQIKDPSFRIMVSEEGVHVYNRDGLQQDTDPYRFYAGLNVQEDASHAFYLGVELARAQIAWQLKKRYVQDELLEWGVASVQQNRQAKVAHREASIKERLEKTRNDKDGDPISE

SEQ ID NO: 155187 - protein, 89 aa, Glycine max
  Coding DNA Sequence Number=SeqID_63502
MFCPPPPIYRGKEGGGCRPARPDYAIIPSLASGMLRNFTDCTLTLPFNSRHVAEHHGLPNDGCQVPRSGQARFVSQQIDGPRTKLGYDS

SEQ ID NO: 155188 - protein, 105 aa, Glycine max
  Coding DNA Sequence Number=SeqID_63503
MAKSPQEQVQMVEMVEGSELEWSPPLLLLVMVLVLWAPQSQGSWAVEAPPVGSNPLGMYPPLFSLNNLVDVPSTRTDPQEMYPLLFSVNNPSRCTFYLYHKGCTL

SEQ ID NO: 155189 - protein, 107 aa, Glycine max
  Coding DNA Sequence Number=SeqID_63504
MGLNQAHAFSKKVHQVKLKYGRHALRCPYRTRARARVMGEAEEVQEKMKADMEAMKEQMATMMEAMMSMKKIMEANAVIVAATSAVAKVNPMLPSGLKQMNHPTSNM

SEQ ID NO: 155190 - protein, 155 aa, Glycine max
  Coding DNA Sequence Number=SeqID_63505
MAEPSKKRKEEQRIQYTNTFSSRSIIDPKFIDMDFFLDESFKCIQAFQNSNLIPFMSLKLACVFGMVKAFYSNLEIQESTLISEVYGIKMVIDQSLFYDLTQLSSESVPFEGTLDDDWKSIFLCRVPPVYCTNQADMTRRLLAGSLALETHPWCL

SEQ ID NO: 155191 - protein, 155 aa, Glycine max
  Coding DNA Sequence Number=SeqID_63506
VILDPKYLDLEFFDGETFDCYQVFQNSALVYFMSLKLPYFLELAKVFYNNLKIQDGVVYSEVHSIPNVVDQSLFYSLTKLPIQGVPFEGTLADMIGRLLVGSFTFDCRIMHYIIVRILHPRSSKLAQASEEDLILLWVLQTGRQIDWAHLVRYRM

SEQ ID NO: 155192 - protein, 141 aa, Glycine max
  Coding DNA Sequence Number=SeqID_63507
  Subcellular localization annotation: CTP_CleavageSite=47; ConfidenceScore=5.28e-01
MGQMATQLNQAQSQNSDKLPSQTVHNLKNVSAITLRSGKKIQVPPPVAAPAPQPVKLHSTPEKEDDLVAQEKKLPDHEGVNKNFHAGGPSSSSSDLQQPPITLPFPPRAIPNKKMEEVEKEILETFRKVEVNIPLLDVVTP

SEQ ID NO: 155193 - protein, 123 aa, Glycine max
  Coding DNA Sequence Number=SeqID_63508
MAPTRHPLDPDKSNRALGFPSLITGLCQSFGVPVAPTKAANHRAHVQTHDCLYQLSLSMQSQGFASFSCPTPDQFRAEVAWPGDWPEAQAGQAPPEAPGDGEEAHEDEEMADLLDFLGGSGAT

SEQ ID NO: 155194 - protein, 155 aa, Glycine max
  Coding DNA Sequence Number=SeqID_63509
  Homolog annotation: Hit_ID=A5AK77; Match level="QueryCoverage=50%, HitCoverage=9%, E-value=1e-07, Identity=38%"; Hit description =Putative uncharacterized protein
MTRGNPGDLQPFAPEIDRTFHRLVRHSVHPNHSVHFKHCEHFEHSEYSIAGDSEYSDFEHSTTNFHTENMAQPPPRERTLREITAPDFTYDSLCIQYPDEGVPYVLKTGLIHLLPKFHGLVGEDPNKHLKEFHIVCSTMKPPDVQEDHIFLNAFP

SEQ ID NO: 155195 - protein, 54 aa, Glycine max
  Coding DNA Sequence Number=SeqID_63510
MASPFIFLHLHSTAIRSQEANESIDQDPRPTSSTWSYIMWYQEHLHLGSIIFQS

SEQ ID NO: 155196 - protein, 92 aa, Glycine max
  Coding DNA Sequence Number=SeqID_63511
  Subcellular localization annotation: CTP_CleavageSite=53; ConfidenceScore=5.32e-01
MVASSNHWIAEPGKLSSKAGNIPRCWTQKVVNTTKSQMKSPVTAEEFNAMGVKAMGTSKLNVPPISRSRGKDFLYVGLMIQRVNKKVILTEM

SEQ ID NO: 155197 - protein, 58 aa, Glycine max
  Coding DNA Sequence Number=SeqID_63512
KRISKKGRGVFSKQGVQIEIRPTWAFQEVPPEGGAFWRKQPSSPGRAGWQAPPSFSYK

SEQ ID NO: 155198 - protein, 147 aa, Glycine max
  Coding DNA Sequence Number=SeqID_63513
  Subcellular localization annotation: CTP_CleavageSite=31; ConfidenceScore=5.14e-01
YYPGHHQHQSYAEPNVPPVHVPKFMSQHHPSQAQYQSTSFSGHTSQGCQQSFQPLGFSSYIPQYSFQVPSTSNVFYGSSQMFATTFNTPSSAYNLAPSSSCYRPSLPTQIRDMSHEDEDEDEDNNNNNDDDDDVDDDDNSGHHVPQQ

SEQ ID NO: 155199 - protein, 153 aa, Glycine max
  Coding DNA Sequence Number=SeqID_63514
MANPLVLVLFASITGSIGSGEEPPDDNGVSVQPQQKMSFRDKTMVNKEKPSPRQRARFQHHEGTIDKTCKLTTNFDLMDVGNDFYMVKFDLEEDRAKVIGEGPLSLPNNLDFDSRLRFIAIGKPMRMDTNTLDMRCGHFPRVCVEVDLNKPVV

SEQ ID NO: 155200 - protein, 275 aa, Glycine max
  Coding DNA Sequence Number=SeqID_63515
MATKQIHLHFFVEGRQCDGAHGFISRIYVKFITPNCLVDGQVLDLRPVSDLRPFIHTHGMSAFSCCGALCIALSCLLLVSLGGYNFLCQDRPQTCRGIGRRAWNATLPQGGQGHAVRPTGGILRIESFNEDVEAVYGPSWEFTILGQCCPLEGPDHSQSLAFSAPPRGTAPSPQCRPDQMLTMDEQERIDERPWGTFYCDPTRAPRLHTLALRDAFVRRRGGGTCKAKDSDVQRVRWNLVFIGVERNCRSLFVGVVVAFADNSQLADNSWELVDN

SEQ ID NO: 155201 - protein, 90 aa, Glycine max
  Coding DNA Sequence Number=SeqID_63516
MVDLVGGGWICAMVEWVGVMKENLGFGRMKVGDGKNKCLMEEGEESIVAIGMEKDFRRIVEMLVWLAVEFLKYGCNNNGFGGYNDCGGHQ

SEQ ID NO: 155202 - protein, 94 aa, Glycine max
  Coding DNA Sequence Number=SeqID_63517
  Gene Ontology: Mol. function=aspartic-type endopeptidase activity; Biological process=proteolysis
  Homolog annotation: Hit_ID=A5B3J2; Match level="QueryCoverage=62%, HitCoverage=13%, E-value=3e-11, Identity=52%"; Hit description =Putative uncharacterized protein
MTLRRRKEEEEEEEEEEEEEEEEEEEEEIVTSPKKLDITDLDPTNITLHLVDRLVVYPRRAIEDMLVKVDKFIIPVDFEILDVEADEDVPIIFE

SEQ ID NO: 155203 - protein, 478 aa, Glycine max
  Coding DNA Sequence Number=SeqID_63518
  Gene Ontology: Mol. function=protein binding; Cellular component =nucleus; Biological process=root development
  Homolog annotation: Hit_ID=A7P9T4; Match level="QueryCoverage=88%, HitCoverage=78%, E-value=1e-161, Identity=65%"; Hit description =Chromosome chr14 scaffold_9, whole genome shotgun sequence
  Pfam annotation: Domain name=SWIB; Domain location=259-334; Score =87.4; E_value=4.7e-23; Accession=PF02201.9; Description=SWIBMDM2 domain
  Subcellular localization annotation: CTP_CleavageSite=41; ConfidenceScore=5.14e-01
MSMNNNNPSNPYGPSSTANPHSQITPGQGQYPRSQAHAIIQAQFQAQLQAHGLTLNPNAKRFPPKPPIHTATTPFKQTEPAPTVPARRKKHKPNEKHLPEKALAILPESEIYTQLLDIEARVDAALVRKKVDIQEALKNPPCIQKTLRIFVFNTFANQSSADSSAPTWTLKIVGRILEDGEDPEQAGDVAAQRMMPPLYPKFSAFFKRVTIYLDKRLYPDNNVISWENSRSSAAHEGFEVKRKGDREFPAQIRLEMNYMLEKFMLSPALREVLGVQVDTRARIVSAIWHYVKARKLQIPNDPSFFHCDQALQRVFGEDKVKFTMVSQKISQHLFPPQVILLEHMIKLSGNSPVGSACYDVMVDVPFPIQRELNALVANVERTKEIDACDESICGIIRKIHEHRRRRAFFVGFSQSPLEFIKALVESQNKDLKVLLGESRHNAEKDRKSDFFKQPWVEDAIVRYLNRKPAAGSDAPGST

SEQ ID NO: 155204 - protein, 127 aa, Glycine max
  Coding DNA Sequence Number=SeqID_63519
MTRGNPGDLQPFDPEIDRTFHILVTYSMHPDHSVHFEHSEYYVAGDSEYSDFEHSTTNFHTKNMAQPPPHERTLREMAAPDFTYESLCIQYPDEGVPYVLKTGLIHLLPKFHGLAANIYNTSQHNYM

SEQ ID NO: 155205 - protein, 131 aa, Glycine max
  Coding DNA Sequence Number=SeqID_63520
MSSVIACLQKATMSSFAFRRRQCLCRSKLHDDDSTQKNDFKIESTSSRSRLISRFKKRHQNSREDEFKIQEKKSRSNKSRLHKGSIEKDFSKTKHSTILFYKRVFSNFSKLPEYLLSGNRLHGNQLPVIKI

SEQ ID NO: 155206 - protein, 29 aa, Glycine max
  Coding DNA Sequence Number=SeqID_63521
MGLELDGRCIATVFTCLVVIISWLLTFIQ

SEQ ID NO: 155207 - protein, 70 aa, Glycine max
  Coding DNA Sequence Number=SeqID_63522
  Subcellular localization annotation: CTP_CleavageSite=27; ConfidenceScore=5.06e-01
MTYQGNPCGVYPDLSSLTGSGVYPDLSSFTGSGVYPDLSSFTGSGVIQTFVACIKRSAPTQVHITFCYIN

SEQ ID NO: 155208 - protein, 218 aa, Glycine max
  Coding DNA Sequence Number=SeqID_63523
QDNPTGHMRTTLTPGWPTGLKALPNHILKQPQSLVGAEILGIPTNHSGPKTRNFLRRFIKHLTGTDAVSRNRVTSNQCINHVGIKVQPELDDMYMDLLGSCERAHTSACLEEEGEGVLAGEDVASAHGYVEGERELGRGVEWKILKARERSPKGERAHEKNRRLAAKGSVATTAETIIWAWTCFSWSRVVHLSDMSARVARVLCSGGGLKGCNFGANI

SEQ ID NO: 155209 - protein, 112 aa, Glycine max
  Coding DNA Sequence Number=SeqID_63524
  Gene Ontology: Cellular component=nucleus; Biological process =regulation of transcription, DNA-dependent
  Homolog annotation: Hit_ID=A7P9U2; Match level="QueryCoverage=79%, HitCoverage=73%, E-value=4e-23, Identity=60%"; Hit description =Chromosome chr14 scaffold_9, whole genome shotgun sequence
METEKRNKVVLISEHNIRCLRKPKASVNRPPTPDVVENVPEREPTLQELINIKLIETGEKERLMELLRERLVDCGWKDEMETLCRAVVKKKGRNNVTVDELVHVITPKGRGS

SEQ ID NO: 155210 - protein, 239 aa, Glycine max
  Coding DNA Sequence Number=SeqID_63525
  Gene Ontology: Mol. function=transcription factor activity; Cellular component=nucleus; Biological process=regulation of transcription, DNA-dependent
  Homolog annotation: Hit_ID=A7QXY1; Match level="QueryCoverage=22%, HitCoverage=13%, E-value=5e-15, Identity=68%"; Hit description =Chromosome undetermined scaffold_235, whole genome shotgun sequence
MEQTHSGKYFVKVTQYGDFATVALLIFSSVTLQSHNGRSTHRLNEMALTQDPDTNVFDHHPKKSVPCMTPLPCAGGDAPGWGRYAVEVRDLQSKEWRWLGTFDMVEEAACTYDCVTRAICSAKDGTNFVYPSPPVRRPCRQTIVFLLRCQCQRRLRSQLLQPLPPPRLLRYLPLQDQCYQEVTRLAIIALRKSRCLSGKGMPSKNDLNSTSDLSCCEKGASWEAPLTVANESIYLPKFH

SEQ ID NO: 155211 - protein, 133 aa, Glycine max
  Coding DNA Sequence Number=SeqID_63526
MGGNQPRQGYNAGEYSGFQPGLNFNQQQGQWRSHPSNQFNKEQGGPSNRPQQQGPSLYERTTKLEETLAQFMQKNLLVLLERTMSRIQKEECKAVMTKGRMATMVENEGRVVDDQELVVVEEKDDESRKPNII

SEQ ID NO: 155212 - protein, 884 aa, Glycine max
  Coding DNA Sequence Number=SeqID_63527
  Homolog annotation: Hit_ID=A7P9U7; Match level="QueryCoverage=49%, HitCoverage=98%, E-value=1e-102, Identity=49%"; Hit description =Chromosome chr14 scaffold_9, whole genome shotgun sequence
MVDFWTSVPSYELKINGIPRTVVATSKPEDLIIFLDFSIPITNSTEQVLNALHVNSGVLIPLHGRSNGTRGFSFKLKNISGTEIITIELQAASILGKTGTPVSPVAPITFLYDPMKPNVVLRTSSLTETRDFNINIMAEFTKPVFGFGTSIVEVSGGRLIRQGKGTIKSFILVDCPSSDKGGVSYHSCREDSTPAISIALDSFISAGTIATSLVAAMVSLSSANLEALSILALGGASSPASNPSINLHGMIGHLQVFALTSWFSTNQFIKYSETTRGLRWLIPHHKLPWKKIDTWKKLGWRSNGQSAGERDQQQTDLMSLSYIDPKLSFQTENTTNFGRFHNQHDLSKTSTLYGLPLNSIEYFTYFLRGEPLSASNVIKGMESYKGWQDMEMNLFWLGVGGGCLLLFHVFMIFFLRHRTGRSPQGSLSVPRFELFLLILMLPCLSQSSTFVIKGRTTGGIITGVLLLAIPVAFILSALLFLIIAIYAGSFAQYKQFKKITNEEKWYTKLLFCFIGRSTTGKWFNREGLPSSFLSRFGILFDDWKGPPVLILGDQNEQNNTITKWSESGKSGNGRTKTVCSEDSNEEIKISTFKKVLGCMRASYIILDLLRRVGLGIISVAYPSESSNKSLFALIITSMQFIYLFTTKPYINRGVHVVESVSLLCETGVFSILVLHNGSHSVESKTWELVMLFLLMFTFIAQLTNQWYAMVNSLWKLSQTQNNSLRDGVKLAAKGLILPFLPSKHWSSVISTFSQPETNQLSVNPTCSGIDFERRNRNGYMDPISTMTATVVPVQSPSTPNHNVVERRDPTTWETGASSHIEVEGKWLKGHKAGLKKELRMLRELAKASFSGDTRFDEASTSYTLGEQQHSSGEIYLGNPKRRYC

SEQ ID NO: 155213 - protein, 75 aa, Glycine max
  Coding DNA Sequence Number=SeqID_63528
  Gene Ontology: Mol. function=nucleic acid binding
  Homolog annotation: Hit_ID=A5B779; Match level="QueryCoverage=50%, HitCoverage=4%, E-value=4e-09, Identity=71%"; Hit description =Putative uncharacterized protein
MLNVSTTERNLGLSTTDTRRSVERASAVISPAPPVFDGDNYQIRTTRMEAHLEANDLWEAVEEDYEVFPYQLIQQ

SEQ ID NO: 155214 - protein, 114 aa, Glycine max
  Coding DNA Sequence Number=SeqID_63529
MVAPPNSISLVDQFNEMVAWPGTQPSLHREDEGPTAQVPQHMEDESSEATIPEPFDIGEEAEETQPSAPMVNLPSPQPAADPFTPLLQMPEDPTTPVLAVDTSPPTTPVLQLTD

SEQ ID NO: 155215 - protein, 47 aa, Glycine max
  Coding DNA Sequence Number=SeqID_63530
MGAKYLEVVKRGSHPNNGWSPDEIRGQYDRDCGVADKSEALAPTYPQ

SEQ ID NO: 155216 - protein, 165 aa, Glycine max
  Coding DNA Sequence Number=SeqID_63531
  Homolog annotation: Hit_ID=A5AWV0; Match level="QueryCoverage=73%, HitCoverage=8%, E-value=3e-09, Identity=29%"; Hit description =Putative uncharacterized protein
MRAGNSNIYGFLKPQSIQRSRQSQFETESYIKSWMQSSKRDVYLGAYLNGGHWQMVVIVPKEHLVVWFCSLHNRSDNYLKGIINSALKGFDDAPQPKSKAPARWIVVKCNRQKGSTECNYYVMYWMSTIILGSFRNNWEAYFNDPRPLEPERLKALRIQWAQYYL

SEQ ID NO: 155217 - protein, 233 aa, Glycine max
  Coding DNA Sequence Number=SeqID_63532
  Gene Ontology: Mol. function=sugar:hydrogen symporter activity; Cellular component=integral to membrane; Biological process =carbohydrate transport
  Homolog annotation: Hit_ID=Q9FXY8; Match level="QueryCoverage=44%, HitCoverage=18%, E-value=3e-30, Identity=66%"; Hit description =Putative glucose translocator
MLALVMHDLTVASEGSSEPEAGWFDLFSSRYRKVVSVGATLFLLQQLVGINTTVYYSTSVFRSAGIASDAAASALVGASNVFGTIVASSLMDKKGRKRLLITSFSGMLHCGGRKIEHCGAVGRRDVRDRDWRDRETRGYWERDIKGLPHIDQFLNSPHIDHWNVVVRILRFIKGSPWEDYCMRTGDIKILFLILMQTGLDLLRIGGTPQHIVFSLGGTSFHGKARNKICRRKY

SEQ ID NO: 155218 - protein, 164 aa, Glycine max
  Coding DNA Sequence Number=SeqID_63533
MTNANCPQESLHSVSNGNLRVCVCVMKGCVFVIRGVCVCIFHEGVCVSMTRPSRKQGPQYPPMVRQGSYYSLLTLDDEGSLSIVLSQPSLRREGNARAHGCVFHGRKMRGVSTNAYSRKTSEKTERSGLRTLSVKGSGVVFTHGEGCFPCSYVFLNCDKEFRPT

SEQ ID NO: 155219 - protein, 227 aa, Glycine max
  Coding DNA Sequence Number=SeqID_63534
  Gene Ontology: Mol. function=2 iron, 2 sulfur cluster binding; Cellular component=peroxisome; Biological process=electron transport
  Homolog annotation: Hit_ID=Q9SW45; Match level="QueryCoverage=55%, HitCoverage=12%, E-value=3e-45, Identity=59%"; Hit description =Xanthine dehydrogenase
MNKLQNQLEKVESLTQDLEEGLEFLFRIFLQKAVASGGSNPARLGELGGNHLPYFAINRGGTEALPKRFRNVFREEFRKGFRPFFDVLHSFFIVLRSSTVVADTHENAKIAARRFHVEYEELLAILSIRDAVNARREVQMGGQEHFYLEPHSTLIWTVDGGNEVHMISSTQAPQKNQKYVSHALGLPMSKETRSAFIVVAASVQSYLLNRPVKITLDRDVDMMITGQ

SEQ ID NO: 155220 - protein, 103 aa, Glycine max
  Coding DNA Sequence Number=SeqID_63535
MMNKTRPCNAYFYLEAKSINIFVPLEIEESTPADECNYASKWKDGGSSLGGRRRQWNDTTVTTTLPTETKSLTGWKKALSSASHHKIDDDDDNSDKFLEGMFL

SEQ ID NO: 155221 - protein, 245 aa, Glycine max
  Coding DNA Sequence Number=SeqID_63536
MKLTSSSSTEEGVGLQCQRDEVNVKERSKVNKHARVQRKEQAERSTNTLGFKERSKLAESILPRGCNSSFIALVVKVEDPQSLGEFRPISLVGVLESYATIMYSRLIKLPFTYLGILVGANPRKMETWNPIVDKITKRLHSGKHKSLSFTGKGEEDSMDQVEEESLKWFDSMVKRKMELEVVERLFYVGGIFDIEIDALVKSSLTTIIVLPGTVTMHYLQPRGACSGKIASEANSAACIKALMKG

SEQ ID NO: 155222 - protein, 130 aa, Glycine max
  Coding DNA Sequence Number=SeqID_63537
  Subcellular localization annotation: CTP_CleavageSite=39; ConfidenceScore=5.31e-01
MAQGISMRGVPRSLLKSGPLATSSTVSCDQCCCMVLFVTAMKIANTTANGTNNQATPKWIEVKSHVQSGGYECGYCMMHWMWNIVSGGLKNDWSMWFLDGTTLDKETNVQHIFLKFKAINMEGYQVREYP

SEQ ID NO: 155223 - protein, 153 aa, Glycine max
  Coding DNA Sequence Number=SeqID_63538
  Gene Ontology: Mol. function=protein transporter activity; Cellular component=cytoplasmic vesicle; Biological process=intracellular protein transport
  Homolog annotation: Hit_ID=A9PF13; Match level="QueryCoverage=37%, HitCoverage=12%, E-value=8e-16, Identity=77%"; Hit description =Putative uncharacterized protein
MPFRWHRFGYWTVLCAVGKEQRANAKSLVRLGGDIIRFWPNFLQCPASSDLKVNKKDRHLGWGLLYHVCTLNYCVGGEILHLIVTSIFACHMLLCVAHFLESRGMIEDALEVPTDPDYRFDLPIQLGKLDAKSIAIELQSEQQLGELAMFTGN

SEQ ID NO: 155224 - protein, 87 aa, Glycine max
  Coding DNA Sequence Number=SeqID_63539
MKNNICLKKKYVSTTKDDIDKYPVLLNIKFVVICPQHCTNNFWVTNQVIHLHLAYSHGYPQDVVGPCGLNNLKRDRLRMQKKQQQSI

SEQ ID NO: 155225 - protein, 92 aa, Glycine max
  Coding DNA Sequence Number=SeqID_63540
MMYVATYPSAGGRRVTREMRVPRKEYARSRHQRLFEENVGKTGKDAIYELLSERLGSCIYARGRVFPFAPTYSSIVMRKSDLRSSFITKCLG

SEQ ID NO: 155226 - protein, 194 aa, Glycine max
  Coding DNA Sequence Number=SeqID_63541
MGEKLATQLAQASKLLNWQEDPSSASQEQHEPEVVDLIRWDSPGMGSLAWQSNGLVVFDRLTTNIGKYIDKNKTPTALDLPNLSKESWKVYKGLVEQGRNLIIDDGETQDSSYVLQRDGHKAEREHKSVCCSGPKVEEAKYQRVMLEEGNNVDYIISTRAKVMQSYPARALGRRLQVDWARYPREGPRVLMSLR

SEQ ID NO: 155227 - protein, 440 aa, Glycine max
  Coding DNA Sequence Number=SeqID_63542
  Gene Ontology: Mol. function=zinc ion binding
  Homolog annotation: Hit_ID=A7UQU7; Match level="QueryCoverage=53%, HitCoverage=47%, E-value=2e-25, Identity=31%"; Hit description=IMP dehydrogenase/GMP reductase, putative
  Pfam annotation: Domain name=DUF1723; Domain location=159-208; Score =51.4; E_value=3.1e-12; Accession=PF08330.1; Description=Protein of unknown function (DUF1723)
MVRTRGLGRALSRVIDKGSIREDGHHEDDVPQRRRPTASARRQRVDVAIVEDVPQVTEDVLERTAGVDAVDIEGITIDGVEGSPADHAEGFPGGPRDPLVLTSFADHMAHSIWSGQERLELKLVSHGRKVDKFGRPTLEIEGLVVATGLSPLIGCFVVTGDPGLIFAFVERWHRETSTFHLPVGEFTITLDGVAALLHLPIIGALHSFEPLLVDEAVFLLMELLEVFNEEARAETVLAHRAYSATHVHVVHLEGFRDLGQTGVYAWGAAALVHMYDQLNEACQTHTRQMAGYLTLLQCWIYEHFPSVHQCVTDDAYAETTPCASRGFDLISYFQGQLRWGPIVVFVQPERVEINDRWMHFSDHVAPTGEICVVPGQAGDQPRHPLAPHDEEYVEPHIPEVLVASDLPRHSVKGWSVCSTSRWSLKAQSYTRSCKIASGSL

SEQ ID NO: 155228 - protein, 50 aa, Glycine max
  Coding DNA Sequence Number=SeqID_63543
MGPILSEPQKPLMGEKKLMVEKTKKKLEQAAQSGSTEVVIDPPSSIRRDM

SEQ ID NO: 155229 - protein, 99 aa, Glycine max
  Coding DNA Sequence Number=SeqID_63544
MEELINKTQLSPKSNFNVITSARWLHNRISLSAPYCCHSAPTNIVRDHHSICRGHPTVHHNSSLGDLPGPQGSSLSGDTPPSTKYTLPQFILFPVSYEA

SEQ ID NO: 155230 - protein, 78 aa, Glycine max
  Coding DNA Sequence Number=SeqID_63545
MLIDVGNALACGCCVCSWGAKCTDLPWSLALALGHCTDLPWSLALALGHIHTSYVVYVHGGWSALTLSDGPDVGDKRG

SEQ ID NO: 155231 - protein, 41 aa, Glycine max
  Coding DNA Sequence Number=SeqID_63546
MARRMMGKKMNSNSEIVKKAKKKNERMETEVTTIPLNKFDA

SEQ ID NO: 155232 - protein, 204 aa, Glycine max
  Coding DNA Sequence Number=SeqID_63547
MFDEKGERMVVLRKNCSHTYPGSIDFYHKWDGEVWFCTDCGGGHCCTAVSQILDLLSGKGAFGQFEDKAVVGKNLKDFVQVFQVIRKGFTIDQDIVEEDYNEVPQIRPKIGVHSFLKGRKGVAKPKRHYQKFIMAVENRGGEGACTRTNDAILKHRIDLGFNFLLLEMGVNGMVGGAGWRKLCWWSEKGWELVDDGEDSGMSSW

SEQ ID NO: 155233 - protein, 177 aa, Glycine max
  Coding DNA Sequence Number=SeqID_63548
  Homolog annotation: Hit_ID=P83326; Match level="QueryCoverage=63%, HitCoverage=60%, E-value=5e-08, Identity=29%"; Hit description =Pectinesterase inhibitor precursor
  Pfam annotation: Domain name=PMEI; Domain location=26-169; Score =35.6; E_value=1.8e-07; Accession=PF04043.6; Description=Plant invertasepectin methylesterase inhibitor
MVHSFIKHPLLPSLLLLLCSVFSLCSARTVKIRDICSKHPKPDICGKILLSLPGAAEAVDLRSASLYVINVAHGNATEGKFQTTRIARGAGDPETRQRYNACSKDYTDVLLSLARAKKSYSSGNYSDLKSNGAIVIKDVQDCDTKATDSTYVLLINQDVVDTSRIIVILADYLAGKY

SEQ ID NO: 155234 - protein, 263 aa, Glycine max
  Coding DNA Sequence Number=SeqID_63549
EIRGVQRVGLIKFKLENQPEIHLQLERVLGWAGAEFLVRLEREPLTLTVAPNLVGEEEGVDGSMWKLVASGDAGQRGIWRCRHWRGGTVEMPVARVFQLREGRSEGKPWALPILIYIRDEGRDIRFQFTRRSLSQVRAGQQSYSSASLVTTSISFVLEYKCEVKSHIEVERSPYMVARGLQVYPSNLMWKRLTLEGEMLEYKCEVKSHIGSPYVVAHGLRVYPSNLPNTLPPCSLDPQQSLSFSKKGSGQTRLNPIKLNQHMS

SEQ ID NO: 155235 - protein, 166 aa, Glycine max
  Coding DNA Sequence Number=SeqID_63550
MAFLVLSRAPPMVALLGFLRVREKGIEISKWMVVIEPRPCKPPPPPQRRSDPENGPWTGIKKKYPEDPFWKEKRMAEILRWNHPSLNIPKTDNARAHNHLLKRIDEKIDKIYTQVGISDENLQYLSERVKKQYHQLSKEISHLENEWKKTIFSAVSNAKEREKKEA

SEQ ID NO: 155236 - protein, 171 aa, Glycine max
  Coding DNA Sequence Number=SeqID_63551
MLSRGGYECLEKKLMVEKTKKKLEQAAQSGSTEVVIDPPSPIRRHMKWKMARTKKTGQMTSEAAKEIAEKIVSQGSFVPHGRQDVVTTAIGRPEYPGHVRDAEAGVTIKQYYGPTPRTSRTSSSMAPEELEQLTQQIRDQLEESITKKNDSTADVILQPDAITGTCTASEA

SEQ ID NO: 155237 - protein, 124 aa, Glycine max
  Coding DNA Sequence Number=SeqID_63552
MSTRRENTTLKMTGILNTNDHHDRRTQSPNAEEEDDAHDGNAARRIEPGVQRYFLHQLLGAPTKMLGAPSSTPLVDERLSIKGTGLPFGLSHNLLGMHQRNPILLITVESKVRIFGQILDIFYS

SEQ ID NO: 155238 - protein, 81 aa, Glycine max
  Coding DNA Sequence Number=SeqID_63553
VDEREGEGHTRGRGRGKEAAAEEEERKKQCIRKEREMERRVARLRRGGGGGGSVKWKGWGGRKEKVEARRRRKLRKQEGEG

SEQ ID NO: 155239 - protein, 213 aa, Glycine max
  Coding DNA Sequence Number=SeqID_63554
  Gene Ontology: Mol. function=phosphoprotein phosphatase activity; Biological process=intracellular signaling cascade
  Homolog annotation: Hit_ID=A5C0F5; Match level="QueryCoverage=46%, HitCoverage=15%, E-value=2e-18, Identity=43%"; Hit description =Putative uncharacterized protein
LAPKRTPPVIENKPLGHRWLRRGNQHIGNDDLIVFRRKLDIMKRHEFLWEPYIAMVMSALPPICLVGSVAWCVVVPLICFQVVEWHQPDRVLRQFGMQQPIPGCPSQPQNIHGGLLSFNSDYMIEYRQKTKMFVDPKDANTATLRITKPVSHGPPPEHEFAPQEFHILSSSVETQGIGRRREAIEVEPYFYPQMENHGHGMYYTPPTFSQYPT

SEQ ID NO: 155240 - protein, 120 aa, Glycine max
  Coding DNA Sequence Number=SeqID_63555
  Homolog annotation: Hit_ID=Q2R139; Match level="QueryCoverage=81%, HitCoverage=9%, E-value=2e-07, Identity=35%"; Hit description =Transposon protein, putative, unclassified
MCQKLVITRKELQLPMEEKRKFLVEGSHDKEIELDETQLTNETTQDYGMKTEIPFFNVLKLPQRSSPPAIVVQEPAIVQDQVYHDDDDPRIYEEAMRSLDCKKWQEAMESEMESMKINKV

SEQ ID NO: 155241 - protein, 145 aa, Glycine max
  Coding DNA Sequence Number=SeqID_63556
VEEEPQLLVVFVVTAAAVLEEEHMACLDQQHFEKEGQAVVVVEDLSISKLDDSSNLDCIYCLKGHNYSAVVGFVAEEIAAKKDRDLYGDLQKNIDHRLLQQMKMNLVISPRAPPLAASVILLSMEEFLQEHPLKVIPAENGPGSK

SEQ ID NO: 155242 - protein, 93 aa, Glycine max
  Coding DNA Sequence Number=SeqID_63557
  Homolog annotation: Hit_ID=P93169; Match level="QueryCoverage=31%, HitCoverage=15%, E-value=2e-07, Identity=86%"; Hit description=Early light-induced protein
MSSLPLSLNDVCCFPCSHSIGTKALFALLCTRNHKESCTLTISSFRYPETRLRPFDLRYIREQPSEPATLVTPPPSIEPKPQPVSTPSPKRIH

SEQ ID NO: 155243 - protein, 54 aa, Glycine max
  Coding DNA Sequence Number=SeqID_63558
GFLRFHWRRGEWGRRKNVALGAMVAPGRRWRKGNGKRRDEEEKKTTSEWKEERT

SEQ ID NO: 155244 - protein, 81 aa, Glycine max
  Coding DNA Sequence Number=SeqID_63559
MASPLSLPFSIPLPFIFQEAKESIDEKDPRPTSSNGAYISFTLWECSGITSSGLSKMAPTPLLFSFDEPCTYNFHHNIFLL

SEQ ID NO: 155245 - protein, 141 aa, Glycine max
  Coding DNA Sequence Number=SeqID_63560
  Subcellular localization annotation: CTP_CleavageSite=55; ConfidenceScore=5.20e-01
MKGRTHKYGFNNNKREKAEKIMGSPPASTPPPPPPSPPSPPPPTSDASTSPSAVKRTRKASRLRSLSTRPPGAERPVVHVDPATGKADGPHRKKLRTYLGIVARDKVDVTYENWKEVPTAQKDLIWEDIQVFFFAYLILFN

SEQ ID NO: 155246 - protein, 191 aa, Glycine max
  Coding DNA Sequence Number=SeqID_63561
MGIKVAREMNLYHVIFEMDSMDWKPSLSHVYRKANHSANFLANLRHNGSFVMTRVLSPPPLLRLILVDDAQGVVLPAGNIGFVKTDVNEAILANPPSSLPLSLTPHAKSRKATLKSSSRSGRVCCDAHHRVLPFHWHQSTLCSSLYSQSQGFKYPETRLRPFDLCYIKALGVVLAISFIHKRNVAEDPLKS

SEQ ID NO: 155247 - protein, 77 aa, Glycine max
  Coding DNA Sequence Number=SeqID_63562
MLISGGAYLWAVGILIPLYFPFYVIIIHIAIPNCSYLLLLNCYSLIVVPNNLTMEKSTPKELESKVPPKDIPKEDKH

SEQ ID NO: 155248 - protein, 107 aa, Glycine max
  Coding DNA Sequence Number=SeqID_63563
DCHHQKGEIVEAMPSKIILMMPKNQEASKFQESRFKNNQDQDSRSRFKAYIYLGCDTENKRGYMSCGSVQVERTSTWFFKENKGRLLEISRIGGCLGTGCRHGLWSN

SEQ ID NO: 155249 - protein, 66 aa, Glycine max
  Coding DNA Sequence Number=SeqID_63564
MLNDERLMLKRKEVPQWIRRSPQTRSPQCGCSHGSTGDFDTRRKKKNDRVQALSHGFWSIFDKLFQ

SEQ ID NO: 155250 - protein, 123 aa, Glycine max
  Coding DNA Sequence Number=SeqID_63565
  Homolog annotation: Hit_ID=A5AWV0; Match level="QueryCoverage=54%, HitCoverage=4%, E-value=3e-07, Identity=41%"; Hit description =Putative uncharacterized protein
MACDSLEEQASQGSFVARGRQDVLVAAIERPEHHGRVRVAGENVVIWFCSLHDRPDNFLKGIINSALKGFDDTPQSKSKVVARWIVVKCNRQKGRIECGYYVMHWMSTIILGSFKNNWKMVIV

SEQ ID NO: 155251 - protein, 154 aa, Glycine max
  Coding DNA Sequence Number=SeqID_63566
  Gene Ontology: Mol. function=aspartic-type endopeptidase activity; Biological process=proteolysis
  Homolog annotation: Hit_ID=A5B3J2; Match level="QueryCoverage=95%, HitCoverage=31%, E-value=3e-10, Identity=31%"; Hit description =Putative uncharacterized protein
MRLRTASGDVVPINLEIEASCRRNNAARRRREQDTEGSSYTSSPLSPNHTQMDGEPTQRVTLEDFSNTATPQFFTSIARPEVQATNISYLHSLIQLIQGNLLNGLPSEDPYVHLASYIEICNTVKIAGVPEDVIRLNLFSFFPSRRGKTMVALF

SEQ ID NO: 155252 - protein, 190 aa, Glycine max
  Coding DNA Sequence Number=SeqID_63567
  Gene Ontology: Mol. function=aspartic-type endopeptidase activity; Biological process=DNA integration
  Homolog annotation: Hit_ID=A5BGZ1; Match level="QueryCoverage=72%, HitCoverage=11%, E-value=9e-20, Identity=44%"; Hit description =Putative uncharacterized protein
MSFGLCNALAIFQRCMLAIFSDMVEKSIETNLDRGRQGIYTIYYASKVLSHKISARGIEVMQPRKGDLAIVFAAEVQVILDRVEEFDIIIKEKKGSENVVADHLSQLKNEKVTKEEPEVKGEFPDEFLLQVTARPWFAGDASQRRKHEAFFGTATVHPMAVTTVGTERQQKCYNQKAPPSGELLGRPKWA

SEQ ID NO: 155253 - protein, 65 aa, Glycine max
  Coding DNA Sequence Number=SeqID_63568
MEFYQDSYGFLRERKRLRCEEYFSQLRHDIEIPNGENARNWVANLIFKFHDDPTMTESEIVIFLR

SEQ ID NO: 155254 - protein, 237 aa, Glycine max
  Coding DNA Sequence Number=SeqID_63569
  Homolog annotation: Hit_ID=A5BTR2; Match level="QueryCoverage=67%, HitCoverage=11%, E-value=4e-26, Identity=40%"; Hit description =Putative uncharacterized protein
  Pfam annotation: Domain name=zf-CCHC; Domain location=212-229; Score =23.3; E_value=0.00046; Accession=PF00098.14; Description=Zinc knuckle
MQTSKGKSIALKASQKAKLNKLSMVLSSVSKLEVEDSDDKFSYKEDKLILLTRRVQRMLRKRKGSNKFFSKRGYQQGESSKEKVRAWKNQNKAALSWQWLKVIEIRHEKVLDLFKAIDDQFITSDKALVSTLILKFSSLRLISVKGVCEYIMQMQDISAHLKKLEEEERLVMDMGESALLTTACGKNKATKSQANQKGNGKIRPQVDIKKVAKCFFCKKKGHMKKNCPRFQKWLEKK

SEQ ID NO: 155255 - protein, 95 aa, Glycine max
  Coding DNA Sequence Number=SeqID_63570
MTKSKGKDPLEGLGGPMTRARARKAKEALQQVLSILFEYKPKFQGEKSKVGFSSSCNKGPIGNLGISLLGDQMVADLLAVGGDFWLPTISVTLSH

SEQ ID NO: 155256 - protein, 93 aa, Glycine max
  Coding DNA Sequence Number=SeqID_63571
  Homolog annotation: Hit_ID=Q9T0L1; Match level="QueryCoverage=50%, HitCoverage=15%, E-value=5e-17, Identity=80%"; Hit description =Putative uncharacterized protein AT4g13400
MNIVFGMKSNLTLDAWDKPMLEGQEKFGVYDHMYFLGFSVFCRYPSYCRPNIWPRNALPELEVAFKALGKLIFDIGLMLAYHCDQYGKTTIDI

SEQ ID NO: 155257 - protein, 78 aa, Glycine max
  Coding DNA Sequence Number=SeqID_63572
  Pfam annotation: Domain name=zf-CCHC; Domain location=44-61; Score =8.7; E_value=0.073; Accession=PF00098.14; Description=Zinc knuckle
MRQEYEGDQWGPDPRRKRIAKGRPVSTRIPTEMDEDENERASRKKCGLCRQHGHNRNNCPNEEGKSGCQNPTSVKSMN

SEQ ID NO: 155258 - protein, 212 aa, Glycine max
  Coding DNA Sequence Number=SeqID_63573
  Homolog annotation: Hit_ID=A5AW27; Match level="QueryCoverage=42%, HitCoverage=6%, E-value=8e-18, Identity=47%"; Hit description =Putative uncharacterized protein
MWLQDQVQKQNSELWLKVFEKLDSDLIAIEYIPSKLQLADMFTKGLPTEQLQDLTCKLEMIDIHSPVHLETLVKPTNTSSSSLAFSGTSQAYALSVLQSTAQGTWVVDTGATDCMTHSSTEFISYRPCPNNKKIATADGTFIIVVGKGDILLCQDLILRDVLHDQGTGKMIGLVREKNGLYLLEEARGTCSNKSQLPLSLLSESPPSHNKDI

SEQ ID NO: 155259 - protein, 96 aa, Glycine max
  Coding DNA Sequence Number=SeqID_63574
MELIVQMKGRLKLNVTTTSSGGMRTISNSDVLVTIPEALKDRKLELLPAMVREQELDVLLKGSIKARRRSNDDGGRWLMTKDSVKWRLVVYAVTGH

SEQ ID NO: 155260 - protein, 281 aa, Glycine max
  Coding DNA Sequence Number=SeqID_63575
  Homolog annotation: Hit_ID=A5C9T7; Match level="QueryCoverage=14%, HitCoverage=3%, E-value=1e-10, Identity=66%"; Hit description =Putative uncharacterized protein
  Pfam annotation: Domain name=DUF659; Domain location=199-281; Score= -4.9; E_value=6e-07; Accession=PF04937.6; Description=Protein of unknown function (DUF 659)
MENDCWQKAIETELLALEENQTWDVVPCPPSIKPLGSKPVLSNGGYGGAMTVWRGGFLIKGHQIAVALRVSNDGTMAAAIGLTVAAVMTEEIPLLLSTMAEPSSILRIQAPLFVITRAKEHLVGKSDNVASCKKTPPDVVKELKGYMANKKSGTTYSSTGSDEFEDSCNATALAAKTKCETKKGPMDSHWSIWATFSIPSYHDIRVPLLKKKVEYTENLMKSHREQWVKYAGIMFLKSVDGSDFVKIGEKLFELLDAIVEEVGEENVVQVVTDNGSNYVLA

SEQ ID NO: 155261 - protein, 299 aa, Glycine max
  Coding DNA Sequence Number=SeqID_63576
MAQRKNIYKIPSGAWREKDEYNVRMTMMQCGLTDQWLSYPPGIHIRRTTTIKFMPDRIAPRLPPLDPTKKKGETIALKSSVEFDQNNAMLFYFKDMQGDNEFYQCLIQDTPPIHSRFVFDFHKYFKATMRKAIVIAWARKQDKVNYQLMEMQKEVDVVEPALTEVTSQPPQIVEDTLATISISNTPREITPLTTFAPTGLSEERIRVPSTGQPRRDHEKKNTLESSLKSFNDFVLFNMNLMVEQRLPPFIQTPPSPPTTIVQPHPEVPTLAITVDLVLVPPHLPPKSPPPIPQPLSTKG

SEQ ID NO: 155262 - protein, 94 aa, Glycine max
  Coding DNA Sequence Number=SeqID_63577
MANQDRSIDNGHGQFVRVVVNQEDHGQSILTQGFNVTFGHGCGEFTMVVSAKPGITLGFDQENKKIQGKGGKRVILWIFLDPSSPRLAFGSPGP

SEQ ID NO: 155263 - protein, 89 aa, Glycine max
  Coding DNA Sequence Number=SeqID_63578
  Subcellular localization annotation: CTP_CleavageSite=79; ConfidenceScore=5.51e-01
MACLVKLSLSLFDLQVGIRAGSPATIVAAAVRRQPPPSAASRRRPSQPPSNSPASSGFCAPRGARHNPANRVARFAATRRSTAAPLPGA

SEQ ID NO: 155264 - protein, 445 aa, Glycine max
  Coding DNA Sequence Number=SeqID_63579
  Homolog annotation: Hit_ID=A7P9X2; Match level="QueryCoverage=43%, HitCoverage=52%, E-value=3e-34, Identity=45%"; Hit description =Chromosome chr14 scaffold_9, whole genome shotgun sequence
  Subcellular localization annotation: CTP_CleavageSite=50; ConfidenceScore=5.05e-01
MGVNENGTEVQPTLDNQYSQSKPSFSSTNQPSFSKPHHQENQTSYSGLVDSREDKSQEETPAIISELFEGFLTIGTLGAETVTNEPGTPTFAMPSENITSRSEEVTGNELKLISYELEKFLETEKEESLYDSSGRNSYVSIITLSEKEIDGPKAEDYRNKAVCPLQGYLLGSSFELPETKEVRKERASLAELLYKTKSTSQDCIDTGIQGETQVKRTPKSAAMHIMRKILKRVHSSSKSCNTSRNDADSASTNKKLQKATNSVSSASAFPSSISQKLDDLNFSLWRQKIEPVIKSYKLQRFVTNPQIPLQLLTEVGRDAGIENPAYEAWEQQDQSMREFLLRILAISNSLASVGNPISLQEHIDATLEGLLQDYYSVISIIESKFQPLPIEEVEALLLAHEARLRNFRKHIFDLPLTIGKNPSLTSARDTAKIEYISGGNPHPIN

SEQ ID NO: 155265 - protein, 110 aa, Glycine max
  Coding DNA Sequence Number=SeqID_63580
MLARIPQVVVACCIPLGSIHMFWRRLSFSDQGLSEPEVGIKDVMETIYQKFEELDVCCKFTLRSKLWEIAHTNQNSMCPPPAKVNTKGHRRKLRVGTQGQQSAIHLTGSM

SEQ ID NO: 155266 - protein, 115 aa, Glycine max
  Coding DNA Sequence Number=SeqID_63581
  Homolog annotation: Hit_ID=A5BP71; Match level="QueryCoverage=40%, HitCoverage=12%, E-value=8e-10, Identity=59%"; Hit description =Putative uncharacterized protein
  Pfam annotation: Domain name=zf-CCHC; Domain location=88-105; Score =18.3; E_value=0.0026; Accession=PF00098.14; Description=Zinc knuckle
MTIIVNAEACGYVSMNYYQYIDVVYTNEHILKAYSTHWWPLGNEAAIPPSDEAWTLIPDPTTIRAKGRPKSTRRRNEMDWLEPSDHRQKCSRCGAEGHNRRRCPIQSDRGSNSFN

SEQ ID NO: 155267 - protein, 197 aa, Glycine max
  Coding DNA Sequence Number=SeqID_63582
VFRKCASSGILPDEPLLPESSRKRFSGSLPEEVFFRKTFGYFRKNTSSRNFPEKVLPELPEEPLTGLPEDSVVSLLRHFFRRPLVFSPLVFYPKVTILRFHCYANNAAYYKQRVGRETNLFAEKKKKTLPWARLAEKKEVHEEDKKNQVHGRGREDEAVRTNSVFRETENKEIEEAYNSQRSHFKCLCMEDLKIEKW

SEQ ID NO: 155268 - protein, 37 aa, Glycine max
  Coding DNA Sequence Number=SeqID_63583
MWLWGGALVLLSGWRGCGFEWTMILVFYCGDYGVCRR

SEQ ID NO: 155269 - protein, 184 aa, Glycine max
  Coding DNA Sequence Number=SeqID_63584
MLESFKQQEQMSVLELYIEKDVAGGSMFHFANSLTSCGNCLSNDETQAPTNMSNLHVDEDDDDYLVSNSYVEESLDEDDSVDGISDTDDEVTDIIQPIRIVHPTKGVQGIQNPFWNDALHYNNINWSHPDEDDICGLEMPSSFNVGQELYVGMDFDSKDVVKNAVKQYVMKVHQSFKVVESKWE

SEQ ID NO: 155270 - protein, 201 aa, Glycine max
  Coding DNA Sequence Number=SeqID_63585
MEEDGDDVLQMSGSWLPMWLLAPNELLGLSDLDALSEVVVLSAILQLFNALPCLLTGETSHGSNVVQYSVSKCPIQNMINDAFEFDRHHANEVPIISNADVNLEKDVMSNVTQEGHKAREYYYLTRDGEQPLYEGQLRNGARSTYEVDKKVHREFVPWFNNRIRNNLDSLSALDKDVLLSLAQGPFDKVRRSYSSNNDAEM

SEQ ID NO: 155271 - protein, 370 aa, Glycine max
  Coding DNA Sequence Number=SeqID_63586
MAMVGAKHSFAYVVFMQNPNLVVSLEKVQLREPARAPQFIKDFINGGDKEAGQKWTCARSNKPLLKHGFNLGLNFMFLEMRITIGLNIDRRKIGDEEEYGESEFGLKVLHKVDIALEFNQASIMGEFHGEADILNQNGNGFIKAVTGEVLTITHHNAQRGACVAFQGPNDPRASENLFGSLLGLDGLVGWVKAPKQECLPEGAMELDLGKNDPVDDADYQPAFPPGVLLALPPDQREVEVEDQLCDWPNIQTLRGLVGMLAMTFMVCEKLVDLEDPTERIGSIKPWNIQFNTMRDGDRGQRGYRCGGRGRRAWKIPRLYFVNKLIKLKGHIVQSGKACIVVLLLEAFDYIDYAMVIKWVKLKNLEHIGIG

SEQ ID NO: 155272 - protein, 70 aa, Glycine max
  Coding DNA Sequence Number=SeqID_63587
MVSQGGQYGVGGFETVGKEETVIMTEEKGATMVTILDGGSKEGNLGIFETKEMQCLVLMNGIEVSIYKTL

SEQ ID NO: 155273 - protein, 143 aa, Glycine max
  Coding DNA Sequence Number=SeqID_63588
MIANQTSPKWSSTDATNVHTDGEPTIHIEHFFYIHKLEKVGLKLHETLLFCGARCYSNEPQLIYPELIRMFWTTRPLFPRLKSGRKLDQDKKLKRILPSESTQAKQSHEVTFIQQEVIIYSTSSSNPKDVPPINYVALVALTE

SEQ ID NO: 155274 - protein, 113 aa, Glycine max
  Coding DNA Sequence Number=SeqID_63589
MEGFIATQGDVVVTHAGVMVMWWLSMAKRRNKNKGDLLGGKLRIRSNHGVRKNFGTVTDFLILLGGFDIVNSFGKCTKVVTSKSGMSNNNGFFKCDRWWVSSLEKVVVKEDGG

SEQ ID NO: 155275 - protein, 54 aa, Glycine max
  Coding DNA Sequence Number=SeqID_63590
MANTSMGAGGENSVEHYTKIGKNELSRELRKNMERQKDMGEGGEGFGWKNLLEK

SEQ ID NO: 155276 - protein, 415 aa, Glycine max
  Coding DNA Sequence Number=SeqID_63591
  Homolog annotation: Hit_ID=A2Q1N1; Match level="QueryCoverage=41%, HitCoverage=52%, E-value=9e-13, Identity=31%"; Hit description=IMP dehydrogenase/GMP reductase, putative
  Pfam annotation: Domain name=DUF1723; Domain location=142-191; Score =69.5; E_value=1.1e-17; Accession=PF08330.1; Description=Protein of unknown function (DUF1723)
MVRTKGLPRALGSGIGRGMGRDEHDVNVSRCRRPTASARRQRVQVDVAEEVPQVTEDVPPQVTKDIPDVTEDVPHGSPADHDEGFPGGPRDTSVLTLFADHVHIVSGVASRKVDKLGSPVPEIEGLVAGTRLSPLIGCSVVTGDPRLISAFAERWHRDTNTFHLPVGELTITLDDVACLLHLPITGALPRYPTKRLELRSYVLMGLTCDCHGSVRPGLVWGLCLGSCRAGSHCVTDDAYVETTPRASRWLTTKVHMKGIKGVSYRAHLDALTITNISWLPYSEHQAFGYIQTIPSPLVTASLSYEEIDERWMHFGDHLAPVGEICVVSGQEGDEPRQLAALDVDAYVEPHVLEVPVAADLPRHSVVACEGCEAIAERLKRVLNLRMVTAGTELHDIMEDFLRITKGEASNGSLRA

SEQ ID NO: 155277 - protein, 44 aa, Glycine max
  Coding DNA Sequence Number=SeqID_63592
MAKTQATGLQMRTRLKMKGRKKSLFPARATHKGCESPLIQSGCS

SEQ ID NO: 155278 - protein, 111 aa, Glycine max
  Coding DNA Sequence Number=SeqID_63593
  Subcellular localization annotation: CTP_CleavageSite=52; ConfidenceScore=5.12e-01
MAVVSHLYLPLNPHTKKNTLIGVEFSESSSKIRWRKSLNPPFHSFSKVVFAACTEPRSHWRDRNFKKMFFSVEPEIPLSPLCFDSETCVGPTSANERETSKYAKKTGKGSR

SEQ ID NO: 155279 - protein, 209 aa, Glycine max
  Coding DNA Sequence Number=SeqID_63594
  Subcellular localization annotation: CTP_CleavageSite=52; ConfidenceScore=5.05e-01
MASNWTSINLFRELLGAPSNIAGAPSNLLKGQFCPSFKNTKNFIPLSEAFCLLSSAKKLFSSLLSSAKKHSVFFSSSPRGFSGFIFSARLVFHLHSRVKDAGKNGGSLVTVSLPEDPLGVLSELPEEDLPEDFRKKGSSVGNETTSGRTDLPKNSRNTSSGMFPEDVLVPETFRKRVLPDDLSEVPEALSGRAFFRNCSGRSTSSGSSF

SEQ ID NO: 155280 - protein, 231 aa, Glycine max
  Coding DNA Sequence Number=SeqID_63595
  Homolog annotation: Hit_ID=A5C0G0; Match level="QueryCoverage=41%, HitCoverage=14%, E-value=4e-17, Identity=44%"; Hit description =Putative uncharacterized protein
MEIPNVNGLNIQDDDGDLEFNIALAPKDVIDWSLLEITEVKYGIFLFRFFFHLVVQRILKGRPWSFDKHLLILGVIKEGANPTTIPLFLVPFWIQMHNLPLGFMSQEVGQSIDEFCDHFFAMPMDDGTRHWSSELYTMITEESAVKYLHGGRHGPSVAVTKTKTIATINAIMRMGNRQQMEMSLISWNYRGLNNPNIVPVLNDLVQAYHLEILFFCETLVHSNRIEDIKVK

SEQ ID NO: 155281 - protein, 106 aa, Glycine max
  Coding DNA Sequence Number=SeqID_63596
  Homolog annotation: Hit_ID=A5C0G0; Match level="QueryCoverage=78%, HitCoverage=12%, E-value=1e-07, Identity=37%"; Hit description =Putative uncharacterized protein
MVIPIAIEEETRGILRSIATGLSNLPWCIFDDFSDLLSQEDKIGIHDHPNWLIRGFRAVVFNSNLHDFPIEGKIEEAWEMRDDQSTTIFETLHKEMGSLIAQEEIY

SEQ ID NO: 155282 - protein, 276 aa, Glycine max
  Coding DNA Sequence Number=SeqID_63597
MGSATPPTPGRGFVLNAEGAPWKLLRKDLTTLLQTWSVLSYSNLAPTCHTSDLNMDRARGVVPYSLTFESLSPAINLAYIRKNCWNPDYPKITFSGTRKARARGPSDASAPSSSSATPAPAPIPAPFGTSMQSSDQIVLMLQSLHHGLCLVMQSIHDLAQHRPIMSMKAFMAQVTWTGVRPSPLGEGKAPTAQEPQPKPEATPEATPEETPEVTPATTPSEAPEDGDGVANTDYVANMVAAKSSWDPWPTPALDTSLPAQDAHSTPQDDSTPVQKD

SEQ ID NO: 155283 - protein, 60 aa, Glycine max
  Coding DNA Sequence Number=SeqID_63598
MRKKDGGMRFRNLHAFNLAMLGKSSIGAQSKFCLRSIHASQVMLNEGRTWRIGNGRDILI

SEQ ID NO: 155284 - protein, 681 aa, Glycine max
  Coding DNA Sequence Number=SeqID_63599
  Gene Ontology: Mol. function=transcription factor activity; Cellular component=nucleus; Biological process=regulation of transcription, DNA-dependent
  Homolog annotation: Hit_ID=A7P9Y5; Match level="QueryCoverage=55%, HitCoverage=100%, E-value=0.0, Identity=84%"; Hit description =Chromosome chr14 scaffold_9, whole genome shotgun sequence
  Pfam annotation: Domain name=GRAS; Domain location=293-589; Score =407.6; E_value=1.9e-119; Accession=PF03514.5; Description=GRAS family transcription factor
  Subcellular localization annotation: CTP_CleavageSite=72; ConfidenceScore=5.56e-01
MMNSLCGSSLSLKSENNNSRTKLQQPTSSNDSVLQSKKNNATQSSGDLDQTSLTPPSLNLPSLKFDLDGDVEVQSPDSSMWESFFADHIDGDFMISSPVRTPQAASSYNCNYNYAQGMQGQSLSGCSPPRFSSSQIGAFNSSSSLNKGKGLSPLHRVFNSPNNQYMQHVENLSLPAIEEFLEDYQTKVSSSDHNITSSSECFDLSSHQIPSSILDGLALHNSSRYHRGSVVDEESTVHGGGGGGGGSSQLSQESDIYHQMGSMASASLSQALQQERYQEKQQKQQAQQLQQQQRQHQQENLMVPIPIEIEQEQDSGLQLVHLLLACAEAVAKEEYMLARRYLHHLNRVVTPLGDSMQRVAVCFTDSLSARLNSTLTPKPATPSKPLTPSNSLEVLKIYQIVYQACPYVKFAHFTANQAIFEAVEIEERVHVIDLDILQGYQWPAFMQALAARPAGAPFLRITGVGPLLDAVRETGRCLTELAHSLRIPFEFHAVGEQLEDLKPHMLNRRVGEALAVNAVNHLHRVPGNHLGNLLTMLRDQAPSIVTLVEQEASHNGPYFLGRFLEALHYYSAIFDSLDATFPAESAQRAKVEQYIFAPEIRNIVACEGAERFERHERLEKWRKIMEGKGFKGVALSPNAVTQSKILLGLYSCEGYRLTEDKGCLLLGWQDRAIIAASAWRC

SEQ ID NO: 155285 - protein, 172 aa, Glycine max
  Coding DNA Sequence Number=SeqID_63600
  Gene Ontology: Mol. function=phosphoprotein phosphatase activity; Biological process=intracellular signaling cascade
  Homolog annotation: Hit_ID=A5AJ35; Match level="QueryCoverage=72%, HitCoverage=38%, E-value=4e-17, Identity=36%"; Hit description =Putative uncharacterized protein
  Pfam annotation: Domain name=DUF1723; Domain location=28-77; Score =67.2; E_value=5.4e-17; Accession=PF08330.1; Description=Protein of unknown function (DUF1723)
MAPCCAYKTTIFQIKCGKTKKESSVRVNISQHLVSALVERWRTEIHTFHFPHGETTTTLQNVALQLSLKIDGLPVTGFITDDIRVVCQTLLGETPPDKYQLPDDADDVVITQDARAHIMMIIGCCLMLDTLGARVHFSISILFSSSRSGREVGLNKNWWMFVVATVMGVGPH

SEQ ID NO: 155286 - protein, 129 aa, Glycine max
  Coding DNA Sequence Number=SeqID_63601
MKIETGHSSSAPSPSRLSTLNEKLEMVLATLPKLTNEEHKQCCEMAKIMLKVAVPPDTILNTVNAKDQIYGGVSTSFAVRWKDILGRLWNFIDKDGNFHTIVYNHDLDKPTIVAGWTVLRDFYHLTGDH

SEQ ID NO: 155287 - protein, 48 aa, Glycine max
  Coding DNA Sequence Number=SeqID_63602
  Gene Ontology: Mol. function=protein serine/threonine kinase activity; Biological process=protein amino acid phosphorylation
  Homolog annotation: Hit_ID=Q5MJV5; Match level="QueryCoverage=95%, HitCoverage=16%, E-value=1e-09, Identity=60%"; Hit description =Avr9/Cf-9 rapidly elicited protein 256
MTEDEEKVILIEWTYDCYTQGTLHVLVEDDKETLNDMKSLEKLVMIAL

SEQ ID NO: 155288 - protein, 159 aa, Glycine max
  Coding DNA Sequence Number=SeqID_63603
  Homolog annotation: Hit_ID=A7P9Y8; Match level="QueryCoverage=33%, HitCoverage=10%, E-value=6e-14, Identity=73%"; Hit description =Chromosome chr14 scaffold_9, whole genome shotgun sequence
MDHAIFLAWPWLKAKVKDFNTSFNHWAALWCLVTSISGTTGTGQFGGSALVDELQGHNAILKDCIEQLTAIESSRTSLVSLLREALEDQEFKLGQVRSQIQAAVKELKMFLQADHQGLLNNLENLYAVLPMENLIPRILRVPPPNALDSCSYMIDTSAK

SEQ ID NO: 155289 - protein, 147 aa, Glycine max
  Coding DNA Sequence Number=SeqID_63604
  Homolog annotation: Hit_ID=Q6WAY6; Match level="QueryCoverage=78%, HitCoverage=19%, E-value=1e-08, Identity=33%"; Hit description =Putative uncharacterized protein
MARVAKVVRILAQELDRVKQNRNGVVGIPRQHLEERAGALVDKGEWTSFIDVLALLVFGIVLFPNVDGLVDLAVIDVFLAYHHSKESSVIAVLADAYDTLDLRCEKSNAGIVCCTPTLYVDLSVPYKVIACVPRKKKQIGRNSWQIW

SEQ ID NO: 155290 - protein, 196 aa, Glycine max
  Coding DNA Sequence Number=SeqID_63605
  Homolog annotation: Hit_ID=Q9LSE0; Match level="QueryCoverage=95%, HitCoverage=39%, E-value=9e-69, Identity=62%"; Hit description =Genomic DNA, chromosome 3, P1 clone: MOJ10
MNFASLWIMTGASRIRDLPPEQFCCHGFVLGKTAEAGFGNEMYKVLTAAALSIMLNRGKYPFGDYICYSNFTFTMNEVKHLWRQNDCESKYGRQLVMRTDDFEKPAQTNVLCSNWKEWKQPIICSVFLENIHSQMRIAAFDLFGDPQVLGSQPNVFGELLRVLISPSKEVEAAVNWVIGDEENPDISLHMQILMNR

SEQ ID NO: 155291 - protein, 77 aa, Glycine max
  Coding DNA Sequence Number=SeqID_63606
  Gene Ontology: Mol. function=protein serine/threonine kinase activity; Biological process=protein amino acid phosphorylation
  Homolog annotation: Hit_ID=A7PJH7; Match level="QueryCoverage=76%, HitCoverage=7%, E-value=4e-17, Identity=72%"; Hit description =Chromosome chr12 scaffold_18, whole genome shotgun sequence
MQETRLKELFDCIPTLDELHALGGEGFKADIILMDSEKDKKLSMLKKLIMALVRGLNSNPATSWEIVTITGNVIGQF

SEQ ID NO: 155292 - protein, 133 aa, Glycine max
  Coding DNA Sequence Number=SeqID_63607
MVIVVIYQLCDSGTIMPKKKGRGQPKGSQAKNCQESALGNLNSCINPSNMVEVDPGCEEPEDEDFHLYCLSVRIVHVVYGELMVNNYKLLRTTCSRKVFIMLEIRNPIRGSIAPVTMAARVPRTNSGISSLLR

SEQ ID NO: 155293 - protein, 86 aa, Glycine max
  Coding DNA Sequence Number=SeqID_63608
MIFANKEKGVSTKQRLISKNKCIGEKRKKKDKKKYVPEIETEILVCVRLRNGRGTSFEVEGQNVREVGREWMRNNTMAQRMGEGRE

SEQ ID NO: 155294 - protein, 51 aa, Glycine max
  Coding DNA Sequence Number=SeqID_63609
MAVTESEWKDTQVAVTIAVETKSFALNFNGSGSKKKEEKGEKAKVCVRGAK

SEQ ID NO: 155295 - protein, 329 aa, Glycine max
  Coding DNA Sequence Number=SeqID_63610
  Gene Ontology: Mol. function=protein binding; Cellular component =endoplasmic reticulum; Biological process=regulation of epidermal cell differentiation
  Homolog annotation: Hit_ID=A7QFG1; Match level="QueryCoverage=54%, HitCoverage=37%, E-value=6e-45, Identity=41%"; Hit description =Chromosome chr8 scaffold_88, whole genome shotgun sequence
  Pfam annotation: Domain name=Kelch_1; Domain location=132-177; Score =17.9; E_value=0.022; Accession=PF01344.16; Description=Kelch motif
  Pfam annotation: Domain name=Kelch_1; Domain location=179-212; Score =10.3; E_value=0.18; Accession=PF01344.16; Description=Kelch motif
  Pfam annotation: Domain name=Kelch_1; Domain location=214-255; Score =10.9; E_value=0.15; Accession=PF01344.16; Description=Kelch motif
  Pfam annotation: Domain name=Kelch_1; Domain location=85-130; Score =44.4; E_value=3.9e-10; Accession=PF01344.16; Description=Kelch motif
  Pfam module annotation: Pfam domain module=Kelch_1::Kelch_1::Kelch _1::Kelch_1; Domain location=132-177::179-212::214-255::85-130
MVLLLSPGGGGKFGGVADENEGGADGGGDEVGDGDDGVKGMDLEFELGEGVGEGAVEEGGGGGATMDLYFTSQNVITSLKPMSLVRSYALVVWLNGEIYVFGGGNGYVWYDTVESYNPVHDSWTLCRSLNQKKGRLSGAALNDKLFVVGGGNGVDSFSDVEMLELDIGRHVSLKILALHRYALGGFDGDKIVPSIEVFDPRLGAWTIGEPMNHRRGYSAVVVVKESIYMIGGVKVCENIVDTEEYRRTERMAAMEPWRYELIKMNHFRGLSLGIVKLFSKQCHLSQFSAPLGTRDDLVTNFSKFLPSRRGMLAGKELLEPRTLVIVKFK

SEQ ID NO: 155296 - protein, 114 aa, Glycine max
  Coding DNA Sequence Number=SeqID_63611
  Subcellular localization annotation: CTP_CleavageSite=52; ConfidenceScore=5.01e-01
MEEHKLNTPPATSLNTSNHLLFYLQHTNFTSATWSLCTWLRPEQLQVLQPMPAALQTQVQVLKSLVKPALPCTFGRANRSCDMQSFVASRSGDMPRGSSLSKAPSALAPCMADT

SEQ ID NO: 155297 - protein, 223 aa, Glycine max
  Coding DNA Sequence Number=SeqID_63612
MRRKTKMFVDPNNANTAALGEVVETLQYMVSPQGRNTWTVDDLVPYVDKLAIISEEQERVTEPVSHGSASEREFPAQEFHILQSSVETRGLGRRREPIEVEQYSQQMMERGHGMYYTPATFSEYPSQMYQYPFEGHHTDTSASEHSFGGVAETQAHFSWPTMTPSQQHDAPMATPNAPFAPQWNVPGAIPDMGDLLGVDLRQEFSVELSKQKRGDNAAEEILI

SEQ ID NO: 155298 - protein, 251 aa, Glycine max
  Coding DNA Sequence Number=SeqID_63613
MGDIIKTKAKVVEDLTHVRHDHNKLNDKEMWQISHFSLLGNFMQSASLRHATRGCVASANGDSTGIATCNGALAMQGGVAGQTSALPLACSSSFLQKVKAPLVLARSPENARSFGDLGMNSVITMLYFNGRVYEDNDGIIFEGSKKAIQIKRGISFNALKKKIGDKDVAGGSMFHSANSLTSCGNYLSNDETQPATNMSNLHIDEDDDDYLVSNSYVEESVDEDDSVDGISETNDEVTDIPQPVRIVHPAK

SEQ ID NO: 155299 - protein, 76 aa, Glycine max
  Coding DNA Sequence Number=SeqID_63614
MAAEWRSKRERRRHFKEKMSLEEAHHHRRPWIRAWRKKEMNEGRGKEEHEILCSKRALKSEPTNSRSSPTFSAKCA

SEQ ID NO: 155300 - protein, 99 aa, Glycine max
  Coding DNA Sequence Number=SeqID_63615
MPLLENITKMPKAIEALELGAENVEQQVQFVVVDPNPDPARALRRLFRGGGSRCHEMTTKSIGKCGVRRRRAAEAERGGGGGDPGEGASEDGRRFGNVE

SEQ ID NO: 155301 - protein, 119 aa, Glycine max
  Coding DNA Sequence Number=SeqID_63616
MKVRVAEAEPFGGVDSGVEGKEEGVVELRVLDLGDECDRRGKAERRLGKNAWGLLLSGRWAAAMVSGAIKGAGCCGMSVGRGGGVGMGDGVGTGGGVGMDVCVRSAFAEEEDGGASEWC

SEQ ID NO: 155302 - protein, 142 aa, Glycine max
  Coding DNA Sequence Number=SeqID_63617
MCMGYRIGRLRVPTDSWVTARMGIFTLGQGLWHSSLWVFGKIFTAFTLQVVRMRAHTAYPCQTTKQTEKIAMVSHNKSNDKITESRNARYQTLISSRDHCLMACNFRLTTSRNLTPIVKQSVKFCDMSGVERKHYCAIRKVP

SEQ ID NO: 155303 - protein, 244 aa, Glycine max
  Coding DNA Sequence Number=SeqID_63618
MAPKKLSTKRSRRDAAAEGSSAAPEFDSHCFRSTEHQQRFEAIKGWHWTSLVTPMAKFDPEVVLEFYANAWPTKEGVRDMSSWVRGQWIPFDADALSQFLGDPLVLEEGQQCEFSQTRNRADGFDEEVIAQLLCTPGQDFAQTTAGMRVIADAIYLFAGMPPTRHLLDPDKSNRALGFSALITGLCQSFRGDAPQGTAAPPPPHQAGPAGSLGMKRYLQHLVRQQAANHRGLVQIHECLYHSAA

SEQ ID NO: 155304 - protein, 85 aa, Glycine max
  Coding DNA Sequence Number=SeqID_63619
MAATYARGISKRELKELTQPRPRAILYNSPSQQNNHEFKDKIASRIFAMQNGKQKTNNWKLGAAILAVSMSNGGVLTQASDRGRT

SEQ ID NO: 155305 - protein, 44 aa, Glycine max
  Coding DNA Sequence Number=SeqID_63620
MEAANGGGTEETNEEEPGRRTRRVKKRNQEDKGTGNNAVNLIGG

SEQ ID NO: 155306 - protein, 96 aa, Glycine max
  Coding DNA Sequence Number=SeqID_63621
MSKANLSRLRSDPVRIAAFCFKNLKRTEVLDTDISSAVESSCFSAIGVFFMQKNGDGGRWFGKLVGKGAVLAGNGVDPLGKKNIAVMVKYDETSMA

SEQ ID NO: 155307 - protein, 296 aa, Glycine max
  Coding DNA Sequence Number=SeqID_63622
MGCKWIFKKKSRLSTEEVIHYKARLVAKGYIRKEEVIYIEIFSLKHSEQREVWSVHDDEGDERWEIIVGRYGRLKEMFIVEKRIIEGVDMTLCAFLVLKFLEALRKNWDRIHIGDRKIFVNLPKYKIDCVSKQNGNTKGRGKQVSQNARMQVTETRHKHVQDQNRKVFVRQRDRSGTRGVWRVKGGQKHIDREDELKGMLYVMDVWEEIQLKYMGGVGANLGMWMKLPSPGRGMVEETTLVVNHCGCRWGEDISEEDESSNGNEIGLDIGLQRSEFSTGDSNEGWKLGEDGGLGKG

SEQ ID NO: 155308 - protein, 54 aa, Glycine max
  Coding DNA Sequence Number=SeqID_63623
MSLVESPTVATYHLAGGRCKTHGCVFQERKMCGVTTNVYLRKTSEKSERCSVRT

SEQ ID NO: 155309 - protein, 269 aa, Glycine max
  Coding DNA Sequence Number=SeqID_63624
MALGLSLVFYEFACHACSLSLILHVTTYAHQVFDEMPQWLDYVLLQPGFFAKGLDLGLFDPFKDVKDGELLDEEDIATGEEDAGEEEDDGANEIGNKIIFDHLWFNLNLVKGLANQLGIPRAGLGFDEPWKFFEAHQGQTLGSLKAELGFDEPLEILRGSPRVDLRFDEPWRFVEAHQERTLGLMRPWRFVRAHQGWTFGLTSLGDSSRITEGSPRADHGFDKFLEIRQGSPRADDGFDKPWRFVKAHQGQTLGLTSLGDSSTLTKGKP

SEQ ID NO: 155310 - protein, 105 aa, Glycine max
  Coding DNA Sequence Number=SeqID_63625
MGLNQAQTFKKRFYHVKVKRQFFSKVYEMIWDLEMIDMLVEAIASLTRYCDQSLRCFTFGDFQLAPTIEEFEGILGCPIRGRKPYLFFGYYLSMARVAGVVRISE

SEQ ID NO: 155311 - protein, 87 aa, Glycine max
  Coding DNA Sequence Number=SeqID_63626
MASKRKQAAAGLAGKKTGLRRREDAEARGRGKRSSNKKRRECEETEMGVVHIGSVRREKGRNWNGSSPHWINKEEGRKKDKENCNFI

SEQ ID NO: 155312 - protein, 533 aa, Glycine max
  Coding DNA Sequence Number=SeqID_63627
  Gene Ontology: Mol. function=phosphotransferase activity, alcohol group as acceptor; Cellular component=cytoplasm; Biological process =nucleoside metabolic process
  Homolog annotation: Hit_ID=Q9FKS0; Match level="QueryCoverage=100%, HitCoverage=99%, E-value=1e-122, Identity=68%"; Hit description =Uridine kinase-like protein
  Pfam annotation: Domain name=CoaE; Domain location=56-232; Score= -99.3; E_value=0.095; Accession=PF01121.11; Description=Dephospho-CoA kinase
  Pfam annotation: Domain name=PRK; Domain location=57-244; Score =199.5; E_value=8e-57; Accession=PF00485.9; Description =Phosphoribulokinase  Uridine kinase family
  Pfam module annotation: Pfam domain module=CoaE::PRK; Domain location= 56-232::57-244
  Subcellular localization annotation: CTP_CleavageSite=61; ConfidenceScore=5.03e-01
MPEETTSIDYVMEAASGPHFSGLRLDGRMPSSATAAAASSSADSTLTPDFLPNQPFVIGVSGGTASGKTTVCDMIIQQLHDHRVVLVNQDSFYRGLNPEELERVHEYNFDHPDAFDTEQLLECTMKLISGQGVHVPIYDFKKHQRSSDSFRQVNASDVIILEGILVFHDQRVRDLMNMKIFVDTDADVRLARRIRRDTMERGRDINSVLEQYAKFVKPAFDDFVLPSKKYADVIIPRGGDNHVAIDLIVQHIRTKLGQHDLCKIYPNAYVIQSTFQELETENNPMLLMADGGCGVVCVLYLLHGVVVVCRCALPSRGRAGAGSSLLGAGSSPLVVAGCGVVRAGCAAVFCAVCSPAVLLHFNFRGMHTLIRDRDISKHDFVFYSDRLIRLVVEHGLGHLPFTEKQVVTPTDLCFVNCNMSGKEVTDRQWVTNGGSVYTGVDFCKKLCGVSIVRSGESMENALRACCKGIKIGKILIHRDGDNGKQAPEGIHCVCKRFPSLKIVTSEIDIEINEEYRVIPGLGEFGDRYFGTDD

SEQ ID NO: 155313 - protein, 125 aa, Glycine max
  Coding DNA Sequence Number=SeqID_63628
MAPKKLLCKKARKEAVGEGSSAAPQVDMEFDGHQFQSEEHQRHFEAIKGWSFLKERQVQLKEGEYVYFQERKGSGISAPGCGTNGSPLMKMPLISFWGIRWSWKRDNVVSSVREGARPRDLMRRP

SEQ ID NO: 155314 - protein, 40 aa, Glycine max
  Coding DNA Sequence Number=SeqID_63629
MENNKTCQSIVGSKEMKENAKNESKNAQWRLGAAAKGWLP

SEQ ID NO: 155315 - protein, 116 aa, Glycine max
  Coding DNA Sequence Number=SeqID_63630
  Homolog annotation: Hit_ID=Q6WAY3; Match level="QueryCoverage=31%, HitCoverage=1%, E-value=2e-08, Identity=69%"; Hit description =Gag/pol polyprotein
MAAFIKQYQYNTDMAPDRTQLQNMCKKEHESFKEYAQRIEVGLRRGKLDYAAFASTRNRRFEAGGAKEKEGDTHAVTSTPTWPKSQQTPHNPTNQYSPLIEAVPKSNKHENAITRK

SEQ ID NO: 155316 - protein, 130 aa, Glycine max
  Coding DNA Sequence Number=SeqID_63631
MGQQPGTQASKGRKGRVKSGKFNVRAQVEGLSKVEEKFDRAAELEEEHAKVSSLQVEREARQRVIESLHGEAVKWMDRFTLTLNGSQELPKLLAKAKVMAGVYSASEEVHGLFEYCQHMIELMSHIIRNR

SEQ ID NO: 155317 - protein, 86 aa, Glycine max
  Coding DNA Sequence Number=SeqID_63632
MKVYDDVVIYANAMHEYDAGMIHLLQCYKEMHDAIKEYARGLSATMQHQKRKTLDEASLLSSESETHHDHRSTSTPYGSHRPGCRA

SEQ ID NO: 155318 - protein, 109 aa, Glycine max
  Coding DNA Sequence Number=SeqID_63633
MSLDAAYGGNLILKPLIDAIKIIKDMCSNPYHNLRDMSIIKRGVNQVEIDESHTKLEKKLGNIHSQPKPNPKKKDINVVMTRSKRIKENSEENEGSSPKDADDILTKEN

SEQ ID NO: 155319 - protein, 61 aa, Glycine max
  Coding DNA Sequence Number=SeqID_63634
MDCHHKKGGDCGSNVFQDYFDDAKESRVKQVSRIKIKIQDSRIIKIMIQDSSKESRLKIQE

SEQ ID NO: 155320 - protein, 133 aa, Glycine max
  Coding DNA Sequence Number=SeqID_63635
MDRDRLVYGLVTHMDMNIGALTPSQISSIAQSNSSRLGFPTLITALCRARGVICDSLTYESLSLAINLAYIKKNYWNMDDLTVNFRGARKARARLADVPSSSTPPAPPTYATPTPAPPGPSAQDSQCFESMLL

SEQ ID NO: 155321 - protein, 35 aa, Glycine max
  Coding DNA Sequence Number=SeqID_63636
MTELVKFHKDVESVLENLTDDSQIGSCWIKWPQNN

SEQ ID NO: 155322 - protein, 308 aa, Glycine max
  Coding DNA Sequence Number=SeqID_63637
MTCAILVVVAREFSGCFASEVEEWRSICGHVGSPTRLITVKPHLEFSSFGDALPLVVPIVTVLLPNRMISLEPACESWGSKWIRFNVNLLASIWKDLGSDNDRIGTELKGVQGDLRMPDRRKEAIPLFWEWSSGYTEEVLGGEGKNHGKPMRVAIDAFLAYHHNKESPVVAVLVDMYDAFDLRCEKSSHCMCLGKDKVYWEEFLASVMGLSISWFSRWKEGVVGVLCSGAPLEETIMPFIARGFSEANTEILQKIRQAWNKVEREDKELRGRSNSVIGETEESEESEEVRVLKAELEKTKVAKEKLKV

SEQ ID NO: 155323 - protein, 183 aa, Glycine max
  Coding DNA Sequence Number=SeqID_63638
  Gene Ontology: Mol. function=oxidoreductase activity; Cellular component=membrane; Biological process=fatty acid metabolic process
  Homolog annotation: Hit_ID=Q01C53; Match level="QueryCoverage=90%, HitCoverage=13%, E-value=2e-41, Identity=43%"; Hit description =Putative tetrafunct
  Pfam annotation: Domain name=3HCDH_N; Domain location=101-181; Score=- 80.6; E_value=0.0025; Accession=PF02737.9; Description=3-hydroxyacyl -CoA dehydrogenase, NAD binding domain
  Pfam annotation: Domain name=ECH; Domain location=1-100; Score=-36.4; E_value=0.00027; Accession=PF00378.11; Description=Enoyl-CoA hydrataseisomerase family
  Pfam module annotation: Pfam domain module=3HCDH_N::ECH; Domain location=101-181::1-100
MYDGVREIGQLNSTQITARKPSDVAIDGLALDGGLEVAMACNARLSTPTTQLGLPKLQLGIIPGFGGTQRLPRLVGLTKGLEMILVPGVTDCGLVPRQVKKLAIIGGGLMGSGIATALILSNYTVILNEVNEKFLDVGMNRIKGNLQNCVKKGKLTKENFEKTISLIKASLLVSFEADKEQLG

SEQ ID NO: 155324 - protein, 120 aa, Glycine max
  Coding DNA Sequence Number=SeqID_63639
MTYNLNRLGKHSYIVVNRVHPTTVRGESHRGCHHEKESTVKGIHVVGASEKGKLENMIQEDQNANTFVTVTTHQTYQARTDATDTTWIMEAQLPPGWKSLNIDQYDGLLDPNKHVDASVT

SEQ ID NO: 155325 - protein, 121 aa, Glycine max
  Coding DNA Sequence Number=SeqID_63640
MMITKDDDKGDDKKLKDQSKNNSSESRTIQEFKIESRRIQDSRRKLRVKNQDSRFKIPRIKIKIQESREGLIKIRYILCGTSRRYIYLGLTENKRGYISCGSVLVEGTSTMVSKRTRDLFL

SEQ ID NO: 155326 - protein, 64 aa, Glycine max
  Coding DNA Sequence Number=SeqID_63641
MGEEEKKPEQNKVEEKKANEEEKKEEEKKPEESKDDKESKEESTPPEIVQGTTFAMHGHFKHDF

SEQ ID NO: 155327 - protein, 67 aa, Glycine max
  Coding DNA Sequence Number=SeqID_63642
MGESLHKVGTGKYAIVDPRACNLQLHFHPGQLEFCPFLSPMSYIILNVKVTTLNAMAAEPPDGKGVG

SEQ ID NO: 155328 - protein, 101 aa, Glycine max
  Coding DNA Sequence Number=SeqID_63643
  Homolog annotation: Hit_ID=A5AV98; Match level="QueryCoverage=87%, HitCoverage=11%, E-value=9e-22, Identity=57%"; Hit description =Putative uncharacterized protein
MCFMSQNTSHVSPISIFNGLNFSGWNEQVQFYLGVLDLDVVILEEKLVTITDASSNKEKSCYKAWEKSNRLSLMFMRMTFADNIKTTLPKTDNVKESRSLT

SEQ ID NO: 155329 - protein, 210 aa, Glycine max
  Coding DNA Sequence Number=SeqID_63644
MARIADKIKTIDGSKETLKLVVRITELWFIGTSGSCYLDIFIIHRVIKSMWSTSLVWLTRLSFVIFHPEDDYCVQFLEYLDHHESEGPIIVLLSNARIKEGQGSYPCSVSNSLKASKLTIHEPVAPIEEFNQKLSKLGIEIRSVLTHRSQWSSQPLGSAQLSSREAFISKSEAKSISEINNICEEFVCVTVGTITRIVMDNHSWCYASCI

SEQ ID NO: 155330 - protein, 100 aa, Glycine max
  Coding DNA Sequence Number=SeqID_63645
MEIGEKLLFWRSTTTTAQTTETRWKRKVLLDQFSQFTLVATYPSVGGGRQAHGCAFQERKMRGVATNVYLRKTSEKLGKDVVYELLSERFGSCIYARGRY

SEQ ID NO: 155331 - protein, 91 aa, Glycine max
  Coding DNA Sequence Number=SeqID_63646
MVNVLKLRLNPLDTTRVRSLVEIILDQTLLISRSNSELAKEEKVKVIDDLLSEADWLSEMHPLSEASCSLSRWETLKEVKSEIYMPSQPAQ

SEQ ID NO: 155332 - protein, 954 aa, Glycine max
  Coding DNA Sequence Number=SeqID_63647
  Gene Ontology: Mol. function=nucleic acid binding; Cellular component= nucleus; Biological process=RNA interference, production of siRNA
  Homolog annotation: Hit_ID=A7PG79; Match level="QueryCoverage=96%, HitCoverage=100%, E-value=0.0, Identity=73%"; Hit description =Chromosome chr6 scaffold_15, whole genome shotgun sequence
  Pfam annotation: Domain name=DUF1785; Domain location=268-320; Score =98.5; E_value=2.1e-26; Accession=PF08699.1; Description=Domain of unknown function (DUF1785)
  Pfam annotation: Domain name=PAZ; Domain location=321-461; Score =129.1; E_value=1.3e-35; Accession=PF02170.13; Description=PAZ domain
  Pfam annotation: Domain name=Piwi; Domain location=607-915; Score =399.7; E_value=4.6e-117; Accession=PF02171.8; Description=Piwi domain
  Pfam module annotation: Pfam domain module=DUF1785::PAZ::Piwi; Domain location=268-320::321-461::607-915
MGNKGFQLQTHGRLKSFLVPNASLNFCHLHNSSFMDNAMDSFEPDGNGKESLPPPPPVVPSDIVPLKAEEVLCTPTEHNKKKASRLPIARSGLGSKGNKIQLLTNHFKVNVAKNDGHFFHYSVAFTYEDGRPVEGKGVGRKIIDRVQETYHSDLNGKDFAYDGEKSLFTVGSLPQNKLEFEVVLEDVTSNRNNGNCSPDGLGDNESDRKRMRRPYRSKSFKVEISFAAKIPMQAIASALRGQETENFQEAIRVLDIILRQHAAKQGCLLVRQSFFHNNPNNFADVGGGVLGCRGFHSSFRTTQSGLSLNIDVSTTMIISPGPVVDFLISNQNVRDPFQLDWAKAKRTLKNLRIKTSPSNQEFKISGLSELPCREQTFTLKGKGGGDGEDGNEEITVYDYFVKVRKIDLRYSADLPCINVGKPKRPTFFPIEEVCELVSLQRYTKALSTLQRASLVEKSRQKPQERMKILSDALRTSNYGAEPMLRNCGISISTGFTEVEGRVLPAPRLKFGNGEDLNPRNGRWNVSRVKFVEPSKIERWAVANFSARCDVRGLVRDLIRIGDMKGITIEQPFDVFDENPQFRRAPPMVRVEKMFEHIQSKLPGAPQFLLCLLPDRKNCDIYGPWKKKNLADFGIINQCMCPLRVNDQYLTNVMLKINAKLGGLNSLLGVEHSPSLPVVSKAPTLILGMDVSHGSPGQTDIPSIAAVVSSRHWPLISKYRACVRTQSAKMEMIDNLFKLVSEKEDEGIIRELLLDFYTTSGRRKPENIIIFRDGVSESQFNQVLNIELDRIIEACKFLDENWEPKFVVIVAQKNHHTRFFQPGSPDNVPPGKCSGSLQHLGSCEKGAPSPALNYCGTSRPTHYHVLLDQVGFSPDQLQELVHSLSYVYQRSTTAISVVAPICYAHLAATQLGQFMKFEDKSETSSSHGGLSGAGAVPVPQLPPLQENVRNTMFFC

SEQ ID NO: 155333 - protein, 195 aa, Glycine max
  Coding DNA Sequence Number=SeqID_63648
MKEQNLEGNEQSSKHWYCVKRHHDDSPANMLGRVSFAWNVWVVRKKVPLGVRCLRVPVLWVVMMWVLQMSRIGHWKKKLGMVIEAMSRFNYTNLHTIVRILQHTRSGRKYQCTVSGRHKFGNGNDTEEVHDSGMGGMDMVAVRKLYYDWANVFIGMKIIEGGVARGRDIPGLDGLSMVHDEMEAVAVIFGYQAID

SEQ ID NO: 155334 - protein, 125 aa, Glycine max
  Coding DNA Sequence Number=SeqID_63649
MQFLRGLNEQYASIRSHVLLMDPIPAISKIFSGQMSYRMSRHHASEHAVYVCLYEQIKQGTIKVAHKRLKSQNSQTNSSIPDLVQNSCSLHDYIAVYDSGLQLLDAGGDLSSSEKSAVKELKDNF

SEQ ID NO: 155335 - protein, 85 aa, Glycine max
  Coding DNA Sequence Number=SeqID_63650
  Subcellular localization annotation: CTP_CleavageSite=29; ConfidenceScore=5.35e-01
MSPPPLEPHNHSQTHLKLSGQLPLQAPFSAGGLVGACALSATLDRLARISEFRLSTRLLAQRMDSSDALIGMNPRSVNMHSSSFF

SEQ ID NO: 155336 - protein, 146 aa, Glycine max
  Coding DNA Sequence Number=SeqID_63651
  Homolog annotation: Hit_ID=A5C3T2; Match level="QueryCoverage=92%, HitCoverage=14%, E-value=2e-26, Identity=50%"; Hit description =Putative uncharacterized protein
MNINCAIRKDEPPVIIDESSHVVVALYERWERSNRLSVMFIKTKISAGIHGYVNQHEKLITSNKALASTLIMKFSSLQLTSVKGVCEYIMQMKKKGLKMGESTLLTTVCRKNKAIKSQANQKRNGKIPPQAYIKKGMQKPMETSGK

SEQ ID NO: 155337 - protein, 83 aa, Glycine max
  Coding DNA Sequence Number=SeqID_63652
MDKSLKVGEDEWMEKERTHGPEIYPKAHENPRAFCCISGPISLESSIQCPWRVRLHQVSLWDFDPAQTLTKTYRLLSGQSMTS

SEQ ID NO: 155338 - protein, 133 aa, Glycine max
  Coding DNA Sequence Number=SeqID_63653
  Gene Ontology: Mol. function=3-hydroxyacyl-CoA dehydrogenase activity; Cellular component=glyoxysome; Biological process=fatty acid metabolic process
  Homolog annotation: Hit_ID=A2WPN5; Match level="QueryCoverage=93%, HitCoverage=16%, E-value=5e-46, Identity=70%"; Hit description =Putative uncharacterized protein
MKKYSREILKFAQQAPNLQHPLVCIDVIEARIVVGPRVGLWKEVEAFEGLVRSDTCKSLVHIFFAQRVTSKTPRVTDRGLVPRQVKKVAIIGGGLLGSGVATALILSNYHVILKEVNEKFLDAGMNRIKDENR

SEQ ID NO: 155339 - protein, 41 aa, Glycine max
  Coding DNA Sequence Number=SeqID_63654
MYLVLELIPFLNSINGSGMEKEEREETPLQGEDESRRSSPP

SEQ ID NO: 155340 - protein, 232 aa, Glycine max
  Coding DNA Sequence Number=SeqID_63655
  Homolog annotation: Hit_ID=Q9M0T8; Match level="QueryCoverage=31%, HitCoverage=14%, E-value=6e-07, Identity=30%"; Hit description =Putative athila transposon protein
MEVIISLKDQVKELAVKIKEITNKVDCNAVTTRSGLATKELVRKDMEVDNRVKEDIHEEDVIIEEIAREPIKTKSELTREDKQAITREKLYPHKPTKQDKLLKDLITKNKSLKDYGVVTLGEDCSAILENPKKLGSDETNRHAIQLADRSIKFPFRIVENMPVQVGRFTIPVDFVIMDIKEDVVEITFDVREAMKHPKDKGACFKVDIIDEGKDEKLAIISNTLHKEDKQAL

SEQ ID NO: 155341 - protein, 142 aa, Glycine max
  Coding DNA Sequence Number=SeqID_63656
  Subcellular localization annotation: CTP_CleavageSite=40; ConfidenceScore=5.01e-01
MMHALDLNSQMQCGTYRIQYQGNSPKRVYTTPHLGNHTVFVDATQSCTVTPSPRDVQQGQCTPMDIHNTRRMNVGTIKYNDHGQIKAPKHPCSECLDSLTTLVPHEWAVRQSQCTSHERTQHAHANCISNINQHSMFTSFST

SEQ ID NO: 155342 - protein, 375 aa, Glycine max
  Coding DNA Sequence Number=SeqID_63657
  Homolog annotation: Hit_ID=A8C978; Match level="QueryCoverage=99%, HitCoverage=54%, E-value=1e-68, Identity=40%"; Hit description =Forisome
MLILEQLKHYSWDAKVLIVQAAFSLEYGKIMYLPLTTQCQQQIENLFADLNGLLMVPQNTQHLPYFNSVVKKAMQMIECIIEWKRLISLGHDIKDVPTLAETFHQIPVVVYWAIFTFVSCTGQIDEFTDYKVQRHELSKSFEPKLDSILGKFKEFLERCSKEIVRIEDYTRREKIVIHTGKNIVKVLKALIISRENRDLRQNVFNVLTGEQVKIEEFKKYVLLFISGLDKIEDEIRLLKSIHEKLKEKPREVEGYRSEDFKILWIPIVDEWNEERRKKLESHLQCNKFGWYVVKYFNFETGMKLIKEVFKYKEKPIIALINPQGKVENIDTKQIISVWGIDGFPFRTSDHYRLTQQWNWFWSEMTKLNQGIESLI

SEQ ID NO: 155343 - protein, 81 aa, Glycine max
  Coding DNA Sequence Number=SeqID_63658
MLCHLRILGLAPLTICLGFTRWSGAMQSIEDLKVMPKGIHHQLIQQALQLLHKGFMARCISGIQRQKKRIAKDCGKGDKGD

SEQ ID NO: 155344 - protein, 563 aa, Glycine max
  Coding DNA Sequence Number=SeqID_63659
MERVDKEILEQLSASLDARTILALPSASNPLATLDGIVCDLAWRSLMKQVGPGGGTVPPSTATSSVEEGGQPADEVGHIVVAAEPQDVPPAPPAIKAPTVNTATVAPSPPSIVAIQEVAPTAIEVVMPTTQAGSVVALSSTVVAPLLSVGVAATSAPTMLSPSSATPVTSPFTVLVAVGATYKSEQKTPIGFVSAFDKNLIRSSGENGLRHQEAMQKEASLEVKVAKWRVTACTLWRVEHPKVANATVAFVEVVRSNRQLSSKVSGVLTKLLRTQLDGDELFGYCKDLQAEKMNLSDKVESLAIERDGLAKVVVDLEARLKESESKLEASELQAAKTREATRELEEELFLYKKEAIKQAGFFDPFKDVKDGVLLNEEKIAAKEETANEGHLRFDFNLVKGLVTHLVGLPSVLWNFSPDGSSLLMVMRSWCELNQIEGLIMQLVAVHLVELGPWTMIVLVTASKQTKEVPLGFVEVCTKGGPWVLETYIPAQIKVRNKKDCQGPGTCLPWVLSSLRSFAEINQGSSSSMDSFASWKMNGSGMEKEEREETPLQGEDESRRSSPP

SEQ ID NO: 155345 - protein, 132 aa, Glycine max
  Coding DNA Sequence Number=SeqID_63660
  Subcellular localization annotation: CTP_CleavageSite=88; ConfidenceScore=5.44e-01
MSLVRATHGEWHVCKSMMPKTQVRQFPCSYSKGLAKPKCVSSTASGMCRNLPFSGARGCIFHGSKMRGVATNVYSRKTLEKLERCGLRTLIVKGSGVVFKHGEGCFPRFYISSITMKKSDLRSSCKSGKVMC

SEQ ID NO: 155346 - protein, 74 aa, Glycine max
  Coding DNA Sequence Number=SeqID_63661
MQRVGLAKRGGSLSAILKNAIPERFVCLASGCAKPNSKELKSREVFRLSAEHALCETTTANDQGLRHLAQAQIG

SEQ ID NO: 155347 - protein, 171 aa, Glycine max
  Coding DNA Sequence Number=SeqID_63662
MDVTFHEHELFFPLKTLHSSPQRGGDLKVHNHDRLEQDIMLFDVMPTTIDDGIQDNGDENMEDQIQNNVNENMVKDDKVSPETLTPFHSVADTQNYVSTYIQCNVSTTLNSDPIVSPYTFPPHTNIGQPPTKYEPVATYHSTGGRRQKAKGASSKKENVWESLPTFIRGKR

SEQ ID NO: 155348 - protein, 208 aa, Glycine max
  Coding DNA Sequence Number=SeqID_63663
MASHKRKAPASVSQARYDRSRFVSQDAWDRYADNVLGRKILPERNVKLYITKFDEFRREIERMNWHKELTNFSKGSIDVAIVKEFYANLYDPEDKSPKQVRVRGHLIKFDADAFNTFLKTPVVIEEGESLPAYSRRAAFEDFEEELDYSGPDLECSIYSNLALTSHTSDITLDRAKLIYGLVMMMDMNLGSLILGKISLIAQHDSSRL

SEQ ID NO: 155349 - protein, 100 aa, Glycine max
  Coding DNA Sequence Number=SeqID_63664
MQFRATFHNDRDIIKVPFFYHIQWAPEYPEYVRFKYNGVVYQIRVRLHKGKNFFTEGLKQFRKELAIYESTIIHFFAIDHISIFDLHFSPPLEQQTSGRP

SEQ ID NO: 155350 - protein, 74 aa, Glycine max
  Coding DNA Sequence Number=SeqID_63665
MVTYKGRRGKVVARHRKEGAWVCAVEEKVAIAGRPWAQWHQGSCLFLGGVSSLLLCQGVANALWVFQSHSFLLA

SEQ ID NO: 155351 - protein, 88 aa, Glycine max
  Coding DNA Sequence Number=SeqID_63666
MNSPFNKACPFQILDALAKYEIAKLVALALSILNWRPSICRSLSLSLPKTIVFCFYQHIQVVVLALVGVEFMCPCGYEGAFVPCCDGL

SEQ ID NO: 155352 - protein, 110 aa, Glycine max
  Coding DNA Sequence Number=SeqID_63667
  Pfam annotation: Domain name=zf-CCHC; Domain location=16-33; Score =23.4; E_value=0.00044; Accession=PF00098.14; Description=Zinc knuckle
MWKNSSLKVFKEKSFIICYECKKSGHFKSECPYLEKSKDKKNTWEDLDDTSSDEEEEEEANISLMANTTSKESELDQEYKSTQVCHVDETLKIKETKLCLENETISKNLG

SEQ ID NO: 155353 - protein, 195 aa, Glycine max
  Coding DNA Sequence Number=SeqID_63668
MDMNLGYIISAQTSLIAQHDSSRLGFPALITALCKARGVVSDSLTLESLGLAINVAYVKKNCWNLDDHARPREESLQGLGLPSIMSMEEFDAQVAWSGAQPSPSGGGGASAAQEPASEEPAAAEGEDELTPPEPFYFDADAHMAQEEGTSTDQIPEPSPAPVPEETQPSTPVTEPEQPIQDSSVAPTLNFNEDQP

SEQ ID NO: 155354 - protein, 125 aa, Glycine max
  Coding DNA Sequence Number=SeqID_63669
  Homolog annotation: Hit_ID=A5AZ88; Match level="QueryCoverage=67%, HitCoverage=8%, E-value=9e-11, Identity=32%"; Hit description =Putative uncharacterized protein
MPLYAKFLKDMLTKKNRYIHSDRIVVEDIEEDADIPLILGCPFMSTASCMVDMGKKILQMGIEDQKISFDLFQEDKDPPSQNVCFKVHVMEEKRPEKKEALSIACRTKPQMLMGFYNFKLGLARG

SEQ ID NO: 155355 - protein, 92 aa, Glycine max
  Coding DNA Sequence Number=SeqID_63670
MKTPDEVARYTICGGAHESGCCIPNEEKIAHEVNYMGNQPRGNINTSGFPGFQNNQQYQQQRQWQNHPGNQFNKDWGGSSTRPQQQMPSLYD

SEQ ID NO: 155356 - protein, 174 aa, Glycine max
  Coding DNA Sequence Number=SeqID_63671
MVGVLGRVFCLCPVFLAVIVCADIGYVGVRELNWRWATGDGGFMRDLWMWKTSCAPSPDRHLVPHVMVVPGDMSRGSGDLGDVRRAPGSQQIKGTKTTKQGGLCGGWPAEAVRASGNRLPMGCNRLPGLEMKVCAIDYTVPFSGFPVLKLCDSSLASSNRLPRLCNRLPEMKSL

SEQ ID NO: 155357 - protein, 102 aa, Glycine max
  Coding DNA Sequence Number=SeqID_63672
MQSIHDLAQQRPIMSMEAFMAQPEAEVEAEETPNDTPTTTPMEVTGKDGATETGVDTNYVADVIAAQGTWDAWPTPAAQDTPMPAKDAPTTPHDDPAPAQDD

SEQ ID NO: 155358 - protein, 190 aa, Glycine max
  Coding DNA Sequence Number=SeqID_63673
  Homolog annotation: Hit_ID=A7Q1Y0; Match level="QueryCoverage=34%, HitCoverage=5%, E-value=2e-07, Identity=44%"; Hit description =Chromosome chr13 scaffold_45, whole genome shotgun sequence
MEFRRFPHLWDKLSILELQNVNDVMDAIQANLKKKEQIEELVLEWDNDPQDSQIAKDPFPLLESLQFEDMPEWEEWLPFEGLPQLALFSPSFLPSGLEALVAEAAMLSSMYKHELGLLFQCLTPLTHLALCGLGEEDLLNTLLKELILPTSLWEKGFNISLLSDGLTSGTMEALNPCQKISCHPLLNYWR

SEQ ID NO: 155359 - protein, 297 aa, Glycine max
  Coding DNA Sequence Number=SeqID_63674
MASNSARAQKKAKSSKRKQGECSQAALNKLDMWFTDENKKTNFKMIYVMKNGFNFPNLLEAQGLSTLVQMKGTFYPELVKVFYTCAKADMEGNVYSTVNSVEMVIDTTVWKVVARIDMGGVCKFEEFVDGYNKMATYRGVLLDPTRILRNKLGIGDIMLKSRRLVDYEFSYAVLTSKFIDYFNIDVSNEIVDFTKASNEITKRHLTKLGMTYVDHEWIMAGEEPAAANIDQMEEEAQQEPTHQWNPFESLMIQKMDVSLHLHQAKVHSSLENITTRLENIETRLSLSNLLNPDEDEA

SEQ ID NO: 155360 - protein, 267 aa, Glycine max
  Coding DNA Sequence Number=SeqID_63675
  Subcellular localization annotation: CTP_CleavageSite=41; ConfidenceScore=5.63e-01
MAKSLKKQKGSSSTTTITGHRRHGTSGDPPAPNPPSFSSPRSLTLFSSDDQRQRYYSQFSNRVILDLKYSDVEFFDGETFDCYQVFPNSELVEFMSLKFLYYPELSLTKLSCQGVPFEGTLVDDWKHVYSSHDAHKMVCNDHADMTNRLLAIQVNAPLPYPHLVTLFLQHFNVPLEDEPFVKVKRSFAIGVGVVGAQDLRPPIPDERTSPPPPQWDNSSSLLTKVFTELQDLRAFVANRFNAMDSRITRLEDNMSFIRRCFDPPVDS

SEQ ID NO: 155361 - protein, 141 aa, Glycine max
  Coding DNA Sequence Number=SeqID_63676
  Subcellular localization annotation: CTP_CleavageSite=42; ConfidenceScore=5.23e-01
MFILTSIAINSSLTSKQAHVCISAVIAASTAVSYDYSSFSSGCSTGVGSESLWKKRNLQCEGHFSKLQHFFAISNGENAQKLVSDQVLRYHDDPTIKESEIIIFTKIDLSVCGKKRRCWEGKRENEIERRRRRRAYRQSQN

SEQ ID NO: 155362 - protein, 15 aa, Glycine max
  Coding DNA Sequence Number=SeqID_63677
MEDAPVSFASPSRRR

SEQ ID NO: 155363 - protein, 153 aa, Glycine max
  Coding DNA Sequence Number=SeqID_63678
MSQPTLRREGEAKLTGASSIGGKCTESSPMFIERKTLEKPKETGHEEYSRFGSYLYVDKSGALAPTYPPSKRKSDLRSSFKRGESSDSFLLGRWSFKALDLKMIHFTWCENLRRWTSNHLMRSTKAGLLLLRILHRRGNQTYVVLAKDSKVMC

SEQ ID NO: 155364 - protein, 175 aa, Glycine max
  Coding DNA Sequence Number=SeqID_63679
  Gene Ontology: Cellular component=microtubule organizing center; Biological process=microtubule cytoskeleton organization and biogenesis
  Homolog annotation: Hit_ID=A7PM75; Match level="QueryCoverage=60%, HitCoverage=13%, E-value=3e-29, Identity=67%"; Hit description =Chromosome chr14 scaffold_21, whole genome shotgun sequence
MASEGIGNELPKELIVIDDVLSAMVGIEGRYILIKTICGKSDDITFLVDPSMDLALQGVQSVQYPNLLLHIKELAKRIFPLCKSFLLINQFVESRSEFQSGLVNHAFSAALRALLLVGKTQSRQRRVVDSTKITMVGALHVAESHCTTAVALSLSDKVESGEKLHQQHLGFIGSF

SEQ ID NO: 155365 - protein, 225 aa, Glycine max
  Coding DNA Sequence Number=SeqID_63680
  Gene Ontology: Mol. function=aspartic-type endopeptidase activity; Cellular component=small subunit processome; Biological process=DNA integration
  Homolog annotation: Hit_ID=A5B323; Match level="QueryCoverage=85%, HitCoverage=16%, E-value=1e-32, Identity=38%"; Hit description =Putative uncharacterized protein
MTTSGPVFSFSGTPTIATAKLNWKNYLSWSASVELWFLGQGYHDHLEKNVNVVPNDKKPEWEKVDYQLCVVLWQSVESDVLEILRSFKTCHLFWKKAQEIFANDIQSLFDATVKVTALKQSNHVMIAHMGKARAAVEELRRFLVADSLEEVNRKLDKFYMVLAGDQVPSMDSLITRLLRVPHALKDENLTDAVETSAMVVPRGRGGGRNSRGGRNGRSGRPQCTY

SEQ ID NO: 155366 - protein, 275 aa, Glycine max
  Coding DNA Sequence Number=SeqID_63681
  Gene Ontology: Mol. function=phosphoinositide phospholipase C activity; Biological process=intracellular signaling cascade
  Homolog annotation: Hit_ID=A5C6C9; Match level="QueryCoverage=68%, HitCoverage=17%, E-value=4e-30, Identity=35%"; Hit description =Serine/threonine protein phosphatase
  Pfam annotation: Domain name=DUF1723; Domain location=1-50; Score =41.4; E_value=3.2e-09; Accession=PF08330.1; Description=Protein of unknown function (DUF1723)
TPRSGTVSSFVEQWYRETSSFHLPVGELTITLDDVSSILHMPVDDAVQMLVDLLMAGHWTAAARAYLLHLLGCTPFANKSATNVHVVYLEALRDLSQTGRYAWGVVALVHMYDQLNDASINSSRQLGGYITLLQCWIYEHFPSVAESTTDQDYDEDSSRACRWIVTKKTVKSIRTMVYRERLDRLRIPDVFWIPYGEHRPAILAPPVDSWVSYDDIHDRWMHYSDHIVPAGEVYVVPGQCASDYMDWFFRISHPFMTLGHASDPPHLPIQNDQSL

SEQ ID NO: 155367 - protein, 126 aa, Glycine max
  Coding DNA Sequence Number=SeqID_63682
MAKYDPKIVMEFYANAWPTEEGVKDKRSWVRGQWIPFDEDAINQFLGHALVLEEGQHCEFSERRSQASGFDEEAIGQLLCVLGQDFAQSVTGSRVRIMRTSMTTLTQIWMILLLRNILLDKWPQTS

SEQ ID NO: 155368 - protein, 777 aa, Glycine max
  Coding DNA Sequence Number=SeqID_63683
  Homolog annotation: Hit_ID=A7PG46; Match level="QueryCoverage=97%, HitCoverage=98%, E-value=0.0, Identity=52%"; Hit description =Chromosome chr6 scaffold_15, whole genome shotgun sequence
  Pfam annotation: Domain name=DUF630; Domain location=3-54; Score =85.0; E_value=2.4e-22; Accession=PF04783.3; Description=Protein of unknown function (DUF630)
  Pfam annotation: Domain name=DUF632; Domain location=299-667; Score =435.7; E_value=6.3e-128; Accession=PF04782.3; Description=Protein of unknown function (DUF632)
  Pfam module annotation: Pfam domain module=DUF630::DUF632; Domain location=3-54::299-667
MDDDDKALQLCRERKKFVKQALDGRCSFAASHVSYVQSLKSTGTALRKFLEPEAPIESSLDTSTNATPEQPLDKTLSQFSLSSSVSRRTDAAETFSPTPSPPSSSKFQAHHMKFSSSSSKKVEEKPPVPIIGTVTSSGTPHNVVPHPTDKSAFEVSPLPVETPPWDFFGLFHPIDHQFSFQEGKVMHQDMVANADDISRLREEEGIPELEDDEKVSSHEREDSTDSEDEFDDEPATDTLVQRFENFNRVNDHIKPNDLSATDKHPKGDSASEVELGNGEKGNSPVVSPLKTASTEVSLLTVIDKSKEKENHREKVVPKDFFSSMKDIEFLFVKASESGKEVPKMLEANKSHFRPLFPAKENRLVAPSFLKACFSCGEDPSKLPEEPAQNSVKYLTWHRTMSSRSYSSANPPGANSKADVDDVTNNLFDNFCMISGSHASTLDRLYAWERKLYDEVKASDLIRKEYDMKCKFLRNLESKGEKTSRIDKMRAVVKDLHSRIRIAILRIDSISKRIEELRDKELTPQLEELIDGLSRMWEVMFECHKLQFQTMSTVYNNSHAGIAATHSELRRQITSYLESELHYLSSSFTKWIGAQKFYLEAINGWLHKCVSLKQKPGKKKRPQRPLLRMYGPPIYATCEIWLEKLGELPVQDVVDSMKSLAGEIAQFLPRQEKNQGKGANHSHLTTWSANNIRSESSDNLLRDGTLEDWDSGFDQFRASFLGFLAQLNNFAGSSIMMYTDLRQAIQIAKKNYHHRSNSQAQDGQWNSLSQDDNSMSQS

SEQ ID NO: 155369 - protein, 151 aa, Glycine max
  Coding DNA Sequence Number=SeqID_63684
  Pfam annotation: Domain name=Transposase_23; Domain location=3-56; Score=-11.7; E_value=0.022; Accession=PF03017.5; Description =TNP1ENSPM transposase
MQLVALGKLYDTSSTIHNVPYADDVVRVSVVKVYHSDALVPFPTSEIKFVKEVVGTFVGWPTHLVKPISDEVSQNPLTRPVKSIEADKVVALVDPLGELVKNLFEIYQKPIQLLWDGAQFGIDNVKDGFFITHANFSEIILGDKCLNISII

SEQ ID NO: 155370 - protein, 133 aa, Glycine max
  Coding DNA Sequence Number=SeqID_63685
MAVMGLFQNPSFVKSYTFETLMWIAKLVLMGAISTLLLLKVILAKSPILLHYSQVDHHHHFSFLQLPSPTSDPKHTTTISLDTANHPTKSENQTNEPKEEQKKVAEDEEQLQQQQVRIATIGGSATPRTTKVD

SEQ ID NO: 155371 - protein, 212 aa, Glycine max
  Coding DNA Sequence Number=SeqID_63686
  Homolog annotation: Hit_ID=A5AGN5; Match level="QueryCoverage=25%, HitCoverage=9%, E-value=2e-07, Identity=56%"; Hit description =Putative uncharacterized protein
ILHFGQMEKTNLKGFCNTSKIVFASLILINSGGINSTFAVQQMFLLQILGIILTYFGIICLGGIWKLQNRGGHHLTVISSERLVDSASGRYCQLSVTWPRSPLVFLLNVDIGLRKGSPTFNEARAVDFIEENGIMADICESISGSHAMLLFISNRAELLKYPDAKVISLGIGDTTQPILVVITDAMSKLSHFQMAIGNLYMFTDMAAQGEQS

SEQ ID NO: 155372 - protein, 39 aa, Glycine max
  Coding DNA Sequence Number=SeqID_63687
HGSAGDFDTRRKKKNDRVQAQGERRRMIGFKRKEKEEER

SEQ ID NO: 155373 - protein, 25 aa, Glycine max
  Coding DNA Sequence Number=SeqID_63688
TCKRNLQDSGTLKRVAWGLGRKAPK

SEQ ID NO: 155374 - protein, 39 aa, Glycine max
  Coding DNA Sequence Number=SeqID_63689
MEEMAPKKLSTKRSRRDTAVEGSSAAPEFDSHHFRSAEH

SEQ ID NO: 155375 - protein, 97 aa, Glycine max
  Coding DNA Sequence Number=SeqID_63690
  Homolog annotation: Hit_ID=A5C693; Match level="QueryCoverage=47%, HitCoverage=28%, E-value=2e-08, Identity=50%"; Hit description =Putative uncharacterized protein
MTGDASKFTHISPKKSGHVTYGDNNKGRILGVGKIGLKHNLLSVSQYPEATGPMTCGNHLVPHFLLLSSRGGGPDDMRGTIWSCTFLPFVIQRQRVR

SEQ ID NO: 155376 - protein, 80 aa, Glycine max
  Coding DNA Sequence Number=SeqID_63691
KSKRRTEEKKKIGSRPSPVRALSAHHALSGQGSIGAKQGVKHKDAGSVTRAKRGSQAKRAIQQKHTLSTRSERAKHGVSR

SEQ ID NO: 155377 - protein, 32 aa, Glycine max
  Coding DNA Sequence Number=SeqID_63692
MTKARQKGVRKGKRGRWLPPSSPRRPQLAQAS

SEQ ID NO: 155378 - protein, 183 aa, Glycine max
  Coding DNA Sequence Number=SeqID_63693
MKREKHVSYSSHNSCKSLSEELRDYYEGWHRSHLRPHSHRRENERKPQEVNIKLPYFHGKDNVEANLDWEIRAEQQLKRKSTSKSYGSHSYPKKDQGQGILGVRPSKPKDDKGKTIEKQPLKAKDTLLLNAPTKKTMIMRGQDIYSGQDEATTSPSSSESEEAKGEESSEEISPQEEGDLLMV

SEQ ID NO: 155379 - protein, 253 aa, Glycine max
  Coding DNA Sequence Number=SeqID_63694
MGDQEETQEQMKADMSALKEQMASMMEAMLGMKQLMEKNAATVAAVSSAAEADPTLLATTHHPPSNIVGRGRDTLGHDGSPHLGYNRAAYPYGLPPNYSPPILQEDAGHIASPVHEKEPHQQPDEVHKDPQVYARRDVEFYPPIPEGPAPGTLPQPNIAASPIVLSMEGPPPATEERRKLDLLEERLRAVEGFCPPDYPFADMTDLKKKYPMLLFPRSSKCRTSISIKGRLVPKTISRCTADSLAGAAVPPAH

SEQ ID NO: 155380 - protein, 238 aa, Glycine max
  Coding DNA Sequence Number=SeqID_63695
  Homolog annotation: Hit_ID=Q9XE43; Match level="QueryCoverage=34%, HitCoverage=9%, E-value=8e-07, Identity=32%"; Hit description =Putative non-LTR retrolelement reverse transcriptase
KVLVKKAGTSSAKTDDVAHQVFDNLSECSVESKSSQEISCTLGDNDSTTDDDSSHSCGSKSSSQLDDNKAPTPWVNLFKDNRSPSKGFGMKFSPPPSDDEVLLEEIDLQPLEEAWGHSLIGYVAGRFPGKKALLDCCQKWGVKFSYSAHESGWLVFKFESEDDLNQVLSAGPYFIFQRPLLLKVMPAFFDFGNEEFSKIPVWVKLRNLPLELWNPQALGKILSKIGSPIRSDHLTASK

SEQ ID NO: 155381 - protein, 56 aa, Glycine max
  Coding DNA Sequence Number=SeqID_63696
MDPKRIKVIPEWPTPPSVEGRSPEYEEPRDLRSNPFQGGGKLDGSLLVELLWRLDL

SEQ ID NO: 155382 - protein, 170 aa, Glycine max
  Coding DNA Sequence Number=SeqID_63697
MGSSQMPSLKKRFYQVKVKSLGTTSLKELGQLMGQLQRQAFRKDYGKIWDLAMLSPMVEEFEEILGCPLGGRKPYLFTRFYPSLARISKIVQILAQELDHRKQVENGVVGMPRKYLEAKARILAGKGEWAPFIDILALLIFGGFLFPNVDGLVDLAAIDVFLAYHNHKES

SEQ ID NO: 155383 - protein, 91 aa, Glycine max
  Coding DNA Sequence Number=SeqID_63698
MVIDQSLFHDLTQLSSDGVPFEGRSTPDEEGNLPVEDNSTLLRRLMDKFNAMELQVDMRFDAMESRITKVEEDVSFIRTCFDPPPPPPSSS

SEQ ID NO: 155384 - protein, 66 aa, Glycine max
  Coding DNA Sequence Number=SeqID_63699
  Homolog annotation: Hit_ID=A2Q5V4; Match level="QueryCoverage=42%, HitCoverage=5%, E-value=8e-07, Identity=85%"; Hit description=Gag -pol polyprotein, putative
MDVKSAFLNGYLNEEVYVEQPKGFVRPNSSRSCIQAQEGSLWIEASSKSLRMSNESFDILSNSYAI

SEQ ID NO: 155385 - protein, 65 aa, Glycine max
  Coding DNA Sequence Number=SeqID_63700
MSAYSRFVNREPRAKRTFGHTLSRESQALSAQPLHLRLIWSAKLAKDELSQLQFDLNSAKLRPDR

SEQ ID NO: 155386 - protein, 136 aa, Glycine max
  Coding DNA Sequence Number=SeqID_63701
MSRALLLKQSFYLLLSRETSLSTAIPLELEVIPQVKELLDESLVRKSLNPCALLVPKIGIMRHQIPMIGGMMNLLSGATLFCKITHAPNIFMICVHRDSLEIISMKIKKKFPWRQDIFFKECRANLIRKIIYNDLK

SEQ ID NO: 155387 - protein, 71 aa, Glycine max
  Coding DNA Sequence Number=SeqID_63702
MSSSPSLDDYCLGFFWQVVWGGHAFDLASKVRRVRCNTWVSGAASWFKKLRHHFSLCELPKSHASTNGVKV

SEQ ID NO: 155388 - protein, 135 aa, Glycine max
  Coding DNA Sequence Number=SeqID_63703
  Homolog annotation: Hit_ID=A2Q500; Match level="QueryCoverage=68%, HitCoverage=11%, E-value=3e-08, Identity=29%"; Hit description =Endonuclease/exonuclease/phosphatase
MAGCGANWIELYTTRPGSIPLEILLASSPNPVIIASWNIRGFNLPLKHHAMQSFLRCKEINVMVVLETKLNKALVEEIMRRKFGDWHFTHNFASHNAGRILILWKQDKIHFSVLESNAQLIHCAIDCKIIAKHFQ

SEQ ID NO: 155389 - protein, 136 aa, Glycine max
  Coding DNA Sequence Number=SeqID_63704
MEGLVDLAAIDAFLAFHHGKESPVVAIFSMYDTFDRGCEKSSARIVCCALTLYVWLVSHLFLQEGRPVYPLQGCPNVPLMGTRGCINYNPVLSIRQLDYPMREVPSDESITPFIARGFSDHNARVLQGVRKAWDAA

SEQ ID NO: 155390 - protein, 176 aa, Glycine max
  Coding DNA Sequence Number=SeqID_63705
MIIHTFCQLEASEPIDTQRLTSSSAPLSSRDGESDDIRRYLMVISTFCPLEASVPVDTQRLMSSSAPSSSRDGESDDMRRYLMVIRTFFQLEASEPVDRQRLMSSSAPLSSRDGESDDMQRYLMVIRTFCQLELEASKPVDTQRLTSLSAPFPERSTSSSRDCEKVSFLPSGPRVR

SEQ ID NO: 155391 - protein, 276 aa, Glycine max
  Coding DNA Sequence Number=SeqID_63706
  Subcellular localization annotation: CTP_CleavageSite=21; ConfidenceScore=5.22e-01
MAIPVVWLRFLQGNVEIHHPSAASVSPVSACGAALKPSSMVPFPDLFAGSFFTANSRLPPSSTSLKSRAVSYPNFVRGPFGCTNSNQAHLDLPGCSNRKRCLLVVATQLAWASWATTTSLFSPINRGKRAEQIRSTLLSYGVPVTPSKVIRLPITRAFIEKYCTPRQAQGDAHQAANAPPPPWQADPAGSLGVANHHGQVQIHECFYRFSLSQQGQGSAPFVCPTPKQFGAEVAWPGDWPDALAGEEPAGSPGEADESRMDEDMTDLLGFLGGSGA

SEQ ID NO: 155392 - protein, 278 aa, Glycine max
  Coding DNA Sequence Number=SeqID_63707
  Gene Ontology: Mol. function=cysteine desulfurase activity; Cellular component=cytoplasm; Biological process=cysteine metabolic process
  Homolog annotation: Hit_ID=A4W9R3; Match level="QueryCoverage=100%, HitCoverage=68%, E-value=1e-131, Identity=83%"; Hit description =Cysteine desulfurase
  Pfam annotation: Domain name=Aminotran_5; Domain location=1-278; Score=412.2; E_value=7.5e-121; Accession=PF00266.10; Description =Aminotransferase class-V
  Pfam annotation: Domain name=Beta_elim_lyase; Domain location=3-236; Score=-118.4; E_value=0.012; Accession=PF01212.12; Description=Beta -eliminating lyase
  Pfam module annotation: Pfam domain module=Aminotran_5::Beta_elim _lyase; Domain location=1-278::3-236
MENVRTQVAAFLNARSPEELVFVRGTTEGINLVANSWGNAQVRAGDNIIITQMEHHANIVPWQMLCERVGAQLRVIPLNVDGTLQLELLDGLLDDRTRLVAVTQVSNVLGTENPVAEIVDKAHQAGAKVLIDGAQAVMHHAVDVQALDCDFYVFSGHKLYGPTGIGVLYVKEDILQAMPPWEGGGSMIATVSLTEGTTYARAPWRFEAGTPNTGGIIGLGAAISYVSAIGLEAIQEYEQLLMHYALAELASVPDLTLYGPADRQGVIAFNLGKHHAYD

SEQ ID NO: 155393 - protein, 132 aa, Glycine max
  Coding DNA Sequence Number=SeqID_63708
  Gene Ontology: Mol. function=cysteine-type endopeptidase activity; Cellular component=endoplasmic reticulum; Biological process =proteolysis
  Homolog annotation: Hit_ID=Q9FS02; Match level="QueryCoverage=99%, HitCoverage=48%, E-value=9e-57, Identity=68%"; Hit description =Cysteine proteinase precursor
  Pfam annotation: Domain name=Peptidase_C1; Domain location=1-132; Score=80.9; E_value=4e-21; Accession=PF00112.14; Description=Papain family cysteine protease
PELVDCDTKGVDQGCEGGLTDDAFKFIIQNHGLNTEANYPYIRVLMEISVAIDASGSDFQFYKSGVFTGSCGTELDHGVTAVGYGVSDDGTEYWLVKNSRGPEWGEEGYIRMQRGVDSEEALCGIAVQASYP

SEQ ID NO: 155394 - protein, 129 aa, Glycine max
  Coding DNA Sequence Number=SeqID_63709
  Subcellular localization annotation: CTP_CleavageSite=35; ConfidenceScore=5.06e-01
MDMSIGDLISGKMTMMAQSNSSRLGFLALITTLCRSRGVGSDALTSYENLRPVIDLAYIIRNCWNANDQTINFPEARKTTLRAADVPSSFAPIAGIPTSSTSAPPPALADPSAQSSQTTDAKLQSLFEG

SEQ ID NO: 155395 - protein, 105 aa, Glycine max
  Coding DNA Sequence Number=SeqID_63710
MTKVNKEPFLGVFCLCPVFFGCDGLCCLNVELLGCWGKIGRIDGDPVFDRNEDMGYVGVRELSLEVGNRGWWVYARFVDVENLLCTIARPPSSTTCDGYPIILQA

SEQ ID NO: 155396 - protein, 158 aa, Glycine max
  Coding DNA Sequence Number=SeqID_63711
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-25, Identity=53%"; Hit description =Putative uncharacterized protein
  Subcellular localization annotation: CTP_CleavageSite=27; ConfidenceScore=5.25e-01
MTMITPSSKLTLTKGNKSWFRLFISILYSTVKYLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 155397 - protein, 66 aa, Glycine max
  Coding DNA Sequence Number=SeqID_63712
MEKSDKKNFKDKKRKKAYITWEDNDIDSSGDSVNKVVNPSLMATNYESEEEMHSMTCIKNLSNLPN

SEQ ID NO: 155398 - protein, 217 aa, Glycine max
  Coding DNA Sequence Number=SeqID_63713
  Homolog annotation: Hit_ID=Q2HW90; Match level="QueryCoverage=67%, HitCoverage=33%, E-value=9e-15, Identity=32%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKEVFGGKGQRPWKIKVNGLSFIDILAFLIFGVVLFPNMEGLVDLAAIDAFLAFHHGKESPVVAILAMYDTFDRGCPSIRYKVTARASKRERESRTSPIANQGQSSGGHLLRPRGDPWTSQLLSAYDRLNGPYD

SEQ ID NO: 155399 - protein, 68 aa, Glycine max
  Coding DNA Sequence Number=SeqID_63714
MDNEEGVQEQMKADLSALKDQMAFISEVMLKLQKTIEDKATATASSIAHKPTPMACLRTSLPVPPQKI

SEQ ID NO: 155400 - protein, 45 aa, Glycine max
  Coding DNA Sequence Number=SeqID_63715
MVEAEKEILETFRKVEKCYYPVGFIEDALVRAGGELILPLVDFIF

SEQ ID NO: 155401 - protein, 77 aa, Glycine max
  Coding DNA Sequence Number=SeqID_63716
MTEARQKGVRKVNETKIKVRETNGDHEGPKNEEERTTNDEERLKIFAKSPTETLRKRYESISAWIFFTETIFLTNFK

SEQ ID NO: 155402 - protein, 89 aa, Glycine max
  Coding DNA Sequence Number=SeqID_63717
  Subcellular localization annotation: CTP_CleavageSite=61; ConfidenceScore=5.58e-01
DFRSRARSKTLPYLFSLSSSCLKSLFSFSSRPKSAGNHSVDTHIVVGRTHRIPYTVGKPTLSSLEPTEPPTLSKNPYCRRSNPTEPTLS

SEQ ID NO: 155403 - protein, 139 aa, Glycine max
  Coding DNA Sequence Number=SeqID_63718
METLQKVRKAWEVVQKKDKELRGSNSGPIGGYRRWLKAHVQGLDWFPSLRTTKREEVEAPEENEEEELAACPRSKKSLAQHLEATEQSMLAIIGQYKEEFNQSLTHEQKLVEDFAQAYAEKEARGRVIDALHQNDHVDG

SEQ ID NO: 155404 - protein, 15 aa, Glycine max
  Coding DNA Sequence Number=SeqID_63719
LIPFVQRAISGCTGS

SEQ ID NO: 155405 - protein, 231 aa, Glycine max
  Coding DNA Sequence Number=SeqID_63720
GQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALIIGLCQSFGVPVAPTKVIRPPITRAFIEKYCTQRQAQAVFTAFGSPAGGQPPSTYQFRAEVAWPGDWGGGPKQERRPRTLPAMEKKPTRMRRWPICLTSQEGVET

SEQ ID NO: 155406 - protein, 212 aa, Glycine max
  Coding DNA Sequence Number=SeqID_63721
MEESLSPFLVRDFGAQSLKIVQRVNKAWESPLRKDKELRGIRNGIIRGYHEWLRVHTRGLDWLSNLKIIDEENFEAPEEDEEVQALKLELGKARLAKEKFKSAATNIRKECAELREENAATARALEQETKRARKEEHGRDKFQGALWGSNNELKLRREEREQSQVHGMVLKEELVACSRSKEEFGPTLKGHRAKHASYNRAVQRRVKPVFDP

SEQ ID NO: 155407 - protein, 127 aa, Glycine max
  Coding DNA Sequence Number=SeqID_63722
MDEYFRVSNCKSEKDMWDTLQDMQKRFTHIVNHLASLGKIFQNEDLVNKVLRYLSREWQPKKHEMELMRLNCRSKLHDDEPSNFDDVKSPSDRFNTSRSSIKNPIQDSRFKGRNQEETSQDFIWNKY

SEQ ID NO: 155408 - protein, 116 aa, Glycine max
  Coding DNA Sequence Number=SeqID_63723
  Pfam annotation: Domain name=Transposase_23; Domain location=1-71; Score=4.7; E_value=0.00036; Accession=PF03017.5; Description =TNP1ENSPM transposase
MEDSDKCGLYVDDSPPRLVALRRVYEGSMTIHNVPLGNDQVKVGVEEVRHADARVPVPTQEVQLMGQTLNTFLIWPTHLVKPFLEQNKQVAKGLTKPIDMLDPDVDPLYLMILTIP

SEQ ID NO: 155409 - protein, 67 aa, Glycine max
  Coding DNA Sequence Number=SeqID_63724
MLNFSTRQSNRLNRNPGIAPVRVTYQIGYASNPVPCNQPNTEPVRTGKLGLVGYTQFPGCTLSLCKL

SEQ ID NO: 155410 - protein, 82 aa, Glycine max
  Coding DNA Sequence Number=SeqID_63725
  Homolog annotation: Hit_ID=A5AHJ1; Match level="QueryCoverage=95%, HitCoverage=30%, E-value=4e-10, Identity=39%"; Hit description =Putative uncharacterized protein
MWDTLQLTHEGTTDVKVNHLAALGKEFQNEDLINKVLRCLSREWQPKVTAIYESRDLSNMSLATLFGKLQEHEMELLKMAPK

SEQ ID NO: 155411 - protein, 203 aa, Glycine max
  Coding DNA Sequence Number=SeqID_63726
MPTLSANSWDIRWCWKRARNVSMARGGTGLMGSMRRPSPSCYVWRLPGILWIQISPTEPGIFLADHRTLPVIRSPRALPRQAQGDAPQAAGAPPPPHQAGQAGVFDMEHYLRHLVRQQAANHRAHVQTHDCLYQMSLSMQSQGFASFSCPTPDQFRAEVAWPGDWPEAQAGEAPPEAPGGGEEAHEDEEMADLLDFLGGNGDT

SEQ ID NO: 155412 - protein, 117 aa, Glycine max
  Coding DNA Sequence Number=SeqID_63727
MASSKEIAYSEWSFASLTVLRKVEEEPQLLVVFVVTAVVAVAILKEEHMACLDQQHSKKEGQVVVVVVEDLSISDLDDSSNLDCIYCLKGHNYSAIVGFATEEVYYKCLQHKLQVAH

SEQ ID NO: 155413 - protein, 182 aa, Glycine max
  Coding DNA Sequence Number=SeqID_63728
DSFEEQVTQGFFVPHGRRDVLTTAIGRLEHPGHVRAAGVGVTIKQYFGSAPRMSRSSSSLPPEELQQLAQQIRNQPEESITKKVTRQLMGLALPPEPLVGPSSPRVSTKESCVDPSGNNPETDDSDRCGLYIKANPSRLVALGRVYEGSTVVHNTPLLPGQVKVGVEEVKDPDAAVPVPTNE

SEQ ID NO: 155414 - protein, 206 aa, Glycine max
  Coding DNA Sequence Number=SeqID_63729
MRTSMTTLTQMWMTLLLSNVLPSDHNSDLPLPTCQLVYAILTRMSVHVAQLIADAIYLFAGMPPTRHPLDPDKSNRALGFPALITSLCQSFGVPITPSKAQGDAPQAADAPPPPHQADPAGSLDMERYLQHLVRQQVANHRGQGQGFAPFACPTPDQFRAEVAWPGDWLEALAGEAPAGAPGDAEEARMDEEMTDLLGFLGGSRAM

SEQ ID NO: 155415 - protein, 102 aa, Glycine max
  Coding DNA Sequence Number=SeqID_63730
  Subcellular localization annotation: CTP_CleavageSite=30; ConfidenceScore=5.16e-01
MYPLLFSVTKTQVDVPSTYTTKDVPSNVVRQSSQAVSPLKLCKGETKDISGEEQGLENKKLRKLFGKGRRRRKISRKGFKISQKMFKEVLKVIQMQVEVLLL

SEQ ID NO: 155416 - protein, 88 aa, Glycine max
  Coding DNA Sequence Number=SeqID_63731
MVVVVVFGYGESWVGRAIMVVCHDAKVMVVCVPMGFLFISLGRMIFTTKMIHILKLGRDASMEEKKDGEKERGGSTKLREEKGRGVEL

SEQ ID NO: 155417 - protein, 65 aa, Glycine max
  Coding DNA Sequence Number=SeqID_63732
MTRDASKFTTISPKKNGHVTYGDNNKDDDKGDDKKLKDQSKNNSSDSKINQRTTQVNQQQFKSSR

SEQ ID NO: 155418 - protein, 90 aa, Glycine max
  Coding DNA Sequence Number=SeqID_63733
  Homolog annotation: Hit_ID=A5BSZ8; Match level="QueryCoverage=100%, HitCoverage=9%, E-value=2e-21, Identity=56%"; Hit description =Putative uncharacterized protein
MTVADNIKITLPKIESAKKFMGLVGERSQTADKSVAGTLMSTLTTMKFDGSRTMNELVIEMTNIATRLKTLGMTVNENFLVQFILNSLPS

SEQ ID NO: 155419 - protein, 159 aa, Glycine max
  Coding DNA Sequence Number=SeqID_63734
  Homolog annotation: Hit_ID=A5AZG1; Match level="QueryCoverage=26%, HitCoverage=12%, E-value=2e-07, Identity=57%"; Hit description =Putative uncharacterized protein
MSHHSSSVNGESTSHKDPLSRILDELSFLKLWKEKKKEKKRVEINQDEREQIREEERRKIMKEMKRENHASYSSHDSCKSLREELSYYYRRRHSSHIKHHSQRREKDIRPQEVNISLPYFHGKDNVEAYLDWEMKVEQLFACHHISEERKVPLATLSFQ

SEQ ID NO: 155420 - protein, 60 aa, Glycine max
  Coding DNA Sequence Number=SeqID_63735
MKSESTDLMMQAPLELVGLGSSSSMDSFASWKMNGSGMEKEEREETPLQGEDESRRSSPP

SEQ ID NO: 155421 - protein, 96 aa, Glycine max
  Coding DNA Sequence Number=SeqID_63736
MTIVSAFAPPCSNPLMQSPALQLPIASFGQLEQSSLPEHENLESQNSPIESNLELRPPTSIQPLESASSTQTQLPHVVPTHPMVTSSQHGITKAQP

SEQ ID NO: 155422 - protein, 43 aa, Glycine max
  Coding DNA Sequence Number=SeqID_63737
MPLQGEYESRISSPPEEAMDKSLKVGKDEWRERRSTKFCASNE

SEQ ID NO: 155423 - protein, 86 aa, Glycine max
  Coding DNA Sequence Number=SeqID_63738
  Subcellular localization annotation: CTP_CleavageSite=70; ConfidenceScore=5.26e-01
MLVRMTHTHLFAAARVKSCPGMHNSCVIASLSGCARIVGRLPISGGQRTLNSLKVSIWSPLKVRTYSPLRARACSPLKLRMCCPLK

SEQ ID NO: 155424 - protein, 214 aa, Glycine max
  Coding DNA Sequence Number=SeqID_63739
  Homolog annotation: Hit_ID=A4PP05; Match level="QueryCoverage=47%, HitCoverage=24%, E-value=2e-07, Identity=33%"; Hit description=IMP dehydrogenase/GMP reductase, putative
MAGYISLLQCWIYEHFPSVHRSVVDDGYAEASPRACRWLTGKAQMTGIKGAPYRARIDALTVTDLISSYIGQVRWGPIIVYLRPKRVVRQMGYIQTVPPPPVHDSLTGTDKDDRWVQFADHVAPTGELCVVPGQTCVSLPTPDDDFVEPPVAQVPVTSDPPAHSVVDCTACVRMGRIAEQLERVINLRMVTAGTDLYDIMDLCLRIARDDDPDD

SEQ ID NO: 155425 - protein, 153 aa, Glycine max
  Coding DNA Sequence Number=SeqID_63740
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-25, Identity=54%"; Hit description =Putative uncharacterized protein
  Subcellular localization annotation: CTP_CleavageSite=18; ConfidenceScore=5.23e-01
MTMITPSSKLTLTKGNKSCKSPWHMYTYVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 155426 - protein, 118 aa, Glycine max
  Coding DNA Sequence Number=SeqID_63741
MHKALRLNAPFPYPHLVTLFLQHFNIPLDSEPYVPIKRSFLIGAVVVASFGYRKERDGSWSILDRFDGLQTYVGERFDSLERQVDTRFEEMNSRIAKVEEDVTIIRDYFDLPPLPPSV

SEQ ID NO: 155427 - protein, 162 aa, Glycine max
  Coding DNA Sequence Number=SeqID_63742
MWVFNTGRQLDWAHLVRYCMHKALRLNAPLPYPQLVTLFFRHFQIPLDSEPYVPIKRSFLIGAAVIASFGYRKERDGSWVKKGVPPADDEGHIPVEDNSTLLQRLMDKFDGLQTFVGDKFDAMELQVDMRFDAMESRITRVEEDVSFIRTCFDPPPPPPSSS

SEQ ID NO: 155428 - protein, 110 aa, Glycine max
  Coding DNA Sequence Number=SeqID_63743
  Homolog annotation: Hit_ID=A2Q4L4; Match level="QueryCoverage=86%, HitCoverage=9%, E-value=4e-13, Identity=40%"; Hit description=RNA -directed DNA polymerase
MGSLSNGVINARKIQNLKRELNILEAGINDRTLSQAEVELKKYLQDKLWNAAYAFESMLRQKARLKWLKEGDNNCNYFHRLINHRRRHNAIQGLIMDGVWVHEPSSVKKL

SEQ ID NO: 155429 - protein, 87 aa, Glycine max
  Coding DNA Sequence Number=SeqID_63744
MEEKVKLKISGGLRSTYLKLLCSDTTCWKLAYEASMEARSLSFNKEKLHHQESDLDKKLKEEASMEEENTRERGGGGGGRGVGIEGD

SEQ ID NO: 155430 - protein, 49 aa, Glycine max
  Coding DNA Sequence Number=SeqID_63745
MGKSHYCFLDGFSGYMKITIAPEDQEKTYMTAPLALLPNMHACTLHALI

SEQ ID NO: 155431 - protein, 68 aa, Glycine max
  Coding DNA Sequence Number=SeqID_63746
  Subcellular localization annotation: CTP_CleavageSite=24; ConfidenceScore=5.04e-01
MITKVMNKKLKRSKKNSSESKNISSKSRTSQEFKNQGEFKTQEESLESRIKTQDLKNQDQDSRLKIQE

SEQ ID NO: 155432 - protein, 196 aa, Glycine max
  Coding DNA Sequence Number=SeqID_63747
MTEREMITIMVDTLPTFYYEKLIGYMPAKFADLVFVGERIESGLRKGKFEYASNVAPNNNRRAPVMGARKKEGDTHAVTTAPTWMKASQNIQSSYQPNPPNFSIRAGSSLQTQVKGPPATERTPAQHTAPATPRPVNTPYCGLHYWRIIWWWPYPGRSSSHHTPSGTTRMPSVHTIVELPDTSLTPASRSCIRCST

SEQ ID NO: 155433 - protein, 203 aa, Glycine max
  Coding DNA Sequence Number=SeqID_63748
GVCHPDTDERPCGSVDPDTIYLFAGMPPTRHSLDPDKSNRALGFPALIMGLFQSFGVPVTPSKVIRPPITWAFIEKYCTPRQAQGDAPQAADTPPPPHQADPAGSFGMERYLQHLIRQQAANHKGQVKIHECLYQLSISQKSQGFAPFVCPTPDQFRAEVSWPGDWPEAQVGEAPAEGPGGAEEARMDEEMTDLLGFLEGSGA

SEQ ID NO: 155434 - protein, 87 aa, Glycine max
  Coding DNA Sequence Number=SeqID_63749
MYASLVLSITTQVDVPSTCATKDVPTNVLGQRILRREGKDQKNSQAVSPLKSLGREKGDTKEFRRLVLLFFWQREKRRKDNTLLFSA

SEQ ID NO: 155435 - protein, 82 aa, Glycine max
  Coding DNA Sequence Number=SeqID_63750
MCVHLFNFDRLRIKLQSLDFFRGTKFRALLFLSFHSSFSIFKLLSMASYGDLKKQRNPLMKKIQGLQAPHGATSCGIKSIFI

SEQ ID NO: 155436 - protein, 54 aa, Glycine max
  Coding DNA Sequence Number=SeqID_63751
MEIALASLELEGQGSSSSMNSFASWKMNGNEMEKEEREEMPLQGEDDSRRSSPP

SEQ ID NO: 155437 - protein, 188 aa, Glycine max
  Coding DNA Sequence Number=SeqID_63752
  Homolog annotation: Hit_ID=Q2HW90; Match level="QueryCoverage=39%, HitCoverage=14%, E-value=5e-09, Identity=44%"; Hit description =Putative uncharacterized protein
MASQEKWGLFADILALLIFGVVLFPNVDGLVDLATIDVFLAYHHSKESLVVAILVDLFDTFDRRCEKNSERIVCCLPALYVWLVSHLFQQDIRHPCPLQSYRACVEKRKVDWDQHLVGIGGSAINMFPRWKEGKEGVIFTGAWHDLKRRVTCLRKIQEEFGSTLGSHGAKHASYHRAVQGRVEPVCDP

SEQ ID NO: 155438 - protein, 116 aa, Glycine max
  Coding DNA Sequence Number=SeqID_63753
MHKALRLNAPLPYPHLVTLFLQHFNIPLDFEPYVPIKRSFLIGAAMIASFGYRKEHDGSWDRFDGLQTFVGERFDALELQVDMRFDEMDSRITKIEGDVSYICTCFDLPPPLPPSS

SEQ ID NO: 155439 - protein, 156 aa, Glycine max
  Coding DNA Sequence Number=SeqID_63754
  Homolog annotation: Hit_ID=Q2HW90; Match level="QueryCoverage=98%, HitCoverage=30%, E-value=2e-10, Identity=26%"; Hit description =Putative uncharacterized protein
MVEEFEEILGCPLGGRKPYLFSGFYPSLARVSKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARIVCCSSLCGAGFTPFSPRR

SEQ ID NO: 155440 - protein, 95 aa, Glycine max
  Coding DNA Sequence Number=SeqID_63755
MSDTMSRTSCSKILEVAVQCTKLQDPRCRIQCPGHPARKYWKLLYNALKLQDPRCRIRYFFRIMIDLIQHKPLQPRYAHCYITMEAARVLNQVRD

SEQ ID NO: 155441 - protein, 93 aa, Glycine max
  Coding DNA Sequence Number=SeqID_63756
MTKSKGKDPLEGLGGPIDEDMTKSKGKDPLEGLGGPMTRARARKAKDALQQVLSILFEYKPKFQGEKSKVGPIGNLGISLLGDQMVADLLAVG

SEQ ID NO: 155442 - protein, 141 aa, Glycine max
  Coding DNA Sequence Number=SeqID_63757
SILKWLLAEDIGCVTPRVNLGEDTVCWAFTPNGKFSTKLVYCMLKGEEQNDDMDFWRKNYLHAHLMEVDEERRSLFVVRLNIIWLAPKKLVFRNEDFDVDNIAYTIKAQARLMGALPKGGKMRGVATNAYLWKTLGKPKET

SEQ ID NO: 155443 - protein, 55 aa, Glycine max
  Coding DNA Sequence Number=SeqID_63758
MSSYDNKKNRTTASTSTCQASNPYSNITQSGIHTGGTYIDIGDPVWECPHCKAMM

SEQ ID NO: 155444 - protein, 95 aa, Glycine max
  Coding DNA Sequence Number=SeqID_63759
MNRQEAFWSYPLGWCRPIGRHHAQKNQTSNHRPVHLQMGSMIERKEKRFVYCIHCSSDENNEEEEMEEGIGVSEPRNVVGFYTKNLCVSFDGSTI

SEQ ID NO: 155445 - protein, 58 aa, Glycine max
  Coding DNA Sequence Number=SeqID_63760
MRCRGACPGELTYTFFLGETILGCVAAALSICPELGKGRRPIGRDPSLYLRPSLSTRK

SEQ ID NO: 155446 - protein, 167 aa, Glycine max
  Coding DNA Sequence Number=SeqID_63761
ISKLIWSTKCRALLSLSLRSSPSSSKLLSMASYGEAKESIDEEDPRPTSSNGAWEHHKSFYTGSATTRAYIQVPKRPAVLDISFNLVKILLQAKIHKGFKPKSSTCTTKDVSSNVLRQRSQAVKRLILCEWGYKRILRREKGDTKEFRRLVLRSFGKGRRETQKEFK

SEQ ID NO: 155447 - protein, 140 aa, Glycine max
  Coding DNA Sequence Number=SeqID_63762
MDWGMNPGCREGGMRRQDSGRIGAWPGHVSQCFTSAGIMFEEEVAAIGEEFPQDPPSLVRAWRIPIPKWGTGAYEGRFFEDPNNEGLIIDFDREVSQTISEEEEEDVLSPELERLIAQEEREMKPHQEETELINLGTGEG

SEQ ID NO: 155448 - protein, 91 aa, Glycine max
  Coding DNA Sequence Number=SeqID_63763
MSYRMSRHHTSEHANYIGLYEQIKQSNIKVAHKTLKSQNSQNNSSIPDLVQNPCSLHVYIAVCVSGLQQLVLDEIYHSPEKSALKDLKDTV

SEQ ID NO: 155449 - protein, 238 aa, Glycine max
  Coding DNA Sequence Number=SeqID_63764
LEEKLDALVHLVTPLAMNQKFASAPVSRACGLCSSADHHTDLCPSLQQSEAYAANIYNRPPQHQNQQQQNNYDLSSNRYNPSWRNHPNLIWTSPPQQQQPVPPFQNVASPRNPYVPPMQQQQQQQQRQQATEPPRPLTFLRRMGHMATQLNQAQSQNSDKLPSQTVQNPRNVSAITLRSGKQFEVPPPITAPAPEPVKLHSTPEKEDEMVAQKRKLPDHEGANKNFHADGPSSSSSDL

SEQ ID NO: 155450 - protein, 110 aa, Glycine max
  Coding DNA Sequence Number=SeqID_63765
MGSSQAPRLKKRFYQVKIKSLGVASLKELGQLMGQLQRRAFRKTYGKIWDLTMAKLTPTVEEFEEILGCPMGGRKPYLFSGFYPSLARISKIVKISTQELDRGKQVENGE

SEQ ID NO: 155451 - protein, 186 aa, Glycine max
  Coding DNA Sequence Number=SeqID_63766
  Gene Ontology: Mol. function=magnesium ion binding
  Homolog annotation: Hit_ID=P45799; Match level="QueryCoverage=100%, HitCoverage=100%, E-value=6e-87, Identity=86%"; Hit description=ADP compounds hydrolase nudE
  Pfam annotation: Domain name=NUDIX; Domain location=46-177; Score =54.4; E_value=3.9e-13; Accession=PF00293.19; Description=NUDIX domain
MSKPLQKPTILKVETVAKSRLFNVESVDLEFSNGVRRVYERMGPSSREAVMIVPIVDDHLILIREYAVGTESYELGFSKGLIDPGETVFEAAKRELKEEVGFGANELSFLKKLSMAPSYFSSKMNIMVAEDLYLESLPGDEPEPLPQVRWPLSQLMSLLEEEDFNEARNVSALFLVREWLQAQGRL

SEQ ID NO: 155452 - protein, 168 aa, Glycine max
  Coding DNA Sequence Number=SeqID_63767
  Pfam annotation: Domain name=Transposase_23; Domain location=106-168; Score=-14.2; E_value=0.043; Accession=PF03017.5; Description =TNP1ENSPM transposase
HPGCVRAAGVGVTIKHYFGSAPRTSCSSFSLPPEELQQLTQQIRDQLEESITEKVTRHLMALFCQMKSQMQSQGLALPPEPLVGPLGPRVSTKGSCVDPSGNDPEIGDSDRCGLYIEVDPARLVALGRVYEGSTIVHNTPLLPGQVKVSVEEVIDADASVPVPTHEVS

SEQ ID NO: 155453 - protein, 142 aa, Glycine max
  Coding DNA Sequence Number=SeqID_63768
MALGSKRALNPLMKKATYQLKIIPLFFKGLWTSLMDFRLLLVTSLMPWNCKFTCSSMPWNQGSPKLKKMSPSFVLALIHHHRLHRRLSLSIMTKYCHHQKGGDCRQRIKLNVLMMPKDYMNHMLLKDLFKTKIFKMNDQDSL

SEQ ID NO: 155454 - protein, 344 aa, Glycine max
  Coding DNA Sequence Number=SeqID_63769
  Homolog annotation: Hit_ID=Q6WAY6; Match level="QueryCoverage=77%, HitCoverage=43%, E-value=6e-17, Identity=27%"; Hit description =Putative uncharacterized protein
MEGRTGVLISCGGFPNVPLLGTRGCISYNPVLAIRQLGYPMRGAPLEDELAPVISRGFNKTNVETLQKVRKAWEVLQKKDKEIRGSNNRPIGGYCKWLKAHVQGLDWLPSLRTAKRKEVEAPEEDEEVQALRTELKQAQTVKERFKSAALKIRKENAELRDINMATTKALERETKRACREEHGRNKFRGALWGSNNELKLRREERDQSQVDSLILKDELEVCLRSKRNLSQWLCETETNMLAIVSKYQEELNLATAHEHKVANEYARVHAEKEARGRVIDSLHQEATMWMERFAFTLNGSQELPRLLAKAKAMADTYSAPEEIHGLLGYCQHMIDLMAHIIRNR

SEQ ID NO: 155455 - protein, 160 aa, Glycine max
  Coding DNA Sequence Number=SeqID_63770
MGYMPSNFADLVYAGERIKVGLMRVKFDYVSPIGASSRRTRIAGAKKKEGDAHTVTSTPAWPKPPQTPHGTHQYAQHHLSFSARAEASSDTALTHRGELFRLRLRLGLTRPTTLTLTQTRRGTFHLDPNDIWGTLAIFHHQPIGRGGPGKDHLVSIPKMV

SEQ ID NO: 155456 - protein, 150 aa, Glycine max
  Coding DNA Sequence Number=SeqID_63771
MRGRGCTAARPGELVTSSLCFLVGPGAEKCPKSDHFSFLLNILHISFRNVTKPYGLHGAQFSWQESKCLQTIVPDEIRGSKDKDTNFVRAISPSDRPLAKAQSTKPVKRKGIRGIREKETVIVLKTTKVDDHDCLRMPTDLIVSGRQRTL

SEQ ID NO: 155457 - protein, 67 aa, Glycine max
  Coding DNA Sequence Number=SeqID_63772
MLNFSTSQANRLNRNPGIAPARVTYQIGYASNPVPCNQPNIEPVRTGKLGLVGYTQFPSCTLSLCKL

SEQ ID NO: 155458 - protein, 96 aa, Glycine max
  Coding DNA Sequence Number=SeqID_63773
MSGFTRDPPQISASPHQLDLAPYALGPYNAQWNVPGLLHDKHTLRSSRILGEMEVDEPWLGLWLPLNYQVDMGASQHRTQGSFLKKASQGSYLVYK

SEQ ID NO: 155459 - protein, 77 aa, Glycine max
  Coding DNA Sequence Number=SeqID_63774
MMMTKGDDKGDDKKLKDQSKNNSRESKIIKNNSRVQDKNQEEFKTQEESLETRIKIQGSRSQESRSRFKNEEKTQSR

SEQ ID NO: 155460 - protein, 211 aa, Glycine max
  Coding DNA Sequence Number=SeqID_63775
MVNLYSLLFCRLQVVPYAVVLLNLAFAFLLKSKRKRLATWGINKGFQQGPYNQQGQWRSHLGNQFNKDQGGPSNRPPQQGPNIFQRTTNLKETLTQFMQVTMSNHKSTESALKNLEIQLGQLAKQLAEKSSNNFGANTKKNPKEECNAVMTRNKKRLVVDDKDKVALEKQIVVKDDTEKNKEEVTDVTSQESEKPLMVKEKEINDQEKEIE

SEQ ID NO: 155461 - protein, 155 aa, Glycine max
  Coding DNA Sequence Number=SeqID_63776
MATAAAVSSAAEADPTLLATTHHPPPNAVGRERSTLGHNSNPYLGYNRVAYPYGLPPNFTPPFMHDDTGHVTSPILEGEPPRQLDEVYEDHREYAQRDVDFYPSIPVEGLAPNTLPQPNLTSHSIFLSTEGPPQAVEERRKLDLLEERLRAVEGF

SEQ ID NO: 155462 - protein, 57 aa, Glycine max
  Coding DNA Sequence Number=SeqID_63777
MLRGTWIRATWGYVSSVEEWYLEICCGGQETLGMSGGVLFPKTKLDQSRPNPGIVSQ

SEQ ID NO: 155463 - protein, 177 aa, Glycine max
  Coding DNA Sequence Number=SeqID_63778
  Homolog annotation: Hit_ID=A5B5G7; Match level="QueryCoverage=88%, HitCoverage=10%, E-value=4e-07, Identity=27%"; Hit description =Putative uncharacterized protein
MASRKRKAPSTPTQVRFDRSRFTSQEAWERYTDVIVPRKLLPERNVVVYYTEFDEFKEELKRHHWDEELTYFIDSNIDVAIVKEFYANLYDPEDKSPKQVRVRGHLIKFDEDTLNTFLKTPVILEEGESLCAYSRFALQRPDPQELAAKLCIPGRGFELNVNGYPLKILRKNMTTLA

SEQ ID NO: 155464 - protein, 132 aa, Glycine max
  Coding DNA Sequence Number=SeqID_63779
  Homolog annotation: Hit_ID=Q1S5L7; Match level="QueryCoverage=66%, HitCoverage=42%, E-value=8e-13, Identity=48%"; Hit description =Putative uncharacterized protein
MPHVDLNEDNNYMDASTSAEYVAKHEQFMLMQDMVCDALRQPQTFKAPNSSNMEEPPNEDTQRFYNLLVEANEPLYEGATNSKLSISVRLLGSLTEYKFCNKPRYCAKTVGTSNRKPVLVKVMFYLPIIPRS

SEQ ID NO: 155465 - protein, 119 aa, Glycine max
  Coding DNA Sequence Number=SeqID_63780
MSRGSGDLGDVRWGAIAQNQAWPIPTQPGHSQSVRTCDIPKQIAMAAQLIHDRVVMECLKGVWETLEGNERCRFRGTIRLTATSLVHPEQPARTLQQPVEWILPTPTPYRLVEPVQVIE

SEQ ID NO: 155466 - protein, 136 aa, Glycine max
  Coding DNA Sequence Number=SeqID_63781
  Homolog annotation: Hit_ID=Q84VI1; Match level="QueryCoverage=70%, HitCoverage=14%, E-value=4e-34, Identity=80%"; Hit description =Envelope-like protein
MLSQHPNMLNYTDSVMKRESPLSLHYKLFEGTHVPDIVSTSVSTSGKAAASGAVSKDALIAELKDTCKVLEATIKATTEKKMELERLIKRLSESGIDDEEAAEEEGEAAEEEEEAAEEEEDAAEETESDDDSEATP

SEQ ID NO: 155467 - protein, 32 aa, Glycine max
  Coding DNA Sequence Number=SeqID_63782
MAGTFFLLKQQNGLEIMSGDVTIGGIRAKVGF

SEQ ID NO: 155468 - protein, 88 aa, Glycine max
  Coding DNA Sequence Number=SeqID_63783
MGKARAAVEELRRFLVADLLEEVLAGDQVPLMDSLITRLLRVPHALKDENLTDAVETSAMVAPRGRGGGRNSRGGRNGRSGRPAMHIL

SEQ ID NO: 155469 - protein, 83 aa, Glycine max
  Coding DNA Sequence Number=SeqID_63784
  Gene Ontology: Mol. function=nucleic acid binding
  Homolog annotation: Hit_ID=A5C693; Match level="QueryCoverage=78%, HitCoverage=29%, E-value=1e-12, Identity=47%"; Hit description =Putative uncharacterized protein
MAFLDSLSFKSNFKNRIFQDDDEDRVNLCLMTKSDENNKEDSVRKKWYIDSGCSKHMTGDVSKFTTISPKKSGHVTYGDNNKG

SEQ ID NO: 155470 - protein, 48 aa, Glycine max
  Coding DNA Sequence Number=SeqID_63785
MKFASLASTHHRRVMSWFRLYRMVPLTKKLVANLLNVILSLSEIPGGN

SEQ ID NO: 155471 - protein, 220 aa, Glycine max
  Coding DNA Sequence Number=SeqID_63786
  Homolog annotation: Hit_ID=Q652R5; Match level="QueryCoverage=35%, HitCoverage=31%, E-value=2e-23, Identity=69%"; Hit description =Putative uncharacterized protein P0603C10.50
  Subcellular localization annotation: CTP_CleavageSite=51; ConfidenceScore=5.10e-01
RPPRPPTHRGLVLAPTAGAQLGTVTQLPVHPASPVLLTKNGPLGALDSMARLNRAAAPYPEGNFGGNQLLDGSISLSPLYPKSDERFARQYRCGPPPEFPLASPRSGIVHHLSGPDRYALTRTLHRRSGSVGGATHRGIPPISFLAPYGCRGTPRARAAIHNRDDDVSTSISTARAWATIAIRVGQCPESIGGPALTVPHPTGTHRRPPSASLPTISSTL

SEQ ID NO: 155472 - protein, 111 aa, Glycine max
  Coding DNA Sequence Number=SeqID_63787
MGRASAFIDQIAAISPIASLKDSWVWGADPKGIFSTNSAYLCVKAEHLDEDQCLGFQHFWDIKIPPRALVFAWRLLWDRLPTLYHGRIEGYQQKVENLVDSSYKINMEAQK

SEQ ID NO: 155473 - protein, 142 aa, Glycine max
  Coding DNA Sequence Number=SeqID_63788
  Gene Ontology: Mol. function=protein binding
  Homolog annotation: Hit_ID=Q949G8; Match level="QueryCoverage=69%, HitCoverage=9%, E-value=9e-14, Identity=43%"; Hit description=HcrVf2 protein
  Pfam annotation: Domain name=LRR_1; Domain location=49-71; Score =10.9; E_value=2.9; Accession=PF00560.24; Description=Leucine Rich Repeat
  Pfam annotation: Domain name=LRR_1; Domain location=73-95; Score =17.2; E_value=0.061; Accession=PF00560.24; Description=Leucine Rich Repeat
  Pfam module annotation: Pfam domain module=LRR_1::LRR_1; Domain location=49-71::73-95
MTSWQSLHCGFKFTKQPFCWELYPNPWGFLQSCSLYTIRNNTLSENLLNVKILRLRSNRFAGHIPSEICQMSHLQVLDLAQNNLSGNIPSCFSNLSAMTLMNQSTDPRIYSQGKHGTSMESIVSVLLWLKGRGDEYRNILGL

SEQ ID NO: 155474 - protein, 169 aa, Glycine max
  Coding DNA Sequence Number=SeqID_63789
MASRKRKAPASVSQARREIDGNNWHKELTNFSEGSIDVALVKEFYANLYDLEEKSPKQVRVRGNLIKFDDDALDTFLNTLVVIEEGESSPSYFKFCRLRPDPQELAPRLCIPGRGFELNANELLLKILRKNLTTLAQTWSVISFSNLAPTSHTSYITLDRAKLIYGLVL

SEQ ID NO: 155475 - protein, 111 aa, Glycine max
  Coding DNA Sequence Number=SeqID_63790
  Homolog annotation: Hit_ID=A5B939; Match level="QueryCoverage=51%, HitCoverage=36%, E-value=2e-15, Identity=71%"; Hit description =Putative uncharacterized protein
MESRAPSGPFLVNGTGMPDEVEAGLRWPAARYPRPHKGCWSIKTAGRWSWKSKSAKDLPTLETAQPEVGSSGWKSTARRVVSGAPPAALENPEDRVPPTPGRTHNRIRSPR

SEQ ID NO: 155476 - protein, 161 aa, Glycine max
  Coding DNA Sequence Number=SeqID_63791
MHRSPTSNLVPLDLEIEATFQRNRAKKRRKLMQDRTVASILEEETYFSDLLSPDSPSSRELATQFPKAITMAKEHDQRITLEDYSISSVLQFFTSIAHLEVGTYFKDYLMKITMHTRQRSLKYVTLLRLPVYQTKLLGSAFSHSHWQEKPRGGSTHSRATV

SEQ ID NO: 155477 - protein, 135 aa, Glycine max
  Coding DNA Sequence Number=SeqID_63792
MTNAAARKEEERTEIETHQESNCQVTSIHHQLTNEEETPEVSSTPEYPYLDIGGYVGGKDKGRLELSIEDQKISFDLFEAMKHSDMGDAYFEEEEVEQEIALSVATMVLQSPLEKEPCYGRDCIACDEELDDSKD

SEQ ID NO: 155478 - protein, 154 aa, Glycine max
  Coding DNA Sequence Number=SeqID_63793
LCQSYGVPVAPTKVIRPPITRAFIEKYCTQRQAQGDAPQAAGAPPPPHQAGPAGSFDMEQYLWHLVRQQAANHRAHVQTHDCLYQMSLSMQSQGFASFSCPTPDQFRAEVAWPGDWPEAQAGEAPPEVPGDGEEAHEDEEMADLLDFLGGSGAS

SEQ ID NO: 155479 - protein, 67 aa, Glycine max
  Coding DNA Sequence Number=SeqID_63794
RVHRLGDCYTENKIGYISCGSVQVEGTSTCVFKENKGGVIPCGSLDYKGFYKVETNLKNSRLLGDWM

SEQ ID NO: 155480 - protein, 142 aa, Glycine max
  Coding DNA Sequence Number=SeqID_63795
MAPRKLASKRSRKDKVAEGTSSAPEYDSHRFRSAEHQCYRPAPGYPLVLEEGQECEYGQRRNRSDGFDEEAIAHLLCIPGQDFARTAAGRRVRIMRTNMTTLTQIWMTLLLSSIQPSDHNSDLPLPKCQLVYGTYQAPSGPG

SEQ ID NO: 155481 - protein, 129 aa, Glycine max
  Coding DNA Sequence Number=SeqID_63796
MYEYPRRTRALTRKHSFQNSCGYSCFVGKREMVPKKLSTKRSRRDATGEGSSAASEFDSHCFRSAEHQQRFEDIRGWSFHRERRVQLREDEYTDFQEEIARRHWTPLETPMAKFDPEIVLELYANGGIL

SEQ ID NO: 155482 - protein, 74 aa, Glycine max
  Coding DNA Sequence Number=SeqID_63797
MYGSVTMKGRAERTLDKEEDEEHVMEEARELRRGARPKIPNSKLKDFYWHKEQHTHEGAYRGCQKDPGDDGKPQ

SEQ ID NO: 155483 - protein, 65 aa, Glycine max
  Coding DNA Sequence Number=SeqID_63798
MGLGKDSHGNADVVDIRGNPHKYGLGYEPGKPKRRKAPPRLRADRAWPDHVSQCFTSAGIMFEEK

SEQ ID NO: 155484 - protein, 153 aa, Glycine max
  Coding DNA Sequence Number=SeqID_63799
GAEDDVSLYGLSELFVLQTAKKNVYTDNHSGISARQRVSNVSMTDLVSAKDDAFRLTDSKKNVYTANHSGISAGQRDSNVSMTDLVSTEDDTAKKNVYTDNHSGISARQRVSNVSMTDLVSAKDDRDSNVSMTDLVSAEDDKSPRVNGLVGRD

SEQ ID NO: 155485 - protein, 136 aa, Glycine max
  Coding DNA Sequence Number=SeqID_63800
MNKSKSGSHAAAVWLPKQTRAPWQLRTILPNIVGRGRDALGHDAALTWDTTERLTLMDCRPTIHHPALSSPTKSIKTLKIIRGGRKGDRVFIPDPEGPAPGTVCPNPTGSQTSPIVVSHGRAKPPATRRKEEASRL

SEQ ID NO: 155486 - protein, 304 aa, Glycine max
  Coding DNA Sequence Number=SeqID_63801
MAPKKLSTKRSRRDAVAEGSSAAPEFDSHRFRSAEHQQRFEAIKGWSFHRERLVQLREDEYTDFQEEIARRHWTSLVTPMAKFDPEIPFDANALSQFLGDPLVMDEGQQCEFSQRRNRADGFDKEAIAQLLCTPWQDFARTAVGRRVQIMRTSMTTLTQTWMTLLLSNVLPSDHKSDLLLPKCQLVYAILTRMSVHVAQVIADALYLFAGMPPTRHPLDPDKSNRALGFPALITGLCQSFGVPVAPSKAANHRGQVQIHECLYRFNLSQQGQGFTPFACPTPEQFGAEVAWPGDWPEAQAGEEP

SEQ ID NO: 155487 - protein, 41 aa, Glycine max
  Coding DNA Sequence Number=SeqID_63802
MENNDGLWWLMVDVGDGEKRKKEEEMAFFLSYKKAKAEMLK

SEQ ID NO: 155488 - protein, 109 aa, Glycine max
  Coding DNA Sequence Number=SeqID_63803
MGEVEEVQEKMKSDMSTLKDQMASLMEAMLSMKRLIESNAAMVVAASTVVEADPALSSVVNLAHKLAPHMMGRGGEILGNTNSPRQSEGNKEEGRTARVYAVGGQRKPR

SEQ ID NO: 155489 - protein, 287 aa, Glycine max
  Coding DNA Sequence Number=SeqID_63804
MGWLGIPRKCLEAKARILAGKGEWAPFIDILALLIFGGVLFPNVDGLVDLAAIDAFLAYHNHKESPVVAMLAELYDTFDRRLRHACPLESHRSCTEKGRATWDQLLASKEGASVNLIPSMEGRKNRSSYFMQRISKCSLDGDEKLHQLKSHQRGDTSEGPQGMRGVAKEGQGTQGQTAKREEDEAPEEDEEVQALRMELKQAQTVKERFKSAALKIRKENAELRDINIATTKALEQETKRARREEHGRNKFRGALWGSNSELKLGKEERDQSQVDSLILKDELKACS

SEQ ID NO: 155490 - protein, 59 aa, Glycine max
  Coding DNA Sequence Number=SeqID_63805
MGKDGHSHPGSRLMGVGLASGSKIKGMPHIYFHDTHTTMMIWKFYAKLVMDAPMWTLRH

SEQ ID NO: 155491 - protein, 126 aa, Glycine max
  Coding DNA Sequence Number=SeqID_63806
MALFEEKRTHEDIDKWIVCFDGASNALGHGVGAVLVSPDDQCIPFTARLGFWAVAFEKIKLGLANPPVLMTRASHRIISRQAGILLCNDGRAGWKTVVFHIKQYVENKAIPGISDNEKPALTGDGY

SEQ ID NO: 155492 - protein, 73 aa, Glycine max
  Coding DNA Sequence Number=SeqID_63807
MTSYSNMYKENWTQTWPMGSEIYPEVHENPRAFFSNSSPILLEPLAHGSSDWSLPREDCITASPALLPYSDSP

SEQ ID NO: 155493 - protein, 97 aa, Glycine max
  Coding DNA Sequence Number=SeqID_63808
MQLAVNMNGLPNITGMSLSSHISITTNYVGKIKCFTLTNTYSITPYGLVKEWIHDVGYNVQDILPENTGVAAQCTKAAGSTMSDTMSRTSGPKILDT

SEQ ID NO: 155494 - protein, 249 aa, Glycine max
  Coding DNA Sequence Number=SeqID_63809
  Gene Ontology: Mol. function=ribonuclease activity; Cellular component=cytoplasm; Biological process=RNA processing
  Homolog annotation: Hit_ID=A4WF61; Match level="QueryCoverage=66%, HitCoverage=83%, E-value=3e-65, Identity=75%"; Hit description=Maf protein
  Pfam annotation: Domain name=Maf; Domain location=2-180; Score=232.7; E_value=8.4e-67; Accession=PF02545.5; Description=Maf-like protein
MITLYLASGSPRRRELLTQLGLQFERLITDVEEQRQPGEAAESYVRRLASDKARAGVRIAPQDLPVLGADTIVVLNGEVLEKPRDAAHAAQMLGKLAGQTHQVMTAVALADAQGELDCLVTTDVTFRTITAEEISHYIASGEPMDKAGAYGIQGLGGNFVRRINGRDKMTAELLVNVTPSETRVAYIDGGILQEIHIEREARRGIVGNIYKGRVSRVLPGMQAAFVDIGMDKAAFLHASDIMPHTECVA

SEQ ID NO: 155495 - protein, 264 aa, Glycine max
  Coding DNA Sequence Number=SeqID_63810
MVLEEGQGCEYGQRRNRSDGFDEEAIAQLLCIPGQDFARTAAGRRVRIMRTNMTTLTQIWMTLLLSNILPTDHNSDLPMPKCQLVMVPPRHPLDPWISPTGALGFPALITGLCQSFRVPVASSKVIRPPSPGAFIEKYCTQRPAQGNAPQAADAPPPHQAGPAGSFDSEQYLRHVVRQQAANHRAHVQTHDCLYQLSLNLQSQGFTSFPCPTPDQFRAEVAWPGDWPEAQAGEAPVEAPGEAGEAREDEEMTDLLDFLGGSGAT

SEQ ID NO: 155496 - protein, 52 aa, Glycine max
  Coding DNA Sequence Number=SeqID_63811
MDKSLKVGEDEWRERERRSTKFCASNEFSPLIQDQVQDSPLSVLSCHEACKA

SEQ ID NO: 155497 - protein, 277 aa, Glycine max
  Coding DNA Sequence Number=SeqID_63812
GCINYNPTLAIRQLGYPMRGAPTEESMSPFLVRDLGAQNSKTIQRIHKAWETPLRKDQELRGIRNGIIGGYHEWLKVRIRGLDWLAKLKVVSEENFEAPEEGRGSPSSQKRVRKGKTRQGEVQVGCYTRSEGVVAGYGKRMQLPQEPLERETKRARKEEYGREQISAGALWGSKRSWSQRLCETETNMLAIIAKYQEELGLATAHEHRIADEYAQVYAEKEARGRVIDSLHQEATMWMDRFALTLNGSQELPRLLAKAKAMADTYSAPEEIHGLLGY

SEQ ID NO: 155498 - protein, 288 aa, Glycine max
  Coding DNA Sequence Number=SeqID_63813
  Subcellular localization annotation: CTP_CleavageSite=35; ConfidenceScore=5.21e-01
MDMDIGSLISGQMTMMAQSNSSRLGFPALITALCRSRGVGSDALTSYKNLRPVIELAYIIRNYWNANDQTVNFPKARKTKLRAIDVSSSFAPIVGIPASFTSAPLPALADLPAQSCQTSDAKLQRLFEGQILIMKSLHELAQQRPIMSVEQFIEKVAWPRARPSFVGDKESFIAQAPQQHELEPENDHSFEAIIPGAVDFPKRRLETRSNEAAHPRPVPVSANVPFPGVDPSSPQHTADSSTPVLQIPEGQTIPVLALDISPPTTPVLHLTDKEDVQAQDIQDQSQEF

SEQ ID NO: 155499 - protein, 67 aa, Glycine max
  Coding DNA Sequence Number=SeqID_63814
MITMMTTKDDEQKAQENQEQVKSSRIKKNSRFKKKAYKQEDSRFKISRIKIKIQDSRFKNEEKTQSR

SEQ ID NO: 155500 - protein, 177 aa, Glycine max
  Coding DNA Sequence Number=SeqID_63815
MTPAEARNLIEKMASNSQQFSARNDAIVIRRVHEVATNSAASSETKKLEGKLDALVNLVTQLALNQKSVPVARVCGLCSSVDNHSDLCPSMQQPGAIEQPEAYAANIYNRPPQPQQQNQPQQNNYDLSSNRYNPGWRNHPNLRWSSPQQQQQLPAPSFQNVAGPSRPYIPPPIQQQQ

SEQ ID NO: 155501 - protein, 109 aa, Glycine max
  Coding DNA Sequence Number=SeqID_63816
MAPLPLPRFHTTNRHFQLNRYRHDHCRKIPYDNDTILLCNDAVKHQIPPRLVWILFAVKTWPCSVCHQRRHPPPHPPPPPPKPPPQPQSWLAQAELPFYSCSVFLHPTP

SEQ ID NO: 155502 - protein, 75 aa, Glycine max
  Coding DNA Sequence Number=SeqID_63817
  Subcellular localization annotation: CTP_CleavageSite=30; ConfidenceScore=5.10e-01
MYLLLFSVTTTQVDVPSTCTTKDVPSNVLRQSSQAGEGRHKRIQAVSPSLGKGEERHKRIQAVSPSILFGKGRRE

SEQ ID NO: 155503 - protein, 53 aa, Glycine max
  Coding DNA Sequence Number=SeqID_63818
ILRASNLATGVSQRALLWASEARLTGVLSKGGKMRGVTTNVYLWKTSEKPKET

SEQ ID NO: 155504 - protein, 569 aa, Glycine max
  Coding DNA Sequence Number=SeqID_63819
  Gene Ontology: Mol. function=transporter activity; Cellular component= membrane; Biological process=transport
  Homolog annotation: Hit_ID=Q6KAY9; Match level="QueryCoverage=77%, HitCoverage=93%, E-value=0.0, Identity=80%"; Hit description=Outer membrane protein
  Pfam annotation: Domain name=OEP; Domain location=258-444; Score =177.0; E_value=4.8e-50; Accession=PF02321.9; Description=Outer membrane efflux protein
  Pfam annotation: Domain name=OEP; Domain location=53-235; Score =132.1; E_value=1.6e-36; Accession=PF02321.9; Description=Outer membrane efflux protein
  Pfam module annotation: Pfam domain module=OEP::OEP; Domain location =258-444::53-235
AAVLTLAGCSTLVPKNTAVAPAIPAQWPAEAAQGQVADVAAVGWRDFFTDPRLQQVIDQSLQNNRDLRVAVLNVERARGQYRVQRADRVPGVAVTGQMDRRGTDAGVTEQFTAGVGVAEFELDLFGRVRNLSEAALQQYFAVAANRRNAQLSLVAETATAWLTYGADAQQLKIAEATLKTYEDSLRLAEARHERGGSSALELTQTRTLVETARTDAARLRGQLAQDRNALALLAGGQLDPALLPDSIEPQLLALAPPPAGLPSDVLLQRPDIMAAEHQLLAANANIGAARAAFFPSISLTGSIGSGSNELSNLFDSGTRVWSFLPKITLPIFQGGKLRANLAIANADRDIALAQYEKSIQVGFRETADALALNVSLDEQVSSQQRLVDAAEQANRLSQARYDAGLDSFVTLLDARRTAYNAQQTQLQAQLAQQANRITLYKLSSNSIPVAPGHARRPFVPACLTSGRTALRARRAWPGATAWANGTMQTDIHRDAGSILLGWGCPGCTTHGASRLPRCVPRDRNSSAATKASVCRTAAPATGCCGISPFPSCAPVIRRAAASANADGQA

SEQ ID NO: 155505 - protein, 108 aa, Glycine max
  Coding DNA Sequence Number=SeqID_63820
MAAQLIRDRRNLHGCFRRTVEWILPTPTPYRLVEPVQVIEVTSSEEDPEEDLEELPPEPAVDALDFLEGDEDPLLEVDSPEEVMSASEADSTEDSGPGEMAISGGSSS

SEQ ID NO: 155506 - protein, 45 aa, Glycine max
  Coding DNA Sequence Number=SeqID_63821
MSLSGLKEHSNPVTPKAYTPKSPSRPLPPDSGPTPKIILAHRLYL

SEQ ID NO: 155507 - protein, 169 aa, Glycine max
  Coding DNA Sequence Number=SeqID_63822
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MDKSLKVGEDEWRERERMGTKFMPQMSPLIQVCLGVIRHVKHEGQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 155508 - protein, 171 aa, Glycine max
  Coding DNA Sequence Number=SeqID_63823
MSGHRVRHRGSCSFTSALDFYLALYSNSSILGQDVRTLYPTSWILQLQFFICHFILPCTLCSPISFLDITLDIMYRLEVMINHGDESTKFLLWDRECSELIGQSANAVNKLKIEDGDVDLTASPQALDKLLGYELAFKIKVQPKFRNSAVLKCSTDSSLINVVMDMLADAE

SEQ ID NO: 155509 - protein, 159 aa, Glycine max
  Coding DNA Sequence Number=SeqID_63824
DFARTAAGRRVRIMRTNMTTLTQIWMTLLLSNILPTDHNSDLPMPKCQLVYAILTRMSIHVAQLIANAIYIFAGMAPTRHPLDPDKSNRALGFPRTDHRTLPVVPESPLHLPKVIRPPHHPRLLIEKVLYPEDKAQGDAPPGRRRAHPHLIRLAQAGGI

SEQ ID NO: 155510 - protein, 170 aa, Glycine max
  Coding DNA Sequence Number=SeqID_63825
MGCKSQCCVWELHYGMHTWHPGRTTWGRVAGRPFRLAPGAVLLTGRGTTGAVCWAGALSAAGGCFHPCWGGGDRVGISFFFPHAHHWGSSVVIGGRVGGIFELAFSQSRFNSFSGEDEIRKVSWHIAYQLFIVERRQRIYHDCDHLPLRHRRDDLGCEILPPLGIFLNGL

SEQ ID NO: 155511 - protein, 160 aa, Glycine max
  Coding DNA Sequence Number=SeqID_63826
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=74%, E-value=2e-24, Identity=67%"; Hit description=LacZ protein
  Subcellular localization annotation: CTP_CleavageSite=30; ConfidenceScore=5.46e-01
MTMITPSSKLTLTKGNKSWYRAPPREGPTVAQTTLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 155512 - protein, 151 aa, Glycine max
  Coding DNA Sequence Number=SeqID_63827
MVSRGGDERDECLFHLGESHDMETCPVVEELLQRLMDCGQLEVFIGGKEEPQICMKGTGSTPIYPRAAPKPTPFAYQSDKAVPWKYTPPASSERVATEVDSLSTKVTNITGLSSVTRSGRVFASPHPAELPSKGKAPMVQEPTDIATPLKE

SEQ ID NO: 155513 - protein, 36 aa, Glycine max
  Coding DNA Sequence Number=SeqID_63828
MAGTFFLLKQQNQLEHMGGKKDMTPNRVVNWPFRTL

SEQ ID NO: 155514 - protein, 223 aa, Glycine max
  Coding DNA Sequence Number=SeqID_63829
MGDQEETQEQMKADMSALKEQMASMMKAMLSMKQLIEKNAATAAAVSSAAEADPTLLATAHHPPSNIVGQGRDTLGHDGSPHLGYNRAAYPYGLPPNYSPPILQEDAGHIASPVLEREPPQQPDEVHKDPQDYARRDVEFYPPIPEGPAPSTLPQPNIAAPPIVLSTEGPPPATEERRKLDLLEERLRAVEGFGDYPFADMTDLCLVPDVVIPPKFNAGLRQV

SEQ ID NO: 155515 - protein, 140 aa, Glycine max
  Coding DNA Sequence Number=SeqID_63830
MARRDKSLAFVDSPHNLCHTEAAGHVTCGDKIMVILHPFAIQTQSCPMVCRDKIMVILHPLSSRGGGPDDMRRHNYGHSAPLCHSDTVVSDGMQRQNLVILHPLSSRGGGPDDMRRQNLVIPHPFAIQTQSCPMARRDKL

SEQ ID NO: 155516 - protein, 199 aa, Glycine max
  Coding DNA Sequence Number=SeqID_63831
  Homolog annotation: Hit_ID=A5B939; Match level="QueryCoverage=18%, HitCoverage=26%, E-value=1e-06, Identity=70%"; Hit description =Putative uncharacterized protein
  Subcellular localization annotation: CTP_CleavageSite=67; ConfidenceScore=5.06e-01
TGEARLIALCARTPKGNRPAHPGNGSAGGRVPAAGRAPHVAWCPVRPRRPLKIRRTECLPRPVVLITASGLQGEQPPGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 155517 - protein, 59 aa, Glycine max
  Coding DNA Sequence Number=SeqID_63832
KVLLYNSRPGLMSVEIKSEFTDKGFKFNGHRLKPFPTNPSSVDVVVEETSLLHHTSLLP

SEQ ID NO: 155518 - protein, 101 aa, Glycine max
  Coding DNA Sequence Number=SeqID_63833
  Gene Ontology: Mol. function=helicase activity
  Homolog annotation: Hit_ID=Q2A9E0; Match level="QueryCoverage=75%, HitCoverage=5%, E-value=2e-09, Identity=46%"; Hit description =Putative uncharacterized protein
MARDKLQSAALPDLKIKLISQRQTDERLYNLPTTTEVATLIVGDEHSADKRDIIIEKQFGLLKRIHELHLAYLPLQYPLLYPKGEDGYSQEPTKLRLYFIP

SEQ ID NO: 155519 - protein, 94 aa, Glycine max
  Coding DNA Sequence Number=SeqID_63834
  Homolog annotation: Hit_ID=A5B0R8; Match level="QueryCoverage=84%, HitCoverage=8%, E-value=1e-07, Identity=41%"; Hit description =Putative uncharacterized protein
MIVGQLFKNTGEVDTIERYLAALGYNDVDWNTLLDYSKATNGYIFSIASGLFLGSQKQTISAQSTMESEMIALATAVESKLAKITWSRDYMAYK

SEQ ID NO: 155520 - protein, 52 aa, Glycine max
  Coding DNA Sequence Number=SeqID_63835
MASGNRLPRIAMVAQLIHGRVEMECLEGVWETLEGNARCRFCGTIRFTATSL

SEQ ID NO: 155521 - protein, 114 aa, Glycine max
  Coding DNA Sequence Number=SeqID_63836
MSDHKSTESALKNLEVQVGQLAKQIADKSSNSFGANTENNPKEQCKAVMTRSKKFVEAEDEESVVYKEQMGEKTGAEVKENDVKGKENQEIGKKIMVQNKEMENQEKEKEEKKF

SEQ ID NO: 155522 - protein, 79 aa, Glycine max
  Coding DNA Sequence Number=SeqID_63837
LSSFIGSGVYPDLSSFTGSGVIQTFVACIKRSAPTQAQVEKDKAPEWRRIKAQVEKDENPSGEGQSPQVEKDEGPSGEG

SEQ ID NO: 155523 - protein, 79 aa, Glycine max
  Coding DNA Sequence Number=SeqID_63838
IAKIHHKVCMCATFGSQEALSMHEMAPRKLASKRSRKDKAAEGTSSAPEYDSHRFRSAVHQQRFEAIKGWSFLRERRVY

SEQ ID NO: 155524 - protein, 147 aa, Glycine max
  Coding DNA Sequence Number=SeqID_63839
MAPPDSIPSVEQFNEMVAWPGTQPSLHREDEGPIAQLPQHMEDESSEATIPEPFVIREEVEETQVRQVAAATPERSLEATSEPSAQGEDIPSPQHATDPSTPLLEMPEDPTTSVLAMDTSPPATPVLHLTDEEDVQTQDPQDQSQES

SEQ ID NO: 155525 - protein, 232 aa, Glycine max
  Coding DNA Sequence Number=SeqID_63840
MDMNLGSFISSQITLIAQHDSSRLGFPALITALCKAWGVHSDSLTHESLSPAINLAYIKKNCWNLNDPTVTFRGLRKARGKRSEAPSTSTSEAPAPSSSTLPHSSSTDIPVILLAPSQIPLSAPLSAGPADFIFTPQILHSMLQSIHRGQSIIMQSLQGLGLPSIMSMEEFNAQLAWLGDQPSSSGGAAEEEETTLAQTPQPSPPSAAAPEETQASSALDLNEDQPQEEQDV

SEQ ID NO: 155526 - protein, 16 aa, Glycine max
  Coding DNA Sequence Number=SeqID_63841
MGLQQPSATFKMQQKM

SEQ ID NO: 155527 - protein, 168 aa, Glycine max
  Coding DNA Sequence Number=SeqID_63842
MAAKDIAILRDRTHIPTEKSLLELTSQDALLPQNKPQQQGPSLYDQTTKLEETLAQFMQVSMSNQKSTESAIKNLEVQVRQLAMQLVDRSSSSFTANTEKNPKEECKVVMTRRKREIHVDESETEKKMEEHKQQLAPKPALEPVSDFVELEEINEETEDDKEEETPIK

SEQ ID NO: 155528 - protein, 75 aa, Glycine max
  Coding DNA Sequence Number=SeqID_63843
MKMLLIPHGVSSIGASEWRRMRERRGHFKEKMSLEEAHHHRRPWIRTWRKKEMNQERGREEHKILCSKRALKSEI

SEQ ID NO: 155529 - protein, 47 aa, Glycine max
  Coding DNA Sequence Number=SeqID_63844
MENKMKNKELKSMEAEWRWKKDDWRCHFKENMSQEEAHHHRKSRIRA

SEQ ID NO: 155530 - protein, 84 aa, Glycine max
  Coding DNA Sequence Number=SeqID_63845
MEKNVATAAAVSSAAEADPTLLAIVHHPPPNTRLTLGLPPNYSPPVMQDDAGHISSPILEGEPPQQPKEVHEDPQDYARRDVEF

SEQ ID NO: 155531 - protein, 246 aa, Glycine max
  Coding DNA Sequence Number=SeqID_63846
  Gene Ontology: Mol. function=carbonate dehydratase activity; Cellular component=periplasmic space; Biological process=one-carbon compound metabolic process
  Homolog annotation: Hit_ID=Q6DAJ6; Match level="QueryCoverage=89%, HitCoverage=89%, E-value=2e-66, Identity=54%"; Hit description =Carbonic anhydrase precursor
  Pfam annotation: Domain name=Carb_anhydrase; Domain location=27-246; Score=107.5; E_value=4.1e-29; Accession=PF00194.12; Description =Eukaryotic-type carbonic anhydrase
MMMKSKHTLIALLLAAAPFAHVQAAAWDYAQPQQWGDLSPDFHVCKQGVNQSPIDIRQALHASLPALTLTLELQARQAAIVNNGHTVQINLQQGDTLTLDGETFTLKQFHFHTPSENLIDGKRYPLEGHFVFSDEQQQLAVIGVMFEAGAANPVLTTLLDTLPAQVNQPATLQQDVDITPLLPADRRYYRFSGSLTTPPCSEGVRWLVMKQPVTASAQQLQAFSAVLGEHGNSRPVQPLNGRLVVE

SEQ ID NO: 155532 - protein, 410 aa, Glycine max
  Coding DNA Sequence Number=SeqID_63847
  Homolog annotation: Hit_ID=A2V5D2; Match level="QueryCoverage=10%, HitCoverage=84%, E-value=3e-09, Identity=70%"; Hit description =Putative uncharacterized protein
MTCGWGTVSARGPSRLTNPMQTANTGECYHGRHTAGANVRREEGNNPDRQLRKRNSSLVESACAEDVTGLNHAPKLRQRHYVLLGRGAFCKPLKGESTPKARLKSVVDGKQVNIPVLGVTAKGGRRRLGYPGDGCPGVMTSRHGGEVTDALLPGKASKLQGLAPGAEASRRYQLAATEKLLIEAPVNGGRNYNGPKVAKFLVGVPAARRKDPVGGFEALDASLRGANLEIPPFNFDWGGLLPKRNGGARRLANPGRTSGGAKAGHSDPVVLNGRAIAQRIKGPKGTAVRRLKWYASWYERTGVNAPLVFGLSCQWHCPGPEGTLKTTTLIGRAEGKGRSIHEYVTDFTRAANAASVKKIRFVHQNLPGGNSAVVPPDPMPNSEVKRRSADGSVGPPHARVGNCQASNLVC

SEQ ID NO: 155533 - protein, 134 aa, Glycine max
  Coding DNA Sequence Number=SeqID_63848
  Homolog annotation: Hit_ID=Q57H85; Match level="QueryCoverage=38%, HitCoverage=49%, E-value=1e-20, Identity=96%"; Hit description=ORF16- lacZ fusion protein
MAYTKRSDLARASGPHKVCRSPDWSLQLDSMKSESLVIVDQNATVNTFPGLVKGVSTEYLKTDGNVVFEILLFNNPEQAENLKRRVVFILRNKNEITMRSSLSNACSPQRCKTPVGCEVKRLSVHGGCPGSQRR

SEQ ID NO: 155534 - protein, 75 aa, Glycine max
  Coding DNA Sequence Number=SeqID_63849
MNVLSGATLFCKITRTPNLMVMCYKERPILEVGVEGRSPKYEDEATTSPFPSEEVKKKKGKNLVKKSTLKKKDNH

SEQ ID NO: 155535 - protein, 42 aa, Glycine max
  Coding DNA Sequence Number=SeqID_63850
MDKSLKEEEDEWKERKRRSRKFCASIEPTNPKSSPRFSTKCA

SEQ ID NO: 155536 - protein, 54 aa, Glycine max
  Coding DNA Sequence Number=SeqID_63851
MPSHELSDWSLGVMAGQNDRAIADALQALAQAIGNPNMGEAGGAIKYQGLDRFQ

SEQ ID NO: 155537 - protein, 137 aa, Glycine max
  Coding DNA Sequence Number=SeqID_63852
  Homolog annotation: Hit_ID=Q84VI1; Match level="QueryCoverage=41%, HitCoverage=8%, E-value=4e-23, Identity=96%"; Hit description =Envelope-like protein
  Subcellular localization annotation: CTP_CleavageSite=55; ConfidenceScore=5.19e-01
MIKPQRRLCTKGTRTCSRLAPGIAERLQSRKGKTPLKRSGRIKTMAQKKSTPITPATSRRSKVAIPSKKRKEISSSDSDEDVELDVSTSKKAKTSGKKISQPSVITKYSRRSAFHGYLIKMSFWFTICPIIFTPGTT

SEQ ID NO: 155538 - protein, 64 aa, Glycine max
  Coding DNA Sequence Number=SeqID_63853
MKKQQWKRRCSGRQRRRGNRRRHPLGNKPWKKELHPQDEPWIGSLERMLQWRKRKRERKREGGA

SEQ ID NO: 155539 - protein, 89 aa, Glycine max
  Coding DNA Sequence Number=SeqID_63854
MDFKICPIMQKIAVKFVQQNFCSCAENACALLAIGKLGGVDGDPVLRGTKIRATWEYVSSVEGGQLGMVGSCVICGCGRVDLHHRPIAT

SEQ ID NO: 155540 - protein, 79 aa, Glycine max
  Coding DNA Sequence Number=SeqID_63855
MARSVSAPCPYLRDLYGRELKRFLAIIPKVVISLLMVSRGIILFEEHTAAVGTTSNNMFSKRKTLDEGSLLLVFSSTEL

SEQ ID NO: 155541 - protein, 297 aa, Glycine max
  Coding DNA Sequence Number=SeqID_63856
MYKDNWTHPWPMGSEIYHEVHENPRAFFSSSSPILLELLAHDSSDWSLLREDCITSDGVPFEGTIDEDWKFDFSSHDARRMVCTNQADMTGRLLVGSLAFECRIMHYLIVRILLPRSSNLAQVSEEDLIVIWVFFIGCQIDRAHIVRYRVHKALQSNTHLPCPYLITLFLCDFNVPLESEPFVQVKRSFSIGAGVVSSIGYRKERDGSWVKKDAQPQAADDRSPSPPPQRDDSSSFMQNVLDKLDGLLTFVGERFDSLDSRIDVIDARFAGMDTRITQLEEDMSFICQCFDLPPPSS

SEQ ID NO: 155542 - protein, 78 aa, Glycine max
  Coding DNA Sequence Number=SeqID_63857
  Subcellular localization annotation: CTP_CleavageSite=31; ConfidenceScore=5.09e-01
MMTKVMNKKLIRSKNNSSESKNNSSESKNISSESRTSQEFKNQEEFKTQEESLQSRIKIQDLKNQDQDSRMKKRLNQD

SEQ ID NO: 155543 - protein, 197 aa, Glycine max
  Coding DNA Sequence Number=SeqID_63858
GPNVKTNPLASHGGGSINAIEEDGPSRAKRLEEVATSRRFIYQSLQAACMVSHGGDERDECLFHLGESHDMETCPAVEELLQRLMDWGQLEVCKGGTDSTPIYPRTAPKPMPFAYQSNKVVPWKYTPPAFGERVATEVDSLSAKVTNITGLSGVTRSGRVFAPPHSVELPSKGKAPMVQEPTDVATPSKEVDPPVVK

SEQ ID NO: 155544 - protein, 163 aa, Glycine max
  Coding DNA Sequence Number=SeqID_63859
LFKVALERSPPICASSSSISVVYKNKGETKDIELVAEEQARIGADPSSETSNKYENYKEEARKKTQKHKPKSVESVNADAEAFAEAVEHTKKRDTGHQSVSLENKTGDSTMLKMGDSAKVVIKQDMKGRRHKYGFNNNEREKARKKRVVDDETDDKHQLDEVL

SEQ ID NO: 155545 - protein, 82 aa, Glycine max
  Coding DNA Sequence Number=SeqID_63860
SAPDGGGRMNSTRQSIHGSPNKISRVENKRTVLDNQFAGLIGGGYMNDNNFMGLRIKVENGELANSARQSIRGAPDSLVEDT

SEQ ID NO: 155546 - protein, 46 aa, Glycine max
  Coding DNA Sequence Number=SeqID_63861
MELASITPARFPQPPFFRGYDLNATCAYHGGALGHSIEHCMTLKHK

SEQ ID NO: 155547 - protein, 101 aa, Glycine max
  Coding DNA Sequence Number=SeqID_63862
  Pfam annotation: Domain name=G-patch; Domain location=1-37; Score =17.4; E_value=0.0015; Accession=PF01585.14; Description=G-patch domain
MLGNGYEPGMGLGKDNGGITSLISAKGNRGKFGLDYKPTQADIRKSIAGRKNGSQGSRLRHEDEGGPPYHISRSFISAGLGDEGQVVAICEDGAPSGSDLA

SEQ ID NO: 155548 - protein, 236 aa, Glycine max
  Coding DNA Sequence Number=SeqID_63863
  Homolog annotation: Hit_ID=UPI00016621D1; Match level="QueryCoverage =77%, HitCoverage=39%, E-value=9e-14, Identity=31%"; Hit description =UPI00016621D1 related cluster
MRGTVHEPQYPGLQRTTLLTNRGLHALTLRGLCVLTFRGLHVLTFRGLHALAIRGLRVLTFRGLHALAIRGLHVLTFRGLHALAIRGLHVLTFVGLHALTFRGLHVLANRGLHALTLRGLHVLANVGLHALTFRGLHVLANRGLHALTFRGLHILAFRGLHVLTLRGLHVLALRGLHVLALRGLHVLTIRGLHALTSRGLHVLALRGLPALALGTSYPHLQRTTCPHLRRATCPHL

SEQ ID NO: 155549 - protein, 98 aa, Glycine max
  Coding DNA Sequence Number=SeqID_63864
CDLVGVLAEVSAFALFCLAVIAVLGWWVYARIVDVENLLCTIARPPPSTTCDGVKLPAFIVDHRVVPGDMSRGSGDLGDVRRAPGSQQIKGTKTTKQG

SEQ ID NO: 155550 - protein, 178 aa, Glycine max
  Coding DNA Sequence Number=SeqID_63865
  Subcellular localization annotation: CTP_CleavageSite=41; ConfidenceScore=5.17e-01
MAESSKKRKGSSSTIAAAGHRRHGPSEAPTAPIHPSLSSPRSSTLFSSDDQRLWYNSQFSSRIILDPKYLDTDFFNDETIDCYQMFQNSGLVDFMSLKLPYYPELVKVFYSNLKIQDGIISSEVNGISMIIDQSLFFSLTKLPSQGAPFEGTIVDDWKFDYSSHDARRMVCNDQAEMT

SEQ ID NO: 155551 - protein, 152 aa, Glycine max
  Coding DNA Sequence Number=SeqID_63866
MGCGVKERTESLGGSSNGIIGGYHKWLRVRTQGLDWLPNLKTVRDNEVKASEESDEVQALKAKLERARVVKEKFKSIAIKESSRVKGMIWKDELKACLRSKRNLSQQLSETKGNMWAIIDECKEKLNLAATHEQRLEDEYAKISAEREARER

SEQ ID NO: 155552 - protein, 118 aa, Glycine max
  Coding DNA Sequence Number=SeqID_63867
  Subcellular localization annotation: CTP_CleavageSite=9; ConfidenceScore=5.34e-01
MALVTAWVSPSSLPSLFAPVFSGLSRMIKFASFQIHFDPFIGEDQIRKALRVRSPPSFHSGVSIMCLPSRLSSPFPLLGVPPGPPDPSTFWACSLKDPSPFLHMFRSCILSGTISKLY

SEQ ID NO: 155553 - protein, 57 aa, Glycine max
  Coding DNA Sequence Number=SeqID_63868
MAICSSIGNRQPARVQELARAFSERGVATAIGELPASCNSHWRFTQKNSHQHGDFVL

SEQ ID NO: 155554 - protein, 237 aa, Glycine max
  Coding DNA Sequence Number=SeqID_63869
MTRSRTKQSMDILQQMVADILNKARVEKDEGPEAEREIPLGSSIFIIHSKGEKSLCSSQKVSCNQETDCLLDCENCDQETGYLLENLEHKGEDPKKHFWHLIKFCENFSLGSSLNQSRTYQGNPYGVYPDLSSLSGSGIIQNSITCISDLLLVRITSKCLSLDELIICRKKGLRFNCDKKFSHGHKCSSKLLLLISEEDDNPSDNLVPLDEVGDDGEAVGLFPTQISLHVLSGHMAP

SEQ ID NO: 155555 - protein, 117 aa, Glycine max
  Coding DNA Sequence Number=SeqID_63870
  Subcellular localization annotation: CTP_CleavageSite=28; ConfidenceScore=5.17e-01
MATTIAPSPRPRSSHWFSTGAKTHTLVRARFVVAHRLFLRGVVKGITEQHHGDSLECYPLKVVLSPSNNGTGRLVAPFLSAGISAVDVGVEGAFAADSWSFLGRNSWRVHHDIQLRA

SEQ ID NO: 155556 - protein, 85 aa, Glycine max
  Coding DNA Sequence Number=SeqID_63871
MRQFGYTQIIPAPPVDSWVSYDDIHDRWMHYSDHMVLAGEVCAVPRQCANDYMDWFFHISHPFMTPGQASYPLPNGHAPQPRVVP

SEQ ID NO: 155557 - protein, 118 aa, Glycine max
  Coding DNA Sequence Number=SeqID_63872
  Gene Ontology: Mol. function=aspartic-type endopeptidase activity; Biological process=RNA-dependent DNA replication
  Homolog annotation: Hit_ID=A2Y2J4; Match level="QueryCoverage=75%, HitCoverage=16%, E-value=2e-09, Identity=34%"; Hit description =Putative uncharacterized protein
MKREKHVAYSSHGSCKSLSEEINDYYGGRHRLHTKHHSQRRENDRRPQEVNISLPYFYGKDNVEAYLDWEMKVEQLFACHHISEERKVSLATLNFQGYALSIGGLPLLGKEGFMGILQ

SEQ ID NO: 155558 - protein, 128 aa, Glycine max
  Coding DNA Sequence Number=SeqID_63873
MRHHEQQQNQDMTYSLVRHHEQKQNQDRTYSLVRHHEQQQNKDKNHLEFKFGRNDVFINYDSEHEQHNSLLEHHSDPSFDEHASGHHHNDIACSKRTKLLQRLKRWVDGSEKPRVRHSISKGAEEHCT

SEQ ID NO: 155559 - protein, 123 aa, Glycine max
  Coding DNA Sequence Number=SeqID_63874
MEFGDGTCIGADVLMYGEIKGIWAPRATKSHKSAKPFRFKVLQNWDDIVDLCAKDRATGHGAKTAMDIYEAMSRETNEPKFMGLSVIATIDLEEQALILKEKDNVQLLLAHILTRERLEKKKE

SEQ ID NO: 155560 - protein, 128 aa, Glycine max
  Coding DNA Sequence Number=SeqID_63875
MKNTSYRKNVLPEKLPEEFLPEKLPEEGSSEKTNCSTGRRFFLRNYWKKFFRRSYRKKVLPEELIVLPEEPSSGSFFGRTFVLSEEPSSEEATGRSSSDSFGMIDLCHFQTISMSSTLKPSSPKPTKQ

SEQ ID NO: 155561 - protein, 404 aa, Glycine max
  Coding DNA Sequence Number=SeqID_63876
MASRKRKATASRPREPYDTTRFIFEGAWERYDQNVHSQNILPERNIILYISEYDEFRRELERHSWHKALTRQPDGHIGVALVKEFYANLYDPEDKSLRQTSVVLETGERYTTYTRFCDNPQQLPSKLCIPGHSFVLNAEGALWKLLRKDLATLAQTWSMLSYSNLTPTSHTSDLNMDKARLVYGLVMKMDMDLGSLISGQILQMAQSNSSRLGFSTLITALCIARGVVPDSLTFESLSPAINLADPQDLGSRTRGFFFCSPCSSSTTTNFSSRTSTLRHLRLEHKDFSADAAEPAPWLMPGDAEWPGQESSLLLWGEGEAPTTQEPQPEVDPEPKASPKAEATLEETPKDTHAATPAKDTNYVADMAAAQSTWDPWSTPALNTSLLAQDAPSIPQNEPTPAQDD

SEQ ID NO: 155562 - protein, 141 aa, Glycine max
  Coding DNA Sequence Number=SeqID_63877
  Subcellular localization annotation: CTP_CleavageSite=31; ConfidenceScore=5.30e-01
MPSKVILMMPKNQKSSKIQRFKNQASSFKIQDSRNQEESRLKRRNQEDFTREIQRTNRLRILCLNTLEGTSCVVQVEGTSTWVVVNENKRGYISCGSVQVEGTSTWLFKENKGGCIPCGSLLVKDFTRLKRNLKNRWLLGD

SEQ ID NO: 155563 - protein, 51 aa, Glycine max
  Coding DNA Sequence Number=SeqID_63878
METGFAQESAVEYIIMLAGQSASNAKCQGILNEKKFQKTWKMKNAYSLHIF

SEQ ID NO: 155564 - protein, 220 aa, Glycine max
  Coding DNA Sequence Number=SeqID_63879
  Homolog annotation: Hit_ID=Q8LAX0; Match level="QueryCoverage=28%, HitCoverage=17%, E-value=7e-07, Identity=48%"; Hit description =Homocysteine S-methyltransferase 3
MSNQPAPRWVEPKSHVQTGAYECGYYVMHWIWCIVTGGLKDDWNKWFSDGSPLDVEAITTLRQKWATFFLNLDGLVVLGGDDLNTNVCLLAENFSGDYGDAITVEIRRRVQILANSSAHLLAFETVPNKLEAEVTTKPIVIYPNSGETYDADLKEWVQTEVHKLLKQLAYERFCEASNHSSNVNLADKSRKVKDNIPSIPLIAFINERLKKVQNMILGSF

SEQ ID NO: 155565 - protein, 46 aa, Glycine max
  Coding DNA Sequence Number=SeqID_63880
MSSGDQFTQAKFKNSNRARHLRTTRVSQVNNPPTLVDKARWGRDKY

SEQ ID NO: 155566 - protein, 54 aa, Glycine max
  Coding DNA Sequence Number=SeqID_63881
MGDLCVVPGQEGDQPRHAPALDHEDNMQLGIPQVPVAFDPPPPPHMQGEKCLPL

SEQ ID NO: 155567 - protein, 244 aa, Glycine max
  Coding DNA Sequence Number=SeqID_63882
  Pfam annotation: Domain name=zf-CCHC; Domain location=133-150; Score =11.3; E_value=0.03; Accession=PF00098.14; Description=Zinc knuckle
  Subcellular localization annotation: CTP_CleavageSite=34; ConfidenceScore=5.26e-01
NLSIPSRFMNKNFIRMKDSNREKSLALSSQKNKKASSSREQVLRNSSKALKVDESSDDESEEDSDEDELAFISQKIQKMWRKKGAYKPEHFKSECPDLKKSQDKKKFLKTKEKKDKSRNGYDWEVYVHDEDTVFCYFYGKIGHMTSRCRDHPKKYVLDSTKQMPIMVLGQWLLMAHDGRKMYVPMTGSLSWWNSHKHNLLSISQICDSGYGVSFNKDECAVLCHDGSPLFYAKRKDNLYKIRLG

SEQ ID NO: 155568 - protein, 300 aa, Glycine max
  Coding DNA Sequence Number=SeqID_63883
MKQEGKMRILELSHWDNATTLHTRTNTSYFYTKLPNLENWDVTKCNILPQLIYLKLIRMFWRNSEFLNNKAIVSKVLRMKKFNKSNLKVIKVMIDVAKKEVPQMDKEAINRKKKRKSNAQKQASPAPKKVKAPSKAVDKEWTPPFPPSSSSSKTTHDAPISPQRMHLLSIEQHPPLSIINLKKFKSTQKMKVPLTDDQRESIPTSSPEWMRYEYVHTPVEAYEALSSDAMVHIKTPKWTCGLHALMYTRNWVIAYSPGLHISKAIEIKIVVDRVCPRLPTWDVAKKKDFKLYHYAKMPSR

SEQ ID NO: 155569 - protein, 76 aa, Glycine max
  Coding DNA Sequence Number=SeqID_63884
MSATLPLTHVGDICCETCDGYFMNYDNPDMATMLKKCRSSIGKNLEAIGSSDSIRGRGAISIDDDRGKENKPITAP

SEQ ID NO: 155570 - protein, 121 aa, Glycine max
  Coding DNA Sequence Number=SeqID_63885
  Subcellular localization annotation: CTP_CleavageSite=53; ConfidenceScore=5.32e-01
MYSPLFSLNNLVDVPSTRTDPQEMYPLLFSVTTTQVDVPSTCTTKDVPSNVLRQSSQAVSLLKLCEGGYKRYLREREESKEFSDCVVLNSLTWEKGDTKEFRRLVLGEFFLTKGERNEKDE

SEQ ID NO: 155571 - protein, 206 aa, Glycine max
  Coding DNA Sequence Number=SeqID_63886
MQLGLTNILIARFPNPNYGVKMGFSKEAQNIQWWFQRTSIESRLPQGKSRRSDWGFILNRNCEASLEPLRLKVPLGVGFQRRTTVVRGGHRWLWVVEKKLRTLELVLEERRRKEWLFSKATRNIKVETLKCFCSREKKLFSHKRRHIVDHNGQIVDICPMNLKTKFRQDPTVNEFRRTRLPRHLQTASLKSFSQEASLRSFLLRFL

SEQ ID NO: 155572 - protein, 151 aa, Glycine max
  Coding DNA Sequence Number=SeqID_63887
  Pfam annotation: Domain name=Transposase_23; Domain location=37-107; Score=-5.5; E_value=0.0048; Accession=PF03017.5; Description =TNP1ENSPM transposase
MQSQGLALPPEPLVGPSGPRVSTKGSCVDPSGNNPETGDSDRCDLYIEADPARLAALGRVYEGSTVVHNTPLLPSQVKVGVEEVIDVDAPVPVPTDEVSLVGQTIHTFLAWPTHLVAVSPAKPPPKPDPQVDDPLYLMTLTIPELFLRPYQ

SEQ ID NO: 155573 - protein, 292 aa, Glycine max
  Coding DNA Sequence Number=SeqID_63888
MEITEVKVEKFGAAQLEKRGENGRLESEKNIDAAWGVAEEPGHDATTAPLTGGWSSTCPPTPAPDRRFASSDDTNGAPLDYLELDGVFSDDDSIAAGAKGDEGRAADVEVVATGDEGADLPTNPSVGSDGDEDITVTLVLAEAEEIERRDGDVGTINKRRPNIDLIVALVGRRDGGSVRDLLAPVDYVDFEAVVVNTDVVVRVARDERDLKIRSEEVRYGGVEGVDRDVLEGEGGFGGSKDCPYQKNCEQHEEEEHHYAPEHLPEDLPLLPLVVLALRHGIGRFGVVDASEK

SEQ ID NO: 155574 - protein, 213 aa, Glycine max
  Coding DNA Sequence Number=SeqID_63889
  Gene Ontology: Mol. function=glutathione gamma-glutamylcysteinyltransf erase activity; Biological process=phytochelatin biosynthetic process
  Homolog annotation: Hit_ID=Q2TE74; Match level="QueryCoverage=98%, HitCoverage=50%, E-value=9e-68, Identity=60%"; Hit description =Glutathione gamma-glutamylcysteinyltransferase 2
MAEHSYRHEGWSSVAKSLTEDVPRLLKSEDLKDIQEVLSLAFKSPPSELRGLITWIVEVRRQEDGNLTLSEEEKGRLAIKADILEQIRTTRLFKHVTRLGLSGGKCCSQIDVKHMNADSENPVTLVSGTVTTGGGSEQGVDVLVPLCQREPSRLCLSNEGHCIGMHPSTADVLTMFLLALPLHTWSGIKEEKLRVEALNPLATEDLPPLLQEE

SEQ ID NO: 155575 - protein, 83 aa, Glycine max
  Coding DNA Sequence Number=SeqID_63890
MNAGTCGIEAREREENEKKNAWRGYEEGSDREGEVETEKHFCLEQRECLGEREQSEEKESVCDAAEAADCFVVSRQVLCVRVR

SEQ ID NO: 155576 - protein, 63 aa, Glycine max
  Coding DNA Sequence Number=SeqID_63891
MHPWSCHMGAHQGRGKCGVGNWLMLGCKWQRRCGFQDKVFLAVAYEGFWIFYSKFNTVSNYDG

SEQ ID NO: 155577 - protein, 147 aa, Glycine max
  Coding DNA Sequence Number=SeqID_63892
MGLPFWGRSLVAREVRGIEEFGSEDEFYASSLSSIFDSNRMEDYLVREGVGMSKEMMRTKGDDVVGVWVFMEGNSYLAQFQTLESIEELKRKIDMMNLDDAKLLIVEPCGAEEHVFMKASKGEADFVYLYEDVFKELNIQFPFLNLE

SEQ ID NO: 155578 - protein, 66 aa, Glycine max
  Coding DNA Sequence Number=SeqID_63893
MELHHCPCAKSNHCSSENLGTSWGWRRLIAACPKNPSSQLVMQSFPPRELDMMQSDPPRTLDRRLQ

SEQ ID NO: 155579 - protein, 418 aa, Glycine max
  Coding DNA Sequence Number=SeqID_63894
  Gene Ontology: Mol. function=ubiquitin-protein ligase activity; Cellular component=ubiquitin ligase complex; Biological process =protein ubiquitination
  Homolog annotation: Hit_ID=A7QHS6; Match level="QueryCoverage=99%, HitCoverage=100%, E-value=1e-132, Identity=60%"; Hit description =Chromosome chr8 scaffold_99, whole genome shotgun sequence
  Pfam annotation: Domain name=U-box; Domain location=5-80; Score=82.7; E_value=1.2e-21; Accession=PF04564.6; Description=U-box domain
MDEIDVPPFFVCPISLELMKDPVTVSTGITYDRDSIEKWLFAEVKNDTCPVTKQPLLPDLTPNHTLRRLIQAWCTVNASHGVQRIPTPKPPVDKTLIEKLLRNTSASDSPSLQLRSLRTLKSIASESQSNKRCIESAEGAVNFLATIITTTTTTTTNLLDDDIELEIKTSTAHEALSLLHSIQLSESGLKALLNHPEFINSLTKMMQRGIYESRAYAVFLLNSLSEVADPAQLINLKTDLFTELVQVLKDQVSEKVSKATLQALIQVCSWGRNRVKAVEAGAVPVLVELLLECNERKPIEMVLVLLEILCQSADGRAGLLAHAAGVVIVAKKILRVSTMANDRAAKILLSVCRFSPTPGLVQEMVQLGVVAKLCLVLQVDSGNKAKEKAREILKLHARAWRNSPCIPHNLLASFPMSS

SEQ ID NO: 155580 - protein, 172 aa, Glycine max
  Coding DNA Sequence Number=SeqID_63895
MNQAITKVSQPNPRSHEASHSSPPCHSRTLTRAPSHDNHALLWVLLPLRGGHLWRHRGGHEEHALRRGGASLGGGIVGALKRVQGRTVEGDDHGRTGGAVEREYSRAGIVRRSLDGAATYTGGSRGGLGVGDGEDRRRGKTITYSKTVKIKRPSLYYKYNYYGQRGTRPSTS

SEQ ID NO: 155581 - protein, 40 aa, Glycine max
  Coding DNA Sequence Number=SeqID_63896
MVMTSGVDFKIKTLKVGAKRLKLTIWDTGNIESKSCAFSS

SEQ ID NO: 155582 - protein, 51 aa, Glycine max
  Coding DNA Sequence Number=SeqID_63897
MDDPVWVGDPDFEGELFFMVGSGRANLNPFLVLLPPRREVPDALGGMRIFL

SEQ ID NO: 155583 - protein, 234 aa, Glycine max
  Coding DNA Sequence Number=SeqID_63898
  Gene Ontology: Biological process=transposition, DNA-mediated
  Homolog annotation: Hit_ID=Q1J7G7; Match level="QueryCoverage=17%, HitCoverage=70%, E-value=2e-11, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMAFKLISSFKASLCCLWMYFADHVLAVGELCLVPGQVGDHPRDAPAADPKEYMQPPIPQVLVAFDPPPHAVDDYDGYEAIAQRLERVLNLRMATAGIELYDIMQDCLTIARGGASADGSVRPRQR

SEQ ID NO: 155584 - protein, 71 aa, Glycine max
  Coding DNA Sequence Number=SeqID_63899
MALDSSKETYRAAQCTRQDKMSNEELKLQDPRCRIQCPDILLENTGVAVQCKIKVKCRSEAAGSTMSDTMS

SEQ ID NO: 155585 - protein, 122 aa, Glycine max
  Coding DNA Sequence Number=SeqID_63900
  Gene Ontology: Biological process=transposition, DNA-mediated
  Homolog annotation: Hit_ID=Q1J7G7; Match level="QueryCoverage=31%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPEFDVEQDLLVFTFHLDIKIGFTIQSIFKTLMHKKSPHP

SEQ ID NO: 155586 - protein, 212 aa, Glycine max
  Coding DNA Sequence Number=SeqID_63901
VKLPAFIVDHRVVPGDMSRGSGDLGDVRRAPGSQQIKGTKTTKQGGLWLENEASGNRLPACVIDYTEIVMAAQLIRDRVEMECLEGVWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMLASEADSTEDGGPGEMAISGGSSS

SEQ ID NO: 155587 - protein, 50 aa, Glycine max
  Coding DNA Sequence Number=SeqID_63902
MKSLRGKEIALVKVQWGTDEGDSTWELEDRMRELYPKVGIVGARYAGLTN

SEQ ID NO: 155588 - protein, 46 aa, Glycine max
  Coding DNA Sequence Number=SeqID_63903
  Subcellular localization annotation: CTP_CleavageSite=34; ConfidenceScore=5.07e-01
MPHPIRALGLNVLQHMVPQSNSPSHLLPRTQSSRSSQDPNTNNTRE

SEQ ID NO: 155589 - protein, 92 aa, Glycine max
  Coding DNA Sequence Number=SeqID_63904
MSLKWRQFKYELKSKGYAESKTKEEMVAYIPDPRVDPSQYHDLKISNINKMSRSKYEDLHCMGTNNLPRRIYEMTTKAKGVQPSRAEIYIDT

SEQ ID NO: 155590 - protein, 132 aa, Glycine max
  Coding DNA Sequence Number=SeqID_63905
MELLLLRAGLREEERTSIARFLSGLNMEVSNKDQAQGILGAAHSKPKEDKETTFSPSSSVSEDEVRGEEPSEEVYPHEEGDLLMVRRLLGGQSCDLSQSQRKNILHTCRSKLHDDESSSFDDDKDDDKKPKE

SEQ ID NO: 155591 - protein, 123 aa, Glycine max
  Coding DNA Sequence Number=SeqID_63906
MSNHKSIESTLKNLEVQVGQLAKQIADKASNNFVANTEKNPKEECKVVMTRSKRFMEAEDEDSVVSKKKAAEKKGTDEKKDDVGERSRSEQAREKKREKAVNEGAKVPYPVEPSKKEKDRHLA

SEQ ID NO: 155592 - protein, 34 aa, Glycine max
  Coding DNA Sequence Number=SeqID_63907
SNCFCNASVSDSVDILHRSSPFFIRSSFILRSST

SEQ ID NO: 155593 - protein, 103 aa, Glycine max
  Coding DNA Sequence Number=SeqID_63908
MLQTFTIDLLNLSCKINHNRRITTSPATDTIPGGGIVPTLDGRVLHNSSNNNNLIFRMLLAQVDPTFLHQSSNSNNNNNNSNSNNPRNNKQLRPLRNLPLKNL

SEQ ID NO: 155594 - protein, 23 aa, Glycine max
  Coding DNA Sequence Number=SeqID_63909
MMLGLPQIKPPSENFKNFVIRKA

SEQ ID NO: 155595 - protein, 54 aa, Glycine max; identical to SEQ ID NO: 101079
  Coding DNA Sequence Number=SeqID_63910

SEQ ID NO: 155596 - protein, 91 aa, Glycine max
  Coding DNA Sequence Number=SeqID_63911
MASGNRLPRVGNRLQGLKSEDRKLRWPLGNMPLVIDYQIVMAAQLIHDRVEMECLEGAWETLEGNTRCRFWGTIRFTATSLVHPDEPARTL

SEQ ID NO: 155597 - protein, 119 aa, Glycine max
  Coding DNA Sequence Number=SeqID_63912
  Gene Ontology: Mol. function=nucleic acid binding
  Homolog annotation: Hit_ID=A5AKY6; Match level="QueryCoverage=98%, HitCoverage=14%, E-value=2e-29, Identity=48%"; Hit description =Putative uncharacterized protein
MKQEEWNLLDQLALGVIRLALAKNIAFNIMNKKTTAGLMKALSDMYEKPSAANKESMQIKFEDEVKALILLSSLPDSWAATITIVSSSTRENTLKLSDIRDLILSEDIRKRDSGESSSH

SEQ ID NO: 155598 - protein, 103 aa, Glycine max
  Coding DNA Sequence Number=SeqID_63913
MVEQFNEWVAWPGTQPPLHKEDEDPATQEAAATSEKSLEATPELPAPVANTTSPQQAVDPSTPEDQTTPVLSPNTSPIATPVLHLSEEEEGQTLDTQDQSQDI

SEQ ID NO: 155599 - protein, 30 aa, Glycine max
  Coding DNA Sequence Number=SeqID_63914
MVPDAKRIFSILQCSSAPMVSPEMLNPDSS

SEQ ID NO: 155600 - protein, 76 aa, Glycine max
  Coding DNA Sequence Number=SeqID_63915
MGSNQAHAFKKRFSSSQGQVWRKEHALWCPYRSCARARVMSEIEEVQEQMKASMEAMKEQMTTMMEAMMSMRRMME

SEQ ID NO: 155601 - protein, 73 aa, Glycine max
  Coding DNA Sequence Number=SeqID_63916
MFKSIQRLTNRNEENATGFGGVDGDPGAERNEDKGYVGSDTWRYVAGVRRAWGRQVGCYCPKPSLTNPDPTRA

SEQ ID NO: 155602 - protein, 101 aa, Glycine max
  Coding DNA Sequence Number=SeqID_63917
MAPTRHPLDPDKSNRALGFPTLMTGLCQSFGVPVTPTKVIRLPITRAFIEKYCTQRQAQGNAPQAAGAPPPPHQAGPAGSFDMEQYLRHLVCQQAANHQAH

SEQ ID NO: 155603 - protein, 137 aa, Glycine max
  Coding DNA Sequence Number=SeqID_63918
MTRVNPGDLKPFDPKIDRTFHRLVRHSVHSGHSVHFEHSEHSVEGDFEYSDFEHSTTNFHTENIAQPPPRERTLREMVAPDFTYESLCEDPHKHLKEFHIVCSTMKPPDVQEDHIFLKAFPHSLDGVAKDWLYYLAL

SEQ ID NO: 155604 - protein, 64 aa, Glycine max
  Coding DNA Sequence Number=SeqID_63919
MAYGHEEPGKSEGQVVKKVVHYLQTSFPPQVQASCVAALGAQKIPKITPEQVEPPGCRNLINHE

SEQ ID NO: 155605 - protein, 130 aa, Glycine max
  Coding DNA Sequence Number=SeqID_63920
MAFLGETSSQIVVNSTFDFIFPNGSIVHNDSGVSFQASTLVHIRVPNGCDFQTLKTRIHNTLKLTDKQFLDEIYYRRSFTYADVNTMLMCNHEFSFVGPIELLCSIARTPYGILNLLQATMTPTHDALLY

SEQ ID NO: 155606 - protein, 98 aa, Glycine max
  Coding DNA Sequence Number=SeqID_63921
MLVCGWAVESLVQNEFWMFASRSQRSKCRPIHYRLPLGRIDGDPVLRETRIWATWEYVSSVGGGQQGMVGLCAHCGCGKTCCAPSPDRHLVPHVMGTP

SEQ ID NO: 155607 - protein, 225 aa, Glycine max
  Coding DNA Sequence Number=SeqID_63922
  Homolog annotation: Hit_ID=Q6WAY6; Match level="QueryCoverage=65%, HitCoverage=23%, E-value=4e-14, Identity=31%"; Hit description =Putative uncharacterized protein
MNKLGGFVCTRCDAEKEARGRIVCCLPAASRSVWLISPFRPRSQYPCPLQSYRSCAEKGRVDWDQHLAGIGGSAINWFPRWKEGKEGVLFSCGDYPNVPLIGTRGCINYNPALAIRQLGYPMRGAPTEESLSPFLVRDLGAQGLKVIQRIHKAWRSPLRKDKELRGIRNDAIGGYHRWLRIHTRGLDWLSKLKVIDEENFKAPEEDEEVRALKLELGKGETRQGE

SEQ ID NO: 155608 - protein, 149 aa, Glycine max
  Coding DNA Sequence Number=SeqID_63923
  Homolog annotation: Hit_ID=A5CBJ4; Match level="QueryCoverage=45%, HitCoverage=6%, E-value=8e-08, Identity=44%"; Hit description =Putative uncharacterized protein
CITRVNPSDLQPFDPEIDRTFHRLVRHSVHPGHSVHFEHSEHSVEGDSKYSDFEHPLLIFILRTWLNLHLVRGLLGRWLHLISLIKACAFNILMRGVAKDWLYLAPRSIFSWDDLKRVFLEKFFPVSRTTAIRKDISGIRKISGESLYE

SEQ ID NO: 155609 - protein, 131 aa, Glycine max
  Coding DNA Sequence Number=SeqID_63924
QLEVGNRGWWVYARFVDVENLLCTIARPPPSTTCDGVVPGDMSRGSGDLGDVRRAPGSQQIKGTKTTKQGGLCGGWPAVNFEFIWDVASGLKTRSGSYEGFWQQVVEASGNRLPVCVIDYIEEWVTGNRLP

SEQ ID NO: 155610 - protein, 57 aa, Glycine max
  Coding DNA Sequence Number=SeqID_63925
QTQASKINSRLGSGLLKPGLAWPITTPTYPARALDRRLQVDCARDPREGPRVLMSLR

SEQ ID NO: 155611 - protein, 160 aa, Glycine max
  Coding DNA Sequence Number=SeqID_63926
MNQKSAPVVRLYGLCSSTDHHTDLCPSVQQSEAIEQPKAYVANIYNRPPLPQQQNQPQQNNYDLSSNRYNPGWRNHPNLRWSNPSQQQQQQQQPYFQNVAGPSRPYVPPPIQQQQQQQQPQKQQTVEAPPQPSLEELVRQMTMQNMQFSKRYHSLHSELN

SEQ ID NO: 155612 - protein, 102 aa, Glycine max
  Coding DNA Sequence Number=SeqID_63927
MSLPSAVHVFSIIKCEASGDWEARYSVVFQIGSFAKRKKEEVEMRVVIAKRAGRTKSVSYLCFPLISDERPTWAFQKIPPEGCCFWRKQPGSPGRAELAWAS

SEQ ID NO: 155613 - protein, 78 aa, Glycine max
  Coding DNA Sequence Number=SeqID_63928
MKPCLKLCFYRNKCRTMVTSKENERPNFETIQRLTKTAQHFYRGSSMLLPQEASLRGFLKKLSRGFFEKLSQEASLRS

SEQ ID NO: 155614 - protein, 58 aa, Glycine max
  Coding DNA Sequence Number=SeqID_63929
MTDSPCVILFHIISSIMKPMGKVEMTEAMIISVGIVVSKLGETDDASIRAFRSWQMKN

SEQ ID NO: 155615 - protein, 74 aa, Glycine max
  Coding DNA Sequence Number=SeqID_63930
MGRVNLGLNVTMVVIKCLCIVGYGKGSRYWVLDIFWQIPTVKMYTYVLGTSSKIFESIQRLTYRNEENVTGVFE

SEQ ID NO: 155616 - protein, 109 aa, Glycine max
  Coding DNA Sequence Number=SeqID_63931
GCAHKTHSGLGGAQQVPECPALVTSLCQSPPARSYHHDIGIAPVRQPVDPKKSNRVLRFPALITSLCQFYEAPVTPNKVIRPPINRAFIKKYYAPGQARGEIPQLPGDG

SEQ ID NO: 155617 - protein, 168 aa, Glycine max
  Coding DNA Sequence Number=SeqID_63932
MDEAEEVQEKMKADMEAMKEQMATMMEAMMSMKKIMEANAVIVAATSAVAKVNPMLPSGLKQMNHPTSNMVGKDLGSTDDPMMCKFKTSTPSHPMACLPTIHHPMWHTLSMKISITPLRYSLRTNKPHQAHISQTMGETHEIPHHNLADFEPWLGYATEGQAVGGYTL

SEQ ID NO: 155618 - protein, 66 aa, Glycine max
  Coding DNA Sequence Number=SeqID_63933
  Subcellular localization annotation: CTP_CleavageSite=44; ConfidenceScore=5.33e-01
MTLSLAHQWAKHASTAKRSFNATEESGRASSSRPCAKREINALSAAIVFSQAQRTTDTKLKSTYSR

SEQ ID NO: 155619 - protein, 129 aa, Glycine max
  Coding DNA Sequence Number=SeqID_63934
MAIMMEAKISIKKIMEVNAVAIAATSTIAKVNLTPPSGLNQMNHPTSDMVGKDLGSTGNPHFVQVQNKHAFLSYGLPLNYTPPNENVNNSTPILIESQQPQFDHARVSQPMGGCSNPTSASDCASSIKW

SEQ ID NO: 155620 - protein, 64 aa, Glycine max
  Coding DNA Sequence Number=SeqID_63935
MSLHVLYLYAFSGFPPGISCLLYLSLQSFKEMNMDSRLLVLTGQDHLGLPSGVETKHERAENQS

SEQ ID NO: 155621 - protein, 26 aa, Glycine max
  Coding DNA Sequence Number=SeqID_63936
MAVQQIRDRVEIECLEGAWKTLEGNT

SEQ ID NO: 155622 - protein, 117 aa, Glycine max
  Coding DNA Sequence Number=SeqID_63937
MTRGNPSDLQPFDPEIDRTFHRLVRHHFVPFEHPKHSIIGEFEHFVVYNFEHPDFEHYSFEHSENMAHPPPRERTLREMVAPDFTYESLCIQYPDEDVPYVLKIGLIHLLPKFHGLA

SEQ ID NO: 155623 - protein, 313 aa, Glycine max
  Coding DNA Sequence Number=SeqID_63938
  Gene Ontology: Mol. function=pyruvate dehydrogenase (acetyl -transferring) activity; Cellular component=integral to membrane; Biological process=metabolic process
  Homolog annotation: Hit_ID=A3J2D0; Match level="QueryCoverage=40%, HitCoverage=39%, E-value=3e-46, Identity=70%"; Hit description =Pyruvate dehydrogenase E1 component
  Pfam annotation: Domain name=Transketolase_C; Domain location=1-120; Score=174.7; E_value=2.4e-49; Accession=PF02780.11; Description =Transketolase, C-terminal domain
IPKKEGKDVTLVSFGKIMKVAIQAAEDLAKEGISVEVIDLRTIRPLDYDAILNSVKKTNRLVILEEAWPFASISSEIAYMVQQKAFDYLDAPIKRITTPDAPAPYSAALFAEWFPKLEKVKEEIKNALFALLKLADMSEVTEGGHHFDLKKLSFVGVIVSLGIVFGDIGTSPLYVMKAIVNARKDGAAMPFDEYIEGALSCIIWTLTLQTTIKYVIIALRADNKGEGGILALYSLVKKLKKKWLYVVAIIGAATLVADSVITPSLTVMSAIEGLKIYNPETPVVLITLVILFVVFVVQQFGTASIGKFFGPVM

SEQ ID NO: 155624 - protein, 192 aa, Glycine max
  Coding DNA Sequence Number=SeqID_63939
MERSMIDAASGGTLGDMTPVEARNLIEKIASNSQQFSARNDAIVVRGAHEVATNSSSSSETKKLEGKLDALVNLQSGAIEQPKAYAANIYNRPPQLQQQNKPQQNNYDLSSNRYNPRWRNHPNLRWSSPQQQQQQPASSFQNAAGPSRAYVPPPVQQQQQQHQLRQQSTVEAPSQPSLEELVRQMTIQNMQF

SEQ ID NO: 155625 - protein, 99 aa, Glycine max
  Coding DNA Sequence Number=SeqID_63940
QMEVGNRGWRVYARFVDVKNLLCTIDRTANLVPPVMEWYLEICRGGQETLGTSGGVLLPKTKLDQSRPNPGIVGNWELMEASGNRLPACVIDYTEEWVT

SEQ ID NO: 155626 - protein, 106 aa, Glycine max
  Coding DNA Sequence Number=SeqID_63941
  Pfam annotation: Domain name=zf-CCHC; Domain location=53-70; Score =15.0; E_value=0.0083; Accession=PF00098.14; Description=Zinc knuckle
MATQEEEEEEEYDDKEDFSVFVKKFHKFVKNRRMERRHNFNNGKRSQEGSPTLKCYKCNQPGHINAHYPTNESWPEKNEKKSHEERRSKKAYIAWDDNDSSNDSEK

SEQ ID NO: 155627 - protein, 301 aa, Glycine max
  Coding DNA Sequence Number=SeqID_63942
MEFDNHRFRSAEHQQRFDTIKGWSFHRERCVQLREDKYPDFQEEIARRRWERLVTPMAKFDLEIVIEFYANAWPTEEGVRDMHSRVRGHWIPFDADALSQFLGDPLILEENQQCEFSQRRNQADGFDEEAIAWLLCILGQDFTRTPAWRRVWIMRTSMTTLTQIWMTLLLSNVLPSDHNSDLPLPKCQLVYAILTRMSVHVAQVIADAIYLFAGMAPTRHPLDPEKFNMALGFPTLITGLCQFYGVHVAPNKVIQPPITRAFIEKYCTPRQVQGDAHQAASAPPPPRQANSAGPLSVEHYL

SEQ ID NO: 155628 - protein, 44 aa, Glycine max
  Coding DNA Sequence Number=SeqID_63943
MRECGFYVMYWISRIILGGFKDNWETILMMSRRIKNLLEKGGEM

SEQ ID NO: 155629 - protein, 191 aa, Glycine max
  Coding DNA Sequence Number=SeqID_63944
NWELMEASGNRLPACVIDYTEEWVTGCVIDYQRWKALKYPFYLPVVIVMAAQLIRDRVEVECLEGAWETLEGNTRCQFRGTIRFTTTSLVHPDEPARTLQCTMEWILPTPTPYRLVEPVQVIEVTSSEEDPEEDLEELPPEPAVDALDFLEGDEDPFLEVYSPEEVMSASEADSTEDGGPGEMAISGGSSS

SEQ ID NO: 155630 - protein, 167 aa, Glycine max
  Coding DNA Sequence Number=SeqID_63945
VKLPAFIVDHRVVPGDMSRGSGDLGDVRWGAIAQNQAWPIPTQPGHSRSVRTCDVPKQASSWQSTDKRNKDHKARRLKNEDRRVKMVSGNRFTQRGCNRLPGFENEIQEAMRGFSQQVVETSGNRFPVCVIDYTEEWVIGNRLPEMKSLKIPLLLECNGYEKHCVAA

SEQ ID NO: 155631 - protein, 45 aa, Glycine max
  Coding DNA Sequence Number=SeqID_63946
MPMLNQFHPFIHDFIENIIDVKANNNCGYCAIVALLGMGEDSWSL

SEQ ID NO: 155632 - protein, 220 aa, Glycine max
  Coding DNA Sequence Number=SeqID_63947
LRATKEVEVEALEEGEEVQALRKKLEKAQAVKEKFKSAIVRIRKENAELRGVNIATTKALEQETKRARKEEHGRNKFRGALWGSNSKLKLQREERDQSRIDGMILKDELKTFLKSKRSLSQRLSETETNMLAIISKYKEELDLATAHEHGVADEYARVYAEKEARGRVIDSLHLEATMWMDRFALTLNGSQDLTRLLAKAKAMADAYSAPEEIHGLLSYC

SEQ ID NO: 155633 - protein, 300 aa, Glycine max
  Coding DNA Sequence Number=SeqID_63948
MASKKLSIKWSRRDAHGEGSNAPVEFDSHRFRSVEHQQHFEAIKGWSFHRERRVQLREDEYSDFQEEIARKHWTPLVTPMAKFDPEIVLEFYANAWPTEEGVRDMRSWVRRRTSSVSSVRGGTRPLALTRRPSPSCYAYRGSTLPGPLRGAISCLATIILTSLCLSASWWTTPTRYPLDPEKSNRALGFPALITGLCQFYRVPVTPSKQVTNHHGQVQLHECFYRFSLSQRGQRSIPFVCPTPEQFGAEVAWPRDWPIEEGTGPAGSPGEAAEAHMDEDMTDLLSYLGEGGATRPRSLHL

SEQ ID NO: 155634 - protein, 253 aa, Glycine max
  Coding DNA Sequence Number=SeqID_63949
  Homolog annotation: Hit_ID=Q2AA09; Match level="QueryCoverage=62%, HitCoverage=50%, E-value=2e-07, Identity=29%"; Hit description =Retrotransposon gag protein
MERSMIDAASGGALGDMTPAEARNLIEKMASNSQHFSARNDAIVIRGVHEVATNSAASSETKKLEGKLDALVNLVTQLALNQKFVPVVRVCGLCSSADHHTDLCPSMQQPGAIEQPEAYAANIYNRPPQPQQQNQPQQNNYDLSSNKYNPGWRNHPNLRWSSPQQQQQQPAPSFQNVVGPSRPYIPPPIQQQQQPQKQPTVEAPPQPSLEELVRQNDHAEHAVSTRDQSLHLELNQSDGTIGYTIKSTTVPEF

SEQ ID NO: 155635 - protein, 232 aa, Glycine max
  Coding DNA Sequence Number=SeqID_63950
  Gene Ontology: Mol. function=RNA-directed DNA polymerase activity; Biological process=RNA-dependent DNA replication
  Homolog annotation: Hit_ID=Q0ZCD0; Match level="QueryCoverage=77%, HitCoverage=15%, E-value=1e-08, Identity=24%"; Hit description =Integrase
MERSMIDASSGGALGDMTPAKARNLIEMMASNSQQFSAKSDAIVIRGVHEVATNSSSSAETKKLEGKLDALVNLVTQLVVIQKSAPIARLCGLCSSVDHHTGLCPSVQQSEAIEQAEAYAANIYNRPSQPQQQNQPQQNNYDLSNNRYNPGWRNHPNLRWLNPSQQQQQQPYFQNAAGPSRPYVPPPIQLQQQQQPQKQQTVEAPLQPSLEELVRQITMQNMQFQQETRAFI

SEQ ID NO: 155636 - protein, 85 aa, Glycine max
  Coding DNA Sequence Number=SeqID_63951
MRNALGNGSFVHTPDIVSKIPTVRSWTRNNQYENTGKVIKGVPMNPKKNKGVEERSPEYEEPQDLRSNPFQGGGNDAILPRKGIG

SEQ ID NO: 155637 - protein, 116 aa, Glycine max
  Coding DNA Sequence Number=SeqID_63952
MEVGNRGWWVYARIVDVENLLCTIARPPPSTTCDGVVPGDMSRGSGDLGDVRRAPGSQQIKGTKTTKQGGLWWLASCEFCVIYDYGLWLENEVRKLRKPLVIDYQGRNRSLVIDYQ

SEQ ID NO: 155638 - protein, 34 aa, Glycine max
  Coding DNA Sequence Number=SeqID_63953
MKGQIRVSSLPKPQAKMEDSASVEGFLSKVLGTL

SEQ ID NO: 155639 - protein, 60 aa, Glycine max
  Coding DNA Sequence Number=SeqID_63954
MPKDRGTCLDFRDCHHQKGGDCRQRIKLNVLMMPKDHMLLKALFKTKKLKIFKMDDQDSL

SEQ ID NO: 155640 - protein, 59 aa, Glycine max
  Coding DNA Sequence Number=SeqID_63955
  Subcellular localization annotation: CTP_CleavageSite=36; ConfidenceScore=5.04e-01
MVHDIFVKVKLEVTRTSTILNVFGSRRSSDRKMQGSCMSKRENKRYAVCRTKSMLNAYA

SEQ ID NO: 155641 - protein, 143 aa, Glycine max
  Coding DNA Sequence Number=SeqID_63956
MVHESFSIRGFSTPFWKWPRGNSPQRDPGRIRRPNGTSSAPEYDSHHFRSVEHQQRFEAIKGWSFLRERRVQLRDDEYTDFQEEISRRRWASLVTPMAKFDPEIVLEFYANAWPTEEGVRDMGSWVRGQWIPFDAGAIGQLLG

SEQ ID NO: 155642 - protein, 61 aa, Glycine max
  Coding DNA Sequence Number=SeqID_63957
MRWWRCACCPLSAIPKLLWCLALRLPGGAVLLDESPVNRGPNDLVGAEGRFVELTKARNQS

SEQ ID NO: 155643 - protein, 176 aa, Glycine max
  Coding DNA Sequence Number=SeqID_63958
MNQKSAPVARVCGLCSSADHHTGLCPSLQQSGVNEQHEAYAANIYNRPPQQQNQQHQNNYDLSSNRYNPGWRNHPNLTWASPPQQQQPIPPFQNVAGPSKPYVPSPIQQQQSQQRQQAAEAPSQPSLEELVRQMTIQNMQFQQETRASIQSVTNQMGQMATQLNQAQYQNSDKIPS

SEQ ID NO: 155644 - protein, 184 aa, Glycine max
  Coding DNA Sequence Number=SeqID_63959
  Homolog annotation: Hit_ID=Q2HW90; Match level="QueryCoverage=91%, HitCoverage=33%, E-value=4e-16, Identity=30%"; Hit description =Putative uncharacterized protein
MEVIGQLQRQAFRKADGKIWDLAMVEVSTEAIASLAQYYDKPLRCFTFGDFQLSPMVEEFEEILGCPLGGRRPYFFSGFYPSLARISKIVQISAQELDHRKQVENGVVGIPRKYLKAKARILAGKGKWAPFIDILTLLIFRGVLFLNVDRLVDLAAIDAFLAYHDHKESPVVAMLANLYDTFDR

SEQ ID NO: 155645 - protein, 92 aa, Glycine max
  Coding DNA Sequence Number=SeqID_63960
MGIAPTKIPSGPEEVQHGPGVSQSGYGPLSALQGARSPPASSCRRGIGIVPARHLVDPKKANRVLELQALITGLSQFYGVPVTSSNGIRPPY

SEQ ID NO: 155646 - protein, 104 aa, Glycine max
  Coding DNA Sequence Number=SeqID_63961
LGRIDGDPVLRETRIWATWEYVNSVGGGQQGMGELPAFIVDHKVVPGDMSRGSGDLGDVRRAPGSQQIKGKQDHKARRLVVAGQLLENEVRKLGKPLVIDYQPV

SEQ ID NO: 155647 - protein, 17 aa, Glycine max
  Coding DNA Sequence Number=SeqID_63962
MADQQATKSKAKGSKIP

SEQ ID NO: 155648 - protein, 90 aa, Glycine max
  Coding DNA Sequence Number=SeqID_63963
MLLSSNVIHICVRVVMLVRMIRTRLFAAARVKSCLGMHSSCVIASLSGCIRTVGAFQYQGVAQEKELIKGNYWPLNWERKSRLSIKGRGP

SEQ ID NO: 155649 - protein, 291 aa, Glycine max
  Coding DNA Sequence Number=SeqID_63964
  Homolog annotation: Hit_ID=Q84VI1; Match level="QueryCoverage=100%, HitCoverage=40%, E-value=1e-104, Identity=73%"; Hit description =Envelope-like protein
MATSPKETSAPGSPSVPSSPHQEQPEFNIQPIQIIPGQASVPEKLVPRRQQGVKIAENPSLATSPREVDTEMDKKIRSIVSSILKDASVPDAEKDVPTSSTPDVAVPEADEDVPTSSTPNVSVPDVEKDVPTSSTPNAEVLPSPSEEESTEEEDQASEETPAPRAPEPAPGDLIDLEEVESDEEPIANRLAPGIAERLQSRKGKTPIKRSGRIKTMAQKKSTPITPTTFRRSKVAIPSKKRKEISSSDSDDDVELDVSTSKRAKKSGKKVPENVPDAPLDNISFHSIGNVE

SEQ ID NO: 155650 - protein, 129 aa, Glycine max
  Coding DNA Sequence Number=SeqID_63965
MGETHEIPHHNLADFEPWLGYATEGQAVGGIPFENTLEGPQFRPQPQPLHFAVGRAPPAMAEKGKADHLKERLRAIEGGMQLQNICKKGDGSFKEHAQKVEGSGGPGGTPNDGKGDDDRDGRHIIDTLL

SEQ ID NO: 155651 - protein, 65 aa, Glycine max
  Coding DNA Sequence Number=SeqID_63966
MDGQAKVEYVKRLYDQAKTKWRRMKAQVEKDKAPEWRWMKAQVEKDEGLEAETLPRLLIVAEGPD

SEQ ID NO: 155652 - protein, 119 aa, Glycine max
  Coding DNA Sequence Number=SeqID_63967
  Homolog annotation: Hit_ID=Q6VPQ1; Match level="QueryCoverage=38%, HitCoverage=10%, E-value=6e-07, Identity=45%"; Hit description =Putative gag-pol polyprotein
MAEAGDGGGDYHQLDRSQRLLLDVMTTQMQQLLNCNNEELYRRIKGLEHQMNPNAERPYGRNRRVNNGPNRIEGQDRIEGVKLSVPPFKGRSDPNAYLDWEMKIQHAFSYNDYPEEHKM

SEQ ID NO: 155653 - protein, 218 aa, Glycine max
  Coding DNA Sequence Number=SeqID_63968
MGQLQWQAFRKAYGKIWDLARDFQLVPTVKEFEEIQGCPLGGWKSYLFSGFYPSTTRVAKRVDAFLAFHHGKESPVVAILAMYDTFDRGGEKSGARIVCCALALYVWLVSHLFLQEGRKNQDSIFIRRMSKCSLDGTRGCINYNLVLAIRQLGYPMRGVPSDESITPFIARGFSDHNARDRELRGSSNGIIDGYHKWLRVRTQGLDWLPNLKTVRDDE

SEQ ID NO: 155654 - protein, 116 aa, Glycine max
  Coding DNA Sequence Number=SeqID_63969
  Subcellular localization annotation: CTP_CleavageSite=53; ConfidenceScore=5.65e-01
MNPSFLNKGSPPIKGIPLKAKGSQRNLPFLTCMVTNCRNVPFAGERGRGSRVRFSKEERCAELPPTFICGKRRKNRRKSVKIKILSSGVVFTFEKGRQKRDFCSYVPSFGEEIRPA

SEQ ID NO: 155655 - protein, 92 aa, Glycine max
  Coding DNA Sequence Number=SeqID_63970
MASRKRKAPSTLTQARFDRSRFTSQEAYERYTDIVVPRKLLPERNVVVYYTEFDELKEELERRHLDEELTDFVDNNIDVAIVKEFYANLYDP

SEQ ID NO: 155656 - protein, 240 aa, Glycine max
  Coding DNA Sequence Number=SeqID_63971
MFAFAENGPEELASKRSSKDKAAEGTSSAPEYDSHRFRSVVHQQRFEAIKGWSFLRERHVQLRDDEYTDFQEEIGRRRWTSLVTPMAKFDPEIVLEFYANAWPTEEGVRDMRSWVRGQWIPFDADAISQLLGYPLVLEEGQECEYGQRRNRSDGFDEEAIAQLLCIPGQDFARTAAGRRVRIMRTNMTTLTQIWMTLLLSNILPSDHNSDLPLPKCQLVWRLPGTLWTQISPTGPWDFPR

SEQ ID NO: 155657 - protein, 53 aa, Glycine max
  Coding DNA Sequence Number=SeqID_63972
MTKRSKMFKIESRTLQGSRGNLISRIKNQDSRFKLPRIKIKIQDSRFKNQEKT

SEQ ID NO: 155658 - protein, 25 aa, Glycine max
  Coding DNA Sequence Number=SeqID_63973
AYVESTSKDEKESSSDAMRNPRGSS

SEQ ID NO: 155659 - protein, 319 aa, Glycine max
  Coding DNA Sequence Number=SeqID_63974
VLFPNMEGLVDLAVIDAFLAFHHGKESPVVAILAMYDTFDRGCEKSGARIVCCALALYVWLVSHLFLQEGRPVYPLQGRKNQDSIFMRRMSKCSLDGTRGCINYNPILAIRQLGYPMRGVPSDESITPFIARGFSDPNARDRELRGSSNGIIGGYHKWLRVRTQGLDWLPNLKTVRDDEVKASEESDEVQALRQSLKEPGAAIVGSSSEEVKGIITGQRHDLEGRAKGNMWAIIDKCKEKLNLAATHEQRLEDEYAKISAEREARERVIDSLHQEATMWMDRFALTLNGSQELPRLLAKAKAMADTYSAPEEIHGLLGY

SEQ ID NO: 155660 - protein, 66 aa, Glycine max
  Coding DNA Sequence Number=SeqID_63975
MAFGNRLPRVGFKGNWSTVEASGNRLPVCVIDYTEEWVTGNRLPGFPILKLCDSSLASSNRLPKAV

SEQ ID NO: 155661 - protein, 73 aa, Glycine max
  Coding DNA Sequence Number=SeqID_63976
HRLAEFRSNLMQSYSARALGRRLQVDWARDPRKGLRVLMSLRVSLAIRELLKEVFSKKLLKEVFSRKLLKEAT

SEQ ID NO: 155662 - protein, 187 aa, Glycine max
  Coding DNA Sequence Number=SeqID_63977
MGYVGVRELSWRWATGDGGFMRDLWMWKNLLCTIARPPPSTTCDGVVPGDISRGSGDLGDVRRAPGSQQIKGTKTTKPRKLMWWLGSCESCVIYGLWPLVIDYQGWEARGASGNRLPGDVIDYQASKGNWKTVEASGNRLPVYVIDYTEEWVTEMKSLKIVMAAQLIHDRVEMECLEGAWETLEGNA

SEQ ID NO: 155663 - protein, 110 aa, Glycine max
  Coding DNA Sequence Number=SeqID_63978
MLLSSNVIYICVRVVMLVRMIRTRLFAAARVKSCPGMHSSRVIASLSGCARIVGPPPISGGAPGTVKRKLLRTLNSLKVRMWSTLKMRTRSPLKVRAWSPLKARMCSPLL

SEQ ID NO: 155664 - protein, 118 aa, Glycine max
  Coding DNA Sequence Number=SeqID_63979
SMMIGGGITWMFWKLGRIDGDPTLRGTRIRATWEYVSSVGGEQQGMVGYTVVPRDMSRGLGDLGDVRRAPSSQQIKGTKTTKQGGLCGGWPAEAKMVFGNRLPRECNRLLGLKTRSGS

SEQ ID NO: 155665 - protein, 70 aa, Glycine max
  Coding DNA Sequence Number=SeqID_63980
MARNPRQDFSVSKLHTKLQPLAIILPQIVKGEHFRGREVRGYEWDFEISGLGGLLSLLIFVGMGFGRYDG

SEQ ID NO: 155666 - protein, 87 aa, Glycine max
  Coding DNA Sequence Number=SeqID_63981
MRVQIATRPTWALQKAVASGGSNPARLGELGGNHLPYFAINRGGSEEEKAEALPKRFRNVSVRNFAKVSTVLRRSSFVLHRSSIFNE

SEQ ID NO: 155667 - protein, 65 aa, Glycine max
  Coding DNA Sequence Number=SeqID_63982
MNETTNLTKSANPHNHENAGEGRANRKQLKNPTSRTKLPIHSKDYLDKSEIGSTRNPERSSHQIL

SEQ ID NO: 155668 - protein, 185 aa, Glycine max
  Coding DNA Sequence Number=SeqID_63983
MGHWFHVLRLCNSSLASGNRLPRLCNRLPEIKSLRISLLLIVMAAQLIHDRVEMECLEGAWETLEGNTRCRFRGTIRFTATSLVHLDEPVRTLQRTMEWILPTPTPYRLVEPVQVIEATSSEEDPEEDPEELPPEPAVDALDFLEGDEDPLPEVDSPEEVMSASEADSTEDSGPGEMAISRGSSS

SEQ ID NO: 155669 - protein, 35 aa, Glycine max
  Coding DNA Sequence Number=SeqID_63984
MSQHLYYIVVDSCFERIDEGPQTKSKAATRLIVVK

SEQ ID NO: 155670 - protein, 293 aa, Glycine max
  Coding DNA Sequence Number=SeqID_63985
MRSWVRGQWIPFDADALSQFLGDPLVLEEGQECEYSQRRNRADGFDEEAIAQLLCIPGQDFARTAAGRWVRIMRTGMTTLTQTWMTLLLSNILPSNHNSDLPLPKCQLVYAILTRMSVHVAQLIADAIYLFAVTPSKVIRPPITRAFIEKYCTPRQAQGDDAPQAADAPPPPHQADPAGSFGMERYFQHLVRQQAANHRGQVQIHECLYQLSLSQQSQGFAPFACPTPDQFRAEVAWPGDWPEDQTEEALAGAPDGAEDARMDEEMTRFLGRKRSHVTEVTAFFDISVFFRFV

SEQ ID NO: 155671 - protein, 101 aa, Glycine max
  Coding DNA Sequence Number=SeqID_63986
MREEPACTLQRTVEWILPTPTPYRLVEPVQVIEVSSSKEDPEEDPEELPPEPVVDALDFPEGDEDALPNVDSPKDVMSAFEADSMEESGPRGIATSGDSSS

SEQ ID NO: 155672 - protein, 45 aa, Glycine max
  Coding DNA Sequence Number=SeqID_63987
MEENVKLKVNGGNKPWNEELHHQESALDKKLREKASMEEKNERGA

SEQ ID NO: 155673 - protein, 172 aa, Glycine max
  Coding DNA Sequence Number=SeqID_63988
  Pfam annotation: Domain name=G-patch; Domain location=38-82; Score =12.2; E_value=0.0063; Accession=PF01585.14; Description=G-patch domain
MPYVEAVEESLETSFQALEVVSNAYVESSPVQPCSSDAALMVARVMLRHGYEPKRGLGRNGNGVVSLVVFKGNHGRFELGYKTTRADVRRSALERRGRSMGQLHGPQVKGISLCHISESFISVGWMCEGWVAMIHDEVPQEQSNWVRPCPPEFELGNWQIVEQPGIFVANIM

SEQ ID NO: 155674 - protein, 121 aa, Glycine max
  Coding DNA Sequence Number=SeqID_63989
QSGAIEQPEAYAANIYNRPPQPQQQNQPQQNNYDLSSNKYNPEWRNHPNLRWSSPRPQQQQPAPSFQNATGPSRPYVPPPVQQQQQQQQHQQRQQSTTKAPPQPSLEELVRQMTIQNMQFQ

SEQ ID NO: 155675 - protein, 114 aa, Glycine max
  Coding DNA Sequence Number=SeqID_63990
MDNEDGVQEQMKADLSALKDQMAYIMEAMLKIQKTIEDNATAAASTTIREAEPVLQPAINLGQDRNTIVFNRRYSPQAYPYGLSPDFTPRSPPDDLSQAPTFEGQLPPHADYPL

SEQ ID NO: 155676 - protein, 122 aa, Glycine max
  Coding DNA Sequence Number=SeqID_63991
MSRGSGDLGDVRWGAIAQNQAWPIPTQPEHSQSMRTYDVPKQASSWQSTNKRTKSTKQGGLCGGWLAMYLGWYLKISLWALVIDYQLCVIDYIVLPATGNRLPFMCNRLHSVTCRFQCAKAE

SEQ ID NO: 155677 - protein, 111 aa, Glycine max
  Coding DNA Sequence Number=SeqID_63992
MWMDRFALDLEWKSRPPASISQSKSHGRSVNFIITKKAQKHPYNTRSRKMDNEEGVQEQMKADLSALKDQMASISEVMLKLQKTIEDKATATASNTAREAEPMLQPALNLG

SEQ ID NO: 155678 - protein, 78 aa, Glycine max
  Coding DNA Sequence Number=SeqID_63993
MSEEVDMNFEDEQHFGVNEGHVDCSDTFNTSQWARTVVHENGAVSTSVGRNNLFEETLALGNVVVPSRFMGNQCIEEK

SEQ ID NO: 155679 - protein, 155 aa, Glycine max
  Coding DNA Sequence Number=SeqID_63994
MGCINYNPILAIRQLGYPMRGVPSEEIIAPFIAQDFSEGNAKMLQRVRKAWNAVERKDKKLKGSGNGVISGCHKWLKARTQGITWIPKLKISSGKEAEVPKESKEVQALKEKLERTRVVKEKFKMTATRVRKEYDELRDVNMAMAEALERETKRA

SEQ ID NO: 155680 - protein, 140 aa, Glycine max
  Coding DNA Sequence Number=SeqID_63995
NFLPCPVLLDCDSLCCLNVVLLGCCGSLGGLMGTRGWWVYARIVDVENLLCTIARPPPSTTCDGVVPGDMSRGSGDLGDVRRAPGSQQIKGTKTTKQGGLWWLASYEFCVICVVWPLVIDYQGLENEVRKLGKPLVIDYQ

SEQ ID NO: 155681 - protein, 76 aa, Glycine max
  Coding DNA Sequence Number=SeqID_63996
MGCSSSIAGSDGIVYSDIGARDGSGMGSGEVSQRALLRASEGEAHGCAFQRRKGARSRHQRLFVENVEKTEGNRSK

SEQ ID NO: 155682 - protein, 16 aa, Glycine max
  Coding DNA Sequence Number=SeqID_63997
MASPLTSSPLSSIASH

SEQ ID NO: 155683 - protein, 80 aa, Glycine max
  Coding DNA Sequence Number=SeqID_63998
MTEHILSFKRVVERKRSCYQIAIRRYEITESLLSLDSARYSPSVDEVVSFLAVNVPPILMAHYWRSSQLVRLFPLELYLY

SEQ ID NO: 155684 - protein, 193 aa, Glycine max
  Coding DNA Sequence Number=SeqID_63999
MGDQEETQEQMKADMSALKEQMASMMKAMLGMRQLMEKNVATAAAFSSAAEADPTLLATAHHPPSNIVGRGRDTLRHDGNPHLGYNRAAYPYGLPPNYSPPVLQDDAGHIASPVLEREPPQQPDEVHKDPQDYARRDDRPRTTEERRKLDLLEERLRAVEGFGDYPFADMTDLCLVPDVVIPPKVQSTGLRQV

SEQ ID NO: 155685 - protein, 105 aa, Glycine max
  Coding DNA Sequence Number=SeqID_64000
MFPVINQSALKRVNEHGEEREELGGAGGSPEVSWRHCPAAVVVEVELFLFLDDSAIWSIFCRFYSVGFRDEGCRKGEREEEGAVQGKRKSSICRHGRAVIDYSSW

SEQ ID NO: 155686 - protein, 86 aa, Glycine max
  Coding DNA Sequence Number=SeqID_64001
VFCLCPVLLGLLVCDDLDVELPGCWGKLGRIDGDPVLRETKIWATWEYVSSVGGGQQGMETLGTSGGVLLPKTKLDQSRPNPGIVS

SEQ ID NO: 155687 - protein, 51 aa, Glycine max
  Coding DNA Sequence Number=SeqID_64002
MEALGPQLLAVSGVVAVVGFGGGMLLLLLLRAGPSEVRVIPPSRVVSVAGK

SEQ ID NO: 155688 - protein, 219 aa, Glycine max
  Coding DNA Sequence Number=SeqID_64003
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=88%, HitCoverage=18%, E-value=1e-106, Identity=100%"; Hit description=DNA- directed RNA polymerase subunit beta
  Pfam annotation: Domain name=RNA_pol_Rpb2_6; Domain location=67-219; Score=-193.3; E_value=0.0079; Accession=PF00562.19; Description=RNA polymerase Rpb2, domain 6
MVRGTICGAIRHKLIPTPQNLQQEILLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERL

SEQ ID NO: 155689 - protein, 89 aa, Glycine max
  Coding DNA Sequence Number=SeqID_64004
MLWKLGWIDADPVLRGTRIRATWEYVSSVEGGQLGMVDLCVICGCGESTCTIARSTPSTTYDGVVPGDMSRGSGDLGDVRWGAIAQNQA

SEQ ID NO: 155690 - protein, 175 aa, Glycine max
  Coding DNA Sequence Number=SeqID_64005
VKLPAFIVDHRVVPGDMSRGSGDLGDVRRAPGSQQIKETKTTKQGGLWWLASCEFCVICGLWPLVIDYQGLEKRSQETMGAPGNRLPACVIDYTEGWVTGNRLPEIVMAAQLIRDRVEMECLEGVWETLEGNTRCRFRGTIRFTATSLVHPDEPARTLQRTVEWTAPWISFVYFE

SEQ ID NO: 155691 - protein, 270 aa, Glycine max
  Coding DNA Sequence Number=SeqID_64006
MVLKEELAACSRSKKSLAQHLEATEQSILAIIGRYKEELNQSLTHEQKLVEDFAQAYAEKEARGRVIDALHQEATMWMDRFALTLNGSQDLPRLLAKARAMAEGVQEQMKADMSTLKDQMASIMKAMLKIQKSIEDNAAAASSNTIREAEPVLQPALNLGRDRSATSFNRRYSPQAYPYGLPLDFTYRTDPDDLSQAPTFERQLLPHANYPLQKDDEGDAHLGPLLPPREPTPHEFPQPNIIRHAPSQSAPVKELIPISKDKGKIDLLEE

SEQ ID NO: 155692 - protein, 95 aa, Glycine max
  Coding DNA Sequence Number=SeqID_64007
MENESSEATIPEPFDIEEEAEEAQVRHVAATTPERSLEATLEPSTLVVNLPSPHPTAELFTPLLQMPEDPTTPVLTVDTSPPATPVLQLTDEEDG

SEQ ID NO: 155693 - protein, 114 aa, Glycine max
  Coding DNA Sequence Number=SeqID_64008
MVGYTPSSFTDLVFASERIDVGPKRGKFDHPTRTTEKAGANEEARKPVEFTPIPVSYADLLPYLLDNSMVAITLAKVHQPPFLGEYDSNAMCACHGEAPGRSIEHCRALKRKVQ

SEQ ID NO: 155694 - protein, 148 aa, Glycine max
  Coding DNA Sequence Number=SeqID_64009
MSGFTCDSPQISASPHQLDLAPYASEPYNAQWNAPGLLRDKHTLRSSRILGEMEVDEPWLGLWLPLNYQVDMGSSLAYDNGIWDFVVDLGMAFVDNWVVGHSMGFSLFLTLFICPSFLSRPSRMIKFASFRTHIDPFTGEDQIRKALR

SEQ ID NO: 155695 - protein, 60 aa, Glycine max
  Coding DNA Sequence Number=SeqID_64010
MSGKAIREILVRWLDDLRQNNKEEVKQKLRRMKPETSLKIKEEVKKKFDIDFLAVARYPE

SEQ ID NO: 155696 - protein, 106 aa, Glycine max
  Coding DNA Sequence Number=SeqID_64011
MDCLEGAWETLEGNVRCRFRGTIRFTATSLVHPDESACTLQRTVEWILPTPTPYRLVEPVQVIEVTSSEEDPKEDLEELPPEPAVDALDFLEGDEDPLPEVDSPEE

SEQ ID NO: 155697 - protein, 22 aa, Glycine max
  Coding DNA Sequence Number=SeqID_64012
VSILFFKTFKSVSMLVNVPVDY

SEQ ID NO: 155698 - protein, 50 aa, Glycine max
  Coding DNA Sequence Number=SeqID_64013
MTNFLGLNKVGLGIKWMNGMVKTNKVEDEMVEGKNHSFQRGQHTKDVKDL

SEQ ID NO: 155699 - protein, 181 aa, Glycine max
  Coding DNA Sequence Number=SeqID_64014
  Homolog annotation: Hit_ID=Q6WAY4; Match level="QueryCoverage=95%, HitCoverage=30%, E-value=6e-20, Identity=34%"; Hit description =Putative uncharacterized protein
MGQLQRQAFRKAYGKIWDLAMVEVSTEAIASLAQYYDQSLRCFTFGDFQLSPMVEEFEEILGCPLGGKRPYLFSRFYLSLARISKIVQISAQELDHRKQVENGVVGIPRKYLEAKARILAGKGEWAPFIDILTPLIFGGVLFPNVDELVDLAAINAFLAYDNHKESPVVAMLADLYDTFDR

SEQ ID NO: 155700 - protein, 129 aa, Glycine max
  Coding DNA Sequence Number=SeqID_64015
KLGRIDGDPVLRETRIWATWKYVSSVGGGQQGMVGLCTLCGCGNLLCTIARPPPSTTLVPGDMSRGSGDLGDVRRAPGSQQIKGTKTIKQGGLCGGWQTVNLVVEASGNRLPVCVIDYTEEWVTGNRLP

SEQ ID NO: 155701 - protein, 125 aa, Glycine max
  Coding DNA Sequence Number=SeqID_64016
GNGLHPIPGKVENPGESLETSDSSFQNCPIAQWNAPGLLHDMHMVAFEWYPQKTGDLREPSRGFVVDLGMAFVDNWAVGKEVCYWLSNDIVGFGGKLGRIGMAVTAWVSPSFSPSSFAPVFSVVL

SEQ ID NO: 155702 - protein, 84 aa, Glycine max
  Coding DNA Sequence Number=SeqID_64017
MQDKIDCNNINEIREERNANSIYTGSAMSRAYIQSSSNPLEIFHYLCKSFTDFEYTLGSLTLVFKDSPRDNLSLDYNSHNSRDN

SEQ ID NO: 155703 - protein, 43 aa, Glycine max
  Coding DNA Sequence Number=SeqID_64018
MSKRLQEDWARAVEEGPRVLMNLRVGYPRNIGFFSPCIFGHLD

SEQ ID NO: 155704 - protein, 85 aa, Glycine max
  Coding DNA Sequence Number=SeqID_64019
ARDMVNQEEWVPFMDVLALLIFGVVLFPNVDGLVDLAAIDAFLAYHHSKENSGGGKEGSSLLMWGTTPNIPYIGSYPNFVRGTFA

SEQ ID NO: 155705 - protein, 143 aa, Glycine max
  Coding DNA Sequence Number=SeqID_64020
MDRGMTLTDAPRSSMTFSNLLFLIMQGGNGRGIGGCDSEWRLLSLTEIAYSGWSFASLTLLRKVEEEPQLLVIFVVTAVVAAAVLEEEHMAWLDQQHSEKEGQAIVVMEDLSISDLDDSSNLDCIYCLKGHYYSAVVGFAAEE

SEQ ID NO: 155706 - protein, 57 aa, Glycine max
  Coding DNA Sequence Number=SeqID_64021
MEVKLGRIDGDPVLRETRIWDTWEYVSSDGGGQQGMVGLCALCGCGKLVVHHRPTAT

SEQ ID NO: 155707 - protein, 70 aa, Glycine max
  Coding DNA Sequence Number=SeqID_64022
  Subcellular localization annotation: CTP_CleavageSite=29; ConfidenceScore=5.35e-01
MMTKEMTKSSKINQRTTQVNQRSIKNNSRVQNKNQGSRRKFRVKNQDSRLKISRIKIKIHDSRFKNQEKA

SEQ ID NO: 155708 - protein, 140 aa, Glycine max
  Coding DNA Sequence Number=SeqID_64023
  Homolog annotation: Hit_ID=A5AZG1; Match level="QueryCoverage=37%, HitCoverage=15%, E-value=4e-07, Identity=48%"; Hit description =Putative uncharacterized protein
MSHHSSSVNGEGTSHKDPLSRILDELICLKLWKEKLERKEKGKEKVEISQDEREQIREEERTKILKERHRSHPRPHSHRREKERKPQEANINLPYFHGKDSVEAYLDWETKVEQLFVCHYTSEERMVPLATLSFQGYALY

SEQ ID NO: 155709 - protein, 50 aa, Glycine max
  Coding DNA Sequence Number=SeqID_64024
VVIIKKGEIVEASFTMMNQVDSRSFDDDKDDDKKLKRMISRLSQQVQDQD

SEQ ID NO: 155710 - protein, 50 aa, Glycine max
  Coding DNA Sequence Number=SeqID_64025
MGSKVYPKVHENPKAFFINSSPILLEPLAHGSERECTGMRPLPKVNHLCT

SEQ ID NO: 155711 - protein, 36 aa, Glycine max
  Coding DNA Sequence Number=SeqID_64026
MVEASGNRLPVCVIDYPEEWVTGNRLPDRDGGTTNP

SEQ ID NO: 155712 - protein, 270 aa, Glycine max
  Coding DNA Sequence Number=SeqID_64027
  Gene Ontology: Mol. function=motor activity; Cellular component=cell projection
  Homolog annotation: Hit_ID=UPI00016621D1; Match level="QueryCoverage =86%, HitCoverage=40%, E-value=2e-19, Identity=34%"; Hit description =UPI00016621D1 related cluster
MSFTLIFRGLLALAFRGLLALAFVALHALAFVGLHVLTFRGLHVLAFKGSCTFTFRGLHVLASRGLHVLAFRGLHVLAFRGLHALTLRGLHVLTFRGLRVLAFRGLHVLTFRGLHTLAFRGLHALTFKGSCTFTFRGLHVLASRGLHVLAFRGLHILAFRGPHALAFSGLHVLTFKGLHVLAFKGSCTFAFVRLHALTFRGLHVLAFRGLHVLAVRGLYVLTFRGQHVLTFRGLHALAFRGLHVLHFRGLHILTFRGLYTLAFSGLHIRT

SEQ ID NO: 155713 - protein, 89 aa, Glycine max
  Coding DNA Sequence Number=SeqID_64028
MLWKLGGIDGDPVLRGIRIRATWDYVSSVEGGQLGMVDLCVICGCGESTCTIARSPPSTTYDGVVPGDMSRGSGDLGDVRWGAIAQNQA

SEQ ID NO: 155714 - protein, 71 aa, Glycine max
  Coding DNA Sequence Number=SeqID_64029
MSNQKSTESCIKNLEVQVGQLAKQLEDRPSSSFGANIEKNPKEESKAIMTRSKMVSMNEGEKRIGAEKQQI

SEQ ID NO: 155715 - protein, 83 aa, Glycine max
  Coding DNA Sequence Number=SeqID_64030
MDKKLEEDALMEEKKERRGEQEIEGIKEGEKWNFEPKPLALSKGGKMHGVATNIYLWKTSEKPKETGQRMKILSSGVVFTLEE

SEQ ID NO: 155716 - protein, 65 aa, Glycine max
  Coding DNA Sequence Number=SeqID_64031
MCVCVCLCVCVFLCVCVCVWLCVGVGVSLYAARSQLQQGLKINYGKSSFGVLGQLNNGNCRLPVI

SEQ ID NO: 155717 - protein, 151 aa, Glycine max
  Coding DNA Sequence Number=SeqID_64032
MPASDHAILRDRTHQPTKKSLIELSSHDPLLAQKKLLSKQLEILTQTLGYRLYHLCDNGILKEDFQASSRVHIINKDSGGDLDSVYVGQLAKQIADKSSNSFVENKEQNPKEECKTVMTRSKRFVEVKDDDSVVHKKKTTDKKSTDDKKNE

SEQ ID NO: 155718 - protein, 131 aa, Glycine max
  Coding DNA Sequence Number=SeqID_64033
IDGDPALRGTRIRATWEYVSSVGGGQQGMVVLYVICGCGELLCTIARSPPSTTCDGVVPGDMSRGSGDLGDVRRAPGSQQIKEQRPQSKEACVVASQLLRNGTGRLEAYGNRLPVCVIDYTEEWVTGNRLP

SEQ ID NO: 155719 - protein, 70 aa, Glycine max
  Coding DNA Sequence Number=SeqID_64034
MDSFASWKMNGSRMEKEERRCHFKEKISLEEAHHHRRPWIRAWRKKEMNEGRGRQEHGILCLERALKSEV

SEQ ID NO: 155720 - protein, 44 aa, Glycine max
  Coding DNA Sequence Number=SeqID_64035
MASGNRLPRVGNQLQGLKGCNRLPGLEMKAACFGGLWVIDYQAV

SEQ ID NO: 155721 - protein, 37 aa, Glycine max
  Coding DNA Sequence Number=SeqID_64036
AFGIIKIAWFIFMKLASTLNCEFHEHKGKGFLGCSEV

SEQ ID NO: 155722 - protein, 136 aa, Glycine max
  Coding DNA Sequence Number=SeqID_64037
  Gene Ontology: Mol. function=protein binding; Cellular component =chromatin; Biological process=protein amino acid phosphorylation
  Homolog annotation: Hit_ID=A5ADQ7; Match level="QueryCoverage=96%, HitCoverage=52%, E-value=2e-20, Identity=35%"; Hit description =Putative uncharacterized protein
  Pfam annotation: Domain name=LRR_1; Domain location=119-133; Score =3.2; E_value=80; Accession=PF00560.24; Description=Leucine Rich Repeat
  Pfam annotation: Domain name=LRR_1; Domain location=18-40; Score =19.0; E_value=0.018; Accession=PF00560.24; Description=Leucine Rich Repeat
  Pfam annotation: Domain name=LRR_1; Domain location=95-117; Score =11.1; E_value=2.7; Accession=PF00560.24; Description=Leucine Rich Repeat
  Pfam module annotation: Pfam domain module=LRR_1::LRR_1::LRR_1; Domain location=119-133::18-40::95-117
MDNNLHGTISDALGNLTSLVELDLSYNLLEGTIPTSLANLCNLREIGLSYLKLNQQVNELLEILAPCISHGLTTLADQSSQLSGNLTDQIGAFKNIDMLDFSNNLIGGALPRSFGKLSSLRYLYLSINKFSGNPFE

SEQ ID NO: 155723 - protein, 320 aa, Glycine max
  Coding DNA Sequence Number=SeqID_64038
  Homolog annotation: Hit_ID=Q6UUU1; Match level="QueryCoverage=18%, HitCoverage=40%, E-value=5e-18, Identity=78%"; Hit description =Putative uncharacterized protein
CTAEVVCTEDDVNLRVSTDLLAAIDKGDNHLGITAGPLTSRVSTAEVVCAEHDNVYTDNHLGISAGPLTSRVSIAEVVCAEDDQKNVYTDNHMGISAGPLNSRVSTDRVCRGGRRKSPQVNGLNVYTDNHLGISAGPLTSRVCIGEVVCAKDDVVSTEDDVNLRLDTGLLAVIDKGCRRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 155724 - protein, 96 aa, Glycine max
  Coding DNA Sequence Number=SeqID_64039
MAAQLIHDRVEMECLEGAWETLEGNTRCRFRGTIRFTATSLVHPNEPARTLQRTVEWILPTPTPYRQVEPVQVIERVMRTHSLRWILPRTSCWHPT

SEQ ID NO: 155725 - protein, 106 aa, Glycine max
  Coding DNA Sequence Number=SeqID_64040
  Subcellular localization annotation: CTP_CleavageSite=26; ConfidenceScore=5.01e-01
MARKGMKADLGLKRVSGIGRLKQKPRSRHNVSSSGDRRLMRTASRDGIEGDASGTEESATATGGAGGVGEEKKDDRGRGGRRPSNNFSSWRRANPAAWTKVRGCKA

SEQ ID NO: 155726 - protein, 299 aa, Glycine max
  Coding DNA Sequence Number=SeqID_64041
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVWRPLGTLWTQISPTGAWDSRTNHRTLPVVRSPHCTYQVLYQRQAQGDAPQAAGAPPPPHQAGQAGAFDIEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 155727 - protein, 149 aa, Glycine max
  Coding DNA Sequence Number=SeqID_64042
  Gene Ontology: Biological process=transposition, DNA-mediated
  Homolog annotation: Hit_ID=Q1J7G7; Match level="QueryCoverage=25%, HitCoverage=67%, E-value=7e-11, Identity=72%"; Hit description =Transposase
ERSGYRYIEQLTEMPQNVLYDAIGIYQRWNLLRADQRLIFAKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTT

SEQ ID NO: 155728 - protein, 47 aa, Glycine max
  Coding DNA Sequence Number=SeqID_64043
MKKQQWKRIGRQRRRGEGRHHPPGNKPRKKELHHQELPWIRSLKRML

SEQ ID NO: 155729 - protein, 51 aa, Glycine max
  Coding DNA Sequence Number=SeqID_64044
MEVGKLEVEVTGSWKLEMKVIGSEKLKMEVVVIIKKGKNVNHEDFDDIKKN

SEQ ID NO: 155730 - protein, 162 aa, Glycine max
  Coding DNA Sequence Number=SeqID_64045
MGSKIYPKVHENPRAFFSSSSPSLLESSIQYPCGVGLHHHGPEICPKAHENPRAFSCISGPIYLESSIQCPCRGYNVQIHELHHKLYILQPAKWKNVKFMQNEAELATYLVFLLVSLVAWTTTCFVPTEHLVRNPSTEAEFPTWLAVSVENENPNLIFRFLS

SEQ ID NO: 155731 - protein, 97 aa, Glycine max
  Coding DNA Sequence Number=SeqID_64046
MSEIEEVQEQMKIDMEAMKEQMTTMMEEMMSMRKKMEDNIATVVATSTATEMDPIHLASLNQVNRPVSDIVGQGGEATKNACGPYHVQVHSKHSFPQ

SEQ ID NO: 155732 - protein, 52 aa, Glycine max
  Coding DNA Sequence Number=SeqID_64047
MGEFVYNLSPLRSVHGVPQTLMGRIILDHGQKSRQVDGRNQPRYKGTDASGG

SEQ ID NO: 155733 - protein, 246 aa, Glycine max
  Coding DNA Sequence Number=SeqID_64048
MTSILISRRRQVAGDAIAQLLGYPLVLEEGQECEYGQRRNRSDGFDEEAIAQMLCIPGQDFARTAAGRRVRIMRTNMTTLTQIWMTLLLSSILPSDHNSDLHLPKCQLVYAILTRMSIHVAQLIANAIYIFAGMAPTRHPLDPDKSNRALGFPALITGLCQSFGVPVTPSKVIRPPITRAFIEKYCTQRQVQGDAPQAADPPPPHQAGPAGSFDTEQYLRHLVRQQAANHRAHVQTHDCLYQMSLS

SEQ ID NO: 155734 - protein, 221 aa, Glycine max
  Coding DNA Sequence Number=SeqID_64049
  Homolog annotation: Hit_ID=Q2HW90; Match level="QueryCoverage=82%, HitCoverage=35%, E-value=3e-17, Identity=33%"; Hit description =Putative uncharacterized protein
AIDAFLAYQHSKESPVVAILADLFDTFDRRCEKNNARIVCCLPALCVWLVSHLFQQDTRHPCPLQSYRSCAEKGRVDWDQHLAGIGGNAINWFPRWKEGKEGVLFSCGDYPNVPLIGTRGCINYNPALAIRQLGYPMRGAPTEESLSPFLVRDLGAQSHEVIQRVHKAWRSPLRKDKDLRGIRNGVIGGYHGWLRVHTRGLDWLSKLKVINEDNFEAPGGR

SEQ ID NO: 155735 - protein, 160 aa, Glycine max
  Coding DNA Sequence Number=SeqID_64050
MWAFHKGLQIDWAHLVRYRMHKALRLNAPLPYPHLVTLFLQHFNIPLDSEPYVPIKRSFLIGVSVIASFGYQKEHDGSSVKKGARHVGEEGHDGEDSSLLSKILDRYDGLQTFVGERFDTLELQVDMHFNEMESRITKVEEDMSYIRSSFDLPPPPPPSS

SEQ ID NO: 155736 - protein, 130 aa, Glycine max
  Coding DNA Sequence Number=SeqID_64051
MDELRCHHDLQEIKERGRLFHERSNYSSNTMCPITTTCNKKRPPQHNVSISKPGNRLHSIGHLNFLSSFLSLVIDYTPLVIDYQRPYSKYYSRSLAGQPSHKPPCFVVFVLLSVDCQELACLGTSQVLTD

SEQ ID NO: 155737 - protein, 126 aa, Glycine max
  Coding DNA Sequence Number=SeqID_64052
  Subcellular localization annotation: CTP_CleavageSite=81; ConfidenceScore=5.40e-01
MTPSGPGEVQQGPRVFSSGYGPLSVLQGARPPGKGSRPQDTQWTQRSPTGSWSCQSLITGLCQFYGVPVTSSKGIRPPTNRAFIKKYCVPRQAQGETPQQPRDGRQRAIDAPPSPLEFTSAHPQKG

SEQ ID NO: 155738 - protein, 54 aa, Glycine max
  Coding DNA Sequence Number=SeqID_64053
MDPKSTAHENPMTSPASLAQSSWSLLSKALGGVRSENPFLGHLPMREHGSSPTQ

SEQ ID NO: 155739 - protein, 394 aa, Glycine max
  Coding DNA Sequence Number=SeqID_64054
  Gene Ontology: Mol. function=transporter activity; Cellular component= integral to membrane; Biological process=transport
  Homolog annotation: Hit_ID=A8GCX3; Match level="QueryCoverage=100%, HitCoverage=78%, E-value=0.0, Identity=90%"; Hit description =Metabolite/H+ symporter, major facilitator superfamily
  Pfam annotation: Domain name=MFS_1; Domain location=6-299; Score =18.2; E_value=0.0047; Accession=PF07690.7; Description=Major Facilitator Superfamily
  Pfam annotation: Domain name=Osmo_CC; Domain location=349-394; Score =73.5; E_value=6.9e-19; Accession=PF08946.1; Description=Osmosensory transporter coiled coil
  Pfam annotation: Domain name=Sugar_tr; Domain location=1-348; Score =116.3; E_value=8.9e-32; Accession=PF00083.15; Description=Sugar (and other) transporter
  Pfam annotation: Domain name=Voltage_CLC; Domain location=68-332; Score=-167.5; E_value=0.012; Accession=PF00654.11; Description =Voltage gated chloride channel
  Pfam module annotation: Pfam domain module=MFS_1::Osmo_CC::Sugar _tr::Voltage_CLC; Domain location=6-299::349-394::1-348::68-332
MAVSTFCIGLIPSYASIGIWAPILLLLAKLAQGFSVGGEYSGAAIFVAEYSPDRKRGFMGSWLDFGSIAGFVMGAGVVVLISSIVGEANFLDWGWRIPFFIAAPLGLIGLYLRHALEETPAFQQHVDKMEKDDRNAIENPPKTSFKEIAAKHWKSLLVCVGIVISTNVTYYMLLTYMPSYLSHNLHYSEDHGVLIIIAIMIGMLFVQPVIGLTSDRIGRKPFIIGGSIGLLALAIPCFILINSNVIGLIFVGLLVLAVLLNSFTGVMASILPAMFPTHIRYSALAISFNISVLIAGATPTAAAWLVEATGNLYMPAYYLMVVAVIGLITGLYMKETANKPLRGATPAASDRSEAKELLQETYDNIEQKVEDINAQIAELEKKKQILIDQHPKLD

SEQ ID NO: 155740 - protein, 99 aa, Glycine max
  Coding DNA Sequence Number=SeqID_64055
  Pfam annotation: Domain name=LRR_1; Domain location=15-41; Score=6.8; E_value=17; Accession=PF00560.24; Description=Leucine Rich Repeat
  Pfam annotation: Domain name=LRR_1; Domain location=44-67; Score=7.2; E_value=14; Accession=PF00560.24; Description=Leucine Rich Repeat
  Pfam annotation: Domain name=LRR_1; Domain location=70-92; Score =11.3; E_value=2.4; Accession=PF00560.24; Description=Leucine Rich Repeat
  Pfam module annotation: Pfam domain module=LRR_1::LRR_1::LRR_1; Domain location=15-41::44-67::70-92
  Subcellular localization annotation: CTP_CleavageSite=51; ConfidenceScore=5.78e-01
MTSSVFQGGFNFSSKLQNLDLQNCSLTDGSFLMSSSFIMRSSSSLVSLDLSSNLLKSSTIFYWLFNSTTNLHNLVLDYNMLEGTIPDGFGKGYGSQITS

SEQ ID NO: 155741 - protein, 151 aa, Glycine max
  Coding DNA Sequence Number=SeqID_64056
MIDVSSGGALGDKTPTEARNLIEKMASNSQQFSARNDAIVLRGVHEVAMDSSSFTENKKLEGKLDALVNLVTQLAMNKKSTPIARVCGLCSSTDHHTDLCPSLQQSGVNEQPEAYAANIYNRPLNSKTNNNRIIMTFQAIDTIQVGGIIQI

SEQ ID NO: 155742 - protein, 128 aa, Glycine max
  Coding DNA Sequence Number=SeqID_64057
MAPRKLASKRSRKDKAAEGTSSAPEYDNHRFRSAEHQQRFEAIKGWSFLRERRVQLRDDEYTDFQEEIVRRRWASLVTPMAKFDPDIVLEFYANAWPTEEGVRDMRSWVRGQWIPFAGGGHHWYPSFY

SEQ ID NO: 155743 - protein, 35 aa, Glycine max
  Coding DNA Sequence Number=SeqID_64058
MAYIHIPHKPENPNESLETSNNNLQISPNIMHSIT

SEQ ID NO: 155744 - protein, 350 aa, Glycine max
  Coding DNA Sequence Number=SeqID_64059
  Homolog annotation: Hit_ID=Q84VI1; Match level="QueryCoverage=100%, HitCoverage=55%, E-value=1e-168, Identity=82%"; Hit description =Envelope-like protein
GVKIAENPSLATSPREVDTEMDKKIRSIVSSILKDASVPEAAEDVPTSSTPNVSVPDVEKDVPTSSGPNAEVLSSPSKERSTEEDDQATKETPAPRAPEPAPGDLIDLEEVESDEEPIANRLAPGVAERLQSRKGKTPIKRSGRIKTMAQKKSTPITPATSRRSKAQEIWKKVPEKVPDAPLDNISFHSIGNVEKWKYVYQRRLAVERELGRTALDCKEIMDLIKAAGLLKTVTKLGDCYEGLVREFIVNIPSDISNRKSDDYQRVFVRGKCVRFSPAVINKYLGRPTNGVIDIDVSEHQIAKEITAKRVQHWPKKGKLSAGKLSVKYAILHRIGAANWVPTNHTSTVAT

SEQ ID NO: 155745 - protein, 101 aa, Glycine max
  Coding DNA Sequence Number=SeqID_64060
MYGHIFLQQIYLAFFEACQTLTKGGLAFHCHERLLHFRGLMWMEEDGWIEEEKRIMDIERGFPKLEILRLRMYSLENSKSSGVVLSRCMGYGLPFYFLIFL

SEQ ID NO: 155746 - protein, 88 aa, Glycine max
  Coding DNA Sequence Number=SeqID_64061
MKIVFPDTTNLLCRFHIDKNVKTKCKTLVAQKNAWDYVMEAWGSLVDCPRERYFDKVESAHWSLNKLLQNSIGDICSVWEAMNNMMTL

SEQ ID NO: 155747 - protein, 108 aa, Glycine max
  Coding DNA Sequence Number=SeqID_64062
  Subcellular localization annotation: CTP_CleavageSite=49; ConfidenceScore=5.66e-01
MAQATANPPRYPPIYATSPKFFGSRRGLFRYGTHPTKGTHTPTGGSSPESSSDSASLSQQCSLRRKHDKELFAKAGTDLCPDPDDIWGTLAVSHRQPIGRGGPGKDLP

SEQ ID NO: 155748 - protein, 36 aa, Glycine max
  Coding DNA Sequence Number=SeqID_64063
MELGFRWEALISSFSKIHARPYYVIVPRQESPPQRR

SEQ ID NO: 155749 - protein, 153 aa, Glycine max
  Coding DNA Sequence Number=SeqID_64064
  Homolog annotation: Hit_ID=A5BQ25; Match level="QueryCoverage=82%, HitCoverage=33%, E-value=1e-11, Identity=29%"; Hit description =Putative uncharacterized protein
MVARNATIKKPREEWTEDERRLVQYNLKAKNIITSTQGMDEYFRVSNCKNAKDMMKTNESIQDMQKRFTHVVNHLASLGSIFPNEDLINKVLRCLSREWQPKEHEMELQRLNQHEENDKKKKGISLKASSSIQEESDMEDSIDLDEDEDLSLF

SEQ ID NO: 155750 - protein, 74 aa, Glycine max
  Coding DNA Sequence Number=SeqID_64065
MTMPIGWNSQKSRANAKREEPTYLRSNPLQGGGDDAILPMKGQVTKAMSRRLQVDWARAAEDGPKVLMNMRVDF

SEQ ID NO: 155751 - protein, 252 aa, Glycine max
  Coding DNA Sequence Number=SeqID_64066
  Homolog annotation: Hit_ID=Q6WAY6; Match level="QueryCoverage=61%, HitCoverage=33%, E-value=3e-17, Identity=31%"; Hit description =Putative uncharacterized protein
AKALADQGEWASFTDVLALLIFGVILFPNVDGLVDLAAMDAFLAYHHSKESPIAAILAAVYDTFDRRCEKSNAIIVCCTPALYEGKVGVLSSCKGFPNIPLLGMRGCINYNPVLAIRQLGYPMRGASSKESITPFIARGFSDPNARILQGVRKAWELDWLPKLKVSSEEEAETPEEGEEVQALKEKLEKAQLVKEKFKIMAIKVKKKCDKLRDINIATTKALERETKRARKEEHGRNKFRGALWGRNNDLKL

SEQ ID NO: 155752 - protein, 60 aa, Glycine max
  Coding DNA Sequence Number=SeqID_64067
SFFHGLFPSGWRLLSPLRLCLPLHLHGGKSPLKDLIEAQDPASIVALAQASWSLLSNTLG

SEQ ID NO: 155753 - protein, 106 aa, Glycine max
  Coding DNA Sequence Number=SeqID_64068
MSGFTRDSPQISASPHQLDLAPYASSPYNAQWNASGLLHDKHTLRSSRILREKEVDEPWLGLSRCKIHFLVDVSGMAFVDNWAVGKEKVCYWLSNDIVGLVGNLAV

SEQ ID NO: 155754 - protein, 413 aa, Glycine max
  Coding DNA Sequence Number=SeqID_64069
QMGDAAGFEILKRRENHVFIAPAVFERYGLRRAVIRRRRMLGELLIIKVDQVIFTGGKQGPQDCQIVVAQQIVAVEEGEIAAGGQPGLFRDGKNGGDQRQAEYDGAFRAEEDDVAQAVNEQADANAQQQRVALRPEGREEQADIERQQQQYAPDALERVGFQQLVVQVDVDVGHDARQARLLCDHRTDLFTALLGGLAPRGFLWLIHQTHIGLKGLNAFFYLRFKHQAAGYEQQRYRGHQREFVFPGNQLLGRQQRQADRYRVDQHGRARAGEHQCREGQQERSDVQRQAVAGAQHQDGLHHHQIDGGHQVGGDRGAIEVELYARDIQPQSLIEGIAVDRQAGGESHDDQHALHAQPLIERDQQDESGRELQFAGRHIRTINIDVLTRLFEVMHPEMVPMPTLTSARQQQISR

SEQ ID NO: 155755 - protein, 108 aa, Glycine max
  Coding DNA Sequence Number=SeqID_64070
MLIIVDQHKEKVNLAVSHGHMLEDEQVKVSALQIEREVGERVIELLHGESMKWMNRFALTLNESQELPRLLARAKAVANTYSTPDEVHGLFNYCQHMVELTTHIIRSR

SEQ ID NO: 155756 - protein, 77 aa, Glycine max
  Coding DNA Sequence Number=SeqID_64071
  Subcellular localization annotation: CTP_CleavageSite=42; ConfidenceScore=5.03e-01
MSCSSYGWSSLRSSAGAADESYIGYSGSTTGVDGWVSSGVVSSSAGAGAGGSSISGSWAAEAPPPPEEESWSPGQAT

SEQ ID NO: 155757 - protein, 108 aa, Glycine max
  Coding DNA Sequence Number=SeqID_64072
MMHAPDLNSQMQCGTYRIQYQGNSPKRVYTTPHLENHAVFVEATQSCTVTPPLGAQPGATRSSLPGLGSSSSMDSFASWKINGSGMEKEEREETPLQGEDESRRSSPP

SEQ ID NO: 155758 - protein, 52 aa, Glycine max
  Coding DNA Sequence Number=SeqID_64073
  Subcellular localization annotation: CTP_CleavageSite=21; ConfidenceScore=5.08e-01
MASIIVAICFFMASMSAFICSCASSTSPITLALAQERMQRAMQPMKSMDVCE

SEQ ID NO: 155759 - protein, 272 aa, Glycine max
  Coding DNA Sequence Number=SeqID_64074
  Homolog annotation: Hit_ID=Q6WAY4; Match level="QueryCoverage=67%, HitCoverage=36%, E-value=1e-13, Identity=29%"; Hit description =Putative uncharacterized protein
MGSSQKPSLKKRFYQVKIKSLEVTSLRKLGQLMGQLQRQAFRKAYGKIWDLARVEVSMEPIASLSQYYDQPLRCFTFEDFQLVPTVKELEEILGCQLGGRKPYLFFGFYPSTKRAAKYQGSVWRKGQRPWQIKANGLSFIDILALLIFGVVLFPNMEGLVDLAAIDAFLAFHHGKESPVVAILAMYDTFDRGCPSIRYKVSARASKKERRIGTNSWLAWRDTKASRLSSHGVSVTTTRGYSKEFARHGMRREERTESLGEAVMGSSAAIISG

SEQ ID NO: 155760 - protein, 98 aa, Glycine max
  Coding DNA Sequence Number=SeqID_64075
  Subcellular localization annotation: CTP_CleavageSite=45; ConfidenceScore=5.41e-01
MWSPLKVRMRSPLKAKACSPLKSRTCLPLKARACNPLKARACSPLESSKGEGVMMEACLWGFYGGWIFELQWGPLMVIFHHGDAAEDKGKEVRGGAIH

SEQ ID NO: 155761 - protein, 31 aa, Glycine max
  Coding DNA Sequence Number=SeqID_64076
MGEIWQKGELGTRGHIVIDYTNMIIDYQRAF

SEQ ID NO: 155762 - protein, 65 aa, Glycine max
  Coding DNA Sequence Number=SeqID_64077
MSAYSPFVKRKPRAKRIFVHALSRESQALSAQPLNLRLIWCAELAKAELSQLQFDLDLAKRKPNH

SEQ ID NO: 155763 - protein, 148 aa, Glycine max
  Coding DNA Sequence Number=SeqID_64078
LGRIDGDPVLREMRIWATWEYVSSVGGGQQGMVGLCAHCGCGKNLLCTIARPPPSTTCDGEVPRDMSRGSGDLGDVRRAPGSQQIKGTKTTKQGGLWWLASCEFCVIYGLWSLVIDYQGWEAKGASGNRLPVCVIDYTEEWVTGNRLP

SEQ ID NO: 155764 - protein, 54 aa, Glycine max
  Coding DNA Sequence Number=SeqID_64079
EAGFWAAEAPPPSEGEGWAPGQATCTSNSSMLKMDDKPKPCRLCRMMDCPLCRL

SEQ ID NO: 155765 - protein, 135 aa, Glycine max
  Coding DNA Sequence Number=SeqID_64080
FTRDSPQISASPHQFDLAPYASEPYNAQWNAPGLLRDKHTLRFESYSRRNGGMAFVDNWAVGKEKVCYWLSKDIVGLVGNLAVQEWQPQHGFLPHPHPLSFAPVFSFIQAGLLNLPLFKSTSTFLLAKTKSVKLE

SEQ ID NO: 155766 - protein, 119 aa, Glycine max
  Coding DNA Sequence Number=SeqID_64081
MACGDALYGNLHTHLCYPDPPVACGDTLQLSVPRHSETPSPIDKQRPMWSFAPFLEMSESSSQDYFSLKTSVDPDPRVKWQAEIPKWLSVQRQHLLILTQESGGRRKYPSGYLYKDNIC

SEQ ID NO: 155767 - protein, 83 aa, Glycine max
  Coding DNA Sequence Number=SeqID_64082
DQGVPMNPKRIKVIPEWPTPPTPLIELVRNHVPSWEDAQEMGVEGKDPRGMMQSYPAKALGRRLQVDWARDPREGPRVLMSLR

SEQ ID NO: 155768 - protein, 119 aa, Glycine max
  Coding DNA Sequence Number=SeqID_64083
MAKYDPKIVMEFYTNAWPMKEGVRDKLSYRPSLFHFNFRKKGEILEGTEVVVSLSLIHALSEIHPLSETSALLASKRNLRENLPRQHALSASPARPMRFLSLLVLSVPGSLSQNSLTRA

SEQ ID NO: 155769 - protein, 144 aa, Glycine max
  Coding DNA Sequence Number=SeqID_64084
MDPEKSNRALGFPALITGLCQFYGDLNRKILHAKASTTAVGGVPAAADSGCTATTSTAATTSGFHLFSPVEDRAPDAHAANHRGQVQLNETFYRYTLHQQSQDPSPFLWPTPEQFGATVAWPGDEPDFQTGVGPIGAPGDKDGA

SEQ ID NO: 155770 - protein, 163 aa, Glycine max
  Coding DNA Sequence Number=SeqID_64085
MARECFPNEYMMWNCSSSVDRWHESSFSNASMCVTKWLREKYCTSRQAQGDAPSPPHQADPAGSFDTERYLWHLVRQQATNHRGHVQTHECLYQLSLSLQRQGFAPFLCPTPEQFRAEVAWPGDWPETQAGEAPAEALDDGEEARMDEEMTDLLDFLGGSGAT

SEQ ID NO: 155771 - protein, 131 aa, Glycine max
  Coding DNA Sequence Number=SeqID_64086
MPVAVMCTINDFPAYANMSRWSTKVDVHVVTLKCPLSGWVIVENFTICVIVIGKSKDHDKAHYDIVDLNIRSQLHPKMHPTTVIHLAYEVKVASLIHYRWMCPIERCRTGCHDIALQNMQNVYDRMNRLNK

SEQ ID NO: 155772 - protein, 64 aa, Glycine max
  Coding DNA Sequence Number=SeqID_64087
MDKQHYIESLNLKPIAVSMRGEGSRGFAHKERHREVWGIETEHTMIGMMTMGTTKPAIVVRGKI

SEQ ID NO: 155773 - protein, 124 aa, Glycine max
  Coding DNA Sequence Number=SeqID_64088
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=65%, E-value=2e-33, Identity=100%"; Hit description=LacZ protein
MEGRNDSQFLFLFLLAFTFHKKLYFIGIGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 155774 - protein, 99 aa, Glycine max
  Coding DNA Sequence Number=SeqID_64089
VKKRLSHEVLKVTVGLDSSVGLSAHPPLSAASIDSRIFDDNKDDDKKLKSQYHFMITKMMTFKNEFKIESRTLQGSRAKFDFKNQESRFKDSRIIKIKI

SEQ ID NO: 155775 - protein, 93 aa, Glycine max
  Coding DNA Sequence Number=SeqID_64090
  Subcellular localization annotation: CTP_CleavageSite=28; ConfidenceScore=5.12e-01
MCSQALASLGSFSRKFFKEVSQGASYPRHSLGGEALSSMAYSLVDDASSHLFSFIFRCISMVENHHRRTSLKLKDPASIEALQASFHHAPSQD

SEQ ID NO: 155776 - protein, 215 aa, Glycine max
  Coding DNA Sequence Number=SeqID_64091
  Homolog annotation: Hit_ID=A5BSR3; Match level="QueryCoverage=34%, HitCoverage=24%, E-value=1e-07, Identity=37%"; Hit description =Putative uncharacterized protein
  Pfam annotation: Domain name=Transposase_23; Domain location=149-201; Score=-15.2; E_value=0.055; Accession=PF03017.5; Description =TNP1ENSPM transposase
  Subcellular localization annotation: CTP_CleavageSite=48; ConfidenceScore=5.42e-01
MFILTPNAINSSLTSKRAHMSSDSDSGISSKFLRFLNFSSDCSDRIPKQEAAQSGRTDTVINPSFPIRRHVKWKIARTKKTGQMTSEATKEIADKIDSLEEQSSQGSFVAHGRYVVLTTAIGRLEYPRHVKRRVVLISQGTIKTWVTQRNAGKLYEGSATVHNIPLCHYQVKVGVEEVTDADAPIPVPTEEVQLVGQTLNTFVAWETHLVKHLSK

SEQ ID NO: 155777 - protein, 198 aa, Glycine max
  Coding DNA Sequence Number=SeqID_64092
MAEPSKKRKGSSSRSQWHSEAQETQIPSSISSSLLFSSEEQRIRYTKIFSSRSIIDPKFIDMDFFSNNSFECIQAFQNSNLIPFMSLKFPIYSELVKAFYSNLEIQENTLIYEVFGIKMVIDQSLFYDLTQLSSEGVPFEADMTGRLFAGSLALESRILHYLIVRILLPRSSNIAQVSKEDLIVMWAFILANKLIGHT

SEQ ID NO: 155778 - protein, 184 aa, Glycine max
  Coding DNA Sequence Number=SeqID_64093
MSGLASHDNEWLTNTKMKQEVWKKMEEIIPKMQKIPKRVILRLFQTPGSPRPPEDLGVNNGFRLSNIERFSEIKEKKEIEEEKTRPRHFRIASVTDSYIVLRLFFIHQLGTSSVVQVEGTSTWFVVTENKREYISCRSVQVEGTSTWLFKENKGGYIPCGSLLVKDFTRLKRNLKDRRSLGDWM

SEQ ID NO: 155779 - protein, 200 aa, Glycine max
  Coding DNA Sequence Number=SeqID_64094
  Gene Ontology: Mol. function=nucleic acid binding; Cellular component= intracellular; Biological process=regulation of transcription
  Homolog annotation: Hit_ID=Q2HVE6; Match level="QueryCoverage=55%, HitCoverage=23%, E-value=5e-33, Identity=65%"; Hit description=Zinc finger, C2H2-type
  Pfam annotation: Domain name=zf-C2H2; Domain location=71-93; Score =25.6; E_value=0.00018; Accession=PF00096.17; Description=Zinc finger, C2H2 type
MSNLTSTFAEARASSDNRTEIGTDYSQQYFTPPQTQTQPPLKKKRNLSANPDPKAEVVSLSPKTLLASNRFICEICNKGFQRDQNLQLHRRGHNLPWKLNQRSSKEIIRKKGTSLASRSTSAESMARRSGNMTNDPRSMLFNQTGKLTPTPVALESTTVTVEPYCQEETARSVTGIVANSTTQPTKVAGIVISSSSWEVS

SEQ ID NO: 155780 - protein, 106 aa, Glycine max
  Coding DNA Sequence Number=SeqID_64095
  Subcellular localization annotation: CTP_CleavageSite=57; ConfidenceScore=5.80e-01
MASPPASPPPPPPPPPPPASSDASASPSPVKRTRKTSRLRSLSTRPPGAERPVVHVDPATGKADDPHRKKLRTYLGIVAHDKVDVTYENWKEVPTAQKDLIWEDIQ

SEQ ID NO: 155781 - protein, 78 aa, Glycine max
  Coding DNA Sequence Number=SeqID_64096
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=61%, HitCoverage=25%, E-value=6e-16, Identity=83%"; Hit description =Chromosome chr4 scaffold_32, whole genome shotgun sequence
  Pfam annotation: Domain name=APC10; Domain location=1-78; Score= -76.5; E_value=0.0097; Accession=PF03256.7; Description=Anaphase -promoting complex, subunit 10 (APC10)
MDILAQMEMLAPDHGHTDLIVVVLIVLYVVFKFDESYTPSKVSIRAGDGFHNLKEIKIVELVKPAGWVYLSLYGVDLR

SEQ ID NO: 155782 - protein, 291 aa, Glycine max
  Coding DNA Sequence Number=SeqID_64097
MISRLSLSQNSVQTTIETPPPPPTTTGGHHESLLLAVEPPHREEHFNRSRILRIHLKDLVENNPSNPFLRSFSEGDLDTCCLVFLSESVVWTRLGYFMTNGTTLHLRVEGTSHECTMMINVIASGNFLNKTIAKTIYLSLNRGCKSNWTLSQSKCNNYLSNFNPCTTPHIKFSAMNNARENIIFPTTRQAMGSKREFTTTAKLKKHNNKLEEAIAKLIDLSIASMANQKNINVSIMNLVMQVGQLAKQLQNSFVAFSTKVNCNAITTWSRLVIPNKVAEKKKDEAAKKEKD

SEQ ID NO: 155783 - protein, 357 aa, Glycine max
  Coding DNA Sequence Number=SeqID_64098
MTKHQRSTKRDLSYWEYVDALHSVQNSNFLVKHSASSSDQGIPRRTMPMLDQFHLCIHDSIENIVDIKADGNCGYRAIDALLDMGEDSWSLVTMDKWMNITDMGYVIASRAHANRRREWRVPSRRATWQWCRHLQWHFAGAWTRQSNWRVEGAEFLGCRQQRLFPRGLQSATLQEVASFNGVLVGQKRQHQQRFALPELLKSPLPVDHSREKKKRKEKLIGAVFEQKRRRSVAVVFVFEQKRRRSVAVVFVFEQTSSFLFILRSMTSSSSCASSIQTRSGPIKGDVLWMQPKHVSEHVWNGEADRKLHIRRAVPTYQGEEQIPEEIVPLLRQCGFYWIIKMGYLKINATLISAFIER

SEQ ID NO: 155784 - protein, 129 aa, Glycine max
  Coding DNA Sequence Number=SeqID_64099
  Homolog annotation: Hit_ID=A5BEV8; Match level="QueryCoverage=61%, HitCoverage=10%, E-value=8e-10, Identity=44%"; Hit description =Putative uncharacterized protein
MNKMMTLQHTQIKASFETSTHGVGHVFKVTLYKKLLDMVSKYALNEIVAEYECVPYAGKNPSCCGCVMRTTHGLPCAYQGLCEAKVTITKEMETISKRFEQLNVCGKVHLKKKLQETIYLDLNSMCPPP

SEQ ID NO: 155785 - protein, 129 aa, Glycine max
  Coding DNA Sequence Number=SeqID_64100
  Subcellular localization annotation: CTP_CleavageSite=50; ConfidenceScore=5.50e-01
MTLSSWQKKLNMYFMFKTLVMKGGQWPMATPPGTPPPPFPPSPPPPPPTVASQSSSTLKRTQKATRLRYLATRAPGEDRPVVHVDPAIGKADGPHKKKLRTYLGIVARDNVDVTYETWKEVPVAQKDLI

SEQ ID NO: 155786 - protein, 47 aa, Glycine max
  Coding DNA Sequence Number=SeqID_64101
MWTTTGEKLAAQLAQASKVASSRSNSLLEEGSGRPKWARLLFAPPFY

SEQ ID NO: 155787 - protein, 78 aa, Glycine max
  Coding DNA Sequence Number=SeqID_64102
MAEKTKKKLEEAAQSGSTEGVFDPSSPIRRHVKWKMARTKKTGQMTSEAAKEIAKKIDVLTVAIGLPEHHGCVRAAGA

SEQ ID NO: 155788 - protein, 20 aa, Glycine max
  Coding DNA Sequence Number=SeqID_64103
MALEELRAKPSSTTTKQREL

SEQ ID NO: 155789 - protein, 118 aa, Glycine max
  Coding DNA Sequence Number=SeqID_64104
  Homolog annotation: Hit_ID=A5BKB9; Match level="QueryCoverage=45%, HitCoverage=4%, E-value=7e-07, Identity=50%"; Hit description =Putative uncharacterized protein
MDMHELHNMLVQEEMRLKNQGSHSVHYVSHQGNQGVEKKFMKKHDKGKGPLKINDDSLQIQKKGFLTIQIVSPNKKFIFMGNRVKPPVEAVETYCLKLDTGHHLDLLKTPYVKFLEKR

SEQ ID NO: 155790 - protein, 282 aa, Glycine max
  Coding DNA Sequence Number=SeqID_64105
MESMIDATSGGALGDMTPAEAINLIEKMASNSQQFSARSDAIVIRGVHQVATNSSSSAETKKLEGKLDALVNLVTQLAMNKKSVLVARLCGLCSSADHHTNLCPSMQQSEAIEQPEAYAANIYNRPPQPQQQNQPQQNNYDLSGNRMLLAQADHTFLHQSNNNNNNNNNPRNNKQLRLLRNLPLKNLLPSQSVQNPKNVSAIALRSGKQCQEPQPVASSSFANEPAQLHSTPEKDDDKNLKSKLPNNFYASESKEKQHIPLPFPPRAISNKKMELCTNSKIC

SEQ ID NO: 155791 - protein, 343 aa, Glycine max
  Coding DNA Sequence Number=SeqID_64106
  Pfam annotation: Domain name=Transposase_23; Domain location=205-275; Score=-4.2; E_value=0.0034; Accession=PF03017.5; Description =TNP1ENSPM transposase
MGERWRQFKSDLTSKWELAADKDNVNDTDVRKKAHAIQKQNIAPHMLSHGGYEYLENKLMEEKKKKQLEEASQSRSTDTVIDPPSPIRRHVKWKMAYTKKTGQMTFEAAKEIANKNGKHPGRVCVARADVMFKQYFGLAPRTSHTSLSMAPEDMEQLMQKIKDQLEESITEKGLTLPPEPEVGPSTTRVNTKESCVDPSGNDPDTGDSNKCGLYIEENPPRLVALGRLYEGSTTIHNIPLLHDQVKVGVEEVTEADAPILVPTEEAKLVGWALNTFLAWPMHLVKCLSKQVKHEDLSEIAQSGQCLNIFVIHLWILHMIETIMRVGNANVYGFLEPQSILRSG

SEQ ID NO: 155792 - protein, 87 aa, Glycine max
  Coding DNA Sequence Number=SeqID_64107
MSHRGHLTTAFKIAPCVASLVNVRIYTQFSLNFSQPASIRPYASEPYHAQWNAPGLLHDKHTLRLSRILGEMEVVFVIGSAVDRLCG

SEQ ID NO: 155793 - protein, 101 aa, Glycine max
  Coding DNA Sequence Number=SeqID_64108
  Gene Ontology: Mol. function=helicase activity; Biological process =viral genome replication
  Homolog annotation: Hit_ID=Q9C925; Match level="QueryCoverage=99%, HitCoverage=10%, E-value=6e-16, Identity=39%"; Hit description =Putative uncharacterized protein F14G24.23
  Pfam annotation: Domain name=DUF889; Domain location=1-101; Score= -97.4; E_value=7.2e-05; Accession=PF05970.5; Description=Eukaryotic protein of unknown function (DUF889)
MRLHSNLESVDEQETATFAKWILDIGDGIISHENDGYATIEIPAHLLITEYDDSISAIVKSTFPDLDQHHNNPQFFKSKAILASTNEIVEQINHYVLSFIP

SEQ ID NO: 155794 - protein, 71 aa, Glycine max
  Coding DNA Sequence Number=SeqID_64109
MLATGNRLLPYGNRLPESKTLCKNPQLRVLAFHGKESPFTLKKRNQGKLLAYKGVGMTPPPLGSHNLSKTH

SEQ ID NO: 155795 - protein, 234 aa, Glycine max
  Coding DNA Sequence Number=SeqID_64110
  Gene Ontology: Mol. function=structural constituent of ribosome; Cellular component=ribonucleoprotein complex; Biological process =translation
  Homolog annotation: Hit_ID=Q2PMT2; Match level="QueryCoverage=94%, HitCoverage=94%, E-value=1e-115, Identity=92%"; Hit description =Chloroplast 30S ribosomal protein S2
  Pfam annotation: Domain name=Ribosomal_S2; Domain location=13-229; Score=447.2; E_value=2.2e-131; Accession=PF00318.11; Description =Ribosomal protein S2
MTKRYWNIILEEMMEAGVHFGHGTRKWNPKMSPYISAKRKGIHITNLIRTARFLSEACDLVFDAASEGKQFLIVGTKKKAADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLLEGFIDLGNRLLY

SEQ ID NO: 155796 - protein, 186 aa, Glycine max
  Coding DNA Sequence Number=SeqID_64111
MGDQEETQEQMKADMSALKEQMASMMEAMLGMRQLMEKNAATAAAASSAAEADLTLLATAHHPPSNIVGRGRDTLGHDGSPHLGYNRAAYPYGLPPNYSPPVLQDDAGHIASPVLEREPPQQPDEAHKDPQDYARRDVEFYPPIPEGPAPSTLPQPNIATQPIVLSTEGPSPATEERRKLDLLRKD

SEQ ID NO: 155797 - protein, 102 aa, Glycine max
  Coding DNA Sequence Number=SeqID_64112
KIAIVVRDSARELDHVKQTRNGVVGVPWKYLEGKARDMANQEEWVPFMDVLVLLNFGVVLFPNMDGARRVAHGSSAACPLFVYGPLMVIFHHGDAAEDKGEE

SEQ ID NO: 155798 - protein, 57 aa, Glycine max
  Coding DNA Sequence Number=SeqID_64113
MGVQIAPRPIWALQKIPPEGAEALPKRFRNVFREESRKDFNRSSMFFIRSSSSRSQP

SEQ ID NO: 155799 - protein, 273 aa, Glycine max
  Coding DNA Sequence Number=SeqID_64114
AWRSSLRKDKELRGIRNGVIGGYHGWQKIHARGLDWLSKLKVIDEEDFEAPEEDEEVRALKLELVKARLAKEKFKSAATHIRKECTDLQEENAATARALEQETKRARKEEYGREKFRGALWGSNNELKLRREERDRSRVHGMILKEELVACARSKRSLAQHLEATEQSMLAIIGQYKEELNQSVAHEQKLVEDFAQVYAEKEARGRVIDALHQEATMWMDRFALTLNGSQDLPRLLAKAKAMAEVCTPPEEIHGLINYCQHMIDLMAHIIRNR

SEQ ID NO: 155800 - protein, 317 aa, Glycine max
  Coding DNA Sequence Number=SeqID_64115
MAKFDPEIVLDFYANAWPTEEGVRDMRSWVRGQWISFDADAIGQLLGYPLVLEEGQECEYGQRRNRSDGFDEEAIAQLLCIPGQDFARTAAGRRVRIMRTKMTTLTQIWMTLLLSNILPSNHNSDLPLPKCQLVYAILTWMSVHVAQLIADAIYIFAGMAPTRHPLDPDKSNRALGFPSLITGLCQSFGVPVAPTKVIRPPITRAFIEKYCTQRQAQGDAPQAAGAPPPPHQAGQAGAFDMEQYLRHLMSLSMQSQGFASFSCPTPDQFRAEVAWPGDWPEAQAGEAPPEAPDGGEEAHEDEEMADLLDFLGGSGDT

SEQ ID NO: 155801 - protein, 51 aa, Glycine max
  Coding DNA Sequence Number=SeqID_64116
PLIELVRNHVPSWEDVHERGFEGRILEYEEPRDLRSNPFQGGGDDAILPPK

SEQ ID NO: 155802 - protein, 139 aa, Glycine max
  Coding DNA Sequence Number=SeqID_64117
MERLGSSSSAPNNRERDYHNDSRHVTSVLLWKWWVTHLQSFVDLVFASERIDVGLKRGKFSHPAWTNEKTGANEEGEDEVEAHAVTAIPIQPSFPPTQQCHYSANNKPSPYPPPSYPQRPSLKSTTKPTYRTSNDKHHL

SEQ ID NO: 155803 - protein, 80 aa, Glycine max
  Coding DNA Sequence Number=SeqID_64118
MSLPNAVHVSPLSSAKLLVTGKHKKKRRSRDESRHHGKGRTDEISVLSLLSLISDERPTWALQKIPPEGCCFWRKQPCSP

SEQ ID NO: 155804 - protein, 181 aa, Glycine max
  Coding DNA Sequence Number=SeqID_64119
MAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFCRALGIPPLITGLCQSFGVPVAPTK

SEQ ID NO: 155805 - protein, 66 aa, Glycine max
  Coding DNA Sequence Number=SeqID_64120
MEALMVSRRNHMFVIIKKGENVNVCIHDIDDAKEESNKVASKDKHLLQDLYKIASTNKVLLQDSLR

SEQ ID NO: 155806 - protein, 49 aa, Glycine max
  Coding DNA Sequence Number=SeqID_64121
MWDIPFITEPNQTLTYVMQSYPARALDRRLQVDWARDPREGPRVLMSLR

SEQ ID NO: 155807 - protein, 209 aa, Glycine max
  Coding DNA Sequence Number=SeqID_64122
MIDAFLAYHHSKENPVIAVLADAYDTFDLRCKKSSARIVYCTPTLYVWLVSHVFRHESRPVCPLQGHHMCAEKGKVNWEELLAALRQLGYPMRGASSKEIIAPFVARGFSGGNAKMVEGYHKWLKAWTQWITWLLKLKSPSEEEVEVPEEGEEVQALKVELERMRVVKEKLKTTVSRVGKECDKLRDVNITTAEALERETKRAQKEKWG

SEQ ID NO: 155808 - protein, 187 aa, Glycine max
  Coding DNA Sequence Number=SeqID_64123
MVIDQFLFYDLTQLSSESVPFEGTLNDDWKFDFSVHDIRQLVCTNQADMTGRLLVGSLAFESRILHYLIMRILLPRSSNVAQAHLVRYRMHKALRLNVPLPYPHLVTLFIQHFNIPLDSEPYVLIKRSFLIGAIVIASFGYHKVHDGSWVKKDAQPIDEEGHLPVGEDSSLLQKDFGQVRWSSNLCW

SEQ ID NO: 155809 - protein, 331 aa, Glycine max
  Coding DNA Sequence Number=SeqID_64124
  Gene Ontology: Mol. function=sodium ion transmembrane transporter activity; Cellular component=1-2nm peptidoglycan-based cell wall; Biological process=pantothenate transport
  Homolog annotation: Hit_ID=P16256; Match level="QueryCoverage=100%, HitCoverage=68%, E-value=1e-165, Identity=88%"; Hit description =Sodium/pantothenate symporter
  Pfam annotation: Domain name=SSF; Domain location=1-294; Score=334.3; E_value=2.1e-97; Accession=PF00474.8; Description=Sodium:solute symporter family
MTVQFIGGARLLETAAGIPYETGLIIFGVSIALYTAFGGFRASVLNDTLQGMVMLIGTIVLLVGIVHAAGGLTHAVETLEAIDPKLVSPQGADDILSPAFMTSFWVLVCFGVIGLPHTAVRCISYKDSKAVHKGIIIGTIVVAILMFGMHLAGALGRAVIPDLTVPDLVIPTLMVKVLPPFAAGIFLAAPMAAIMSTINAQLLQSSATIIKDLYLNLRPEQVENERRLKRMSAIITLVLGALLLLAAWRPPEMIIWLNLLAFGGLEAVFLWPLVLGLYWERANAAGALGAMIVGGVLYALLATFKIQYLGFHPIVPSLLLSLLAFVVGNRF

SEQ ID NO: 155810 - protein, 79 aa, Glycine max
  Coding DNA Sequence Number=SeqID_64125
EGEALTDSSECRPWGSPAFSQNIVTLTGLPMILLSESDLTNPWCGVSCYVLLSAPGWFFTDMVDDYEEPHARGHGNTTL

SEQ ID NO: 155811 - protein, 96 aa, Glycine max
  Coding DNA Sequence Number=SeqID_64126
  Subcellular localization annotation: CTP_CleavageSite=17; ConfidenceScore=5.16e-01
MSSSPLGSHNHSQTHLKLSNGFCFETRISTDLHTDKSLRTLWNLDLSLSRTSLTCKSFKPGPDSGACRGFFKKNSKLSFSNLNSGLNRWPCSCSCA

SEQ ID NO: 155812 - protein, 106 aa, Glycine max
  Coding DNA Sequence Number=SeqID_64127
TNGLHPIPVKVENPGFTRNSPQISASPHQLDLAPYASEPYNAQWNAPGLLRDKHTLRSSRILGEMEVDEPWLGLWLPLNYQVDMGANFVVDLGMAFVDKWAVGKEK

SEQ ID NO: 155813 - protein, 511 aa, Glycine max
  Coding DNA Sequence Number=SeqID_64128
  Gene Ontology: Mol. function=cobalamin transporter activity; Cellular component=integral to membrane; Biological process=cobalamin transport
  Homolog annotation: Hit_ID=A8GL73; Match level="QueryCoverage=54%, HitCoverage=51%, E-value=1e-149, Identity=81%"; Hit description=TonB- dependent vitamin B12 receptor precursor
  Pfam annotation: Domain name=Asp_Glu_race; Domain location=301-511; Score=282.1; E_value=1.1e-81; Accession=PF01177.13; Description =AspGluHydantoin racemase
  Pfam annotation: Domain name=TonB_dep_Rec; Domain location=133-318; Score=4.3; E_value=0.029; Accession=PF00593.15; Description=TonB dependent receptor
  Pfam module annotation: Pfam domain module=Asp_Glu_race::TonB_dep _Rec; Domain location=301-511::133-318
SMLDTRELYSQTWDTGLRYKEGIYATQLTGSYSHSKDYDYDPRRGMHDSSASLVDSEQYNLQWGNTLQVGQGTVSSGVDWQQQKIKPDSTTVKGEKSQRDAGIYLTAQQLVGPVTLEGAVRGDDHSEFGWHGTWQTSAAWEFVEGYRFIASYGTAFKAPNMGQLYGNFGNNTDLKPEESKQWEGGDHQRDEATASFDTGPLTHQIGYDYVDPRNAKTHEVLLRRAKQQVKYELDWQLYDFDWAVTYQYLGQRYDKDYSTYPEQSVKLGGVSLWDLAVSYPEENTTSLEAIPSNSTATPRPTVLVFDSGVGGLSVYQEIRQLLPDLHYIYAFDNVAFPYGEKSEEFIVERVMEIVGAVQQRHPLAIVVIACNTASTVSLPALRERFSFPVVGVVPAIKPAARLTVNGIVGLLATRGTVQRSYTHELISRFATDCKIELLGSSELVELAEAKLHGEAVPLPVLKKILHPWLSMREPPDTVVLGCTHFPLLAEELMQVLPEGTRLVDSGAAIAR

SEQ ID NO: 155814 - protein, 108 aa, Glycine max
  Coding DNA Sequence Number=SeqID_64129
HVGDESTEATILEPFVIGEEADETQVRQVAATTPERSLEATLEPPAPVVDLPSPQHTADPSTPILEIPEDPTTPVLAMDTSPPATPILHLTDEEDVQTQDTQDQSQEF

SEQ ID NO: 155815 - protein, 206 aa, Glycine max
  Coding DNA Sequence Number=SeqID_64130
MAPRKLASKRSRKDKAAEGPSSAPEYDSHRFRSAEHIKGWSFLWERRVQLRDDEYTNFQEEIVRRRWASLVTPMAKFDPDIVLEFYANAWPTEEGVRDMRSWVRGQWIPFDADALSQFLGYPLVLEEGQECEYGQRRNRSDGFDEEAIAQLLCIPGQDFARTAAGRRVRIMRTNMTTLTQIWMTLLLSNIQPSDHNSDLPLPKCQL

SEQ ID NO: 155816 - protein, 84 aa, Glycine max
  Coding DNA Sequence Number=SeqID_64131
MCDAILPRKGPVTKAMSKRLQEDWARVDKEGLRVLMNLRLSSSFSRKLLKELLKEVFSKKLLKEVFLRKLLKEVFLRKLLKEAT

SEQ ID NO: 155817 - protein, 19 aa, Glycine max
  Coding DNA Sequence Number=SeqID_64132
MVEKFLKKYFPKSKTAEGK

SEQ ID NO: 155818 - protein, 20 aa, Glycine max
  Coding DNA Sequence Number=SeqID_64133
MEEKRKTKEKRSEEVPSTKE

SEQ ID NO: 155819 - protein, 55 aa, Glycine max
  Coding DNA Sequence Number=SeqID_64134
MILSNMIALNLEQTRWVYNLINLRKLFEWPRKFQLRLNPAKCTFRVKSGILLGFV

SEQ ID NO: 155820 - protein, 83 aa, Glycine max
  Coding DNA Sequence Number=SeqID_64135
MATSQDGNGGVLPLAFAVVEALVKSTYSRCRKNFVERGRQAQTQLNEGQVYCSKLVKELRKNQEQACSHIVRVCDIHSTHGLK

SEQ ID NO: 155821 - protein, 167 aa, Glycine max
  Coding DNA Sequence Number=SeqID_64136
MERSMIDAASGGALGDMTPAEARNLIEKMASNSQQFSARSDAIFIRGVHEVATNSSPSGETKKPEGKLDALVNLNVVGPSKLYVPPPIHQQQQQQPQKQQAVEAPPQPSLEELVRQMTMQNMQFQQETRASIQSLTNQMGQLATQLNQQQSQNSDRLPSQSVQNPKN

SEQ ID NO: 155822 - protein, 70 aa, Glycine max
  Coding DNA Sequence Number=SeqID_64137
YEACLWGFYGGWIFELQWGPLMVIFHHGDAAKDKGKELGEDASMEEKKEEEKERGGSTKLKEEKGREVEL

SEQ ID NO: 155823 - protein, 194 aa, Glycine max
  Coding DNA Sequence Number=SeqID_64138
MVRLMKQANVFMLKKTHKKFIIWEINRDKGILKEDFQDSSRVLIISKDSGGRTRAISSTKTRIADKSSNSFVANTEKNAKEEYKAVMTRSKRFVEDEEEESVGLRKKAIEKKGTDGKKNEVRGEKNQEKEKQIMVKKKELNDQEKEKEVEKEKENKEFEKDEKMRMKRRVEVKKAVNEDMEVPYPVVPSKKEKD

SEQ ID NO: 155824 - protein, 96 aa, Glycine max
  Coding DNA Sequence Number=SeqID_64139
MSSKVILRMPKNQGSRKLQRFKNQVSRIKIQDSRIKFQESRFKNNQDQDSRLKIQEIREDSIKISSKKFFKTLSSRRSFHKIITKEFYSLVIDYQK

SEQ ID NO: 155825 - protein, 42 aa, Glycine max
  Coding DNA Sequence Number=SeqID_64140
MGGACHPARPGEQAFEEVANTHGLRKTPPFDFRHITEFSRIA

SEQ ID NO: 155826 - protein, 186 aa, Glycine max
  Coding DNA Sequence Number=SeqID_64141
MVKEECKEVSVSSKRLAKKESHFEIKTNIKETSPLRQPPHLLLCKKTLLSTATPLGLEVIPQVKELLDEGLVRKSLNPCALLVPKIGIIRHQIPKISDMMNVLSGATLFCKITRTPNIFMVCVHRDPLGSDQGVPMNPRRIKVIPKWLTPPSVEGRSPEYEEPRDLRSNPLQGEGNDAILPRKGIG

SEQ ID NO: 155827 - protein, 32 aa, Glycine max
  Coding DNA Sequence Number=SeqID_64142
MESLRNLDLSLSNWLQVVSTLPSLSELHLESC

SEQ ID NO: 155828 - protein, 130 aa, Glycine max
  Coding DNA Sequence Number=SeqID_64143
  Homolog annotation: Hit_ID=A5B3T6; Match level="QueryCoverage=70%, HitCoverage=23%, E-value=9e-09, Identity=34%"; Hit description =Putative uncharacterized protein
MDHEDPCMHFSTFIGLCSTMRASNEDVEVVYLRAFPFSLASKAKTWLQSHPNKIRNTCGLKLQTIMILDASAGGTMMSKSPEEAIVIIDSIATSDHQSHHDRAPTQRKGIMELDTHSANSSSKQTLDTTN

SEQ ID NO: 155829 - protein, 97 aa, Glycine max
  Coding DNA Sequence Number=SeqID_64144
MLRNFTDYATMLVFLLEHCETLRIMQRCLFRGFRREQTRFKDRPQVLSDEIRVLLGFLSLSKLLDSYLIHHHEACFYSEYWVSACFSRSADGLKRCA

SEQ ID NO: 155830 - protein, 74 aa, Glycine max
  Coding DNA Sequence Number=SeqID_64145
GQGVPMNPKRIKVTPEWPTPPTPLIELVLREGAQSMKNLGIRGQILSKVEGMMQSYPARALDRRLQVDWARDPR

SEQ ID NO: 155831 - protein, 173 aa, Glycine max
  Coding DNA Sequence Number=SeqID_64146
MGEAEEVQEKMKADMEAMKEQMATMMEAMMRMKKIMEANAVIVAATSAVTKVNPMLPSGLKQMNHPTSNMDVNNSTPILIKSQQPQSDHAHVSRPMEETHEIPHHDLANFEPCLGYAAEGQAVGGIPLQNTLEGPQFCPQTQPLHFAVGRAPPAMAEKGKADHLEERLRAIEG

SEQ ID NO: 155832 - protein, 98 aa, Glycine max
  Coding DNA Sequence Number=SeqID_64147
MKLKSRFRLQKSSMSGRSLYDIYEKPVELLWDGKKFGVPNADASFFLTYFYVNEIISGLWMSEVQALVMLQCMDSLSLNPYTMQRLDVLNVDNTLKHG

SEQ ID NO: 155833 - protein, 117 aa, Glycine max
  Coding DNA Sequence Number=SeqID_64148
MRLPGKESLLMKSPITINEILDVSISFLNGYLEETLGSTKIEEIHSKCINLAQDFGSKACRMARHDTCQGLVWFKDKRDAPHYFHDTNAKMMIWKLYAKLVMHAPMRTLKCQIFMVG

SEQ ID NO: 155834 - protein, 61 aa, Glycine max
  Coding DNA Sequence Number=SeqID_64149
MNSVWVFAWMFVEAEDADGDPVLERNEDMGYMGVRELRCEVEQGMVGLARFVDVENLLNSV

SEQ ID NO: 155835 - protein, 158 aa, Glycine max
  Coding DNA Sequence Number=SeqID_64150
MRKGKFEYASNVAPKNNRRAPVVGTRKKEGDTHAVTTAPTWMKTPQNAQNSYQHNHPNFSIRAGSSLPTQVEGPPATEKTSTQHTAPATPRPANNTTPGASYNNARRPPKDEFSPISMAYSELWPSLLENHLVVAIPGKVFQPPYPRWYNSEATCAYQ

SEQ ID NO: 155836 - protein, 43 aa, Glycine max
  Coding DNA Sequence Number=SeqID_64151
MAHQEDKGKELGEDASMEEKKEGEKEGGGSTKLKEEPGREVEL

SEQ ID NO: 155837 - protein, 250 aa, Glycine max
  Coding DNA Sequence Number=SeqID_64152
RGCQHDYGRSVKEGNKEGPEKKNGAKTSSEGLYGAATTSSSFKGLKGTSQGWKDEHAKVSTLQVEKEARERVIESLHEEATKWMDRFAFTLNGSQELPRLLARAKAMADVYSAPEEVHGLFDYCQHMEVQEQMKADMEAMKDQVTSKMEAMLSMRRMMEDNTAAIATTSAAAEADPTHPSGINQTSRPAPDVVGQGGEVLGSTSGPHIVQSKNSFPLYGLPPNYTPPNAVHMPNKNANHSIPVLLESQQP

SEQ ID NO: 155838 - protein, 112 aa, Glycine max
  Coding DNA Sequence Number=SeqID_64153
MGAKHLTRTKQKLHVIHAKVSRTKIRNVYTDNHSGISASQRDSNVSMTDLVSAEDDVNLRVSTGLSTAIDEGRRMTIICLCVPSDTTVSEWQKGVQNDHNLSPHVIEPATSG

SEQ ID NO: 155839 - protein, 66 aa, Glycine max
  Coding DNA Sequence Number=SeqID_64154
EREESKEFSDCVVLNSLTREKGDTKEFRREKRMKRSIEQVFKVWKTRKLQKAFGTKKKKKFKEIQG

SEQ ID NO: 155840 - protein, 130 aa, Glycine max
  Coding DNA Sequence Number=SeqID_64155
GCINYNPVLAIRQLGYPMRGVPSDESITPFIARGFSDHNARVLQGVRKAWDAAVRTQGLDWLPNLKTVRDDEVKTSEESDEVQALKAELERARVVEEKFKAAIMSSSSEEVKGIITGQRHDLEGRAKGLP

SEQ ID NO: 155841 - protein, 136 aa, Glycine max
  Coding DNA Sequence Number=SeqID_64156
MSLVMPMAKFDPDIVLEFYANAWPIEEGVQDLRSWVRGQWIPFDADALSQFPRYPLVLEEGQECEYGQRRNRADGFDEEAIAQLLCIPGQDFAQTAAGRRVRIMRTNMTTLTQTWMTLLLSNILANDHNSDLPLPK

SEQ ID NO: 155842 - protein, 100 aa, Glycine max
  Coding DNA Sequence Number=SeqID_64157
PPKASRKWGGRNTEKIFGGSPLSKCGWVGGPGSDRHVKKAMQGLFAVLQLSMWGWFHTFFSKKVGPSIRYKVTARASKKERRIGTNSWLAWGASVNWFPR

SEQ ID NO: 155843 - protein, 69 aa, Glycine max
  Coding DNA Sequence Number=SeqID_64158
MAGCFRTNQRILVRKGNKDELGKTIGREQEKPPKSQIGCENGSKFSNWPNEREVRWKGFGESHELIWKM

SEQ ID NO: 155844 - protein, 157 aa, Glycine max
  Coding DNA Sequence Number=SeqID_64159
  Homolog annotation: Hit_ID=Q6WAY6; Match level="QueryCoverage=82%, HitCoverage=23%, E-value=1e-15, Identity=33%"; Hit description =Putative uncharacterized protein
MVEVSTEAIASLAQYYDQPLRCFTFGDFQLSPMVEEFDEILGCPLGGRKPYLFSGFYPSLARISKIVQISAHELDHKKQVENGVVGIPRKYLEAKARILAGKSEWAPFIDILALLIFGGVLFPNVDELVDLAVIDAFLTYHNHKESPVCRYCLADLL

SEQ ID NO: 155845 - protein, 118 aa, Glycine max
  Coding DNA Sequence Number=SeqID_64160
MRLRSQSEKPSMLLFIARVLAEGETLPAYSRYCRLPTDFREIKVALCIPGRGFILNSEGHPGRILRKDLTTLAQVWSVLSYSNLAPTSHTSDLTVDRARLIFGLVSHLDINIGALISS

SEQ ID NO: 155846 - protein, 28 aa, Glycine max
  Coding DNA Sequence Number=SeqID_64161
TSRSSIKNPIQDSRFKRRNQEATSQDFI

SEQ ID NO: 155847 - protein, 63 aa, Glycine max
  Coding DNA Sequence Number=SeqID_64162
GIAQGRKASSCRQKCRRGQAFKHLINEWQGKMVLFGNLVQPPIVNADSPTDGTHPLAAGDRDE

SEQ ID NO: 155848 - protein, 61 aa, Glycine max
  Coding DNA Sequence Number=SeqID_64163
AVPSGGSNPARLGELGGNHLPLFPYKLGKEGRTKMFNPPDVSVGYFAKVFHHSSSFFGLQT

SEQ ID NO: 155849 - protein, 53 aa, Glycine max
  Coding DNA Sequence Number=SeqID_64164
MIMRSQDIYSSQDEATTSPSSSESEEAKGEESSEEIYPQEEGQPLMVSVRRYY

SEQ ID NO: 155850 - protein, 325 aa, Glycine max
  Coding DNA Sequence Number=SeqID_64165
MAKFDPEVVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPLPKCQLVYAILTRMSIHVAQLIADAIYIFAGMAPTRHPLDPDKSNRALGFPALITGLCQSFGVPSHYQGDSAAHHPGLLLRSTAAGAPPPPHQAGQAGAFDMEQYLRHLVRQQAANHRAHVQTHDFLYQMSLSMQSQGFASFSCPTPDQFRTEVAWPGDWPEAQAGEAPPEAPGDGEEAHEDEEMADLLDFLGGSGDT

SEQ ID NO: 155851 - protein, 67 aa, Glycine max
  Coding DNA Sequence Number=SeqID_64166
MAHHLPIERKRKGIKFHAFYRYTILFHHVGQLDQLPQVVIQHLLEPVLEVKYYSFKQLGELDGIDFP

SEQ ID NO: 155852 - protein, 72 aa, Glycine max
  Coding DNA Sequence Number=SeqID_64167
MDNEKGVQEQMKVDLSALKDQMASISEVMLKLQKTIEDKVTATASSIVREVEPVLQPALNPGRDRNTAVFVE

SEQ ID NO: 155853 - protein, 106 aa, Glycine max
  Coding DNA Sequence Number=SeqID_64168
MVSGNRLPRGCNRLPGLKTRSGSHEGFWQQVVEASGNRLPVCVIDYTEEWVTGNRLPGFHVLKLCDSSLASSNRLPRLCNRLPEMKSFKIPLLLACSGYETNCVAA

SEQ ID NO: 155854 - protein, 164 aa, Glycine max
  Coding DNA Sequence Number=SeqID_64169
MVRLMKQADVFPLKKTLKKFTIWEINRDKDILKEDFQASSKRTPKLEETLTQFMQVTLSNHKSTESALKNLEVQVGQLAKQIADKSSNSFMANTEKNPKEECKAVMTRSKRFVEAEDEDSDVSKKKAAEKKGTDENKDVVKGESNREKEKQLMVKKKKLNDQEK

SEQ ID NO: 155855 - protein, 70 aa, Glycine max
  Coding DNA Sequence Number=SeqID_64170
MDWSSVLRWMTLRLAQMHNSSFFQILPRAQPRSVALSEWFAKPEDWLSERMKINTLQTCLIILKFREKDY

SEQ ID NO: 155856 - protein, 116 aa, Glycine max
  Coding DNA Sequence Number=SeqID_64171
MDISEDTDIPVILGRPFMLTASCIVDMGKRKLELGFEDQKIDFDLFVEDKPAPEHNVCLRVMGEVQEVLKVRIKMIYCRQAQFLTALIEDHDAKRQSWQLSEILCGNMSAKRVPLS

SEQ ID NO: 155857 - protein, 55 aa, Glycine max
  Coding DNA Sequence Number=SeqID_64172
MATSKNSVGGSVGSSERGQCGFSGSVGGTVGLSEDNVGVEGVVSDSFQAGGERQE

SEQ ID NO: 155858 - protein, 100 aa, Glycine max
  Coding DNA Sequence Number=SeqID_64173
MYIKYGPKYIMKHSQQNKLSNIYPIYNACSELQNKERETRLKRAIKGINSRTHQQESSQGYCASNQWGKTHQMIIMMDGSNSHKGKIITFKLSFQNYHDM

SEQ ID NO: 155859 - protein, 136 aa, Glycine max
  Coding DNA Sequence Number=SeqID_64174
MERSMIDAASGGALGDMTPAESKNLIEKMASNSQQFSARSDAIVIRGVHEVAKNSSSSAETKKLEGTIPGGGIIPTLDGRILHNNSNNNNNLIFRMLLAQADHTFLHQSSSNNNNNNSPRNNKQLRPLRNLPLKNL

SEQ ID NO: 155860 - protein, 115 aa, Glycine max
  Coding DNA Sequence Number=SeqID_64175
  Homolog annotation: Hit_ID=A5BP71; Match level="QueryCoverage=44%, HitCoverage=13%, E-value=1e-10, Identity=56%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MAIIVNAEASGYVSMNYYQYIDVVYTNEHILKACSAQWWPLGNEAAIPPSDEAWTLIPDPTTIRAKGRPKSTRIRNEMDWVEPSDHRQKCSRCGAEGHNRRRCPMQSDRGSNLFN

SEQ ID NO: 155861 - protein, 124 aa, Glycine max
  Coding DNA Sequence Number=SeqID_64176
PTRAFQILPPEGGCFGRKQLSSPGRAELAWDYCFREENPSRGTSVTFPWVITRRFSIVVRHSSFVLRFLRSSTAVLGEKNCFREENPSRGASVTLPRFFRKQIREAFPPLSTVLRSFFVLQRLA

SEQ ID NO: 155862 - protein, 136 aa, Glycine max
  Coding DNA Sequence Number=SeqID_64177
MKLTGSGAAIGGGISICLPDLKPSAPSDLLDSEWRLLSLAEIAYSGWSFASLTLLRKVEEEPQLLVVFVVVVAVVATYPSAGGRRETRGMRVPRKEYARSRHQRLFEENVGKTGKDAIYELLSERFGSCIYARGRY

SEQ ID NO: 155863 - protein, 203 aa, Glycine max
  Coding DNA Sequence Number=SeqID_64178
MLWKLGRIDGDPVLRETRIWATWEYVSSVGGGQQGMVGLCAHCGCGKLVVHHRPDRHLIVMAAQLIRDRVEMECLEGAWETLEGNTRCRFRGTIRFTATSLVHPDEPAWTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 155864 - protein, 70 aa, Glycine max
  Coding DNA Sequence Number=SeqID_64179
MSGLIRDSPQISTSPHQLDFAPYASGLYNAQWNAPGLLHDKHTFRPSPILRKMEVEETIALSSRYGSKSA

SEQ ID NO: 155865 - protein, 122 aa, Glycine max
  Coding DNA Sequence Number=SeqID_64180
MLISPCEWIVPARHPVDPEKSNRVLGFPALIMGFCQFYGVPVTPGKVIRSPTNQAFIKKYCTPRQAQGETPQQPGDGWQRATNAPPPPPEPLSSSTKRRPAQDVKEALLGGNLVPFESMLVI

SEQ ID NO: 155866 - protein, 318 aa, Glycine max
  Coding DNA Sequence Number=SeqID_64181
MVEVSTEAIASLAQYYDKPLRCFTFGDFQLSPVVEEFEEILGCPLGGRKPYLISGYSRTVDLRRSPLSECGWARACQLGYPMRGAPLEDELAPVISRGFNKTNVETLQKIRKAWEVLQKKDKELWGSNNGPIGGYRKWLKAHVQGLDWLPSLRTAKREEVEAPKEDEEVQALRAELEQAQTVKEWFKSAALKIRKENAELRDINVATSKALELEIKRACREEHGRNKFQGALWGSNSELKLRREERDQSRIDSLILKDELKVCSRSKRNLSQRLCEIETNMLAIVSTYQEELNLATTHEHRVADEYAQVYAKKEARGR

SEQ ID NO: 155867 - protein, 174 aa, Glycine max
  Coding DNA Sequence Number=SeqID_64182
MGDQEETQEQIKVDMSALKEQMASMMEAMLGMRQLMEKNVATAAAVSSVVEADPTLLATAHHPPPNAVGREKSTQGHNSNPHLGYNRVAYPYGLSPNYMPLVMHDDAGHVPSPILEREPPQQLHEAHEDHQEHAQGEVDFYPPIPFEGPAPNTLPQHNLTTQPIFLSTEGPPLA

SEQ ID NO: 155868 - protein, 38 aa, Glycine max
  Coding DNA Sequence Number=SeqID_64183
MEEVVPRDMSRGSGDLGDVRWGCYCPKPSLANPDPTRA

SEQ ID NO: 155869 - protein, 100 aa, Glycine max
  Coding DNA Sequence Number=SeqID_64184
  Pfam annotation: Domain name=zf-CCHC; Domain location=21-38; Score =28.8; E_value=2e-05; Accession=PF00098.14; Description=Zinc knuckle
  Subcellular localization annotation: CTP_CleavageSite=38; ConfidenceScore=5.24e-01
MPNAGANHNFASSSNTDTKNMKCFKCLGRGHIASDCPTRMMEACLRRGERRRHPLGNKPWKKELRHQECALDKKLGEDASMEEKKERERERGEHEIEGGK

SEQ ID NO: 155870 - protein, 100 aa, Glycine max
  Coding DNA Sequence Number=SeqID_64185
TYPLKTEENDELLKNGRESLRNYSRKRYGSALAWIFFTKIIFLSNFKRIRSAKKAEPLLPYLPPPIYSKIGEELATQLAQASKVTSSRSNSLLEEESGRP

SEQ ID NO: 155871 - protein, 99 aa, Glycine max
  Coding DNA Sequence Number=SeqID_64186
MSSGCLLVDPNGQNLGRIDGDPVLRETRIWATWEYVSSDGGGQQGMVGLCAHCGCGKLVVHHRPPPPSTTCDGVVPGDMSRGSGDLGDVRWGAIAQNQA

SEQ ID NO: 155872 - protein, 112 aa, Glycine max
  Coding DNA Sequence Number=SeqID_64187
MGPRTGYGKIWNKWLNPKGIEEQWGITFEKQHLIQHACVSFKTRKGKQGSKGLSKELIQGKSIWLEAYKNKIALIISKYACELGSINKNQAKAMGQNTPNDYDDEWLKFSQR

SEQ ID NO: 155873 - protein, 370 aa, Glycine max
  Coding DNA Sequence Number=SeqID_64188
  Homolog annotation: Hit_ID=Q84VH5; Match level="QueryCoverage=100%, HitCoverage=57%, E-value=1e-145, Identity=71%"; Hit description =Envelope-like protein
MATSPKETSAPGSPAVPSSPSSTKAPSIQEQPEFHIQPIQMIPGQAPVPEKLVPKEQQGVKISENPSLATSPREVDTEMDKKIRSIVSNILKNASVPDAEKDVPTSSAPNAEALPSPSEEESTEEDDQATEETPAPKEPEPAPGDLIDLEDVESDEEPIANKLAPGIAERLQKQKGKNPHQEKKSTPITPTTSRWSKVAIPSKKRKEISSSDSDDDVELDVPDIKRAKKSGKKVPGNVPDAPLDNISFHSIGNVERWKFVYQRRLAVERELGRDALDCKEIMDLIKAAGLLKIVTKLGDCYESLVREFIVNIPSDITNRKSDEYQKVFGRGKCVRFSPAVINKYLGRPTEGVVDIAVSEHQIAKEITAKQ

SEQ ID NO: 155874 - protein, 120 aa, Glycine max
  Coding DNA Sequence Number=SeqID_64189
MERGANEKRREQQKGREGKFPIKEWEKAKRKERKFPIKEWEKAKRKERKFPIKEWEKAKRKERKFPIKEWEKAKRKERKFPIKEWEKEKKRREKKDRKLLIKDRKKTEEMCREVFGPDNI

SEQ ID NO: 155875 - protein, 57 aa, Glycine max
  Coding DNA Sequence Number=SeqID_64190
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=80%, HitCoverage=4%, E-value=3e-16, Identity=91%"; Hit description =Phosphoenolpyruvate carboxylase
MAFKEKLVTKDVSLLSRWMAIDLYIREVDGLRFELSMNQCSDKLSELAHEILKGLSV

SEQ ID NO: 155876 - protein, 49 aa, Glycine max
  Coding DNA Sequence Number=SeqID_64191
MDYGLWLQKGNWEIVEASGNRLPVCVIDYTEEWVTGNRLPDRDGGAANP

SEQ ID NO: 155877 - protein, 224 aa, Glycine max
  Coding DNA Sequence Number=SeqID_64192
MAPRKLASKRSKKDKAVEGTSSAPEYDSHRFRSAEHQQRFEAIKGWSFLRERRVQLRDDEYTDFQEEIVRRWWASLVTPMAKFDPDVVLEFYANAWPTEEGVRDIRSWVRGQWIPFDADALSQFLGYPLMLEEGQECEYGQRRNQDDGFDEESIAQLLCIPGQDFARTAAGRRVRIMRTNMTTLTQIWMTLLLSNIQPNDPNSDLPLPKCQLVYGAYQAPSGPG

SEQ ID NO: 155878 - protein, 140 aa, Glycine max
  Coding DNA Sequence Number=SeqID_64193
MPPTRHPLDPDKSNRALGFPALITGLCQSFGVPVTPSKVIQPPITWAFIEKYCTPRQAQGDAPQATDAAPPPHQADPAGSFSMEQYLQHLVRQQAANHRGQVQTHECLHQLSLSLQSQGFAPFACPTPDQFRAEVAWPRD

SEQ ID NO: 155879 - protein, 111 aa, Glycine max
  Coding DNA Sequence Number=SeqID_64194
MQAFRKAYGKILDLTIAEISTEVVVSLTQYYDQPLRCFTFGDFQLGFGKRVGSCKANSKRRSGPTTEVLRRQGKGYGESRGVGPVYGRISIANLWGCPLSKHGWFGGPSRN

SEQ ID NO: 155880 - protein, 64 aa, Glycine max
  Coding DNA Sequence Number=SeqID_64195
NACALLVMGKVLGGVDGDPVLRGTRIRATWGYVSSVEGGQLGMVGSCLICGCARVDLHHLPIAT

SEQ ID NO: 155881 - protein, 174 aa, Glycine max
  Coding DNA Sequence Number=SeqID_64196
FPDESLSEALERLRGLLRKTPTHGFPEPIKLNMFIDGLRPQTKQLLDASVVPSVVRLMKQANVFPLKKTLKKFTIWEINRDKDILKEDFQASSSVLITNKDSGDHTWQSIHQGPGTTKLEETLTQFMQVTMSNHKSTESALKALEVHVGQLAKQIADKSSNSFVANTEKNPKEE

SEQ ID NO: 155882 - protein, 87 aa, Glycine max
  Coding DNA Sequence Number=SeqID_64197
MAPKKLSTKRSRRDAAAEGTSAAPEFDSHRFRSAEHQQCFEVIKEWSFHRERRVQLRDDEYIDFQEEIAHRHWTSLVTLPWLSLTLI

SEQ ID NO: 155883 - protein, 248 aa, Glycine max
  Coding DNA Sequence Number=SeqID_64198
  Homolog annotation: Hit_ID=Q6WAY6; Match level="QueryCoverage=78%, HitCoverage=33%, E-value=5e-13, Identity=30%"; Hit description =Putative uncharacterized protein
GVLFSCGGYPNIPLIGTRGCINYNPALAIRQLGYPMRGAPTEESLPPFLVRDFGAQNFKVIQRGHKAWESPLRKDKELRGIRNGIIGGYHEWLKMSGKSVPGYEKKMQLPRKPLNKKPRGLARKSMAVTNSAEHCGAATTETNMFAIITKYQEELSLATTHEHRVADEFAQVYAEKEARGRVIDSLHQEATMWMDRFALTLNGSQELPRLLAKAKAMADTYSAPEEIHGLLDYCQHMIDLMAHIIRNR

SEQ ID NO: 155884 - protein, 260 aa, Glycine max
  Coding DNA Sequence Number=SeqID_64199
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A8GF11; Match level="QueryCoverage=98%, HitCoverage=77%, E-value=1e-118, Identity=81%"; Hit description=D -isomer specific 2-hydroxyacid dehydrogenase NAD-binding
  Pfam annotation: Domain name=2-Hacid_dh; Domain location=3-248; Score= 101.2; E_value=3.2e-27; Accession=PF00389.21; Description=D-isomer specific 2-hydroxyacid dehyd
  Pfam annotation: Domain name=2-Hacid_dh_C; Domain location=110-259; Score=195.0; E_value=1.8e-55; Accession=PF02826.10; Description=D -isomer specific 2-hydroxyacid dehydr
  Pfam module annotation: Pfam domain module=2-Hacid_dh::2-Hacid_dh_C; Domain location=3-248::110-259
MKVAVYSTKHYDQKYLEHVNEGYGFELQFFDFLLSETTAKNAAGCDAVCIFVNDDGSKAVLAELAALGVKYIALRCAGFNNVDLDAAAALGLQVVRVPAYSPEAVAEHAVGLMMTLNRRIHRAYQRTRDANFSLDGLTGFNMHNKTAGVVGTGKIGVATMRILKGFGMRLLAYDPYPSDAALALGAEYVDLKTLLAESDVITLHCPLTPENHHLLNAQAFSQMKDGVMIINTSRGGLIDSQAAIEALKQQKIGSLPHGCV

SEQ ID NO: 155885 - protein, 539 aa, Glycine max
  Coding DNA Sequence Number=SeqID_64200
  Gene Ontology: Mol. function=oligopeptide transporter activity; Cellular component=periplasmic space; Biological process =oligopeptide transport
  Homolog annotation: Hit_ID=P77348; Match level="QueryCoverage=95%, HitCoverage=95%, E-value=0.0, Identity=72%"; Hit description =Periplasmic murein peptide-binding protein precursor
  Pfam annotation: Domain name=SBP_bac_5; Domain location=78-458; Score= 301.6; E_value=1.5e-87; Accession=PF00496.13; Description=Bacterial extracellular solute-binding proteins, family 5
MKLTFRTTLAALIISSALSSAYAASVPAGAQLASSQEIVRHIKDEPASLDPLKAVGLPEIQVLRDLFEGLTNQDAQGKIVPGVAQSWSSNDNKTWLFTLRKDARWSNGQPVTAQDFVYSWQRLVDPKNSSPFAWFAALSGIENAEAITKGQMSPDKLGVVATDETHLKVTLSRPLPWFPSMVANVAMFPVPQKVIAQNGDGWTAPGKLVGNGAYQLQERVVNEKIVLVRNPHYWDNAHSVLTKVTFIPINEESSATKRYRAGDIDITESFPKNMYGLLKKELPGQVYTPDQLGTYYYAFNTQKGPTADVRVRKALSWSIDRRIIAEKVLGTGEKPAWHFTPDVTAGFTPQQSYLQQHSQQELNAQAKALLTAAGYGPAKPLHLTLLYNTSESHQKIAIAVASMWKKNLGVDVTLQNQEWKTYIDSRNSGNFDVIRASWVGDYNEPSTFLSLLTASHSGNISRFSNAEYDAVLSKASNETSVAARNADYNKAEQIIADQAPIAPIYQYTNGRLIKPWVKGYPITNPEDVAYSRELWIEKH

SEQ ID NO: 155886 - protein, 237 aa, Glycine max
  Coding DNA Sequence Number=SeqID_64201
MIHQPALGGLHRRQPQTIHADAFERGILPRVLHQLLQQRHHIGVLIGGDVIGLGGGKQQLIDDRREQTAEQRALAIVKTLHQLGQRQPHIIERLRSTVERLQAIDQHDLAIEAQEVIFIKPFHHMLTVVVETLLQHGEIAASRRLQQLAGLLFIDVGPGEKLQCRRASHVTRQHKTSRLDEVQSFGFALMQVVGPGGCDLRQAVFIGGRERVEVGAQAVPARGPLLTIALQQADHLA

SEQ ID NO: 155887 - protein, 80 aa, Glycine max
  Coding DNA Sequence Number=SeqID_64202
  Subcellular localization annotation: CTP_CleavageSite=28; ConfidenceScore=5.34e-01
MATQLNQADSQNSDKLPSQTVQNPKNVSAITLRSGKQIEVPPPVATPAPAPEPEPVKLHSTPEKEDELATQKRKLPDHEG

SEQ ID NO: 155888 - protein, 87 aa, Glycine max
  Coding DNA Sequence Number=SeqID_64203
MASYGGEKDSIDEEDPRPPSIHMGATSRMVLKCGNCGSAKPLELVHKLPFIVGGNVPLPKGILKIIPILYWRIPMNPFFPNKGSPPT

SEQ ID NO: 155889 - protein, 123 aa, Glycine max
  Coding DNA Sequence Number=SeqID_64204
MAFLGETSSQTIVNSRLAFIYPTGSIIHNDTGVYFQTSTPVPIRVPNRCDFASLKTRIHNTLQLSDKQFLDEIHYRKPFTDTGKKFLRNFKFLSTCSIDELKNLIKQVAPKGIPLLEFTNHKR

SEQ ID NO: 155890 - protein, 163 aa, Glycine max
  Coding DNA Sequence Number=SeqID_64205
MGDQGETQEKMKADMSALKEQMASMMEAMLGMRQLMEKNAATAAAVSSAAEADSTLLATAHHPPSNIVGRGRDTLGHDGSPHLGYNRAAYPYGLPPNYSPPVLQDDAGHIASPVLEREPPQQPEEVHKDPQDYARRDVEFYPPIPEGPAPSILPQPNIATQPI

SEQ ID NO: 155891 - protein, 187 aa, Glycine max
  Coding DNA Sequence Number=SeqID_64206
MQPPVIYIITRQRITNRRWRDSLNVAKLSKNPLRSNVHDNLTPSELAGVRRYQVKAPDSPVLSIGHPVHVSHSQGIHTSLIRGSLDPRHMSLTHKPLAGPWAPLIISGVSSIGACRPRIFFINGILCFLEDEWQRNGERKRERRRPFKEKMSLEEAHQHRRPWIRAWRKKEMNEGRGREEHKILCSK

SEQ ID NO: 155892 - protein, 55 aa, Glycine max
  Coding DNA Sequence Number=SeqID_64207
MGAKHLTRTKQKSHDDSKSFLVIISASLADEQEEKLLSVLKKHKKAIGWTLVDIP

SEQ ID NO: 155893 - protein, 145 aa, Glycine max
  Coding DNA Sequence Number=SeqID_64208
MASITKAMLKLQKTIEDNATAAASNTAREAEPVLQLVINLGRDKNATGFNRRYSPQAYPYGLPPDFTPRTAPDDLSQAPTFEGQLPPHADYPLQEDDEGDAHLGPLLPLKDPTPHELPQPNIVCHVPSPSAPVKELVPFASTKPT

SEQ ID NO: 155894 - protein, 230 aa, Glycine max
  Coding DNA Sequence Number=SeqID_64209
  Homolog annotation: Hit_ID=Q2HW90; Match level="QueryCoverage=93%, HitCoverage=43%, E-value=7e-24, Identity=32%"; Hit description =Putative uncharacterized protein
MGSSQMASLKKRFYQVKIKSLGITNLKELGQLMGQLQWQAFRKAYGKIWDLAMVEVSTEAIASLAQYYDQPLRCFTFGDFQLSPMVEEFEEILGCPLGGRKPYLFSGFYPSLARISKIVQILAQELDHRKQVENGVVGIPRRYLEAKARILAGKGEWASFIDILALLIFGGVLFPNVDGLVDLAAIDAFLASHNHKESPVVAMLADLYDTFDRRCEKRNTRIVCCTPDLY

SEQ ID NO: 155895 - protein, 176 aa, Glycine max
  Coding DNA Sequence Number=SeqID_64210
MAPRKLASKRSRKDKAAEGTSSAPEYDSHRFRSAVHQQRFEAIKGWSFLRERRVQLRDDEYTDFQEEIGRRRWTSLVTPMAKFDPEIVLEFYANAWPTEEGVRDMRSWVRGQWIPFDADAIGQLLGYPLVLKEDQECEYGPEEEPGGRVRIMRTNMTTLTQIWDDVAPQQHPAQRS

SEQ ID NO: 155896 - protein, 148 aa, Glycine max
  Coding DNA Sequence Number=SeqID_64211
QRFEAIKGWSFHRERRVQLREDEYTNFQEEIAHRRWTSLVTPMAKFDPEIVLEFYANAWPTEEGVRDMRSWVRGQWIPFDADALSQFLGHCPAVMHTGTGFRPDCYREAAADHAHQHDHFDPDVDDTATQQLLVGVCHPDTDERPRGP

SEQ ID NO: 155897 - protein, 52 aa, Glycine max
  Coding DNA Sequence Number=SeqID_64212
MPIGGADIEEDELTDLRSNPLQGEGDMIGMEKEEREEMPLQREDESRRSSPP

SEQ ID NO: 155898 - protein, 69 aa, Glycine max
  Coding DNA Sequence Number=SeqID_64213
KCLCIAGYGKGVDGDPVLRGMRIRATWDYVSSVEGGQLGMVGSLVPGDMSRGSGDLGDVRWGAIAQSQA

SEQ ID NO: 155899 - protein, 201 aa, Glycine max
  Coding DNA Sequence Number=SeqID_64214
MHAVHGWEHCCEAQTLGDILHQGHSFTKSPDTPWQLNLFLSPYQNSHAVPWRYTPPRGKEEEATDVSSLSAKVTNITGLSGVTRSGRVFAPADLPVQPANVKGKEKVVEEQDDEAPLTSNKDIPAKGLPEKKDGKKEVSLEEATQQNPGQGLAVGVTHELRASSGSASEGFERGPCGPRHLGRRFQRAGQPYHCQQLSRLC

SEQ ID NO: 155900 - protein, 163 aa, Glycine max
  Coding DNA Sequence Number=SeqID_64215
VGIMIGGQDVAEEQPAGRWPPHRTHQTGSSSGHTRIPGPLPIPSDIPELADSVGIERDPLTPNPGSHVTHALLCWPSIGIKLKDYFWIKLGHGSNQWCPPPAPYFLLEISILVVPELDASLPEKRPSLDGFEALLVYNAPKAVTVVLRGGTSSFGCLVLLGPL

SEQ ID NO: 155901 - protein, 16 aa, Glycine max
  Coding DNA Sequence Number=SeqID_64216
MGDSMKDLKMSARMQF

SEQ ID NO: 155902 - protein, 173 aa, Glycine max
  Coding DNA Sequence Number=SeqID_64217
  Gene Ontology: Mol. function=nucleotide binding; Cellular component =intrinsic to membrane; Biological process=defense response
  Homolog annotation: Hit_ID=A2Q4E5; Match level="QueryCoverage=98%, HitCoverage=22%, E-value=1e-42, Identity=48%"; Hit description =Disease resistance protein
YDVYEDLQGIKDTLSIVKGVLLDAEEKKEQKHGLREWLRQIQNVCFDAEDVLDGFECHNLRKQVVKASGSTGMKIAADGNKFGLERISVDHRLVQRREMTYSHIDASGVMGRDNDREEIIKLLMQPHPHGDGDGDKSVCVIPIVGIGGLGKTTLARLVFNDKRMDDLFQLKMW

SEQ ID NO: 155903 - protein, 27 aa, Glycine max
  Coding DNA Sequence Number=SeqID_64218
MAENLHRITHGNVSDALRKRLGVDFLH

SEQ ID NO: 155904 - protein, 209 aa, Glycine max
  Coding DNA Sequence Number=SeqID_64219
MASRKRKALASASQARYDRSRFKSQEAWDRYSDIMIGRKILAKRNVMIYHIEFDEFQTELERRNWHKELTNFLDGSIDVAIVKELYANLYDLEDKSSKQVRVRGHLIKFDEDDLNTFLKTPVIIEEGESLSAYSRFCRLRPDPQELAARLYVPGKGFELNTNGLPLKILRKNLTTLAQTWSILSFSNLAPNSYTFDITLDRAKLIFGII

SEQ ID NO: 155905 - protein, 44 aa, Glycine max
  Coding DNA Sequence Number=SeqID_64220
MVIFSHGVTTEDKGEEMNGSGMEKEEREKTPLQREDEFRRSSSP

SEQ ID NO: 155906 - protein, 109 aa, Glycine max
  Coding DNA Sequence Number=SeqID_64221
  Homolog annotation: Hit_ID=A5C922; Match level="QueryCoverage=90%, HitCoverage=36%, E-value=2e-12, Identity=37%"; Hit description =Putative uncharacterized protein
  Pfam annotation: Domain name=Retrotrans_gag; Domain location=46-109; Score=2.2; E_value=0.033; Accession=PF03732.8; Description =Retrotransposon gag protein
MAQPPPRERTLREMAAPDFTYESLCIQYPDEGVPYVLKTGLIHLLPKFHGLAEGVAKDWLYYLAPRSIFSWDDLKRVFLEKFFPASRTTAIKKDISSIRQLSGESLYKY

SEQ ID NO: 155907 - protein, 76 aa, Glycine max
  Coding DNA Sequence Number=SeqID_64222
MVEQGEIVEAKLHGESKVIQRCFDDNNDDDKGDDKNLKDQSKNNSSESRTIQEFKIRIKKNSRTQEESLETRIKIK

SEQ ID NO: 155908 - protein, 53 aa, Glycine max
  Coding DNA Sequence Number=SeqID_64223
MEEIHGEDDEEQGTKIISSRMEKEESLLQMPLQGEDELRTSSPPEEVMDKSLK

SEQ ID NO: 155909 - protein, 115 aa, Glycine max
  Coding DNA Sequence Number=SeqID_64224
VKLPAFIVDHRVVPGDMSRGSGDLGDVRLENEVRKLRKPLVIDYQGIVMAAQLIRDRVEMECLEGAWETLEGNKRCRFRGTIRFTATSLVHPDELARTLQRTVEWTAPWISFVYF

SEQ ID NO: 155910 - protein, 117 aa, Glycine max
  Coding DNA Sequence Number=SeqID_64225
PEEDEEVRALKLELGKGKTRQGEVQVSCYRHPEKSAPSYKKKTRPLQESLNKKPKGPARRNMAERNSEEHCGVATMSSSSEERREIGHGCMTPVSYFKAIAHAPKKEDSLGPNNLAG

SEQ ID NO: 155911 - protein, 54 aa, Glycine max
  Coding DNA Sequence Number=SeqID_64226
MEVKDLIWARLDDGKCGFRNLHFMQNFAVKLCSRILHKCRKMLCFAGCGKSSAE

SEQ ID NO: 155912 - protein, 79 aa, Glycine max
  Coding DNA Sequence Number=SeqID_64227
MNLQLGRIRIHSRRREDLHSNLMKKVLPLERVILPPNVLTKGLCPSASSSSSSSESESECDVQPLEGNLLIVMRLMGSV

SEQ ID NO: 155913 - protein, 328 aa, Glycine max
  Coding DNA Sequence Number=SeqID_64228
  Homolog annotation: Hit_ID=Q1H0M5; Match level="QueryCoverage=67%, HitCoverage=89%, E-value=7e-19, Identity=34%"; Hit description =Sporulation related
  Pfam annotation: Domain name=Colicin_V; Domain location=226-327; Score=-27.6; E_value=0.04; Accession=PF02674.7; Description=Colicin V production protein
  Pfam annotation: Domain name=SPOR; Domain location=170-240; Score =46.2; E_value=1.1e-10; Accession=PF05036.4; Description=Sporulation related repeat
  Pfam module annotation: Pfam domain module=Colicin_V::SPOR; Domain location=226-327::170-240
MARDAVTDNELLLKKTARRRLVGAITLVVLMLIILPFVLKDRVVESSHDNVEITVVNRQANRDPILELPDDEVVIDNEVASSAGTTPSSAEVPEARIEEPSAVALTKSPESQKLVKTEASKPVVAPEATAQAKPVPVEPKVEPKVEPKVEPKVAPVQAVAKEEPAVSDKKTGKFFVQFGVFSDPKNLENLQTKLKQAGFETASENVDAAGQKLRLRTRTYATRNEAAAALKKLQAAGLMRGAIHELFSVLGWVLAFYLANRFNSQVMHYMPEQIPGEAIKAMAAFLIVFLLVLFVSALCALLLTTLMKAIGLGGFNRILGGIAGAGKG

SEQ ID NO: 155914 - protein, 43 aa, Glycine max
  Coding DNA Sequence Number=SeqID_64229
IPLGAILAIVDSVVIETGPAVIARKSIVPKASNSGYLYVSFEN

SEQ ID NO: 155915 - protein, 173 aa, Glycine max
  Coding DNA Sequence Number=SeqID_64230
MELIENMAASDHVILHDRTHYPTKKSLLELSSQDALLAQNKLLSKQLETLTETLSCTLCGRAHESGCCMPTEESTHEVNYTRNQPRKNFNAGGFSRFQQGQHYNQHQNQWRTHPGNQFNKDQGGPSNRPPQQGPKLYERTTKLEETFAQFMQVSMSNHKSTESAIKNLEIQVV

SEQ ID NO: 155916 - protein, 200 aa, Glycine max
  Coding DNA Sequence Number=SeqID_64231
  Homolog annotation: Hit_ID=Q0ZCD0; Match level="QueryCoverage=78%, HitCoverage=13%, E-value=4e-08, Identity=27%"; Hit description =Integrase
MERSMIDAASGGALGDMTPAKARNLIEKMASNSQQFSAKNDAIVIRGVHEVATNPSASSETKKLEGKLDALVNLVTQLALNQKSVPVARVCGLCSSADHHTDLCPSMQQPGAIEQPEAYAANIYNRPPQPQQQNQPQQSNYDLSSNRYNPGWRNHPNLRWSSPQQQQQQPAPSFQNAAGPSRPYIPPPIQQQQQPQKQPI

SEQ ID NO: 155917 - protein, 61 aa, Glycine max
  Coding DNA Sequence Number=SeqID_64232
MRRVITLVVSEPVEHFWPGVMVRRNDHAIADALQALAQAIGNPNRGEASGATEYQGLDRFQ

SEQ ID NO: 155918 - protein, 154 aa, Glycine max
  Coding DNA Sequence Number=SeqID_64233
  Homolog annotation: Hit_ID=A5C922; Match level="QueryCoverage=66%, HitCoverage=36%, E-value=2e-08, Identity=30%"; Hit description =Putative uncharacterized protein
VHPDHSMHFEHCEYFEHSEYSVVGDSEYSDFEHSTTNFHTENMAQPQPCERTLREMVALDFTYESLCIQYPDEGVPYVFKTGLIHLLPKFHGLAGEDPYKNLKEFHIVCSTMKPPDDDLKRVFSEKFFPASRTTAIRKDISGIRQLSGESLHEY

SEQ ID NO: 155919 - protein, 56 aa, Glycine max
  Coding DNA Sequence Number=SeqID_64234
MTKARQKGVHKGKRRRWLLPSSLRRAGLLPLEGTTFCWKILEGPSWPDLLFVHPCY

SEQ ID NO: 155920 - protein, 89 aa, Glycine max
  Coding DNA Sequence Number=SeqID_64235
MLGKLERIDGDPVLRETRIWATWEYVSSVGGGQQGMVVLCALCGCGKLVVHHRQPPPSTTCDGVVPGDMSRGSGDLGDVRWGAIAQNQA

SEQ ID NO: 155921 - protein, 116 aa, Glycine max
  Coding DNA Sequence Number=SeqID_64236
MSMSSRFLRMNDNITLVLHHGGRFTPRASDGKVEYIGGEFDVWEDISADCLNAFILYDLVKASVENEDDLDDVPVAGHEEDVGAGEQRDAGEQMDAGKQRDGGEQRDGGEQRDTDA

SEQ ID NO: 155922 - protein, 106 aa, Glycine max
  Coding DNA Sequence Number=SeqID_64237
MPMAPCESIGWYVPSRHSSGYGPLSVLQGARTPPAKSCHRDIRITPAGHPVDPKKSNRVLGFPALITSLCQFYGVPVTPSKVIRPPTNRAFIKKYCAPMQAEGETP

SEQ ID NO: 155923 - protein, 91 aa, Glycine max
  Coding DNA Sequence Number=SeqID_64238
MSLGHFTKHSVGACLDINCKRTGGNVACPVASEYNIGLRPSHTNPQLNKTSMDSDVNCFTNIAKNEQLKHQNTSMESQITKGNCTYLWGEN

SEQ ID NO: 155924 - protein, 71 aa, Glycine max
  Coding DNA Sequence Number=SeqID_64239
MPPDSWVISYQIKDYMRDHGSIGLFLGNGQGLTFSPWVKVYGKLGFWLMACRTAGHDDGSLLVELLWRLDL

SEQ ID NO: 155925 - protein, 100 aa, Glycine max
  Coding DNA Sequence Number=SeqID_64240
MAEVSIEAIASLAQYYDQPLRCFTFGDFQLSPMVEEFEEILGCPLRGRKPYLFFGFYPFLARIPKIVQISAQELDHRKQVENGMVGVLRKCLEEKARILA

SEQ ID NO: 155926 - protein, 86 aa, Glycine max
  Coding DNA Sequence Number=SeqID_64241
MVEVSTEAIASLAQYYDQPLRCFTFGDFQLSPMVEEFEEILGCPLGGKRPYLFTGHSRTVDLRRSPLSKCGWVGGPSSDQRFPRLS

SEQ ID NO: 155927 - protein, 361 aa, Glycine max
  Coding DNA Sequence Number=SeqID_64242
  Gene Ontology: Mol. function=glycine dehydrogenase (decarboxylating) activity; Cellular component=mitochondrion; Biological process =glycine metabolic process
  Homolog annotation: Hit_ID=A3I284; Match level="QueryCoverage=99%, HitCoverage=38%, E-value=1e-137, Identity=66%"; Hit description =Glycine dehydrogenase
  Pfam annotation: Domain name=GDC-P; Domain location=1-319; Score= -334.7; E_value=0.04; Accession=PF02347.7; Description=Glycine cleavage system P-protein
MLAKITGFAGTSLQPNSGAQGEYAGLMVIREYHISRGEGHRNVVLIPQSAHGTNPASAAMAGMKIVVVKNLESGEIDFDDLKAKTEQHSENLSCVMITYPSTYGFFDANIIEITNLIHQHGGQVYMDGANMNAQVGYTSPGNIGADVCHLNLHKTFAIPHGGGGPGVGPICVAKHLVPFLPTNANIKVGTKEAIEGISAAPYGSGLILNISYAYIKMLGASGLKKATEHAILNANYLKEILAEHFPILYSNKNGKVAHECIVDFRQFKTLGIEVADVAKRLMDYGFHAPTVSFPVAGTLMIEPTESETLIAIKKEIDEIANGEADPANNVLKNAPHTEQLVISDSWDKPYSREKAAYPLDW

SEQ ID NO: 155928 - protein, 122 aa, Glycine max
  Coding DNA Sequence Number=SeqID_64243
  Gene Ontology: Mol. function=oxidoreductase activity; Cellular component=membrane; Biological process=electron transport
  Homolog annotation: Hit_ID=Q2LAK5; Match level="QueryCoverage=63%, HitCoverage=29%, E-value=1e-20, Identity=60%"; Hit description =Cytochrome P450 monooxygenase CYP71D54
MVITGDKMRENVCPRSFLSTQKEFSLFASIREDEASKKFYRLQFANLLRASRKNKIAKEDGAELEDQDFIDLLLRIQQDDTLDIQMTTNNIKALILDIFAAGTDTSASTLEWAMAEMMRNPR

SEQ ID NO: 155929 - protein, 195 aa, Glycine max
  Coding DNA Sequence Number=SeqID_64244
  Homolog annotation: Hit_ID=Q2AA09; Match level="QueryCoverage=82%, HitCoverage=51%, E-value=4e-08, Identity=27%"; Hit description =Retrotransposon gag protein
MERSMIDAASGGALGDMTPAEVRNLIEKMASNSHQFSVRSDAIVIRGVHEVATNSSSSGETKKLEGKLDALVNLVTQLAMNQKSARVARLYGLGSSADHHTNLCPSVQQSEAIEQPEAYVANIYNRPPQPQQQNQPQQNNYDLSSNRYNPGWRNHPNLRWSNPSQQQQQQQQTYFQNATGPSRPYVPPPIQQQQQ

SEQ ID NO: 155930 - protein, 124 aa, Glycine max
  Coding DNA Sequence Number=SeqID_64245
GLHNVPVPFLSLVIDYTPLVIDYQKPSWLPDLVFKPGNRLHPVELACLGTSQVLTDRLCPGWVGIGQAWFWAIAPHLTSPRSPDPRDISPGTTLWSTNKSRKFDPSTLPHLKLVGLWGTHHLWY

SEQ ID NO: 155931 - protein, 176 aa, Glycine max
  Coding DNA Sequence Number=SeqID_64246
MEAIKEQMATMMKAMMSMKKIMEANAVIVAAISAVAKVNPMLPSGLKQMNHPTSNMLDFEPWLGYATEGQAVGGIPFENTLEGPQFRPQPQPLHFAVGRAPPAMAEKGKVDHLKERLRAIEGGEDYAFANLEKLFLIPKHGHSQVQGAGLWQVQGDYSLQEPSKDVLSEDGGIRKR

SEQ ID NO: 155932 - protein, 148 aa, Glycine max
  Coding DNA Sequence Number=SeqID_64247
MPFAGERGRGSWVRFPKEERCAESPPTFIFGKRRENRRKPVKKKILSSGVVFTLEEGEKLAAQASSAPPGEQGCFLQKQQPSGGRVWKGPHSFRRSYGNSRIAQKHLFSTSATLRNFTDRASLLPFDFRDVSGLHILCNKGRQVPQSG

SEQ ID NO: 155933 - protein, 88 aa, Glycine max
  Coding DNA Sequence Number=SeqID_64248
MASSTTITSEVQALKAKLKKTRVVKEKLKTTFTRVRKECDELKDINMTMVEANQFKLRKAERDESWMESMVLEDKLKACQRPKRSLTE

SEQ ID NO: 155934 - protein, 35 aa, Glycine max
  Coding DNA Sequence Number=SeqID_64249
MASGNRLPRECNRLPGLKMGSGSRDGFWFSCYEAV

SEQ ID NO: 155935 - protein, 53 aa, Glycine max
  Coding DNA Sequence Number=SeqID_64250
MERSMIDAASGGALGDMTPAKARNLIEKMTSNSQQFNARNDAIVLRGVHEITI

SEQ ID NO: 155936 - protein, 84 aa, Glycine max
  Coding DNA Sequence Number=SeqID_64251
MENNDGCYTEALQKVRKAWEMVQKKDKELRGSSNGPIGGYHRWLKAYTQGLDCLPNLRTTKGVEVEALEEDEEVQAHTAEVNKS

SEQ ID NO: 155937 - protein, 140 aa, Glycine max
  Coding DNA Sequence Number=SeqID_64252
LAVSIRRARRAWARSAELPSTCAAPTPASNSVAPSIPAQTDSQRFEAMLQRIHQEDEGPTAQVPQHVEDESSKATILEPFDIGEEAEETQVRQVATATPERSLEATTEPSAPVVNLPSPQPAAGPPPLFYRCQRTQLHQS

SEQ ID NO: 155938 - protein, 88 aa, Glycine max
  Coding DNA Sequence Number=SeqID_64253
MEWFYMISHPFMSLTQPGDPPKHPNVFQGYFDDAKESRVKQIPKIQESRFKIQESRLKIQESSFKNQDSRIIKIKIQDTRFKKQEKTQ

SEQ ID NO: 155939 - protein, 43 aa, Glycine max
  Coding DNA Sequence Number=SeqID_64254
MAEQQASKSKDKDKQSTSRTHLVAHDPRNLNKTSTSSEGRKIP

SEQ ID NO: 155940 - protein, 269 aa, Glycine max
  Coding DNA Sequence Number=SeqID_64255
  Homolog annotation: Hit_ID=Q6UUU1; Match level="QueryCoverage=22%, HitCoverage=40%, E-value=3e-18, Identity=78%"; Hit description =Putative uncharacterized protein
YIEQLTEMPQNVLTMPLGYINGVGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSMRDHEGARRGEGLRTARAGFALGAGALPESIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 155941 - protein, 112 aa, Glycine max
  Coding DNA Sequence Number=SeqID_64256
MRSKGIEPTDNLKKGLLGGSMNPPIVGKFLNKRHHMVAQNVLKRSFEDVGSILSQAFLVAWYSKVWHLALTITPGKDIESSYTSLGLGSPRTKSILMSTQGADGMGKGVYSP

SEQ ID NO: 155942 - protein, 193 aa, Glycine max
  Coding DNA Sequence Number=SeqID_64257
MGDQEETQEQMKADMSALKEQMASMMEAMLGMRQLMEKNMATAAAVSSAAEADPTLLETAHHPPSNIVGRGRDTLGHDGNPPLGYNRAAYPYGLPPNYSPPVLQDDAGYIASPVHKDPQDYARRDVEFYPPIPEGPAPSTLPHPNITTPPIVLSTEGPPPATEERRKLDLLEERLRAVEGFGDYPFVDMTIFA

SEQ ID NO: 155943 - protein, 45 aa, Glycine max
  Coding DNA Sequence Number=SeqID_64258
MEYLLVGDEQKRKTESKNAKKDDHRAANSSIPGGSPRLAQLAQAS

SEQ ID NO: 155944 - protein, 176 aa, Glycine max
  Coding DNA Sequence Number=SeqID_64259
  Gene Ontology: Mol. function=RNA-directed DNA polymerase activity; Biological process=regulation of transcription, DNA-dependent
  Homolog annotation: Hit_ID=A7QL19; Match level="QueryCoverage=99%, HitCoverage=35%, E-value=1e-40, Identity=43%"; Hit description =Chromosome undetermined scaffold_116, whole genome shotgun sequence
MVATTYQTSHECPEETIIDILVEGFSRQLKVKTNLNGKVITNDDNKKIPDAVNTLIFTIAQHFIGDRSLWKDRSAELLSNLKCRTLADFRWYRDTFLTRVYTREDSQQPFWKEKFLAGLPRSLGDKVRDKIRSQSANGDIPYESLSYGQLISYVQKVALKICQDDKIQRQLAKEQA

SEQ ID NO: 155945 - protein, 130 aa, Glycine max
  Coding DNA Sequence Number=SeqID_64260
MVGYTPSSFADERIEVGLKRDKFNHLALMNAKTGANEEGENKGQTHAATAIPIRPSFPPAQQCHYSANNDPFPYLPPSYPQRPSLNQPQSLSTTLPMTNTTFSTNQNTNQEMNFAAKKACRIHPHSSVLC

SEQ ID NO: 155946 - protein, 99 aa, Glycine max
  Coding DNA Sequence Number=SeqID_64261
MAKFDPEIVLEFYANAWPTEEGVRDMRSWVRGQWIPFDADAIGQLLGYPLVLEEGQEYEYGQRRNRSDGEASANHAHQHDHPDPDMDDVAPQQHPAQRS

SEQ ID NO: 155947 - protein, 282 aa, Glycine max
  Coding DNA Sequence Number=SeqID_64262
SIDIAIVKEFYANLYVPDDKSPKQMRVRGHLVKFDKDTLNTFLKTPVMLEEGENLCTYSRFSLLRSDPQELAAKPCIPGRGFELNVDGQPLKILRKNMTTLAHTWSILSFSNLIPTSHTSDVTLDKAKLIYGIIMKMDMNLGYLISHQISLIAQHDTSRLGFFALITTLCKARGVQSDSRSLENLSLAINLAYIKNNCWNLDDPKVTFRGPRKARGKRSEAPTTSAPETPIPSSSIAPLPPTQTPIIPPTPTQLGAQPSPSGRGGASVAQELASEEPVAAAA

SEQ ID NO: 155948 - protein, 245 aa, Glycine max
  Coding DNA Sequence Number=SeqID_64263
LGKARLAKEKFKSAATHIRKECTELQEENAATAKALEQETKRACKEEYGREKFRGALWGSNNELKLRREERDRSRVHGMILKEELAACARSKRSLAQHLETTEQSMLAIIGQYKEALNQFVTHEQKLVEDFAQVYAEKEARRRVIDALHQEATMWMDRFALTLNGSQDLPRLLAKAKAMAEEQMKADLSALKDQMASISEVMLKLQKTIEDKAMATTSSTVREAEPVLQPASNPGRDRNTVVFGR

SEQ ID NO: 155949 - protein, 112 aa, Glycine max
  Coding DNA Sequence Number=SeqID_64264
  Homolog annotation: Hit_ID=UPI0000ECBAF8; Match level="QueryCoverage =36%, HitCoverage=48%, E-value=1e-16, Identity=100%"; Hit description= UPI0000ECBAF8 related cluster
MATRPTWAFQILPPEGGRSEEGKGSAFLALRIHLKSVEKIVSVKKIQAEALPLQLSRPAGMQAWHWPSFYNVVTGKTLALPNLIALQHIPLSPAGVIAKRPAPIALPNSCAA

SEQ ID NO: 155950 - protein, 176 aa, Glycine max
  Coding DNA Sequence Number=SeqID_64265
MFLLYQLNIFRFTFAFVNYIVIYKTKVERKDIDLIVEEEAQIGADRSSATSNKAKIYNEEARKKTQKHKPKRVESVNDDAEAFAEVLEHTKKRDIGHQSVSLENKTGDLTMLKMADSAKVVIKQDMKGRKHKYGFNNNKREKKRVVDDETGDKHQLDEFPRRQIETKNRCLNQRKM

SEQ ID NO: 155951 - protein, 123 aa, Glycine max
  Coding DNA Sequence Number=SeqID_64266
MSGLTRDSLQISAGPYQLDLAPYASEPYNAQWNAPGLLHDKHTLRSSRILGEMEVDEPWLGLWLPLNYQVGMGASFLAAKFISWLAFLDCAKGDVRHWKCDRQTLWLILGMAFVDNWAVGKEK

SEQ ID NO: 155952 - protein, 70 aa, Glycine max
  Coding DNA Sequence Number=SeqID_64267
MKKQQWKKSGRQRRRGKRRRHPLGNKPWKKELHHQDEPWRGCFNGGKERGRERERGSTKLKEEKGREVEL

SEQ ID NO: 155953 - protein, 103 aa, Glycine max
  Coding DNA Sequence Number=SeqID_64268
MVQMISDTIYCLQESHPQRHPVDLEKSNRALGFPALVTGLCSPTGCSFPPARSRHHDIGIAPARHTVDPKKSSRVLKLSSSNYGSLSVLRSACHLQQGHQAPY

SEQ ID NO: 155954 - protein, 115 aa, Glycine max
  Coding DNA Sequence Number=SeqID_64269
  Homolog annotation: Hit_ID=A5BP71; Match level="QueryCoverage=65%, HitCoverage=19%, E-value=2e-11, Identity=46%"; Hit description =Putative uncharacterized protein
  Pfam annotation: Domain name=zf-CCHC; Domain location=88-105; Score =12.7; E_value=0.018; Accession=PF00098.14; Description=Zinc knuckle
MVIIVNAEACGYVSLNYYQYIDVVYTNEHIVKAYSAQWWPLGNEATIPPSNDAWTLIPDPTAIRAKGRPKSTRIRNEMDWVEPSEHRQKCSRCGAEAHNRRRCPMQSERGSCSTR

SEQ ID NO: 155955 - protein, 25 aa, Glycine max
  Coding DNA Sequence Number=SeqID_64270
MTLLMKKIQGLQAPHGATSCGIVGQ

SEQ ID NO: 155956 - protein, 77 aa, Glycine max
  Coding DNA Sequence Number=SeqID_64271
MGAKHLTRTQTKVACHQAKQKNVYTDNHSDISARQRDSKVSMTDLVSAEDDAFRLTNSKKVYTDDHSGISARQRDSK

SEQ ID NO: 155957 - protein, 85 aa, Glycine max
  Coding DNA Sequence Number=SeqID_64272
  Gene Ontology: Mol. function=aspartic-type endopeptidase activity; Biological process=DNA integration
  Homolog annotation: Hit_ID=A5B7I8; Match level="QueryCoverage=100%, HitCoverage=9%, E-value=7e-24, Identity=53%"; Hit description =Putative uncharacterized protein
MQGCLSYRKPIDSERWIYVEDVSCGESFNVKLHGTKHRIDNTNSGALWHKCLGHISKNRIERLVSNGILDSIDFTSFDVCVECLK

SEQ ID NO: 155958 - protein, 125 aa, Glycine max
  Coding DNA Sequence Number=SeqID_64273
MLATGNRLLPSDTLCRPATIFAQKPNGCGEPEKGLSTSFSLMCVAFKHKVQSLIDAGWLTFQEDSLNVRTNPLTCHRGSAVNSVEEWESRGLKQIGNVSTFRRFILEALRAAGMIDLDGDKEILV

SEQ ID NO: 155959 - protein, 192 aa, Glycine max
  Coding DNA Sequence Number=SeqID_64274
MSAFIRQWLRTNPQEIEARLCIPRKGFVLNAEGQPWKLLRKDLKTLAKTWSVFPYSNLAPTSHTSDLDMDRGRLVYGLVTNRDMNIRALILGQIYSIAQSNSSRLRFPALMTALCRARGVTSHSLTYESLSLAINLAYIKKNCWNVDDLTVNFRGVRKARVRPTHVPSSTLPAPSTSATPTPAPPGSSTKDS

SEQ ID NO: 155960 - protein, 89 aa, Glycine max
  Coding DNA Sequence Number=SeqID_64275
MLWKLGGVDGDPMLRGTRIRATWEYVSLVEGGQLGMVSSCVICGCGESTCTIARSPPSTTYDGVVSGDMSRGSGDLGDVRWGAIAQNQA

SEQ ID NO: 155961 - protein, 93 aa, Glycine max
  Coding DNA Sequence Number=SeqID_64276
MPHGLFPYKIHALMPLRHFTEHLAGARLGINSKRTGTMWHSTKRRSKYTNEKLESLGMEHLLVGDEQKRKTESTNAKNDDPRAANSSIPWVWL

SEQ ID NO: 155962 - protein, 182 aa, Glycine max
  Coding DNA Sequence Number=SeqID_64277
  Gene Ontology: Mol. function=helicase activity; Biological process =viral genome replication
  Homolog annotation: Hit_ID=Q2A9I1; Match level="QueryCoverage=95%, HitCoverage=12%, E-value=3e-30, Identity=39%"; Hit description =Putative uncharacterized protein
MMLGSCKGPTSFEDIRTVANIQYPTYRETCFAMGFLQDDREYVEAIKEAKDWGIANYLRKLFVLILLIGAMSKPEEVWNQCWHWLVDDIAYQHSKSTMNSKLQINDDTLRNLTLIEIEQLLHINQRSLKDYPTMSYPQDINLTSYLQNNLVLSELDYNHDATRSEFEHLFASMTGNLPIHIL

SEQ ID NO: 155963 - protein, 125 aa, Glycine max
  Coding DNA Sequence Number=SeqID_64278
MVLFSILYLTGMYIARYRVEVMVTQNNESSKFLLWDHECAELNDQTADEVNRVKIEVDFSSFWHDGDVDLNASPQALDRLLGYVLAFKVRIQSKFRNVVVLRYSNELDLINVVLEMLADSERYDA

SEQ ID NO: 155964 - protein, 407 aa, Glycine max
  Coding DNA Sequence Number=SeqID_64279
  Gene Ontology: Mol. function=inorganic phosphate transmembrane transporter activity; Cellular component=1-2nm peptidoglycan-based cell wall; Biological process=phosphate transport
  Homolog annotation: Hit_ID=A8GHP5; Match level="QueryCoverage=74%, HitCoverage=58%, E-value=6e-54, Identity=37%"; Hit description =Phosphate ABC transporter, inner membrane subunit PstA precursor
MGFALVPLIFTLAEDALFSVPVALGQGSLALGATPWQTLTRVVLPGASAGIFAALMIGFGPCGGRNHDCTDGHRQHAGERRRTCVAAADIHAGDQHRGGTDSSAAAPALQAFWPQPVDQYQFQPPQGAPLRVLGETLDRQQQGDRWRYVVKTGNRDFAAPDFRVIVSQGEAQTRRPAEALVLQRRSGGNAYGWLVELREDNEVLTARDRDALLQQRLKQVHEQLRQASNIRRIEMARLNAQLESLQQQADEQRRGGHFSLQDQSELDANSAALHKRFGALAQQLAHLQHESQRDTLVLRDVQGDDHLIPLAQVVAAWYPNSLSIGQKIGHFLSQIWQFVSDSPTSGGSENGALPAIFGTVLMVLLMSVIVMPLGVVAAVWLHEYAGRNALTRLVRIAVVNLAGAPSI

SEQ ID NO: 155965 - protein, 105 aa, Glycine max
  Coding DNA Sequence Number=SeqID_64280
HKALRLNAPLPYPHLVTRFLQHFNIPLDFEPYVPIKRSFLIGASVIASFGYQKEHDGSWVKKGLTIWNYKVDMRFNEMESRITKVEDVSYIRSSFDLPPPSPPSS

SEQ ID NO: 155966 - protein, 145 aa, Glycine max
  Coding DNA Sequence Number=SeqID_64281
MAPRKLASKRSRKDKAAGGTSSAPEYDSHRFRSAIHQQRFEAIKGWSFLRERRVQLRDDEYTDFQEEIGRRRWASLVTPMAKGQWIPFDADAIGQLLGYPLVLEEGQECEYGQRRNRSDGFDEEAIAQLLCIPGQDFARTAAGRL

SEQ ID NO: 155967 - protein, 55 aa, Glycine max
  Coding DNA Sequence Number=SeqID_64282
MNLEEQSRIFAKIGEKLVAQLAQASKVATSRSNSLLEEGSGRPKWARLLFAPPFY

SEQ ID NO: 155968 - protein, 181 aa, Glycine max
  Coding DNA Sequence Number=SeqID_64283
VGIMIGGRDVAEEQRHPYLGQGGHVGAHDSHSPPCSSPGKILPRPVPPLAILAFLALFQYHRISQELADSVGIERDPLTPNPGSHVTHALLCWPSIGIKLKDYFWIKLGHGSNQWCPPPAPYFLLEISILVVPELDASLPEKRPSLDGFEALLVYNAPKAVTVVLRGGTSSFGRLVLPGPL

SEQ ID NO: 155969 - protein, 86 aa, Glycine max
  Coding DNA Sequence Number=SeqID_64284
MHSCRPEDYIQSAQPQVPIAFDPPPHVDGYNGYEAIAQRLERVLKLRIVTAGTELYDIMQDCLTIARGGPSADGTVRARQRRRTDH

SEQ ID NO: 155970 - protein, 110 aa, Glycine max
  Coding DNA Sequence Number=SeqID_64285
MLAAQLAQASRVASSRSNSLLEESSGGPKWAWLLFAPPFLLKCYGTSLIVQRCFHLISGVSRNLTDCASIFSFVFRHVPEFHKLPNDGCQAPYKDQTKVACHQAKVPGRN

SEQ ID NO: 155971 - protein, 60 aa, Glycine max
  Coding DNA Sequence Number=SeqID_64286
MFFHGKMPRKWVFRPYLTSTYQTRGGVEGRSPEYEEPRDLRSNPFQGGGNDAIIPRKGIG

SEQ ID NO: 155972 - protein, 102 aa, Glycine max
  Coding DNA Sequence Number=SeqID_64287
MIAHIPDPRVDPSQYRDLVHYWCSEKGQTTKAKGVQPSRAEIYIDTRTRKDGSIVTEKAAIVIDELKKKIVEAESSQNLQSTQDSTDWTNDIYSKVKGPEKR

SEQ ID NO: 155973 - protein, 61 aa, Glycine max
  Coding DNA Sequence Number=SeqID_64288
MDVMDWCELERIDGDPVLRETRIWATWEYVSSVGGGQQGMVGLCAHCGCGKLVVHHRPTAT

SEQ ID NO: 155974 - protein, 164 aa, Glycine max
  Coding DNA Sequence Number=SeqID_64289
MTCILLSSTIPTSAPWGVLKRLEPDVRPKKPTGAKSRKGKQEEKEEEERPLIRKRKLPTTSTKSADQTEAGNSQAQMPKKKKKVKQVEPEPSVAVEDGEPAKKKKKKTKSSKEQGDNQPVDVQPPSTDIGGTEVEAAPSVAEMGNPIEQPNLPQEQPVVEVSFS

SEQ ID NO: 155975 - protein, 94 aa, Glycine max
  Coding DNA Sequence Number=SeqID_64290
MMIFFFLERHHRICVATYPSAGGRRVTRGMRVPRKEYARSRHQRLFEENVGKTGKDAIYELFSERFGSCIYAGGRVFPFAPTYSSIWDEKIRPT

SEQ ID NO: 155976 - protein, 161 aa, Glycine max
  Coding DNA Sequence Number=SeqID_64291
GNPSDLQPFDPEIDRTFHRLVRHHFVPFEHLEHSITGESVHSVIGDFEHPDFEHYNFEHSDFEHSENMAQPPPRERTLREMAAPDFTYESLCIQYPDEDVPYVLKTRLIHLLPKFHGLAGTGYITLLQGPSRAGDDLKRVFLENFFPASRDPGHQKRYFRN

SEQ ID NO: 155977 - protein, 90 aa, Glycine max
  Coding DNA Sequence Number=SeqID_64292
MMSRLSQQVQDQVYRKDIKKNQDSREDDFKIQENKPESNKSRLHKGMTSFEIKSQGDVTLPMGFLKIFLEVITLPMVFLARHEESIKARP

SEQ ID NO: 155978 - protein, 107 aa, Glycine max
  Coding DNA Sequence Number=SeqID_64293
MGYVGVRELSWRWATGDGGFMHALVKLPAFIVDHRVVPGDMSRGSGDLGDVRRAPANQPIKGTKTTKQGRLAWWLGQLLRNETGMLKGPLVIDYQCWVIDYTEEQAT

SEQ ID NO: 155979 - protein, 146 aa, Glycine max
  Coding DNA Sequence Number=SeqID_64294
KERALRRLYQTCAKARVMSEIKEVQEQMKADMEAMKEKITTMMEAMMSMRKMMEVNTATVVAASTATEVDLTHLSGLNQVNHPISDMVGQRGKALGRRGPPAMVEWEKFDHIEERLRVIKGGENYAFADMAELCLVPDMVIPPKFK

SEQ ID NO: 155980 - protein, 38 aa, Glycine max
  Coding DNA Sequence Number=SeqID_64295
MWTTTGEMLAAQLAQASQVASYQCNNLLEESSGRPMWA

SEQ ID NO: 155981 - protein, 176 aa, Glycine max
  Coding DNA Sequence Number=SeqID_64296
  Homolog annotation: Hit_ID=A5AIK9; Match level="QueryCoverage=61%, HitCoverage=6%, E-value=2e-12, Identity=38%"; Hit description =Putative uncharacterized protein
MTRGNPGDLQPFDPEIDRIFHRLIRHSVHPDHSIHFEHCEHFEHSEYSVTGDSKYSDFEHSTTNFHTENMAQPPPRERTLREMAAPDFTYESLCIQYPDEGVPYVLKTGLIHLLPKFHGLVGEDPHKHLKEFHIVCSTVKPPDVQEDHIFLKAFPHSLEGVAKDWLYYLAPRSIFS

SEQ ID NO: 155982 - protein, 88 aa, Glycine max
  Coding DNA Sequence Number=SeqID_64297
MEVEEPWLGLWLPLNYRVDRGSSLAYDNGIWGFVVDLGMAFVDNWAVGKEETHIDPFTGKDQILKALKVLHLWAYSLKDLCPLFAHVL

SEQ ID NO: 155983 - protein, 27 aa, Glycine max
  Coding DNA Sequence Number=SeqID_64298
MGIMVEFVREGGSATRIGIKCVRGFWE

SEQ ID NO: 155984 - protein, 251 aa, Glycine max
  Coding DNA Sequence Number=SeqID_64299
  Gene Ontology: Mol. function=oxidoreductase activity; Cellular component=integral to membrane; Biological process=electron transport
  Homolog annotation: Hit_ID=Q9STK7; Match level="QueryCoverage=76%, HitCoverage=43%, E-value=8e-40, Identity=41%"; Hit description =Cytochrome P450 71A26
MMSDARHFVTGTFVDGVALNALGLEDLLIVFRVFGRSFIEQQKLEAIDGSSVMVPVLVVSTTEAAREVLKTHDPVFSNKPHRKMFDILLYGSEDVASAAYGNYWRQTRSILVLHLLLSAKKVQSFVANDIVCRAALGRRYSGEGGSKLCTQINEMVELMGTPLLGDYIPWLDWLGRVNGMYGRAERAVKQVDEFFDEVVDEHVSKGGHDDANEDDQNDLVDILLRIQKTNAMGFEIDKTTIKALILLRTQD

SEQ ID NO: 155985 - protein, 103 aa, Glycine max
  Coding DNA Sequence Number=SeqID_64300
MTAGTGTTNRRIKKIMLVSCVLLWVCCLVGCFCYQYPPLVEQPFPKVVGGANRIPIFLCSVLRSQTCPLHQDFSNRGSVISIPFLVQDRERFDYGMIIRLERR

SEQ ID NO: 155986 - protein, 287 aa, Glycine max
  Coding DNA Sequence Number=SeqID_64301
  Gene Ontology: Mol. function=oxidoreductase activity; Cellular component=integral to membrane; Biological process=electron transport
  Homolog annotation: Hit_ID=A7PCP8; Match level="QueryCoverage=96%, HitCoverage=71%, E-value=6e-59, Identity=40%"; Hit description =Chromosome chr17 scaffold_12, whole genome shotgun sequence
  Pfam annotation: Domain name=p450; Domain location=1-282; Score= -140.1; E_value=9.4e-06; Accession=PF00067.13; Description=Cytochrome P450
MGSSKRGVGRCVIGRRYGGSELREPMSQMEELYGVSVIGDYLPWFDWLGRVNGVYGRAERVAKRLDEFYDEVVEEHVSKRGLDGHGDVDSEDQNDFMGILLSIQESITTDFQIDRTFVKTLVMLLFANCNYEASMFVAGSDTTLGVLEWAMTELLRHQNLVATRVTKVMGYDIAAGTQALVNAWAISTDPSYWDQPLGFQPERFSKSSMNIKGHDFQLIPFGAGRRGCSGIGFVMALNELVLANIVHQFDWSVPSGVVGDQTLDMSQTTGLTVHKKLSLVTLASPNV

SEQ ID NO: 155987 - protein, 460 aa, Glycine max
  Coding DNA Sequence Number=SeqID_64302
MPIGHPQSTGIDLFEITWLEHGTDLGGVKGHSRCRDYMAQVLKFSSGKQTLLPDVIEKECNELAKKRFKQFIHHGLERCQRIAEAEGYYFVFVMSLMGAKSSFGHVVGGHGDLMKSLTEHIGYLTLKLNFLTMRVSVGSYIDGLGIRVVPERGDRNEKEGVVGEVEAEVGWKGTLAVSWIGRPNKEKLMVREWNIRANLLAYEGAAIANHNLERVDDGGVQGEKLGDLGLNEVLGTAAVDKDRMPDKALRLSCRVSDSGGRGNCEIGSGVSSVSLWSLQEVSFSEERRFTGSLGGGGEVVVVESGQGVAACPPRAWPGRNVAAATLVEGLAPHGGASLLKLEQSAMRVLVEGWCETSFEGLHGQTLIVRDAMIVEELGDFENPPRWIITVKSRDVELHVQPGNWRGRVIWLRRSRIESIFESMVDWLWEKVEHSLLKSLRGCLLGIVLRHGGTTGQIRPS

SEQ ID NO: 155988 - protein, 155 aa, Glycine max
  Coding DNA Sequence Number=SeqID_64303
MFNVRLRDSKKKMVFPKKLIRPPRQWFNNIWVLQSQITRYPWEEVEQNFLGLFLWQIFPDGALLKTISPNGIVLKEFTQGSCFLRGLHGLQSKPPLAMASSLCNVHVADKLPFVMASWCQVELATSAGEVFDLLWPTLFLVAFLSTYLRLDFYKL

SEQ ID NO: 155989 - protein, 50 aa, Glycine max
  Coding DNA Sequence Number=SeqID_64304
MGSSLVMDAHLGLMFVFVVVVMGLLYGGYCTIMVVETVVVVVDTVVVVEE

SEQ ID NO: 155990 - protein, 168 aa, Glycine max
  Coding DNA Sequence Number=SeqID_64305
MRSPGTDGQMNISSYFFSTFAQEMLCYALYLKKSIPKFTTSEYELFSMEEGEDIQTMFGCFQIILNELLSLASAKCNTIGLSTRKTLEEDELYRFAERITSSHQAHRFSSSAKREKCAKPKSTNESLDWDSELFLSRVSRERKVQVLESFERFCCVKICRDQSLKQEP

SEQ ID NO: 155991 - protein, 50 aa, Glycine max
  Coding DNA Sequence Number=SeqID_64306
MDTSESGIKDPTRSGFGDTKLRAPHPIYRVCPSQSSLNLLSEREIGSYQT

SEQ ID NO: 155992 - protein, 81 aa, Glycine max
  Coding DNA Sequence Number=SeqID_64307
MVLLKSSLKYILVQSIPSVYVPFSAYLLYLCPSLTQNMFFHEEHHFRLLLPPATTTKTSSSRAVARCQHSHFLNLRKVFGK

SEQ ID NO: 155993 - protein, 149 aa, Glycine max
  Coding DNA Sequence Number=SeqID_64308
  Gene Ontology: Mol. function=protein phosphatase inhibitor activity; Biological process=regulation of phosphoprotein phosphatase activity
  Homolog annotation: Hit_ID=A5B112; Match level="QueryCoverage=71%, HitCoverage=30%, E-value=1e-20, Identity=53%"; Hit description =Putative uncharacterized protein
MKMFNGILVLPISLMVQYISEKGRVRWDEANIGEIEANKPVRQKITEPKTPYHPMIDDDSINLLKISMYYLIFLGSLSPVRGSFDACIDNENRAEAIWSALNDVASSSRRGTGQSGGWTSSEDEPEAMEQDDDDNNGIRDSDRPSNIEL

SEQ ID NO: 155994 - protein, 50 aa, Glycine max
  Coding DNA Sequence Number=SeqID_64309
MALIMFPFLESINLKALAVSRLNATVLHYETNNMLYKGLRKKARVIEDTN

SEQ ID NO: 155995 - protein, 558 aa, Glycine max
  Coding DNA Sequence Number=SeqID_64310
  Gene Ontology: Mol. function=metal ion binding; Cellular component =nucleus; Biological process=defense response to bacterium
  Homolog annotation: Hit_ID=A7QVH7; Match level="QueryCoverage=100%, HitCoverage=100%, E-value=0.0, Identity=65%"; Hit description =Chromosome chr16 scaffold_189, whole genome shotgun sequence
  Pfam annotation: Domain name=Ank; Domain location=111-146; Score =13.8; E_value=0.33; Accession=PF00023.21; Description=Ankyrin repeat
  Pfam annotation: Domain name=Ank; Domain location=246-278; Score =36.3; E_value=1.1e-07; Accession=PF00023.21; Description=Ankyrin repeat
  Pfam annotation: Domain name=Ank; Domain location=289-324; Score =19.3; E_value=0.015; Accession=PF00023.21; Description=Ankyrin repeat
  Pfam annotation: Domain name=Ank; Domain location=44-76; Score=39.5; E_value=1.2e-08; Accession=PF00023.21; Description=Ankyrin repeat
  Pfam annotation: Domain name=Ank; Domain location=77-109; Score=30.2; E_value=7.7e-06; Accession=PF00023.21; Description=Ankyrin repeat
  Pfam annotation: Domain name=zf-C3HC4; Domain location=391-440; Score= 12.3; E_value=0.0036; Accession=PF00097.16; Description=Zinc finger, C3HC4 type (RING finger)
  Pfam module annotation: Pfam domain module=Ank::Ank::Ank::Ank::Ank::zf -C3HC4; Domain location=111-146::246-278::289-324::44-76::77-109::391- 440
MGNSFGCSASGERLVSAARDGDLVEAKMLLECNPCLAKYSTFGGLNSPLHFAASKGHNEIVALLLENGADVNSRNYCGQTALMQACRYGHWEVVQTLLLFKCNVMKADYLSGRTALHFAAINGHARCIRLVVADFVPSAPFEALHAHMVAEASFVKLALFSAIPTIPLSIAKPCMTHGGDTRSSRGLHSSGVSDGFARGLHSSGDEIYAFQPFCCLQQMNKFIPLLELLQVEEGALSKFINKTADAGITALHMAALNGYFDCVQLLLDLSANVSAATFHYGTSMDLIGAGSTPLHYAACGGNLKCCQARIASTLIGASRMALNCNGWLPLDVARMWGRHWLEPLLTPTSDATISSFPSSNYLSLPLMSVLNIARECGLQSTTTSSNEVDACAVCLERQCSVAAEGCGHELCVRCALYLCSTSNVSSETGGPPGSIPCPLCRHGIVSFVKLSDRPSLSLTPEIRRNRVASVPSEMLCPVTCTPFPSVAIPLCTCNDGPCPSFEPREAEAQDGSPRHSQAAMMDQNKMDGPRLEKMTCSGMFWGRRSCSREHQCNSEINA

SEQ ID NO: 155996 - protein, 156 aa, Glycine max
  Coding DNA Sequence Number=SeqID_64311
  Gene Ontology: Mol. function=aspartic-type endopeptidase activity; Biological process=DNA integration
  Homolog annotation: Hit_ID=A5AZ64; Match level="QueryCoverage=58%, HitCoverage=9%, E-value=7e-14, Identity=40%"; Hit description =Putative uncharacterized protein
  Subcellular localization annotation: CTP_CleavageSite=52; ConfidenceScore=5.16e-01
MEYAMQFLMGLNKSFSTIRGQILSMAPFPSVTKVFALVFQEEKQKEVGASTSASEVSHAFALKTSSATRNHPDNRFKGSSKNRPLCAHCAKKYSFSSEPPHKVAQQVFVDMSHSQPSSGDSGSQFQLTAQQYSQLMNILERHVTNVVIPQGVFSAS

SEQ ID NO: 155997 - protein, 61 aa, Glycine max
  Coding DNA Sequence Number=SeqID_64312
MVSLIRCMESRNNTVGDVNVIANSQVQSIIVHRHFSSKSETEIKGISEKRGGGGGTTREKK

SEQ ID NO: 155998 - protein, 48 aa, Glycine max
  Coding DNA Sequence Number=SeqID_64313
MAKEYMKRERRMKKKRGEKKVIAKSLRLLERILLQVVVGNTSRAGVVI

SEQ ID NO: 155999 - protein, 67 aa, Glycine max
  Coding DNA Sequence Number=SeqID_64314
MVVLCERAVVAAQGAMMVVRVSDNGSLRSCLGCEGATLVARGATVTARGSGTSGSKGSRGCVRERQH

SEQ ID NO: 156000 - protein, 143 aa, Glycine max
  Coding DNA Sequence Number=SeqID_64315
  Gene Ontology: Mol. function=phosphoprotein phosphatase activity
  Homolog annotation: Hit_ID=A5C1K9; Match level="QueryCoverage=41%, HitCoverage=4%, E-value=9e-14, Identity=60%"; Hit description =Putative uncharacterized protein
  Pfam annotation: Domain name=DUF1723; Domain location=55-100; Score =23.8; E_value=0.00066; Accession=PF08330.1; Description=Protein of unknown function (DUF1723)
MTGSYRHCHWQDKHRLHSRTQNSSRLGFSFSEHIAILLMTSSSTCSSNIKIKSGPIDGDVLWMQERWRPETHTFHMRYGECIITLQVLLRLRVDGLPLIGPINLDWVDLCEELLGVRPQEGELQERCAAPPIIKLNQSKVVVT

SEQ ID NO: 156001 - protein, 339 aa, Glycine max
  Coding DNA Sequence Number=SeqID_64316
  Gene Ontology: Mol. function=serine-type endopeptidase activity; Cellular component=integral to membrane
  Homolog annotation: Hit_ID=A7QKI0; Match level="QueryCoverage=97%, HitCoverage=87%, E-value=8e-74, Identity=47%"; Hit description =Chromosome chr2 scaffold_112, whole genome shotgun sequence
  Pfam annotation: Domain name=Rhomboid; Domain location=112-302; Score= 162.3; E_value=1.3e-45; Accession=PF01694.13; Description=Rhomboid family
MSSSTIRRDLESGGANKNINNISYSAAPTSYVYDPEVHWTSWLVPLFVAVNVVVFFVVMYVNDCPRKNLGFEGDCVARFLGRFSFQPLRENPLFGPSSSTLTKMGALRWDDVVNHHQAWRLVTCIWLHAGVVHLAANMLSLVFIGIRLEQQFGFGMFLLSAYFSFIPMDMVTHLEVFMFFCVLQILLLNGYDLTFLKTLAVRIGIIYLLSGFGGSVLSSLFIRNNISVGASGALFGLLGAMLSELITNWSIYTNKAAALFTLLFIIVINLAIGMLPHVDNFAHIGGFLSGFLLGFILLLRPQFGWLEQQRLHAGVHLKSKYKAYQYVLWIVSAILLIVG

SEQ ID NO: 156002 - protein, 94 aa, Glycine max
  Coding DNA Sequence Number=SeqID_64317
MVMMMLEKEGSKGKEKRKKNQKNHTGINKAQAHLAENEEVIVVVVVEASLVDNKLFHHFEDVVDGECVFMGNSTTAGVLGKGKILLKLLEKIYP

SEQ ID NO: 156003 - protein, 152 aa, Glycine max
  Coding DNA Sequence Number=SeqID_64318
MILVPKKRWKKKKKAYPAASVHGGSNRPVTEVDEVGNVVDVLVCSVGEHGAAAGEAEPVAVVADPVLDGLLHRELAVGHVGVPRDVAAGRPGEGVPVAVRGGDAALEKVAVRRTVALAVDHSPARVLEGARVVLAGGVLAERHVAGRVVEGG

SEQ ID NO: 156004 - protein, 70 aa, Glycine max
  Coding DNA Sequence Number=SeqID_64319
MEMKRHHKEKLQNTDHDQLEARLRHPQSNEYSTHKLLERTQEGSHPRRIINTQDGPSLSHIHRLTGRTSR

SEQ ID NO: 156005 - protein, 203 aa, Glycine max
  Coding DNA Sequence Number=SeqID_64320
  Gene Ontology: Mol. function=protein transporter activity; Cellular component=cis-Golgi network; Biological process=intracellular protein transport
  Homolog annotation: Hit_ID=A7PDP7; Match level="QueryCoverage=52%, HitCoverage=13%, E-value=5e-40, Identity=71%"; Hit description =Chromosome chr11 scaffold_13, whole genome shotgun sequence
MRPQSSNSSGLRFISGIICKSKVLRFERMLFCAMRGNMLFIQAPTDEQIMDLVSAEMARTKILKICEAFGANCYPVAEDISKQRQITREVCVLGLAPLMDPLSTYLYDTLHPKVVHETNIDFLCDLLDILKMEVLGEQHSRRSESLAGLRPTFERILVDVHERFTFRAQTHIRDEIVNYMPTNEDLDYPEKQKRYAENVTAFH

SEQ ID NO: 156006 - protein, 68 aa, Glycine max
  Coding DNA Sequence Number=SeqID_64321
MWCRRVWFSAWSSHRAVRGRLVKRDASNSLSGWETLEEDKSEICTPSAQPACPARTLCLLALSAPMLA

SEQ ID NO: 156007 - protein, 160 aa, Glycine max
  Coding DNA Sequence Number=SeqID_64322
MEEGVATVELVLLREVSKAVVQLPPREGDLLFSSHYCFCWSSSFSSISFWHFACASCLSLMTLPKRSFTWINSHSLLVMSSLADAIVASSNKFRSVLRLYADYIAEAEATAAIPAATFMPKIPLGAILAIVDPVVIAVSKFKVVLWSLLESQLCLKPRTQ

SEQ ID NO: 156008 - protein, 69 aa, Glycine max
  Coding DNA Sequence Number=SeqID_64323
  Gene Ontology: Mol. function=hydrolase activity
  Homolog annotation: Hit_ID=O65755; Match level="QueryCoverage=88%, HitCoverage=32%, E-value=1e-20, Identity=80%"; Hit description =Putative deoxycytidylate deaminase
MCELSILWLVYGAKAEATIAIGFDDFISDALRGTAFYQKAQLQIKRVDGKEANIAGEVFERTEEKFRMY

SEQ ID NO: 156009 - protein, 193 aa, Glycine max
  Coding DNA Sequence Number=SeqID_64324
MGDQATSITPYTAEKPTLSSLEPTKPPTLFLEVWLEEIPTYIVATKVLKHSWVLKAQSFLREVLLLIEVRGKLKVSCHFVRSHCHCHCLGSRLLGAPVEITSDKDPVIVHNKLLTLLVIILEFGALVCKLSFRELNGHPMALLNTIFYASLKLVNAKKKNLKKAYDDLLTHPSLLRMFPHDPTSRLSSSSSTM

SEQ ID NO: 156010 - protein, 340 aa, Glycine max
  Coding DNA Sequence Number=SeqID_64325
  Gene Ontology: Mol. function=transferase activity; Cellular component= chloroplast; Biological process=glycolysis
  Homolog annotation: Hit_ID=A7NSW0; Match level="QueryCoverage=39%, HitCoverage=31%, E-value=2e-45, Identity=65%"; Hit description =Chromosome chr18 scaffold_1, whole genome shotgun sequence
  Pfam annotation: Domain name=Hexokinase_2; Domain location=217-338; Score=-68.8; E_value=7.6e-08; Accession=PF03727.7; Description =Hexokinase
SDSSISSGSLRFLQFFPLIAPIELSNVRETEKGLKPPLILSWCDSFFSLREYYHANPNGEDHFEFLRERKRLRCERYFSHLKHYIKIPNGENARNWVANIVLKFYDDPMVNRSKIVFFLIQATSRSGIMWPVKIGVESTEKWLDGHNRRRRKPQPSSLFMAAEKFMYNYKGRDVVACLNEAMERQGIDMRLSALVNDTVALLAGVEYWDNGVVVARTNACYVEQISAIPNTDWGAFSNGLPLTKINREMDVATINLGDEQIFEKTISGMYLGEIVRQVLLEMAEEGCLFGKCVPQKLSTPLILREFLLGCFMSKVRDGNMRFGPDCILMGGGATGANKLI

SEQ ID NO: 156011 - protein, 183 aa, Glycine max
  Coding DNA Sequence Number=SeqID_64326
MLEKAKLITNNGTRAENIPGNRQLPQQLHDNVAENDNGTSIGEGNVSHMENDDLSDLFKMLDEMYLLTEGSQIQKNFIYIKQIYKNYEECKVSTIFIVKSDGTYEITIHDSCCLNQTEENPNTHEFLKSDFSSSNHVVQYLEQSNRATDVIVNPTEGTSNMPNQTSISSDNNSNQKKKIDCAD

SEQ ID NO: 156012 - protein, 78 aa, Glycine max
  Coding DNA Sequence Number=SeqID_64327
MSFNKEEEVSHCGGGEGVRSLGMGGGRVNDLEDEKEGGFGAGGSPDVPWRRWPSAVVVKDEPFLFFEGSASRTSFYKF

SEQ ID NO: 156013 - protein, 153 aa, Glycine max
  Coding DNA Sequence Number=SeqID_64328
  Gene Ontology: Mol. function=sugar:hydrogen symporter activity; Cellular component=integral to membrane; Biological process =carbohydrate transport
  Homolog annotation: Hit_ID=Q39416; Match level="QueryCoverage=53%, HitCoverage=20%, E-value=4e-17, Identity=54%"; Hit description =Integral membrane protein
SQAPRAVKHILVKPLLRDLNPYLPQTLATSSSGAHAMKTVSIIVSLCRDPLHEELLLSSSGISLKPVWLHVLGCGPVRYSFLSLDLSNVGAMVGAITSVIDDCCDPQYNRDSSFLYMGMLLEGFGVGIISYVVPVYIAEIAPQNLRGGLGSVN

SEQ ID NO: 156014 - protein, 88 aa, Glycine max
  Coding DNA Sequence Number=SeqID_64329
MWTTSCIVDMGRKKLELGFEDQKIDFDLFVEDKPAPEQNVCLQLILKDRYKGFNFLRKRLKNNLEIFFLKIVLSLTASLVLTAFFVML

SEQ ID NO: 156015 - protein, 93 aa, Glycine max
  Coding DNA Sequence Number=SeqID_64330
MQMLPFLYPLKRLRDVGPAKPADRPNHDANDPLYLMTLTIPQLFLKLLQVMWDATVFGMFNESYPLYIKHEDLSEIAHGGQCLSISIIQLWIL

SEQ ID NO: 156016 - protein, 70 aa, Glycine max
  Coding DNA Sequence Number=SeqID_64331
MERQQEKEPKERSGGVTTVGKLCSTKAECPTHLKKITGMGKDFLVMMDSMNKVLLVKGDSANVISTHWEI

SEQ ID NO: 156017 - protein, 90 aa, Glycine max
  Coding DNA Sequence Number=SeqID_64332
MAAEWRRRGVERRSHFKEKMSLEEAHHHRRPWIRAWRKKEMNEGRGREEHEMFCSKRALNFENQTTRQWSIYMENKMKNKELKRIHITKR

SEQ ID NO: 156018 - protein, 54 aa, Glycine max
  Coding DNA Sequence Number=SeqID_64333
MGVSLAIIGLSSSFSRKLLKEAILGGEAPSSLAYSLVDGASPLLFSFAFRCISM

SEQ ID NO: 156019 - protein, 119 aa, Glycine max
  Coding DNA Sequence Number=SeqID_64334
  Gene Ontology: Mol. function=receptor activity
  Homolog annotation: Hit_ID=A5C4V3; Match level="QueryCoverage=50%, HitCoverage=4%, E-value=3e-16, Identity=60%"; Hit description =Putative uncharacterized protein
  Pfam annotation: Domain name=LRRNT_2; Domain location=38-80; Score =47.6; E_value=4.4e-11; Accession=PF08263.3; Description=Leucine rich repeat N-terminal domain
MSCYSLKLFYALLLLLLHAAGSILGFNSLPNSTEIKCIQTERQALLNFTHGLKDDSGMLSTWRDDGNNRDCCKWKGIQCNNQTGHVEMLHLRGQDTQYLIAIMIFKGVISQNSWARSPT

SEQ ID NO: 156020 - protein, 143 aa, Glycine max
  Coding DNA Sequence Number=SeqID_64335
MGQPSWSSWTMLTEDPWLGKGLAWTLGLESESLKVKSFAWISFWTSVLRARQCSTSWPGAPWWKAHVRSCRYQGEREANQHTLSGLDQRSLFGGFVSDMVVEGFGDFVVVEGIVVDGIVVGDTVVEDIGKGNVAFVGDMLGSG

SEQ ID NO: 156021 - protein, 214 aa, Glycine max
  Coding DNA Sequence Number=SeqID_64336
MLESFKQQDQMSVLELYIEKDVAGGSMFHSANSLTSGGNYLSNDETQPTTNLSNLHIDEDDDDDDDDYVVSNSYVEESLDEDDSLDSISDTDDEVTDIPQPVRIVHPAEGAQRIENPFWNDALHYNNINWSYLDEEDICGLEMPSTFNVGQELYVGMEFDSKDAVKNAVKQYVMKVHQSFKVVESKTNKYVESHTMGWTTHMSEYDHDTRSRET

SEQ ID NO: 156022 - protein, 26 aa, Glycine max
  Coding DNA Sequence Number=SeqID_64337
MGLSSSFFGNLLKEASQGGELSYERD

SEQ ID NO: 156023 - protein, 105 aa, Glycine max
  Coding DNA Sequence Number=SeqID_64338
MGPSQTPSLKKRFYQIKVKSLGITSLKEFGQLMGQLHRQLFAKLTLSPMGEEFEESLGCPIGGRKPYLFSGFYPSLARISKIVQISGQELDHRKEVGDGVVGIPR

SEQ ID NO: 156024 - protein, 174 aa, Glycine max
  Coding DNA Sequence Number=SeqID_64339
  Subcellular localization annotation: CTP_CleavageSite=47; ConfidenceScore=5.51e-01
MGQLAPHLNLQQSQNSDRLPSQSVQNPKNVSAITLRSGKQGQGPKPVASSSSANEPAHPHSAPEKDDDKNLKSKLPNNFYAGESKEKQHIPLTFPPRATSNKKMEEAEREILETFRKVKARLTGALSKGGKMRGVTTNEGISTSHVDKSGAFAPTYPLSKRKSDLRSSFLCVDQ

SEQ ID NO: 156025 - protein, 30 aa, Glycine max
  Coding DNA Sequence Number=SeqID_64340
MECSGRSKGSKGCKSDGLPLVIHYIQHAHN

SEQ ID NO: 156026 - protein, 28 aa, Glycine max
  Coding DNA Sequence Number=SeqID_64341
MEKNEETTMEEKMSAEDKGEEVRGGAIH

SEQ ID NO: 156027 - protein, 38 aa, Glycine max
  Coding DNA Sequence Number=SeqID_64342
MEKGVEGRSPEYEEPRDLRSNPFQGGGNDAILSRKGIG

SEQ ID NO: 156028 - protein, 42 aa, Glycine max
  Coding DNA Sequence Number=SeqID_64343
MGSKWAPEKIKAFQEWPPLKSVEDIRSFHGLPSFYRRLIRQA

SEQ ID NO: 156029 - protein, 94 aa, Glycine max
  Coding DNA Sequence Number=SeqID_64344
MGIDQSLFHDLTQLSSDGVPFEGNLRTEDSSSLLRKLLDKFDGLQTFVGDKFDAMELHVDMRFDAMESRITKVEEDVSFIRTCFDPPPSPPSSS

SEQ ID NO: 156030 - protein, 314 aa, Glycine max
  Coding DNA Sequence Number=SeqID_64345
  Homolog annotation: Hit_ID=Q6WAY6; Match level="QueryCoverage=76%, HitCoverage=43%, E-value=1e-08, Identity=24%"; Hit description =Putative uncharacterized protein
TINWFPRWKEGNEGVLFSCGDYPNILLIGTRGCINYNLALAIRQLGYPMSGAPTEESLSPFLVRDFGAQSFKVIQRVHKAWEGPLRKDKELRGICNGIIGGYYEWLKVHTRGLDWLSKLKIIKEESFEAPEEDEETFGKSVPGYEKKMQQLQEPLNKKPRGLTRKSMAETNSVELCGAATVSSSFKGKRETNHEHIAWSLKEELAACSRSKRNLSQRLCERETNMLAIVSKYQEELNLATAHEHKVADEYAQVYAEKEARGRMIDALHQEATMWMDRFALTLNGSQELPRLQAKAKAMADTYSALEEIHRLLSY

SEQ ID NO: 156031 - protein, 31 aa, Glycine max
  Coding DNA Sequence Number=SeqID_64346
MEVLLSPIALKVVVMEVCLWGFYGGRIFELQ

SEQ ID NO: 156032 - protein, 153 aa, Glycine max
  Coding DNA Sequence Number=SeqID_64347
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=55%"; Hit description =Putative uncharacterized protein
  Subcellular localization annotation: CTP_CleavageSite=47; ConfidenceScore=5.04e-01
MTMITPSSKLTLTKGNKSWYRAPPRDADQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 156033 - protein, 103 aa, Glycine max
  Coding DNA Sequence Number=SeqID_64348
MPFGEALQQMPLYAKFLKDMLTKKNRYIHNDRIVVEGYFDDAKESRVKQSFKQRFKIQESSFKFQDSRFKKNQDQDSRLKIQESREDSIKISTKKFFKTLSST

SEQ ID NO: 156034 - protein, 42 aa, Glycine max
  Coding DNA Sequence Number=SeqID_64349
MVGSWYRIYATKNRKIQGSRMSEHENKRYAVCRTKSMLNAYA

SEQ ID NO: 156035 - protein, 195 aa, Glycine max
  Coding DNA Sequence Number=SeqID_64350
  Subcellular localization annotation: CTP_CleavageSite=29; ConfidenceScore=5.74e-01
TPAQPQRAPTQNPAPTQPLPVSSSNPSMSANPGRNPPVKKLLEFAAIPLSYTNLFPSLIANQMAMVTPGRIYLSPFPWWYNPNATYTPKQMKDVVTSRRFILEALQEAGMISFDEHEGDSCLIHPGASHDVETCSTAEELLQGMMDQGWYAPQKPNEKKDEIVEDDLSFAKVTNICGMSGVTRSGRVFEAQNPLV

SEQ ID NO: 156036 - protein, 138 aa, Glycine max
  Coding DNA Sequence Number=SeqID_64351
MTGRLLVGSLAFESRILHYIIVRILIPRSSNLAQAHLVRYCMHKAFRLNASLLYPYLVTLFLQHFNIPLDSEPYVPIKRSFLIGAAVIASFGYRKEHDGSWAKMGAQPIDDEGHGGEDSSLLQKILDRFDGLQTFVGE

SEQ ID NO: 156037 - protein, 212 aa, Glycine max
  Coding DNA Sequence Number=SeqID_64352
  Homolog annotation: Hit_ID=Q0ZCD0; Match level="QueryCoverage=73%, HitCoverage=13%, E-value=2e-07, Identity=27%"; Hit description =Integrase
MERSMIDAASGGVLGDMTPTEARNLIEKMASNSQQFSARNDAIVIRGVHEVATNPSASSETKKLEGKLDALVNLVTQLALNQKSVPVARVYGLCSSVDHHTNLCPSMQQPGAIEQPEAYAANIYNRPPQPQQQNQPQQSNYDLSSNRYSPGWRNHPNLRWSSPQQQQQQPASSFQNAAGPSRPYIPPPIQQQQQPLKQPTVEAPPQPSLEEL

SEQ ID NO: 156038 - protein, 143 aa, Glycine max
  Coding DNA Sequence Number=SeqID_64353
MAPTRHPLDPDKSNKALGFPALITGLCQSFGVPVTPTKVIRPPITQAFIEKYCTQRQAQGDAPQAAGAPPPPHQAGPAGSFDMEQYLRHLVCQQAANHRAHVQTHDCLYQLSLSMQSQGFASFSCPTPDQFRAEVAWPGDLLR

SEQ ID NO: 156039 - protein, 140 aa, Glycine max
  Coding DNA Sequence Number=SeqID_64354
MRGAPTEESLSPFLVRDLGAQGLKVIQRIHKAWRSPLRKDKELRGIRNGVIGDWLSKLKVIDEENFEAPEEDEEVRALKLELGKARHAKEKFKSATTHIRKECTELQEENAATARALEQETKRACKERIWPREIPRSIVG

SEQ ID NO: 156040 - protein, 82 aa, Glycine max
  Coding DNA Sequence Number=SeqID_64355
MDFEICQIVQQKAVKFCAAEFCSYVENACALLVMEKSMMIGCGITWMLWKLGRIDGDPTLRGTRIRATWEYVSSVGGGQQGM

SEQ ID NO: 156041 - protein, 325 aa, Glycine max
  Coding DNA Sequence Number=SeqID_64356
  Gene Ontology: Mol. function=protoheme IX farnesyltransferase activity; Cellular component=integral to membrane; Biological process=heme biosynthetic process
  Homolog annotation: Hit_ID=A8GAQ0; Match level="QueryCoverage=81%, HitCoverage=89%, E-value=1e-143, Identity=97%"; Hit description =Protoheme IX farnesyltransferase
  Pfam annotation: Domain name=COX4_pro; Domain location=1-64; Score =64.7; E_value=3.1e-16; Accession=PF03626.5; Description=Prokaryotic Cytochrome C oxidase subunit IV
  Pfam annotation: Domain name=DUF81; Domain location=45-262; Score= -72.8; E_value=0.068; Accession=PF01925.10; Description=Domain of unknown function DUF81
  Pfam annotation: Domain name=UbiA; Domain location=41-311; Score =271.1; E_value=2.3e-78; Accession=PF01040.9; Description=UbiA prenyltransferase family
  Pfam module annotation: Pfam domain module=COX4_pro::DUF81::UbiA; Domain location=1-64::45-262::41-311
MVMNGTASHSTILAVVVGMAVIQVIVHLVYFLHMNTSSEERWNLVALLFTAMIIGIVVVGSIDYPLFLATLVGVSLVVASGCVFNNYIDRDIDKKMERTKNRVLVKGLIAPSVTLVYATVLGIVGFALLYIAANPLAMWLAVMGFVVYVGVYSLYMKRHSVYGTLIGSLSGAAPPVIGYCAVTNEFDAGALILLAIFSLWQMPHSYAIAIFRFKDYQAANIPVLPVVKGISVAKNHITVYILAFMIATLMLTLVGYAGYKYLIVAAAVSVWWLGMALRGYKTENDSVWARKLFVFSIVAITSLSVMMSIDFSATAAPEALVTYVW

SEQ ID NO: 156042 - protein, 18 aa, Glycine max
  Coding DNA Sequence Number=SeqID_64357
MHIVVVHRDRCKWGWGHN

SEQ ID NO: 156043 - protein, 80 aa, Glycine max
  Coding DNA Sequence Number=SeqID_64358
MAAQFIHDRDGVPRGSLGDPRRQCEVPIPWHDPTHGYFVEGDEDPLLEVDSPEEVMSASEADSTEDGGPGEMAISGGSSS

SEQ ID NO: 156044 - protein, 32 aa, Glycine max
  Coding DNA Sequence Number=SeqID_64359
MADGKMIKMKGRINLGLKRLWESLGCANELEE

SEQ ID NO: 156045 - protein, 47 aa, Glycine max
  Coding DNA Sequence Number=SeqID_64360
MTKARQKGDTEREKGEVIAAQLAQASWVASTRRHRLLLEHPGRPKWV

SEQ ID NO: 156046 - protein, 74 aa, Glycine max
  Coding DNA Sequence Number=SeqID_64361
MSITEDMMNWAHPGPFAKLVQKRAFVFKTQHWTLFRFNWKLLTLPALKTVVMYFTLHHNVPSKASLVRHLFCGQ

SEQ ID NO: 156047 - protein, 101 aa, Glycine max
  Coding DNA Sequence Number=SeqID_64362
KSIPAVATCPFAGERGEAHGKRFPKEERCAESPPMFICEKRRKNRRKPVKMKILSSGVVFTFEEGISTSHVDKSGAFAPTYPPLENFQNPICTTLSTDSHA

SEQ ID NO: 156048 - protein, 123 aa, Glycine max
  Coding DNA Sequence Number=SeqID_64363
MHGTERKVELYHTEFDDFKTKLERRNLHKRLTNLADGSIDVALVQDFYANLYNSESPSPKQARVKGHLVKIDADSLNTFLETPMVLAEGETLPIYSKYCRLPLDLREIEAALCIPGRGFHLEC

SEQ ID NO: 156049 - protein, 74 aa, Glycine max
  Coding DNA Sequence Number=SeqID_64364
MEKGWVKEILSPCAMPVILVNQNLSQLLRHVVDTFNINSRANSSHEVGYDRGLSKEEEFDLRGLNMDGPITRAR

SEQ ID NO: 156050 - protein, 252 aa, Glycine max
  Coding DNA Sequence Number=SeqID_64365
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.15e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTFLSYWTTFRKIKAPDNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 156051 - protein, 124 aa, Glycine max
  Coding DNA Sequence Number=SeqID_64366
MWAIIDQYKEKLSLVASHEQILEDEHVKVSVLQVEREARERVTDSLHKEAMMWMDRFAFTLDGSQELPRLLAKAKAMVDVYSAPEEADMEAMKDQMTFMIEAMLSMKRMMESNAAAVAAPGSPL

SEQ ID NO: 156052 - protein, 17 aa, Glycine max
  Coding DNA Sequence Number=SeqID_64367
LRRFWMTPLPVKEDKSG

SEQ ID NO: 156053 - protein, 105 aa, Glycine max
  Coding DNA Sequence Number=SeqID_64368
MTPTHDALLYYNGRWNMSRQNEFVGYSFTGKNSKKFDIPSGCTMDELKDLIKQVTPHGIPLYGIHETQTVLIESNYWKKIGPIEILVVFSELVMEMKDELALSQN

SEQ ID NO: 156054 - protein, 172 aa, Glycine max
  Coding DNA Sequence Number=SeqID_64369
  Homolog annotation: Hit_ID=UPI00006A2D9E; Match level="QueryCoverage =93%, HitCoverage=83%, E-value=2e-13, Identity=18%"; Hit description =UPI00006A2D9E related cluster
TLTVRGLHVLAFRGLHVLANGGLHALTLKGLHVLASRGLHALTLRGLHVLAIRGLHALTFRGLHALAIRELHVLTFVGLHALTFRGLHVLTNRGLHALTLRGLHVLANRGLHALTLRGLHVLANRGLHALTSRGLHILSLRGLHALTFRGLRVLIFSVLHIRTLREFKVLCP

SEQ ID NO: 156055 - protein, 121 aa, Glycine max
  Coding DNA Sequence Number=SeqID_64370
DCARKTPSGPEEGQQCLGVASSKYGSLSVQGSACCPQQGHQAPYQSSFHLEVLRPQAGAGRDTTAALGWTVAGNRHTAITTKVHLSSSIKRTHLVAHDPGDLNKTSASSEGSERYLRYACM

SEQ ID NO: 156056 - protein, 56 aa, Glycine max
  Coding DNA Sequence Number=SeqID_64371
MREIVNGVSTGNAKRRNGKKWKAEKGRSKKGQDEHKQRDRTRGLKWQHTGMRKEEA

SEQ ID NO: 156057 - protein, 89 aa, Glycine max
  Coding DNA Sequence Number=SeqID_64372
MTIDNPSDLQPFDPEIDRTFHRLVRQHLVPFEHPEHSVIGDFEHYSFEHSDFEYSENMAHISEGLSSFFRRSGKGLAILPCSKVHHELG

SEQ ID NO: 156058 - protein, 135 aa, Glycine max
  Coding DNA Sequence Number=SeqID_64373
VPFEGALIDDWKFEFSVHDVRRLVCTNQENMTGRLLSGSLAFESRILHFLIVHILLPRSSNLAQVSEEDLIVMWAFHKGIAIECSIALSSSSHLFPSTLQHPLMQSYPARALGRRLQVDWARDPREGPRVLMSLR

SEQ ID NO: 156059 - protein, 36 aa, Glycine max
  Coding DNA Sequence Number=SeqID_64374
MEIGRSSRGPPPPSGLELSVGQDCAGNEFCGGGLCG

SEQ ID NO: 156060 - protein, 242 aa, Glycine max
  Coding DNA Sequence Number=SeqID_64375
  Subcellular localization annotation: CTP_CleavageSite=53; ConfidenceScore=5.12e-01
MTMQNMQFQQETRASIQSLTNQMGQLATQLNQQQSQNSDILPSQSVQNPKNVSAITLRSGKQCESKEKQHIPLPFPPRAISNKKMEEAEKEILETFTKVESTDVVIHLANRSVAYPAGFIEDVLVKVGTLSMQFGDITVHFNILDAMKHPSEDLFVFRVEIIDHIVDEYMTYLHSNLHDYHSSCIEYEFALDHMSEFDAESEFEFDIDYMSGDVLPLEIDFIESNRTNHVSGSTHTSDFLYE

SEQ ID NO: 156061 - protein, 109 aa, Glycine max
  Coding DNA Sequence Number=SeqID_64376
MDNEEGVQEQMKADLSALKDQMASISEDKATPTASSTVREVELVLQPALNPGLDRNTAVFGRRYSPQAYPYGLPPDFTPRATPEDLSQAPTFEGQLPPYEDYPGKDNEE

SEQ ID NO: 156062 - protein, 76 aa, Glycine max
  Coding DNA Sequence Number=SeqID_64377
MEEEVDPPIKREKHKENKVTNVDCEDDFLDNPITNLIKKELEADFHTKIAYGETKIIHEGGWNNNGVETLECQLVG

SEQ ID NO: 156063 - protein, 103 aa, Glycine max
  Coding DNA Sequence Number=SeqID_64378
MTTLTQIWMTLLLSNILPTDHNFDLPLPKCQLVYAILTRMSIHVAQLIADAIYIFAGMAPTRHPLDPDKSNRALGFPALKGSRKDKAVWKEPVATPEYDSHPF

SEQ ID NO: 156064 - protein, 37 aa, Glycine max
  Coding DNA Sequence Number=SeqID_64379
MVRQLATTARGGHWWVVGGRGEAVRISLSEKKLHFWC

SEQ ID NO: 156065 - protein, 144 aa, Glycine max
  Coding DNA Sequence Number=SeqID_64380
WKWKRDRRVAASATTGGGTSNYLPDLKVMALTFLGFCKVLSLAEIAYSGWSFASLNLLRKVEEGPQLLVVFVVAALEEEHMACMDQQHSGREGQAVVVVEYLSISDLNDSSNLDCCSLTPNCSKKDRDLHGDLQKNIDRRLLQQ

SEQ ID NO: 156066 - protein, 162 aa, Glycine max
  Coding DNA Sequence Number=SeqID_64381
AFRLTDSKKVYTDNHSGISARQRDSKVSMTDLVSVEDDAFHFTDSKKVYTDNHSGISARQRDSKVSMPYLVSAEDDAFRLTDSKKFYTDNHSGISARQRDSKVSMTDLVSAEDDETTLVSACYQAFRLTDSKKVYTDNHSGISARQRDSQVSMTDLVSAQDE

SEQ ID NO: 156067 - protein, 99 aa, Glycine max
  Coding DNA Sequence Number=SeqID_64382
MNDQRRRTVENHPRKRHGSITEAPRLGFSSRKQFFSLILSESPIPGGKRKEKLVIQLALVSQVASSRRHRLLENILEAQVDLVAICTPYLLNTPLSFFC

SEQ ID NO: 156068 - protein, 124 aa, Glycine max
  Coding DNA Sequence Number=SeqID_64383
MVGYTPSSFADLDFASRRIKAGLKRGKFNHPTWTTEKTGPNEEGEKEGETHAVTAIPIRPSFPPTQQCHYSANNKPPPYPSPSYPQRPSLNQPQSLSTALPMTKTTFSTNQKTPTKRNFAAKSL

SEQ ID NO: 156069 - protein, 160 aa, Glycine max
  Coding DNA Sequence Number=SeqID_64384
MASKKLFAKRSRRDAAAEGTSAAPEFDSHHFKSAKHQERRVQLRDDEYTNFQEEIACRHWTSLVTPMAKFDPDIVLEFYANAWPTEEGVRDMRSWVRGQWIPFDADALSQFLGDPLVLEEGQECEFSQRRNRADGFDEEAIAQLLCILGQDFARTAAGRR

SEQ ID NO: 156070 - protein, 100 aa, Glycine max
  Coding DNA Sequence Number=SeqID_64385
TYPLKTEERMKNVEERSKTFAKSLTETLRKRLGLDFLHGTNFLQLFREREKCLRGRTLFYFTSPPIYRKLGEKLATQLAQARKVASSRSNSLLEESSGGP

SEQ ID NO: 156071 - protein, 114 aa, Glycine max
  Coding DNA Sequence Number=SeqID_64386
  Subcellular localization annotation: CTP_CleavageSite=22; ConfidenceScore=5.26e-01
MTSPATDGRILQNSSNNDNKPYFQNVAGPSRPYVSLPIQQQQQQQQQPQKQQTVEAPPQPSLEELVRKMTMQNMQFQQETRASIQSLTNQIGQLATQLNQQQSQNSDRSPFQSV

SEQ ID NO: 156072 - protein, 228 aa, Glycine max
  Coding DNA Sequence Number=SeqID_64387
MSASDHAILRDKVHQPTKKSLLELSSQDALLAQNKLLSRKLEILTETLGCTVCGEAHESGHCIPIEEHTKEVHYMGNQQRQGYNQEGFLGFQQGLYNQQGQWISHPGNQFNKDQGGPSNKPPQQGPNIFQRTTKLEETLAQFMQVTMSNHKSTESTLKNLEIQVGQLVKLLAEKSSNSLGANTEKNPKEECKAIMTRSRKLVAAEDEDIVALKEQVVLKDTIDKNNDE

SEQ ID NO: 156073 - protein, 41 aa, Glycine max
  Coding DNA Sequence Number=SeqID_64388
MKEAMRILKIMGLEGNNELSKRMESPQEIIPSKTLLEIYQE

SEQ ID NO: 156074 - protein, 139 aa, Glycine max
  Coding DNA Sequence Number=SeqID_64389
MCHPTAYLYDYYNSQICNTNEGTTFVSNNTKTLMVNKVITFTQLLELFHQKLNIEPHQHIQHLHFRCPIFESGQHYRYTSIILRDDVDVRQMFNIFYNNPPLPFVELFAIICNNNNPPNNQHYSTSNLEDLSDEYKSCW

SEQ ID NO: 156075 - protein, 132 aa, Glycine max
  Coding DNA Sequence Number=SeqID_64390
MITLFLQHFNVPLDSEPFVKVKRSFSIGANVISSFGYRKERDGSWVKKDAPVQAAEDRSPSPHSQRDDSSSLMHNILERFDGLQTYVGERFDALERQVDMRFDKMDSRITKVEEDVTIIRDCLDLPPPPPSV

SEQ ID NO: 156076 - protein, 147 aa, Glycine max
  Coding DNA Sequence Number=SeqID_64391
MKLYFYKIVLEFYANAWPTKEGVRDMHSWVRGQWIPFDADALSQFLGDSLVLEEGHQCEFGKRRNRADEFNEEAIAQLLCTPDERPRGPSMPPTRHPLDSDKSNRALGFPPLITGLCQSFGVPVTPSKVIRPPITRAFIEKYYTPRQ

SEQ ID NO: 156077 - protein, 37 aa, Glycine max
  Coding DNA Sequence Number=SeqID_64392
MEVVLPFEVDVGRHEPWMIVMEACLWGFYGGWIFELQ

SEQ ID NO: 156078 - protein, 61 aa, Glycine max
  Coding DNA Sequence Number=SeqID_64393
MIMRVQDIYSSQEETTSCPSSIGSEDELRGEESSEEVYPHEKGDLLRVRRLLGGSEGKSSL

SEQ ID NO: 156079 - protein, 84 aa, Glycine max
  Coding DNA Sequence Number=SeqID_64394
MVGYTPSSFDDMVFTEERIKGENVGEAYAVTAIPIQPSFPPTQQCHYSANKPTFSLPTAQLSTKAIPKSTTKYVYRTSNDEHHL

SEQ ID NO: 156080 - protein, 81 aa, Glycine max
  Coding DNA Sequence Number=SeqID_64395
MGELNCAIARSPPSTTYDGVVPGDMSRGSGDLGDVRWGAIAQNQGDRALVIDYQLGVIDYTVLPATERKSLEQDILTMRSR

SEQ ID NO: 156081 - protein, 69 aa, Glycine max
  Coding DNA Sequence Number=SeqID_64396
MGELIFAIARSPPSTTYDGVVPGDMSRGSGDLGDVRWGAIAQNQAWLIPTQPRHSQSVRTCDVPKQASS

SEQ ID NO: 156082 - protein, 93 aa, Glycine max
  Coding DNA Sequence Number=SeqID_64397
MRARGISKSAQFVQQKAVKFCAAEFGSCAENVCVLLVVERLGGVDGDPVLRGTRIRATWGYMSSVEGGQLGMVGSCLICGCGRVDLHHRPIAT

SEQ ID NO: 156083 - protein, 85 aa, Glycine max
  Coding DNA Sequence Number=SeqID_64398
MRGTPSEESITPFIAQGFSDPNARVLQGVRKAWDVVQRKDKELRGSKEETETPEESEEVQTLKAKLGRAQAVKEKFKSMAIKVQK

SEQ ID NO: 156084 - protein, 96 aa, Glycine max
  Coding DNA Sequence Number=SeqID_64399
MVEGDIIEELGQFLDVGLIGYQFMIPSFPFSPQLANYQGRVSIHFEQLDIKVNCRLDSKSARLVFSHIIHAIEAQSCHEGNALIVGRDQHRPNPMA

SEQ ID NO: 156085 - protein, 33 aa, Glycine max
  Coding DNA Sequence Number=SeqID_64400
MEEKLQWGPLMVIFHHGDAAEDKGKEVRGGAIH

SEQ ID NO: 156086 - protein, 82 aa, Glycine max
  Coding DNA Sequence Number=SeqID_64401
  Gene Ontology: Mol. function=RNA-directed DNA polymerase activity; Biological process=RNA-dependent DNA replication
  Homolog annotation: Hit_ID=A5YPB7; Match level="QueryCoverage=50%, HitCoverage=22%, E-value=3e-09, Identity=60%"; Hit description =Putative gag protein
MAGTNPNDGGGLSQFQMQALMQHLERLMKQRDDALHERQNRIDGIKLNIPPFKGKNDPEAYLEWEMKIEHVFSCNNYEEDQK

SEQ ID NO: 156087 - protein, 101 aa, Glycine max
  Coding DNA Sequence Number=SeqID_64402
MNWQEAFRSYLLGWCKPTDRHHKQKNQTSNRQSVHLQMVHLHLAIGTKRGLCTVFAVPQMKTMIQREWRKELAFPMTLNVVDSDSKCPFTSSMVPPFEEIF

SEQ ID NO: 156088 - protein, 28 aa, Glycine max
  Coding DNA Sequence Number=SeqID_64403
MEKNEEKTMEEKWKAKEKRIGKAPSTRE

SEQ ID NO: 156089 - protein, 277 aa, Glycine max
  Coding DNA Sequence Number=SeqID_64404
  Homolog annotation: Hit_ID=UPI00006A2D9E; Match level="QueryCoverage =45%, HitCoverage=68%, E-value=1e-09, Identity=18%"; Hit description =UPI00006A2D9E related cluster
AIRGLHVLTFVGLHALTFRGPHVLTFRGLHALAIRGPHVLTFKGLHALAIRGLHVLTFRGLHALAIRGLHVLTFEGLHALTFRGLHVLVNRELYALTLRGLHVLANRELHALTLRGLHVLANRGLHALTSRGLHILALRALHALTFRGLCVLIFRTSSFLLTVPGPPPDIGRATNYASTTREGGYHTATMHTGARFHPCRCKETNADHAHQHDNFFATYPSAGGRRVTRGMRVPRKEYARSRHQRLFEENVGKTGKDAIYELLSERFGSCIYARGRY

SEQ ID NO: 156090 - protein, 84 aa, Glycine max
  Coding DNA Sequence Number=SeqID_64405
  Subcellular localization annotation: CTP_CleavageSite=3; ConfidenceScore=5.10e-01
MKLASTKSTPVARVCEESSKSEMDKSSTTTTPVPPFQNAAGPSKPYVPPPIQQQQSQQRQQATEALPQPSLEELVRQMTMGSSR

SEQ ID NO: 156091 - protein, 94 aa, Glycine max
  Coding DNA Sequence Number=SeqID_64406
MTEREMITIMVNTLPTFYYEKLIGYMPPNFADLVFAGERIESGLRKGKFEYASNNNRRSPVVGARKKEGDAHAVTTAPTWISSLSIPSTSRGAP

SEQ ID NO: 156092 - protein, 83 aa, Glycine max
  Coding DNA Sequence Number=SeqID_64407
MPISVCQRLGEIEIMPTRMTLHCVVDMGKKMLRMGIEDQKISFDLFHEDKKPPDRNVCFKVHVMEERRPEKKILEVGTLLDPR

SEQ ID NO: 156093 - protein, 134 aa, Glycine max
  Coding DNA Sequence Number=SeqID_64408
SLPNSPTYNNKPQETQHKDAQAKVEYVKRLYDQVKVQIAKKNESYAKQANKKRKEVVLEPDDDFGHLRANVFQEGGNDENLKTVQIQGPMTRSMTKQSVDTLQQMVAGILSKAQVEKDERPKWRRMKAQKQRHY

SEQ ID NO: 156094 - protein, 89 aa, Glycine max
  Coding DNA Sequence Number=SeqID_64409
VGPSAARVNTKESCVDHSGTIQTWGSTTVHNIPLLHDQVKLGVEEVRDADAPILVPTEEVMWDATVFGMFNESYPLYIKHEDLSEIAHG

SEQ ID NO: 156095 - protein, 98 aa, Glycine max
  Coding DNA Sequence Number=SeqID_64410
MADGKLIEMKGRVNLGLKSENKMLMYGWLWKGLYILGYGRFLVDPNDQNLGGIDGDPVLRGTRMRATWEYVSSVEGGQLGMVDLCVICGCGESTCTIA

SEQ ID NO: 156096 - protein, 97 aa, Glycine max
  Coding DNA Sequence Number=SeqID_64411
MKFFQMFVRVFTCKAMKLWKQMDQSSFKNIWDILIRVLDAQAFVGGNQVQPFPFRVLSRGGGCAMFSECSKIRRFKTIMLKITNNRVLRMLKRIKGL

SEQ ID NO: 156097 - protein, 190 aa, Glycine max
  Coding DNA Sequence Number=SeqID_64412
MERSMIDAASGGALGDMTPAEARNLIEKMASNSQKFSVRNNAIVLRGVHEVATDSSSSTENKKLEGKLDALVSLVTQLAMNQKSTPVARVCGWRNHPNLRWTSPPQPQQPVPPFQNSASPSKPYIPPPMQQQQQQSQQRQQVTEAPPQPSLEELVRKMTIQNMQFQQETRASIQSLTNQMGQMATQLNQA

SEQ ID NO: 156098 - protein, 289 aa, Glycine max
  Coding DNA Sequence Number=SeqID_64413
RRDLRKEAAAAGTSAAPEFDSHRFRSVEHQQRFEAIKGWSFHRERRVQLRDNEYTDFQEEIARRRWTSLVTPMAKFDPDIVLEFYANAWPTEEGVRDLRSWVRGQWIPFDADALSQILGYPLVLEEGQECKYGQRRNRADGFDEEAIAQLLCIPGQDFARTAAGRRVCHLPGTLLDPDKSNRALGFPDIDHGFSASRSGFLSHLAANHRAHVQTHDCLYQLSLSLQSQGFPPFPCPTPDQFRAKVAWPGDWPEAQAREAPAEAPGNADEARMDEEMTDLLDFLGGSEAT

SEQ ID NO: 156099 - protein, 43 aa, Glycine max
  Coding DNA Sequence Number=SeqID_64414
MLTTFNTRHVRRYMEKNEEQHWRRSHGVAVEDKGEEVRGGIIH

SEQ ID NO: 156100 - protein, 90 aa, Glycine max
  Coding DNA Sequence Number=SeqID_64415
MGAKHLTRTKEWSHVIKQRSPDEIRKKIYKNKEKKGVMSTWEDLDDTLSNEDDEEANICLMADTTSEESELDQEDEGESKGCDKSGHENT

SEQ ID NO: 156101 - protein, 124 aa, Glycine max
  Coding DNA Sequence Number=SeqID_64416
LGRIDGDPVLRETRIWATWEYVSSVGGGQQGMVVVPGDMSRGSGDLGDVRRAPGSTQIKRTKTTKQGGLCGGWPTVNFDLYVRYGLWLENEVRELGDCGGPLVIDYQSCVIHYPEEWGTGNRLP

SEQ ID NO: 156102 - protein, 185 aa, Glycine max
  Coding DNA Sequence Number=SeqID_64417
  Homolog annotation: Hit_ID=A5C169; Match level="QueryCoverage=68%, HitCoverage=11%, E-value=4e-08, Identity=28%"; Hit description =Putative uncharacterized protein
MVCNDQAETTGRLLAGSLTFDCRIMHYIIVRIMLPCSSNLAQASEEDMILMWAFLTGHQIDCAHLVRYRMHKASRANAPLPYPQLVTLFLRHFQIPLDDEPFVQVKRSFAIGAGAVTSFGYRKDHDGQWLKKDTLPPQDERTPSPPPHERFDYFDGRFEGMDTRITQVEEDVTYLRRCFDLPPPS

SEQ ID NO: 156103 - protein, 50 aa, Glycine max
  Coding DNA Sequence Number=SeqID_64418
MAEFCLVPDVVIPPKFKESLTGAAVTWYTNLEVSRVHSWKDQMVVFIRQY

SEQ ID NO: 156104 - protein, 65 aa, Glycine max
  Coding DNA Sequence Number=SeqID_64419
MSRGSGDLGDVRRAPGSQQIKGTKTTKQGGLLENEVRKLGGLLVVEASGNRLPVCVIDYTEEWVT

SEQ ID NO: 156105 - protein, 89 aa, Glycine max
  Coding DNA Sequence Number=SeqID_64420
MAKKKLLQTISEWWRQFKLDLTRKWALAADKDDVEDNVYEKYGISKDKWAQFYQTCRDPSWEDVQKKTQAIQKQNTGPHMLSRDRVMII

SEQ ID NO: 156106 - protein, 54 aa, Glycine max
  Coding DNA Sequence Number=SeqID_64421
MDKSLKVGKNDWRERERRGMKFMPQMSLLIQDQVQDSPLSVLKCHEACKASRIA

SEQ ID NO: 156107 - protein, 190 aa, Glycine max
  Coding DNA Sequence Number=SeqID_64422
MERSMIDAASGGALGDMTPAEARNLIEKMASNSQQFSARNDAIVIRGVHEVATNPSASSETKKLEGKLDALVNLVTQLALNQKSVPVARQNQPQQSNYDLSSNRYNPGWRNHANLRWSSPQQQQQQPASSFQNATGPSRPYIPPLIQQQQQPQKQPTVEAPPQLSLEELVRQMTMHNMQFQQENRAWGIL

SEQ ID NO: 156108 - protein, 90 aa, Glycine max
  Coding DNA Sequence Number=SeqID_64423
MASSTCFQQISSQITIMKQKPSKTTHHISQNPIPTKIKDALHDSENAFLSRFGVEMGTKGWSFNGVSMEDEEERKSNVREREKASEMWAE

SEQ ID NO: 156109 - protein, 127 aa, Glycine max
  Coding DNA Sequence Number=SeqID_64424
MPFGEALQQMPLYAKFLKDMLTRKNKYIHSDTIVVEKLQFLHSISFLMNLWVTGCTLCGGAHGSGLRNPTKETSHEVNYMGNQPRQNLNAGGFSGFQHGQPYQQHNQWRTHPGNQFNKDQGRPPNRP

SEQ ID NO: 156110 - protein, 207 aa, Glycine max
  Coding DNA Sequence Number=SeqID_64425
MSPFLVRDLGAQNSKTIQRIHKAWETPLRKDQELRGIRNGIIGGYHDGDRNSTFSYHRQVNEEIGSKPRKRQKDEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMMEAMLGMKQLMEKNAATAAA

SEQ ID NO: 156111 - protein, 61 aa, Glycine max
  Coding DNA Sequence Number=SeqID_64426
  Subcellular localization annotation: CTP_CleavageSite=24; ConfidenceScore=5.17e-01
MWSKHLTDTCKALLCPWTSTGIPSSTNVRSIRQVCEVLIFTLSLSQSVGLASHPLSAPLLG

SEQ ID NO: 156112 - protein, 133 aa, Glycine max
  Coding DNA Sequence Number=SeqID_64427
MVEEFEEILGCPLRGRKPYLFSGFYPSLARISKKVQISAQELDRQRQVENGVVGIPRKYLEGVLFPNVDGLVDLAAIDVFLAYHNHKESPVVAMLADLYDTFDRRCEESNARDCLLYSSSLCGAGFTPFFPRR

SEQ ID NO: 156113 - protein, 59 aa, Glycine max
  Coding DNA Sequence Number=SeqID_64428
  Subcellular localization annotation: CTP_CleavageSite=36; ConfidenceScore=5.14e-01
LNLAHQWAKCASTTKRNFSVLSAIEESGRASISRPRAKREFSALSATVVFSQALAHNWH

SEQ ID NO: 156114 - protein, 112 aa, Glycine max
  Coding DNA Sequence Number=SeqID_64429
  Subcellular localization annotation: CTP_CleavageSite=59; ConfidenceScore=5.09e-01
MVKSWNLLRADQRLIFAKKLAQGFPVSTGTPGFILFCEVIFRHSGSPLRVTTTPAALKCAATGRVPFAIQAAQLLGRAIGAGLFAITPAGERGMCCKAIKLGNARVFPVTTL

SEQ ID NO: 156115 - protein, 92 aa, Glycine max
  Coding DNA Sequence Number=SeqID_64430
WNSQAGCLGTGRRHKGHLSNNLVTLFLQHFNIPLDSKPYVPIKRSFLIGTSVIASFGYQKEHDGSWVKKGTRHVGEEGHDGEDSSLLSDFRQ

SEQ ID NO: 156116 - protein, 118 aa, Glycine max
  Coding DNA Sequence Number=SeqID_64431
MAGTNFAELYGVAIVNSSCEGRKGTKTNMLAIIAKYEEELGLATAHEHRIADEYAQVYAEKEARGRVIDSLHQEATMWMDRFALTLNGSQELPRLLAKAKAMADTYSTPEEIHGLLGY

SEQ ID NO: 156117 - protein, 70 aa, Glycine max
  Coding DNA Sequence Number=SeqID_64432
MNISEDTHIPVILGRPFMFTASCIVDMGKRKRELGFENQKIDFDLFVDNKLAPEHNVCLLVMEGGQEVLK

SEQ ID NO: 156118 - protein, 109 aa, Glycine max
  Coding DNA Sequence Number=SeqID_64433
GSQGKEYGRKQISRRLCGVANNELKAGEGKRGTSREHIAWIADEYAQVYAEKEARGRVIDSLHQEATMWMDRFALTLNGSQELPRLLAKAKAMADTYSAPEEIHGLLGY

SEQ ID NO: 156119 - protein, 148 aa, Glycine max
  Coding DNA Sequence Number=SeqID_64434
MPLVIDYQGLENEVRKLGGLLVIDYQGGVIDYTEEWIVMAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDERSTS

SEQ ID NO: 156120 - protein, 47 aa, Glycine max
  Coding DNA Sequence Number=SeqID_64435
MKETVQKHSQSNVYSTLLVAYGTPTKRVEHAISDWVDLEINSGVQVT

SEQ ID NO: 156121 - protein, 72 aa, Glycine max
  Coding DNA Sequence Number=SeqID_64436
MPIGWTSQESEADIEEEEPTDLRSNLLQGGGDDAILPRKGPVTRAMSKRLQEDWARVDKEGLRVLMNLRVDF

SEQ ID NO: 156122 - protein, 105 aa, Glycine max
  Coding DNA Sequence Number=SeqID_64437
MTEKEMIKIIVDTLPVFYYEKSWEGEDERETHAMAAIPIRPSFPPTQQCHYSANNKPSPYPPPSYPQRPSLNQPQNPPSTPPMLNTTFSMNQNTNQGRNFAAKSL

SEQ ID NO: 156123 - protein, 36 aa, Glycine max
  Coding DNA Sequence Number=SeqID_64438
MGAGFVADLGVAFVDDLGFLVDRVVGDAILSRKGIG

SEQ ID NO: 156124 - protein, 66 aa, Glycine max
  Coding DNA Sequence Number=SeqID_64439
MLCIYWVWKEQCRLGRIDGGPVLRETRIWATWEYVSSIGGGQQGMVGLCAHCGCGKLVVHHRPTAT

SEQ ID NO: 156125 - protein, 81 aa, Glycine max
  Coding DNA Sequence Number=SeqID_64440
MSGFTRNSPQISASPYQLDFTLYASGSYNAQWNAPGLFHDKHTLRLSRILGEMEVVFVIGSAVDRLCGRFRDGLCGYLGGG

SEQ ID NO: 156126 - protein, 120 aa, Glycine max
  Coding DNA Sequence Number=SeqID_64441
MASSRDSEWRLLSLAEIAYSGWSFASLTFLRKVEEEPKLLVVFVVAALEADHMACLDQQHSRREGHVVVDVEDLSISDLDDSSNLDCIYCLKGHNYSAVVGFATEGVYYKCLQHKLQVAH

SEQ ID NO: 156127 - protein, 58 aa, Glycine max
  Coding DNA Sequence Number=SeqID_64442
MAEPSKKQKGTSSRSQRHSGSQETPIPSSIPSGSLFSSEEQHICLLFKLRNPRRHPNV

SEQ ID NO: 156128 - protein, 68 aa, Glycine max
  Coding DNA Sequence Number=SeqID_64443
MSGLTRDSPQISASPHQLDLAPYASGPYNAQWNVPELLYDMHMLCSSRILGKMEVVFVIGSAVDRLCG

SEQ ID NO: 156129 - protein, 70 aa, Glycine max
  Coding DNA Sequence Number=SeqID_64444
MKELRAFRVLQRNIIWKFRPRQCDRGSVFFKVSIRHAMAVPKSRSFIKRLPLEASSWFFEKLSQEASLRS

SEQ ID NO: 156130 - protein, 205 aa, Glycine max
  Coding DNA Sequence Number=SeqID_64445
MGEVDEVQEQMKADMEAMKEQMVTMMEAMMSMKKIMEANAVAIAATSAVAMVNPTPPSSLNQMNHPTSDMVGKDLGSTGSPHYVQIQNKHTFPPYSLPPNYTPPNVAYTPSENFNNSTPILIESQQPQSDHAHVSQPMGETHEIPHHNLADFEPCLGYATEGQAVGGIPLQKHFGRASISPPTTTLLWKNGGLHTFKLCGFGLRQ

SEQ ID NO: 156131 - protein, 127 aa, Glycine max; identical to SEQ ID NO: 113663
  Coding DNA Sequence Number=SeqID_64446

SEQ ID NO: 156132 - protein, 120 aa, Glycine max
  Coding DNA Sequence Number=SeqID_64447
MYPPLFSLNLVEVPSTRTDPQEDVPSLVLSQTQVDVPSTCTTKDVPSNELRQRSQAVKPLILCEWGYKRILRWEKGDTKEFRRLVLCSFGKGRRETQKEFRQLVLGEFFLAKGEGNEKDE

SEQ ID NO: 156133 - protein, 60 aa, Glycine max
  Coding DNA Sequence Number=SeqID_64448
MEEKVELKINRGNKPWKEELHHQESALDKKLREEASMEEKNEGKREGGSMKLKEKKRERT

SEQ ID NO: 156134 - protein, 147 aa, Glycine max
  Coding DNA Sequence Number=SeqID_64449
MTRGNPSDLQPFDPEIDRTFHRLVRHHFIPFDLPEHSITGESVHYVIGDFEHPDFEHYNFEHSNSEHSDFEHSKNMVQPPPHERTLREMDAPDFTYESLHIPYPDEDVPYVLKTRLIHLLPKFHGLAVKTRTNILKEFHIVCSTMNP

SEQ ID NO: 156135 - protein, 173 aa, Glycine max
  Coding DNA Sequence Number=SeqID_64450
MASNSQQFSARSDAIFIRGVHEVAMNSSSSAETKKLEGKLDALVNLQSGAIEQPKAYAANIYNRPPQPQQQNQPQQNNYDLSSNRYNPGWRNHPNLRWSNPSQQQQQQPYFQNAASPSRPYVPPPIQQQQQPQKQQTVKAPPQPSLEELVRQMTMQNMQFRQETIASIQSLTN

SEQ ID NO: 156136 - protein, 201 aa, Glycine max
  Coding DNA Sequence Number=SeqID_64451
  Gene Ontology: Mol. function=neprilysin activity; Cellular component =cytoplasm; Biological process=proteolysis
  Homolog annotation: Hit_ID=A8GLF1; Match level="QueryCoverage=100%, HitCoverage=70%, E-value=3e-84, Identity=78%"; Hit description=YicC domain protein
  Pfam annotation: Domain name=YicC_N; Domain location=1-151; Score =271.3; E_value=2e-78; Accession=PF03755.4; Description=YicC-like family, N-terminal region
MTAYARREAKGSWGSAAWELRSVNQRYLETYIRLPEQFRSLEPVIRERIRNRLTRGKIECNLRFDADASAQGELQLNESLAKQLVQAANWVKMQSDEGAVNPLDILRWPGVMTAQEQDLDAINAELLAALDGALDDFIIARESEGNALKALIEQRLQGVTDQVSKVRAQMPEVLKWQRERLVSKLEEAEVQLENNRLEQEL

SEQ ID NO: 156137 - protein, 156 aa, Glycine max
  Coding DNA Sequence Number=SeqID_64452
MAIRERNLASAKWSVLSSIKIVGIGVLQLSLLAQILQANELNLLAIAVVILLVIDTLADRGFGNALIRYQSLNNSELSKLYWGAALSRHPATGKTIYAHCLYGNVFRAGRAGGHAVYRVADAVSAVRHLGLPGDGFHQNADLLLLRASLVPAGVPF

SEQ ID NO: 156138 - protein, 557 aa, Glycine max
  Coding DNA Sequence Number=SeqID_64453
  Gene Ontology: Mol. function=hydrolase activity; Cellular component =intracellular; Biological process=guanosine tetraphosphate metabolic process
  Homolog annotation: Hit_ID=P0AG25; Match level="QueryCoverage=96%, HitCoverage=76%, E-value=0.0, Identity=93%"; Hit description =Guanosine-3',5'-bis(diphosphate) 3'-pyrophosphohydrolase (EC 3.1.7.2) ((ppGpp)ase)
  Pfam annotation: Domain name=HD; Domain location=66-165; Score=75.9; E_value=1.3e-19; Accession=PF01966.13; Description=HD domain
  Pfam annotation: Domain name=RelA_SpoT; Domain location=256-366; Score=168.4; E_value=1.9e-47; Accession=PF04607.8; Description =Region found in RelA  SpoT proteins
  Pfam annotation: Domain name=TGS; Domain location=409-468; Score =99.7; E_value=9.1e-27; Accession=PF02824.12; Description=TGS domain
  Pfam module annotation: Pfam domain module=HD::RelA_SpoT::TGS; Domain location=66-165::256-366::409-468
MAQGTLYIVSAPSGAALCRSTLYLFESLNQLIEKYLPEEQIKRLKQAYLVARDAHEGQTRSSGEPYITHPVAVACILAEMKLDHETLMAALLHDVIEDTPATYQDMEQLFGKSVAELVEGVSKLDKLKFRDKKEAQAENFRKMIMAMVQDIRVILIKLADRTHNMRTLGALRPDKKRRIALETLEIYSPLAHRLGIHHLKTELEELGFEALYPNRFRVIKEVVKAARGNRKEMIQKILSEIDGRLQEAGIPCRVSGREKHLYSIYRKMHLKEQRFHSIMDIYAFRVIVKDLDTCYRVLGQMHSLYKPRPGRVKDYIAIPKANGYQSLHTSMIGPHGVPVEVQIRTEDMDQMAEMGVAAHWAYKEAGESGTTAQIRAQRWLQSLLELQQSAGSSFEFIESVKSDLFPDEIYVFTPEGRIVELPAGATPVDFAYAVHTDIGHACVGARVDRQPYPLSQALTSGQTIEIITAPGARPNAAWLNFVVSSKARAKIRQLLKNLKREDSVNLGRRLLSHALGGSKKLAEIPAENIQQELERMKLSSIDDLLAEIGLGNAMSVV

SEQ ID NO: 156139 - protein, 409 aa, Glycine max
  Coding DNA Sequence Number=SeqID_64454
  Gene Ontology: Mol. function=ATP-dependent DNA helicase activity; Cellular component=intracellular; Biological process=DNA recombination
  Homolog annotation: Hit_ID=Q8XD86; Match level="QueryCoverage=100%, HitCoverage=59%, E-value=0.0, Identity=85%"; Hit description=ATP -dependent DNA helicase recG
  Pfam annotation: Domain name=DEAD; Domain location=20-188; Score =120.5; E_value=5e-33; Accession=PF00270.20; Description=DEADDEAH box helicase
  Pfam annotation: Domain name=Helicase_C; Domain location=261-338; Score=81.7; E_value=2.4e-21; Accession=PF00271.22; Description =Helicase conserved C-terminal domain
  Pfam annotation: Domain name=ResIII; Domain location=16-182; Score= -6.5; E_value=0.00017; Accession=PF04851.6; Description=Type III restriction enzyme, res subunit
  Pfam module annotation: Pfam domain module=DEAD::Helicase_C::ResIII; Domain location=20-188::261-338::16-182
MPARHQLVDKLLAALPFSPTAAQRRVVAEIERDLAHDFPMMRLVQGDVGSGKTLVAALAALNVIAHGKQVALMAPTELLAEQHASNFRQWFAPLGVEVGWLAGKQKGKAREAQQEAIASGQVAMVVGTHALFQEQVKFNGMALVIIDEQHRFGVHQRLALWEKGEEQGFHPHQLIMTATPIPRTLAMTAYADLDTSTIDELPPGRTPVTTVAIPDTRRSDIISRVQSACHEGRQAYWVCTLIDESDVLEAQAAEATWQELKVALPDLQVGLVHGRMKPAEKQAVMAAFKANEIQLLVATTVIEVGVDVPNASLMIIENPERLGLAQLHQLRGRVGRGAVASHCVLLYKAPLSKTAQKRLQVLRDSNDGFVIAQHDLEIRGPGELLGTRQTGNAEFKVADLLRDQSMIPE

SEQ ID NO: 156140 - protein, 146 aa, Glycine max
  Coding DNA Sequence Number=SeqID_64455
  Homolog annotation: Hit_ID=Q6WAY6; Match level="QueryCoverage=84%, HitCoverage=19%, E-value=3e-12, Identity=36%"; Hit description =Putative uncharacterized protein
MYDTFDQRCEKSGARIVYCTKALYVWLVSYLFHQEGRPVCPLQGHRLYAEKGKANWDQLLASMEGVSVNWFPRWKEGRTRILTSCEGFPNVPLMGTRGCINYNPVLAIRQLRYPMRGAPSEESIVPFIAQGFNDPNARVLQGVHKA

SEQ ID NO: 156141 - protein, 60 aa, Glycine max
  Coding DNA Sequence Number=SeqID_64456
MPKDRGTCLDFRDCHHQKGGDCRQRIKLNVLMMSKDHMFLKALFKTKKSKILKMEDQDSL

SEQ ID NO: 156142 - protein, 101 aa, Glycine max
  Coding DNA Sequence Number=SeqID_64457
LNGGSGLLLKLHVLHSHLPHKFFKGRIQPSKVGMIPTPGIVPVAGEHKLQAVQLLQIVAQKGKGLCGGRGHVSKGSTTDNIYHTSLYVVESFIQNITEEAA

SEQ ID NO: 156143 - protein, 72 aa, Glycine max
  Coding DNA Sequence Number=SeqID_64458
MPIGWTSQKSGADIEEEELTDLRSNPLQGEGDDAILPRKGPITRTMSKRLQEDWARAVEEGPRVLMNLRVDF

SEQ ID NO: 156144 - protein, 106 aa, Glycine max
  Coding DNA Sequence Number=SeqID_64459
MWTTTENWGRSLPPSSPRRARLLPPEATAFWRNLLEGPSGPAFEEVTETYGLRKNTSFRFPPHYGISRIVQACFLLIFDMPRDFIHCATKDAKCLEEANQRLYIFK

SEQ ID NO: 156145 - protein, 80 aa, Glycine max
  Coding DNA Sequence Number=SeqID_64460
MCTCAIFGTPNALSMHEMAPRKLASKRSRKDKAAEGTSSAPEYDSHRFRSAVHQQRFEAIKGWSFLRERRVQLKTLKKRY

SEQ ID NO: 156146 - protein, 62 aa, Glycine max
  Coding DNA Sequence Number=SeqID_64461
MWMDRFARTLNGSQELPRLLAKAKAMADTYSAPEEIHGLLGYWKNTITKRAARDPYRTQIQI

SEQ ID NO: 156147 - protein, 109 aa, Glycine max
  Coding DNA Sequence Number=SeqID_64462
MAPRKLASKRSRKDKAAEGTSSAPEYDSHRFRSAEEIGRRRWAPLVTPMAKFDPEIVLEFYANAWPTEEGVRDMRSWVRGQWIPFDADAISQLLGYPMVLEEGQECEYG

SEQ ID NO: 156148 - protein, 51 aa, Glycine max
  Coding DNA Sequence Number=SeqID_64463
MKMLLIPHDVAPCEAYHDSGMEKEERCWRRYFKESMSQEEAHHHKKPWIRA

SEQ ID NO: 156149 - protein, 118 aa, Glycine max
  Coding DNA Sequence Number=SeqID_64464
MYKGVCYKVTDCMIRGWSKMPSSLVFHKNQKDFLRFVVRLGYKNLLVVYTPNKDVNNSAPILIEIRQPQTNHAHVSQPIGETHEMPLHNLADFEPCLGYATEGQAVGGIPLQNTFEGP

SEQ ID NO: 156150 - protein, 123 aa, Glycine max
  Coding DNA Sequence Number=SeqID_64465
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQPVTSVQELVAQRTFEKPPCKA

SEQ ID NO: 156151 - protein, 313 aa, Glycine max
  Coding DNA Sequence Number=SeqID_64466
  Gene Ontology: Mol. function=transporter activity; Cellular component= integral to membrane; Biological process=transport
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDAGLAFIKLKDWSERTTPESQIGAIIQRGMALNMIVKDASYIMPLQLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 156152 - protein, 163 aa, Glycine max
  Coding DNA Sequence Number=SeqID_64467
VFCLCSALLGCDSLCCLNVVLLGCCGSLGGLMGTRGWWVYARIVDVENLLCTIARPPPSTTCDGVKLPAFIVDHRVVPGDMSRGSGDLGDVRRAPGSQQIKGTKTTKQGGLWWLASCEFCMICGLWPLVIDYQGWEAKGASGNRLPACVIDYTEEWVTGNRLP

SEQ ID NO: 156153 - protein, 121 aa, Glycine max
  Coding DNA Sequence Number=SeqID_64468
MRKCGRSGTWRYVAGVRRPWGRQVGCYCPKPSLTNPDPTRASSWQSTDKRTKTTKQGGLCGGWPAVNFECYMGYGLWLKSEDRQAKMASGNRLPRGVFDYQALKNEIRKLRGLLVIDYQGV

SEQ ID NO: 156154 - protein, 30 aa, Glycine max
  Coding DNA Sequence Number=SeqID_64469
MFPHGKMSMKGVFRPYPTLTYPTPLIHMAF

SEQ ID NO: 156155 - protein, 45 aa, Glycine max
  Coding DNA Sequence Number=SeqID_64470
MAKSDRSPVNSDVGRTILCLEARAIKDVAAWAGSPWATFWSGDKT

SEQ ID NO: 156156 - protein, 81 aa, Glycine max
  Coding DNA Sequence Number=SeqID_64471
MDFQNLTSQSPPLKTMIMRARFIEPKYKVLLHLPLVIVKKQKGKGIMQSTPARSIGKTPSRLGQRSKGSVPRVLLAQVNGE

SEQ ID NO: 156157 - protein, 312 aa, Glycine max
  Coding DNA Sequence Number=SeqID_64472
MAKFDPEIVLEFYANAWPTEEGVRDMRSWVRGQWIPFDADAIGQLLGYPLVLEEGQECEYGLRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGLCQSFGVPVAPTKVIRPPITRAFIEKYCTQRQGQGDAPQAAGAPPTTSSGGPGWGIRYGAVFTAFGSPVGSHPRAHVRTHDCLYQMSLSMQSQGFAPFSCPTPDQFRAEVAWPGDWPEAQAGETPPEAPGDGEEAHEDEEMADLLDFLGGSGDT

SEQ ID NO: 156158 - protein, 87 aa, Glycine max
  Coding DNA Sequence Number=SeqID_64473
  Subcellular localization annotation: CTP_CleavageSite=51; ConfidenceScore=5.16e-01
MFLIFFLWGPSAFPVAVSTSTTVLSAPGGLVDKDRRREALGVRFTADVEADASEVGGGGGEGGGGGGVEAEKKEGNKQQFEGCTFRN

SEQ ID NO: 156159 - protein, 171 aa, Glycine max
  Coding DNA Sequence Number=SeqID_64474
MSMLTLATMINVITIMGACQYYIDSDDEHVHNHGGLSYMHNDIIGMCTSTKGTQCCCKGVKDVLHGFGGCRGVVVVVFEVRHFGAGDRVERKTITGKETWWLGMLEKGGLLYMVLIPTIKGPMVEKRIHGGAKGTSVIVDGGCGMVVIVGDKLCMVGGMGLPFAVVAVAGE

SEQ ID NO: 156160 - protein, 93 aa, Glycine max
  Coding DNA Sequence Number=SeqID_64475
MAPRKLASKRSRKDKAAEGTSSAPEYDSHRFRSAEHQQRFEAIKGWSFLRERCVQLRDDEYTDLGSAFLALLILSKLLRKIVSVKKIQAEALP

SEQ ID NO: 156161 - protein, 85 aa, Glycine max
  Coding DNA Sequence Number=SeqID_64476
TVFLHGVEGRSPEYEEPRDLRSNPFQGGGDDAILPPKASSSSFLSKAILGGEAPSSLAYSLVDASIEAPQASFHQVVIRAQELQA

SEQ ID NO: 156162 - protein, 57 aa, Glycine max
  Coding DNA Sequence Number=SeqID_64477
MGNYIIITFILICPNGERSQDLMQSYPLRVLDRRVQENWARAAKKGLGVLMNPRVDF

SEQ ID NO: 156163 - protein, 65 aa, Glycine max
  Coding DNA Sequence Number=SeqID_64478
MVWALERFQGLFLRRDAFLGVIVTDRDLALMNAVKTVFPECTNLWCWFYINKNVKAKWLNMLIGL

SEQ ID NO: 156164 - protein, 68 aa, Glycine max
  Coding DNA Sequence Number=SeqID_64479
MVSGNRLPRECNRLPSLKTRFHVLKLYNSSLASGNRLPRLCNRLPEMKSLKIPLLLACSGYETHCVAA

SEQ ID NO: 156165 - protein, 83 aa, Glycine max
  Coding DNA Sequence Number=SeqID_64480
  Subcellular localization annotation: CTP_CleavageSite=44; ConfidenceScore=5.27e-01
MATQLNQVQSKNSDRLPSQTMQNPKNVSAITLRSGKQIEVSPPVAAPAPEPVKLHSIPEKEDEPTAQKRKLHDHEGANKNFHC

SEQ ID NO: 156166 - protein, 52 aa, Glycine max
  Coding DNA Sequence Number=SeqID_64481
MASAITWATWTLIRVRMAYTNWNLAVRAKPCPGVHNSWAMASSSNPSALFLL

SEQ ID NO: 156167 - protein, 223 aa, Glycine max
  Coding DNA Sequence Number=SeqID_64482
MDNEEGVQEQMKADLLALKDQLASITEAMLKLQKTIENNATAAASNTTREVEPVLQPAINLGRDKNATGFNRRYSPQAYPYGLPPDFTPRTAPDDLSQAPTFERQLPPHADYPLQENDEGDAHLGPLLPLKDPVPHEFPQPNIVCHVSSPSAPVKELVPFAKDKGKIDLLEERLRAVEGLGNYPFSDLACVWDDMSKRSSSDVLPKDGGIFYGRKVVNALLSR

SEQ ID NO: 156168 - protein, 28 aa, Glycine max
  Coding DNA Sequence Number=SeqID_64483
MAILIADTSTTFHRDERPGNIGKCKDHA

SEQ ID NO: 156169 - protein, 71 aa, Glycine max
  Coding DNA Sequence Number=SeqID_64484
MFWLRVKQFTFPVDFVVMDIEEDTEIPLILGRPFMLTANCRNLPFGGRATRDSRDACSTKGIRAESPPTFI

SEQ ID NO: 156170 - protein, 54 aa, Glycine max
  Coding DNA Sequence Number=SeqID_64485
AHLGGEAPSSMAYSLVDGASSYLFYFVFRCISMVLREGAQNMKEPWDLRANPFP

SEQ ID NO: 156171 - protein, 102 aa, Glycine max
  Coding DNA Sequence Number=SeqID_64486
MESRMTKVEEDVSYIRLVFWLYYYEVVIIKKGEIVEAKLHDESTMIQSSKDQRTTHVNQEQVKSSRIKKNSRLKKKVYNQESRFKIQDLKNQDQDSRLKIQE

SEQ ID NO: 156172 - protein, 153 aa, Glycine max
  Coding DNA Sequence Number=SeqID_64487
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MQKLQAKVRLSCMQRLLQEQCQTPFANLISGLNSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 156173 - protein, 135 aa, Glycine max
  Coding DNA Sequence Number=SeqID_64488
  Gene Ontology: Mol. function=protein dimerization activity
  Homolog annotation: Hit_ID=A5BUJ2; Match level="QueryCoverage=54%, HitCoverage=18%, E-value=2e-12, Identity=39%"; Hit description =Putative uncharacterized protein
  Pfam annotation: Domain name=hATC; Domain location=44-93; Score=13.2; E_value=0.0014; Accession=PF05699.5; Description=hAT family dimerisation domain
MNKDFFGSNVGDVTGSEVVGDALSEYDRFIIRKKKARSSYVKSELDHYLEEEVLPRAIDFDILMWWKFNGVNPYRSRLQWTTLEALMCTRSWLWSAENTGSMSYKVVAECATIMNEMVSDDEGGMMGAGVTNLEE

SEQ ID NO: 156174 - protein, 212 aa, Glycine max
  Coding DNA Sequence Number=SeqID_64489
  Homolog annotation: Hit_ID=Q2AA09; Match level="QueryCoverage=74%, HitCoverage=50%, E-value=7e-07, Identity=29%"; Hit description =Retrotransposon gag protein
MERSMIDAASGGALGDMTPAEARNLIEKMASNSQQFSAMNDAIVIRGVHEVATNSAASSETKKLEGKIDALVNLVTQLALNKKFVPVARVCGLCTSADHHTDLCPSMQQPGAIEQPKAYAANIYNRPPQPHQQNQPQQNNYDLSSNRYNPGWRNHPNLRWSSPQQQQQQPAPSFQNAAGPSRPYIPPPIQQQQQPQKQPTVEAAPQPSLEEL

SEQ ID NO: 156175 - protein, 97 aa, Glycine max
  Coding DNA Sequence Number=SeqID_64490
MASRKRKSTASRPASYRNILQEINVKIYHTKFDEFKVELERRNLHKRLTNLQDGSIDMVMVKEFYANLYTSEDQAPKQARVRGHLIKIDADNLNEFL

SEQ ID NO: 156176 - protein, 168 aa, Glycine max
  Coding DNA Sequence Number=SeqID_64491
  Subcellular localization annotation: CTP_CleavageSite=69; ConfidenceScore=5.13e-01
MTIQNMQFQQETRASIQSLKNQMGQMATQLNQAQSQNSDKLPSQIVQNPKNMSAITLRSGNQIQVPPLVAALAPEPVKLHSAPEKKDEIVAQKRKLPDHEGANKNFHAGGPSSSNSDLQHPPIPLPFPPREIPNKKMEEAENEILETFWKVEVNIPLLDAIKADSKIC

SEQ ID NO: 156177 - protein, 42 aa, Glycine max
  Coding DNA Sequence Number=SeqID_64492
VYVCLNAVLVEFSLTRGICECGLIRTRLGYHEESGLAVQETT

SEQ ID NO: 156178 - protein, 224 aa, Glycine max
  Coding DNA Sequence Number=SeqID_64493
MGDQEETQEQMKADMSALKEQMASIMEAMLGMRQLMEKNAATAAAVSSVAEADPTLLATAHHPPSNIVGRGRDTLGHNGSPHLGYNRAAYPYGLPPNYSPPVLQDDAGHIASPVLEREPPQQPEEVHKDPQDYAQRDVEFYPPIPEGPTPSTLPQPNITTQPIVLSMEGPPPATEERRKLDLLEGEIESRGRIWGLSVRRHDGSLLSTRCCYPPKVQSTGLRQV

SEQ ID NO: 156179 - protein, 41 aa, Glycine max
  Coding DNA Sequence Number=SeqID_64494
MAMRRRDMSKGKKEDECRGWSDVVKHGGVEGFGKGDGEPLG

SEQ ID NO: 156180 - protein, 103 aa, Glycine max
  Coding DNA Sequence Number=SeqID_64495
MYLSTIDASRRYRFFVYPFKIFMYHSTGSSKLDRINDFATYGMEDKAPVSLWNRHPTKTLTKSDAILPRKGPVTRAMSKRLQVDWARAAEEGPRVLVNLRVDF

SEQ ID NO: 156181 - protein, 121 aa, Glycine max
  Coding DNA Sequence Number=SeqID_64496
FSSVGPIELLCIIGRTPVGILNILEATMTPTHDALLYYNGGWNMPRQNEFVGYSFTRKNPKKFDIPSGCIMDELEDLIKQVAPHGFPLMVFMKHKRYDDCFFNNQVTMSIQIKISNSKLLN

SEQ ID NO: 156182 - protein, 72 aa, Glycine max
  Coding DNA Sequence Number=SeqID_64497
MTQQTFTKGVEGRSPEYEEPQDLRSNPFQGGGNDAILPSQGHWIKTPSRLRRDPREGPRVLMSLRVYFEPMG

SEQ ID NO: 156183 - protein, 243 aa, Glycine max
  Coding DNA Sequence Number=SeqID_64498
  Subcellular localization annotation: CTP_CleavageSite=35; ConfidenceScore=5.12e-01
MDMNIGGLMSRQMTMIAQSNFSRLGFPALITAFCRSRGVGSDALTSYENLRPAIDLAYIIRNCWNANDQTVNFPETKKTKLREADIPHSFTPIAGIYASSTSTRPPALADLSAQSSQTSDAKFQSLFEGQAPQQHEPEPENDHSSEATISGAVDCKKRKLETRSNEAAHHRPVLASADAPFPGVDPSSPQHAADSSISILEILEGQTIPVLPLDTSPPVTPVWHLTDEKNVQIQDNQDQSQEF

SEQ ID NO: 156184 - protein, 84 aa, Glycine max
  Coding DNA Sequence Number=SeqID_64499
MFRHGKMSMKGVFRLYPTLNIPNTSVEGRSLEYEEPRDLRSNPFQGGGDDAILPPRVLDRRLQEDWARATKEGLGVLMNPRVDF

SEQ ID NO: 156185 - protein, 186 aa, Glycine max
  Coding DNA Sequence Number=SeqID_64500
MERSMINAANGGALGDMTPAEARNLIEKMASNSQQFSARNDAIVLRGVHEVATDSSSFTENKKFEGKLDALVNLVTQFAMNQKSAPVARVCGLCSSADHHTDLYPFLQQSGVNEQPEAYAAKIYNRPPQQQNQQQQNNYDLSSNRYNPGWRNHLNLRWTSPPQQQQPVPPFQNVAGPSKPYVPPPM

SEQ ID NO: 156186 - protein, 88 aa, Glycine max
  Coding DNA Sequence Number=SeqID_64501
  Subcellular localization annotation: CTP_CleavageSite=44; ConfidenceScore=5.43e-01
MATQLNQAQSQNSDKLPSQTVQNPKNVSAITLRSGNQIQVPPPVAAPAPEHVKLYSTTDKEDEIVAQKRKFPNKNFHAGGPSSSNSYL

SEQ ID NO: 156187 - protein, 20 aa, Glycine max
  Coding DNA Sequence Number=SeqID_64502
MATIGLSLPLFWARKASIAA

SEQ ID NO: 156188 - protein, 77 aa, Glycine max
  Coding DNA Sequence Number=SeqID_64503
MAGTNPNDGGGLSQFQMQALMQHLERLDQMENRDHNEEERRRRGNDGVPRQNRIDGIKLNIPPFKGKNDPEAYLEWR

SEQ ID NO: 156189 - protein, 70 aa, Glycine max
  Coding DNA Sequence Number=SeqID_64504
MWHKPSFFIVVATYPSAGGRRVTRGMRVPRKEYARSRHQHLFEENVGKTGKDAIYELLSERFGSCIYARG

SEQ ID NO: 156190 - protein, 95 aa, Glycine max
  Coding DNA Sequence Number=SeqID_64505
MELFRRNRGSTFLSTRSVCLVEFVLTDGEVGGWPSHGQCGSTGIKSSSLIKLLMGEWIQNPNEVKKEAANFFLNRFSEQQLCRPTLDGVHFSSLN

SEQ ID NO: 156191 - protein, 123 aa, Glycine max
  Coding DNA Sequence Number=SeqID_64506
KGRSELWSLGRIMLSSNVIHICVRVVMLVRMIRTPSPCGIQAKLMQSDPPRVLDRRIQEDWARATKEGPRVLMNLGWISEPMGQALASHLKEVNLAISELLKEVFSKKLLKEVFSRKLLKEAT

SEQ ID NO: 156192 - protein, 109 aa, Glycine max
  Coding DNA Sequence Number=SeqID_64507
MKSWVCDIYPCIELANGQTKYAKYSDSKSIQMPKLRRILVSCRSPVADDESDEQNDGDNDEVYFVEAFGKRRHCEAPFGGGDSDCGAKVRRQASGDGDIGKHGPKVTRR

SEQ ID NO: 156193 - protein, 176 aa, Glycine max
  Coding DNA Sequence Number=SeqID_64508
MRDDKRSSYVIGIGVNSGVGLGGKFLIALELAPKWALPAGRVGVGARAWGTSFWMGAGALGCTGAELEESPARAEKLGCSDPPSIGTCLGDVIELPSLQTYLDSLPDEYQVREAGGHIAYQLLIVPPPLRVLFKGLTFLFNHVLQLSVIGSHIGIVLILPKEGSNRILPSTDAGSF

SEQ ID NO: 156194 - protein, 201 aa, Glycine max
  Coding DNA Sequence Number=SeqID_64509
  Homolog annotation: Hit_ID=Q2AA09; Match level="QueryCoverage=78%, HitCoverage=50%, E-value=3e-07, Identity=29%"; Hit description =Retrotransposon gag protein
MERSMIDAASGGALGDMTPAEARNLIEKMASNSQQFSARNDAIVIRGVHEVATNPSASSETKKLEGKLDALVNLVTQLALNQKSVPVARVCGLCSSADHHTDLCPSMQQPGAIEQPEAYAANIYNRPPQPQQQNQLQQNNYDLSSNRYNPRWRNHPNLRWSSPQQQQHQPAPSFQNAAGPSRPYIPPPIQQQQQPQKKPTG

SEQ ID NO: 156195 - protein, 127 aa, Glycine max
  Coding DNA Sequence Number=SeqID_64510
  Gene Ontology: Mol. function=transporter activity; Cellular component= integral to membrane; Biological process=transport
  Homolog annotation: Hit_ID=Q5XXT6; Match level="QueryCoverage=24%, HitCoverage=18%, E-value=7e-09, Identity=87%"; Hit description =Putative aquaporin PIP-type
MAKLGMTMYASIWIFWVGPFVGALVAVAYHQFILRAVAIKALGDQSPLLIVEVIKQEKVKEYEKVEPAKSAFATKAKVRRAIEAEGIPSLMCQATSLLVTSYPTCHSLEPQLPLETELYPRRWKPQR

SEQ ID NO: 156196 - protein, 158 aa, Glycine max
  Coding DNA Sequence Number=SeqID_64511
MMHEDGGLWYEMIKAMGGNILEGCVGGGWFDDNMVSCVGDVGEIVFWKHRWVGEERLMTRWFTWEGGDVIAIRTRKSTITGPNVLVKSPKDGRIMSTRLCPLVNGAVRTICYNCQWGISEKAPKAQLEVEARIIGPLLGCIGVHSTTTTTRIMTFYVG

SEQ ID NO: 156197 - protein, 117 aa, Glycine max
  Coding DNA Sequence Number=SeqID_64512
  Homolog annotation: Hit_ID=A7P060; Match level="QueryCoverage=36%, HitCoverage=35%, E-value=7e-07, Identity=57%"; Hit description =Chromosome chr6 scaffold_3, whole genome shotgun sequence
MEEQFILRVPPNVAERIERLLNENNASSSEDKQYLKFFVKHDHCFRPLRPPLNATLFMQASMDFTCKVDSTISASLSCHSSSLHTPLGVKASSPINFLDDHHLFSNMDPNINIEEGE

SEQ ID NO: 156198 - protein, 88 aa, Glycine max
  Coding DNA Sequence Number=SeqID_64513
MVVLVREEEGSTDDASRVLKWNWKEVPAAQKDLIWEDIQAEFEIHEASDSRTKKKVLQTVGERWRQFKFDLTRKWALAANKDGVDDTL

SEQ ID NO: 156199 - protein, 132 aa, Glycine max
  Coding DNA Sequence Number=SeqID_64514
MRKPDLMANKNKMNNIKSKFRKGLWSLDEDERLVKVIRMTTPPPSPTQAEIPSDGTSRKTRQATRLRRLTTRTLDQARATISVNPATGRGFGPHKDQFHSYLRVVARDKIPIVHPSWNDVPETLKSMIWDDI

SEQ ID NO: 156200 - protein, 145 aa, Glycine max
  Coding DNA Sequence Number=SeqID_64515
MSLGNKILYFSMARIVVADLRDVNVISTTVKENCRRHSTILRRAARQPHLRTYEKLRRSWGQHRCRPNRVLRRLSAMDRRRMVYNSKTAAGQPRRRTNERLRRSWGQHRRRDNRVLRRLSPEDRRRMVLILVRSSVTDDHRKRGS

SEQ ID NO: 156201 - protein, 56 aa, Glycine max
  Coding DNA Sequence Number=SeqID_64516
MSEIEEMQEQMKDDMEAMKEQMTTMMEAMMSMRKMMEVGYPRNIGFFSPCILGHLD

SEQ ID NO: 156202 - protein, 303 aa, Glycine max
  Coding DNA Sequence Number=SeqID_64517
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q4VCL9; Match level="QueryCoverage=22%, HitCoverage=7%, E-value=2e-22, Identity=85%"; Hit description=Plasma membrane H+ ATPase
  Pfam annotation: Domain name=E1-E2_ATPase; Domain location=66-280; Score=-77.4; E_value=0.00017; Accession=PF00122.11; Description=E1 -E2 ATPase
  Subcellular localization annotation: CTP_CleavageSite=59; ConfidenceScore=5.39e-01
MDLGNVFLSNLLKRAGVQFAQKDQVVQPNNPTSQPSRTTNVPNREQASPRHEAIAQPVESQAVPEFLLLIQNMKIGSLYTYRDQQEKIGRWTEQDAAILVPRDIISIKLRDIIHADARLLEGDALSVDQSSLTGESLPVTKNLSEEVFSGSTVKKVGIIIEPMWLMADGGSWRKVAVLGRLLRSRRRRSRHGSSLLAAVCSGSRAAGSEAGCRGRGWFRGRAVLKLRGLQQRSESPTPTADKKKNSAIFRLPATSAMAAMAMAAAMAPPSLTRHATAIRWRFFRKPLRNSAMAPPWPPFNNTD

SEQ ID NO: 156203 - protein, 175 aa, Glycine max
  Coding DNA Sequence Number=SeqID_64518
  Subcellular localization annotation: CTP_CleavageSite=29; ConfidenceScore=5.66e-01
MAESSKKRKGSSTSVAAHRTSRSGVTRVSSAPIPPSLSSFTLFSSDEQCIRYSFLFQSRQILDPKYLDLEFFDGETFDCYQDGTLIYEVHGIPMIIDESLFFSLTQLPSQGAPFEGTLVDDWKFDYYSHDARHMALRSAAPLPYPQLVTLFLRHFEIPLDSEPFVLVKCSFAIGA

SEQ ID NO: 156204 - protein, 129 aa, Glycine max
  Coding DNA Sequence Number=SeqID_64519
  Pfam annotation: Domain name=DUF784; Domain location=23-123; Score= -38.7; E_value=0.038; Accession=PF05617.2; Description=Arabidopsis thaliana protein of unknown function (DUF784)
MATFSNISQMFLCFMISSTLMVKIGLSQDAPEPSNAPGPLSSNEKYLTNCGSHLYPNCGDEVFSAIFFGNKTVSEYCCDKLVNDVGKMCHDDMTKYILTLPKFRAHETQILKRSQTYVPSYIAYASVDV

SEQ ID NO: 156205 - protein, 93 aa, Glycine max
  Coding DNA Sequence Number=SeqID_64520
MRDWGSLVIDLATMKIMIFQGSSFGHVELQSHKASLASMLCLHEMEGFEGSRGIIKNLPSRNKSTLILGHHIKEDLFEPISYGFVDELEQDVA

SEQ ID NO: 156206 - protein, 140 aa, Glycine max
  Coding DNA Sequence Number=SeqID_64521
  Gene Ontology: Mol. function=transferase activity
  Homolog annotation: Hit_ID=A5BLF4; Match level="QueryCoverage=32%, HitCoverage=34%, E-value=9e-12, Identity=76%"; Hit description =Putative uncharacterized protein
MSAPAILIPILVATADADAIVSGGVPKGLPVGIDSVGDLGELVQHGVLAAAFGAGTAVVGGGRGEAAIGGLRWEREKQGRPLCGERNGKLLASGRERVKDKKVVIEHISIELMIFDPLTKGMPLFKFKDHVEKMILGSTL

SEQ ID NO: 156207 - protein, 130 aa, Glycine max
  Coding DNA Sequence Number=SeqID_64522
  Gene Ontology: Mol. function=nucleoside-triphosphatase activity; Cellular component=integral to membrane; Biological process=transport
  Homolog annotation: Hit_ID=A7P5L1; Match level="QueryCoverage=90%, HitCoverage=22%, E-value=8e-21, Identity=57%"; Hit description =Chromosome chr4 scaffold_6, whole genome shotgun sequence
MEKSLLIVEEANLSSRSFSGRVSDDKANRSGRKGMVLPFQPLSLTFDEIKYSLDMPHEMKKQGVFEERRELLKGVSGVFRPRVLTALMGAIQGVPKIKEGYNPATWMLEVTSAGIEASLKVNFTNVYRNS

SEQ ID NO: 156208 - protein, 113 aa, Glycine max
  Coding DNA Sequence Number=SeqID_64523
  Gene Ontology: Mol. function=threonine endopeptidase activity; Cellular component=proteasome core complex; Biological process =ubiquitin-dependent protein catabolic process
  Homolog annotation: Hit_ID=Q9XI05; Match level="QueryCoverage=53%, HitCoverage=29%, E-value=2e-26, Identity=95%"; Hit description =Proteasome subunit beta type-3-A
MQDYSSPKLNNLELAKDFVVSGTASESLYGACEAMFKPDMEPEELFETISQALLSSVDRDCLSGWGGHVYVVLIFRFLDAAVVNFPSEYLYKPLARPEVLTFASIKNNFHNKA

SEQ ID NO: 156209 - protein, 202 aa, Glycine max
  Coding DNA Sequence Number=SeqID_64524
  Homolog annotation: Hit_ID=Q2HW90; Match level="QueryCoverage=33%, HitCoverage=13%, E-value=3e-07, Identity=42%"; Hit description =Putative uncharacterized protein
  Subcellular localization annotation: CTP_CleavageSite=63; ConfidenceScore=5.49e-01
MGVQIATRPTWAFQDAPPKGGYFWRKQPSLPGRAGKSKPRRFRNVSVGDFAKIFNRSSTFFVCSSSFFGLQPQVENGVVGIPRKCLEAKARILASKGEWALFIDILALLIFGGVLFPNVDGLVDLAAIDAFLAYHDHKESPVVAMLADLYDTFERRCEKSSTRIVCSTPALYVWLVSHLFCQEVRHATVHAQRKEGQIGTNS

SEQ ID NO: 156210 - protein, 165 aa, Glycine max
  Coding DNA Sequence Number=SeqID_64525
MFDRSAAEAFEASEILESTRNKEIYRKPNGDEHQRMRRDAILAMQQKSGAKPSVFNRISEGPPLVFDPPTDDMRCHIKPLHLTAMVEAQIINKILVDWGGGGGYIQYPAKVYATKGMNPWSWNKDGKFEMVKADQSSYGIYDAFAREGGQEMARTAPVEIEIHSM

SEQ ID NO: 156211 - protein, 102 aa, Glycine max
  Coding DNA Sequence Number=SeqID_64526
  Subcellular localization annotation: CTP_CleavageSite=38; ConfidenceScore=5.63e-01
MATPPSSRRRRCPPPSGAASQSPSTLKRTRKATQLRSLATRLAGTETPLVHVDPATGRPTVDVTYENWKQVPTARKDLIWKDIQVEFDIPEASDVRTKKKTL

SEQ ID NO: 156212 - protein, 290 aa, Glycine max
  Coding DNA Sequence Number=SeqID_64527
MSSRKSSQRDHLVVVPLVVSKTLEMFQLLVIKARNTYSNVQVQVGRVGKYVRRKKHPLSVEPNDNEITSSKPSKDCWDDLFVVNKGEGGDQFKSNFELYWSSTHYNKLVNFNGKQEEELSTKKLASTNSIVELVNEKGDAITCKLLLQTVDEDWKSVLEVLMGKSKNKPMSIAPLYTENRGDKKKLLNKSKASDRGKGLAMEIHSKASHDIPHPPSSKRKKEYLTHITLEYKSILVLKQSLGNVNLLKLIKGKDAALKEEIDDGFINTLEANSDDRTARASKANVDLEGS

SEQ ID NO: 156213 - protein, 255 aa, Glycine max
  Coding DNA Sequence Number=SeqID_64528
  Gene Ontology: Mol. function=nucleoside-triphosphatase activity; Cellular component=intrinsic to membrane; Biological process=innate immune response
  Homolog annotation: Hit_ID=Q3IA99; Match level="QueryCoverage=34%, HitCoverage=11%, E-value=1e-28, Identity=70%"; Hit description =Disease resistance protein
  Pfam annotation: Domain name=TIR; Domain location=3-102; Score=39.3; E_value=1.1e-08; Accession=PF01582.11; Description=TIR domain
MHLYYMNPIEHESNIDSIEESMIYVLVFSENYASSTWCLDELTKILDCKKRYGRVVIPVFYKVDPSIVRNQRETYAEVFVKHEHQFEDKIDKVHAWKAAQTKACVSNSINPASCVLVPVGVKTTSTKSLSTSINPSLKRPQQQNEPHLQNFVVPGKPRSKRKRLSEPRTNKDPLSIWSHHLNPQIEALCSDPPLLKQAYWLVDSELIMPKPKDNKEQKEEVVIMTKKDEEKVIINVSKEISFGDSELDECSNGQH

SEQ ID NO: 156214 - protein, 293 aa, Glycine max
  Coding DNA Sequence Number=SeqID_64529
MRAQAQFPNTTPPFPTRDIYGSVHRPRECTVDYELVVAMDEINFVTDSDEKKHSPKDANDVLTEKDQASEKVEVPTDGNSMLKKEGDNKKEILISPLPTNISLHLADRSVVYPRRAIKDVLVKVRLGRLTLRLGDEKGAFPSVGTPNPFERILTNEDLDWELNLKVEEILSLHHSHHSPKSSNFERLEYDYGTKTKPSVEEPLELDLKPLLSNLKYVLRDNKEVFGWSIHDIRLNPNMMEVVKGKVSPVQCVPKKGGTTNVAPYGACRPWVFFINGVICFLKINGGGMETEER

SEQ ID NO: 156215 - protein, 156 aa, Glycine max
  Coding DNA Sequence Number=SeqID_64530
  Gene Ontology: Mol. function=microtubule motor activity; Cellular component=microtubule associated complex; Biological process =microtubule-based movement
  Homolog annotation: Hit_ID=A5ATT1; Match level="QueryCoverage=47%, HitCoverage=67%, E-value=6e-18, Identity=62%"; Hit description =Putative uncharacterized protein
MSETEMLGIKDRGQGEQKSPGIIPLAVKDVFSIIQETPGREFLLRVSYLEIYNEIGISALVGFSGEVVLGKIKNVLCKALKREKGLPATMSERENKEVLDKAHSALILSLGDKVLREVSKEKSTVVIWNKLENLYKTKSLANKLYNNNNNNNALSH

SEQ ID NO: 156216 - protein, 77 aa, Glycine max
  Coding DNA Sequence Number=SeqID_64531
MGRLGVHNKTHHKMSMSVRVTLFCKNAPTMWDRHRLKRALKPGVFTPKAYTPNSPLEPLPPNSGPTPKTIFAYRHCS

SEQ ID NO: 156217 - protein, 321 aa, Glycine max
  Coding DNA Sequence Number=SeqID_64532
  Gene Ontology: Mol. function=hydrolase activity, acting on glycosyl bonds; Cellular component=extracellular region; Biological process =cell wall organization and biogenesis
  Homolog annotation: Hit_ID=A7Q0T9; Match level="QueryCoverage=64%, HitCoverage=44%, E-value=1e-95, Identity=76%"; Hit description =Chromosome chr7 scaffold_42, whole genome shotgun sequence
  Pfam annotation: Domain name=Glyco_hydro_28; Domain location=7-303; Score=65.2; E_value=2.3e-16; Accession=PF00295.8; Description =Glycosyl hydrolases family 28
MAWDSACQSESAVNVIIVPQDFSFLVQSTIFTGPCQGVLELKVDGTLMPPDGPESWPKNNSRHQWLVFYRINGMSLEGSSLIDGRGEKWWDLPCKPHKGPHGTTLPGACDSPIAIRFFMSSNLTVQGLGIKNSPWFHFKFDGCKNVHIESIYITTPKLSPNTDGIHIENTNDVKIYSSVISNGDDCVSIGSGCNDADIKNITCGPGHGIRQPIIICFQEKLYSPHLLHQKALMADMMALLLGSPGSGKTTLILARAGKLESNLKGTLNKESQVDRVRKGLTNINIEGSSQNSHHESASVGHLYAGHLLGPDAAGERVVIDE

SEQ ID NO: 156218 - protein, 420 aa, Glycine max
  Coding DNA Sequence Number=SeqID_64533
  Gene Ontology: Mol. function=aspartic-type endopeptidase activity; Cellular component=cellulose and pectin-containing cell wall; Biological process=proteolysis
  Homolog annotation: Hit_ID=Q8W4C5; Match level="QueryCoverage=95%, HitCoverage=87%, E-value=1e-135, Identity=56%"; Hit description =Nucellin-like protein
  Pfam annotation: Domain name=Asp; Domain location=63-413; Score= -137.6; E_value=1.8e-05; Accession=PF00026.14; Description=Eukaryotic aspartyl protease
  Subcellular localization annotation: CTP_CleavageSite=47; ConfidenceScore=5.17e-01
MDVKMKGITALHTLLQFLLFSAIFPLSFSAQPRNAKKLSSDNHHRLSSSAVFKVQGNVYPLGHYTVSLNIGYPPKLYDLDIDSGSDLTWVQCDAPCKGCTKPRDQLYKPNHNLVQCVDQLCSEVQLSMEYTCASPDDQCDYEVEYADHGSSLGVLVRDYIPFQFTNGSVVRPRVAFGCGYDQKYSGSNSPPATSGVLGLGNGRASILSQLHSLGLIHNVVGHCLSARGGGFLFFGDDFIPSSGIVWTSMLPSSSEKHYSSGPAELVFNGKATVVKGLELIFDSGSSYTYFNSQAYQAVVDLVTQDLKGKQLKRATDDPSLPICWKGAKSFKSLSDVKKYFKPLALSFTKTKILQMHLPPEAYLIITKHGNVCLGILDGTEVGLENLNIIGDISLQDKMVIYDNEKQQIGWVSSNCDRLPK

SEQ ID NO: 156219 - protein, 112 aa, Glycine max
  Coding DNA Sequence Number=SeqID_64534
MDVILARSGAKLEADTMCLRGVKQETRLVIEEGRGTSPGREGDDGMWVGSAMGERWNKAEMLWRWPKRDISVQLDGKAQLGERHNEGGVVSSHRAHLFKPLDAQDYVSAAKG

SEQ ID NO: 156220 - protein, 115 aa, Glycine max
  Coding DNA Sequence Number=SeqID_64535
MRTKDLYPLDMDVILKEKLSLGTWKSIAVLLKWIHPKLLLLVPGNANAVAAAALENKDLPFLVAELGSNSHQSNNNNNSDGDDRQFYPLLPFNHSSLKDKSWTIKKMNREMGASV

SEQ ID NO: 156221 - protein, 496 aa, Glycine max
  Coding DNA Sequence Number=SeqID_64536
  Gene Ontology: Mol. function=protein disulfide isomerase activity; Cellular component=endoplasmic reticulum lumen; Biological process =cell redox homeostasis
  Homolog annotation: Hit_ID=P29828; Match level="QueryCoverage=94%, HitCoverage=92%, E-value=0.0, Identity=61%"; Hit description=Protein disulfide-isomerase precursor
  Pfam annotation: Domain name=AhpC-TSA; Domain location=26-124; Score=- 19.8; E_value=0.047; Accession=PF00578.12; Description=AhpCTSA family
  Pfam annotation: Domain name=ERp29_N; Domain location=35-144; Score= -38.0; E_value=0.015; Accession=PF07912.4; Description=ERp29, N -terminal domain
  Pfam annotation: Domain name=Thioredoxin; Domain location=33-141; Score=169.3; E_value=1e-47; Accession=PF00085.11; Description =Thioredoxin
  Pfam annotation: Domain name=Thioredoxin; Domain location=377-482; Score=156.2; E_value=9e-44; Accession=PF00085.11; Description =Thioredoxin
  Pfam module annotation: Pfam domain module=AhpC-TSA::ERp29 _N::Thioredoxin::Thioredoxin; Domain location=26-124::35-144::33 -141::377-482
MAHHNNNRVSIWFLFVSSLLSLFAQISSAEKEFVLTLDRSNFSDIVTKHNFVVVEFYAPWCGHCMKLAPEYEKAASILSSNDPPVILAKVDANEEKNRELARQFQVQGFPTIKILRNGGKVVQDYKGPREADDIVDYLKKQSGPATAEIKSADDASALIGKNKVVIVGVFPKFSGEEYENFNALAEKLRSEYDFGHTLDAKYLPRGESSVTGPVVRLFKPFDELFVDSHDFHMEALEKFVAESSVPVVTVFNNDPSNHPFVVKFFDNPNVKAMMFVNFTADNADSLKLKFRESAEQYRQQGVSFLVGDLEASQGAFQYFGLKENQVPLMIIQHNDGKKFLKTNVEPDHIATWLKAYKDGSVEPFKKSEPIPEVNNEPVKVVVADNLQDIVFNSGKNVLLEIYAPWCGHCKKLAPILEEVAVSYQSNPDVIIAKLDATANDIPRETFEVQGYPTVYFRSASGKISQYDGSRTKEDIIDFIEKNRDKADQQESVKDEL

SEQ ID NO: 156222 - protein, 379 aa, Glycine max
  Coding DNA Sequence Number=SeqID_64537
  Homolog annotation: Hit_ID=A5B5G7; Match level="QueryCoverage=60%, HitCoverage=16%, E-value=1e-07, Identity=22%"; Hit description =Putative uncharacterized protein
MPCLASCVAWVKFQEVVGLLLVAKRMASRKRKATTSRPQEPYDTTRFTYEGDWERYSQNIHSQNVLPERNVNLFITEYDEFRQELIRRNWHKALTQHMDGHIDVALVKEFYLNLYDPEDKLPKQVRVRGKLIKYDVASLNAFLETPPVLQPGEQYTSYSIFCRSHPNPQELASKLCILGCGFVLNAKRAPWKLLRKDLTTLAQTWSVFSYSKLAPTSHTSDLNMDKARLVYGLIMRMDMDVGSLISGQISHMSQSNSSRLGFPALITALCISRGVVAWTRVQPSSLGGGEASVAQEPQPEPQPQSEATPETTPQVSPATTPVVEVSEDVEGAKDTDYTTDLEAAQSTWDPWPTAAQETPQPAQDTPSSPHGEQTPSQDD

SEQ ID NO: 156223 - protein, 176 aa, Glycine max
  Coding DNA Sequence Number=SeqID_64538
MSVEEFLEQVALPGDAILPPRVLDRRLQEAWARATKEGPRVLMNLRDLIEAQRSSLHRSPTSKLPSLGVQPSPSGGGGTSTDHEPVPAEEPLPDAEDELVPPKPFIFETDPVTQEEAAAQDPTYLVHISLAPIPEDSQPSTPASKPEQPIVQDPPTTSVLDLNEHAEDQQRDDQEF

SEQ ID NO: 156224 - protein, 191 aa, Glycine max
  Coding DNA Sequence Number=SeqID_64539
MAASDVAILRDRAHIPTKKSLMELTSQDAWLAQNKLLSKQLEAFIETLRCAICSGAHNFGCYIPNEEPTHEVNYMGNQPRQNFNAGGYFGFQPGQPYNSQQRQWQNHLGNQFNKDQGGPSTRPQQQGRSLYDRTTKLEETLAQFIQVSMSNQKSTESAIKNLEIQVGQLAKQLADRPSSSFSANTEKNPKE

SEQ ID NO: 156225 - protein, 154 aa, Glycine max
  Coding DNA Sequence Number=SeqID_64540
GWHLLSPLLLCLLLHLHGGKSPLKDLIEAQRSSLHRSPTSKLPSLGVQPSPSGGGGTSTDHEPVPAEEPLPDAEDELVPPKPFIFETDPVTQEEAAAQDPTYLVHISLAPIPEDSQPSTPASKPEQPIVQDPPTTSVLDLNEHAEDQQRDDQEF

SEQ ID NO: 156226 - protein, 76 aa, Glycine max
  Coding DNA Sequence Number=SeqID_64541
MEMKRWDAIHFVELDGNNEKGGLSKKLKIYRKALFEEFWEVSRNYESIVHKKSRIRWLREGDANTNFFHSSVNWRR

SEQ ID NO: 156227 - protein, 95 aa, Glycine max
  Coding DNA Sequence Number=SeqID_64542
  Subcellular localization annotation: CTP_CleavageSite=36; ConfidenceScore=5.15e-01
MSLAVGDMYWRFSGVLLHRWFLDFNGIMASMPYVSRCSAEVTRCLMPSLVRKSSLLSVTMAYERSYLHMRCFQVNFSTSLIIISRNGLASIHLVK

SEQ ID NO: 156228 - protein, 80 aa, Glycine max
  Coding DNA Sequence Number=SeqID_64543
  Subcellular localization annotation: CTP_CleavageSite=57; ConfidenceScore=5.07e-01
MEKQVIRGFKISTTITTYRNYNATFFMQRVISRKLTMKHCSNQKRRYNALDFVSHLREEMNKLVREILAAIMQEHADSRV

SEQ ID NO: 156229 - protein, 305 aa, Glycine max
  Coding DNA Sequence Number=SeqID_64544
  Subcellular localization annotation: CTP_CleavageSite=20; ConfidenceScore=5.29e-01
MVEPSKKRKGSSSITTVASQCRHGTSYDPPAPPHPFFSSPMSLALFSSDEQRQRYYSLFSNRVILDPKYLDVEFFDGETFDCYQGTLVDDWKHVYSSHDARKMVCNDHADMTDRLLAGSFTFECRIMHYILCRVLLPRSINLAQASDEDLILLWALQTGGQIDWAHLVRYRIYKALRANAPLPYPHLVTLFLQHFNIPLEDEPFVKVKRSFAIGAGVVASFGYRKDVDGQWVHKQDLPPPIPDERTPSPPPQRDTSSSLSNDVLTKLRDLWAFIGDRFDAMDSRITRLEDDMSFIRRCFDPSADS

SEQ ID NO: 156230 - protein, 140 aa, Glycine max
  Coding DNA Sequence Number=SeqID_64545
MVSSNEVAKSKEEGEDAALRMIEEHGDIAKEHVDEEVEVGGEAEGEVGEGDANDGGVEVLGEAAGEEAQRKLRGTMAAKQRRKQSMGIETPMEATIESTNFLLFLIMSSSDIFMAVDMFAGSELGFIRIIAMKRGEKRSS

SEQ ID NO: 156231 - protein, 133 aa, Glycine max
  Coding DNA Sequence Number=SeqID_64546
MEAMKEKMTTMMEAMMSMRKMMEVNMAKVVATSAATKVDPTHPSGLNPVNPPVSNMVGQGGKALGSTGIPHFVFNEYFDIDGLDLFSELKVPICLYTALGIPLPNTLGGLQYNPQPQPLHFAVGRVPPAMVER

SEQ ID NO: 156232 - protein, 62 aa, Glycine max
  Coding DNA Sequence Number=SeqID_64547
MALGVMAAHLSELLLQPKVTLLAQASWEVKRRTLILFERSCIRLGNGETGSETEKHEDIEVL

SEQ ID NO: 156233 - protein, 654 aa, Glycine max
  Coding DNA Sequence Number=SeqID_64548
  Gene Ontology: Mol. function=motor activity; Cellular component=cell projection
  Homolog annotation: Hit_ID=P15305; Match level="QueryCoverage=59%, HitCoverage=73%, E-value=3e-27, Identity=22%"; Hit description =Dynein heavy chain
TSQGPKKGRMSSSKGPRTKLGYDRLHVLAFRGLHVLDFRGLHFLASRGLHTLSFRGLQILVFRGLHLLYFRGLHLLALRGGLDVLAFRGVHVLDFRGLHVLVLSGLHVLPLRGLHVLALRGLHILAFRGLHALTFKGLHILAFRALHVLDFRGLHVLAFRGLHALSFRGLHILTFKGLHLLDFRGLHVLALRGLHILAFRGLQVLSFKGLQALAFRGLDVLAFGGVHVLDFRGLHVLALSGLHVLPLRGLHVLALRGGLHVLTFRGLHVLAFKGLHILPFRGLHVLAFRGLRALALRGQHILTFRGLHTLTFKGLHVLAFRGLHVLDFRGLHVLASRGLHALSFRGLHILIFRGLHLLYFRGLHVLALRGLHILAFRGLQVLSFRGLCALALRGLHVLVFRGLHALAFRGLDVLAISRVHVLDSKGLHVLALSGLHVLALRGLHIIALRGLHVLAFRGLHVLDFRGLHVLAFRGLYILAFRGLHVLTFRGLYVLAFTGLHILAFRELKWFSFISSWAIPFDLGGGPTMRAQPKEEAIAQLLCIPGQDFAQTVGEAPQQPGDGQQWVIDTPPPPPESTSAHLQRLKHCLRHMVHQQMANHRGSSPRSDPGRAPLKRVPVRPHKPTQALTNTNSRVQNISSVSRPSRDGHSSDRDR

SEQ ID NO: 156234 - protein, 42 aa, Glycine max
  Coding DNA Sequence Number=SeqID_64549
AVNECGTSKFQVLGGLLSPLIFVVGKKSELSWRLKGNMGCGG

SEQ ID NO: 156235 - protein, 88 aa, Glycine max
  Coding DNA Sequence Number=SeqID_64550
LCCLNVVLLGCCGSLGGLMGTRGWWVYARFVDVENLLCTIARPPPSTTCDGVKLPAFIVDLRVVPGDMSRGSGDLGDVRWGAIAQNQA

SEQ ID NO: 156236 - protein, 206 aa, Glycine max
  Coding DNA Sequence Number=SeqID_64551
MGDQEETQEQMKADMSALKEQMASMMEAMLGMKQLMEKNAATAAAVSSAAEADPTPLATTHHPPSNIVGRGRDTLGHDGTPHLGYNRAAYPYGLPPDYSPPILQEDAGHIASPVHEKEPPQQPDEVHKNPQDYARRDVEFYPPIPEGPAPGTLPQPNLAASPIVLSMEGPPPATEERRKLDLLEERLRAVEGFGDYPFADMTDLCL

SEQ ID NO: 156237 - protein, 47 aa, Glycine max
  Coding DNA Sequence Number=SeqID_64552
MKKQQWKRSGRQRRRGEGRHHPLGNKPRKKEIHHQELPWIRSLKGML

SEQ ID NO: 156238 - protein, 108 aa, Glycine max
  Coding DNA Sequence Number=SeqID_64553
MRLLLPLPLVKVKKQKGKNLGKRSPPKKEGQPLMVKEECKEVSVSSKRLAKKERHFEIKTNIKEISPLRQPPHFLLCKKTIVSIATSLRLEFIPQVKELLDDGLVRKS

SEQ ID NO: 156239 - protein, 43 aa, Glycine max
  Coding DNA Sequence Number=SeqID_64554
MPQKIKVALISKSMGIKSPAVDLLCIQEYKTAIIQFKRIMNVR

SEQ ID NO: 156240 - protein, 184 aa, Glycine max
  Coding DNA Sequence Number=SeqID_64555
  Gene Ontology: Mol. function=tetracycline:hydrogen antiporter activity; Cellular component=integral to membrane; Biological process=response to antibiotic
  Homolog annotation: Hit_ID=A7HLD4; Match level="QueryCoverage=34%, HitCoverage=54%, E-value=3e-31, Identity=98%"; Hit description =Pyruvate ferredoxin/flavodoxin oxidoreductase, delta subunit
  Pfam annotation: Domain name=Fer4; Domain location=18-41; Score=12.4; E_value=0.0043; Accession=PF00037.18; Description=4Fe-4S binding domain
MEDQAIVVEIVDGKPKMRGYNYYYCKGCGLCANVCPKSIDPKTKQPAPEEKRAIVMKPETDFADDPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 156241 - protein, 254 aa, Glycine max
  Coding DNA Sequence Number=SeqID_64556
  Homolog annotation: Hit_ID=A5BSR3; Match level="QueryCoverage=47%, HitCoverage=37%, E-value=2e-08, Identity=33%"; Hit description =Putative uncharacterized protein
  Pfam annotation: Domain name=Transposase_23; Domain location=176-239; Score=2.0; E_value=0.00072; Accession=PF03017.5; Description =TNP1ENSPM transposase
MARTKRYGQMTSKAAKEISDRIDSLEEQTTQGSFVPHGRDDILNTAIGKPEHPGRVRAAGSGMTLTQFYGRATRTSSSSSATLMQQQWADIIGNIKEQVRNEYEEQHKRSLEEFKKELSSQIFIQLSQMGSQYSPLIEVDLQALAARLSTKGSNVETADVDPSGDKNVSLKPTMGLYVQRQNTTVLVALGKICEGGSAIHNVTYADDVVRVSVDKVIEGDAEVPFPTSEIQYVKQALQTFIAWPTNLVKKVSHE

SEQ ID NO: 156242 - protein, 222 aa, Glycine max
  Coding DNA Sequence Number=SeqID_64557
  Homolog annotation: Hit_ID=A5C169; Match level="QueryCoverage=68%, HitCoverage=13%, E-value=1e-07, Identity=28%"; Hit description =Putative uncharacterized protein
MVIDQSLFYDLTQLSSEGVPFEGTLNDDWKFDFSVHDACRLVCTNQVNMTGRLLAGSLAFESRILHYLIVRILLPRSSNLAQVSEEDLIVMWAFHTGQQIDWAHLVRYRMHKTLRLNAPLPYPHLVTLFLQHFSIPLDYEPYVPIKRSFLIGAIMIASFGYRKEHDGSWVKKGAQPIDEEGNLPVGEDSSLLQRILDRFDGLQTFVGERFDCFGVTSGHAIR

SEQ ID NO: 156243 - protein, 105 aa, Glycine max
  Coding DNA Sequence Number=SeqID_64558
MTFRLHPQSPELEVMDHPRCRQPKFLPPYHLLSCFPRKNNISAFQNPGLIQFIYMKLPFYPELVKAFYSNLEIQEDSLIFEVYGIKMVIDVRQVASDILRRGGGG

SEQ ID NO: 156244 - protein, 67 aa, Glycine max
  Coding DNA Sequence Number=SeqID_64559
MGQGINPRSLNINCAFMRNIRSYFYGFPNVVVYGFNKDLHSGFPVVVTLTIKDRWPMDGVSFGKQRI

SEQ ID NO: 156245 - protein, 21 aa, Glycine max
  Coding DNA Sequence Number=SeqID_64560
MDLATTSPADERLDRSNNDTG

SEQ ID NO: 156246 - protein, 99 aa, Glycine max
  Coding DNA Sequence Number=SeqID_64561
  Homolog annotation: Hit_ID=A5AZ88; Match level="QueryCoverage=81%, HitCoverage=7%, E-value=8e-10, Identity=32%"; Hit description =Putative uncharacterized protein
MLTKKNRYFHSDRIVVEDIEEDADIPLILGHPFMSTASCMVDMGKKILQMGIEDQKISFDLFQEDKDPPSQNVCFKVHVMEERRPEKKVLEVGTLLDPG

SEQ ID NO: 156247 - protein, 81 aa, Glycine max
  Coding DNA Sequence Number=SeqID_64562
MARIAKVVEISEQELDRVKQNRNGAAGVPRKHLEEKAEALTSQGEWATFIDTVGGSSGDRHLSCLSPQQGKPGHRCFGKCI

SEQ ID NO: 156248 - protein, 149 aa, Glycine max
  Coding DNA Sequence Number=SeqID_64563
  Homolog annotation: Hit_ID=A5C4I3; Match level="QueryCoverage=28%, HitCoverage=17%, E-value=8e-13, Identity=83%"; Hit description =Putative uncharacterized protein
MAARALGVPRHLRAPGVGLWAPHSARLETRTKESDMCASQRASKPVRRKEADWGERLIEPSSSWFPPKFPSGIAGARGRVLSGRCGCSVEPRHGIESSKWAIFGKQNWRCGMNRKLGYGAQLRANLDPTKGVGRLRQQDGGHGSRNPLR

SEQ ID NO: 156249 - protein, 75 aa, Glycine max
  Coding DNA Sequence Number=SeqID_64564
MLLGSRNPSLVVWKGIVHFRHMERQQSLSMAYRPVPLPPDNNVRVSHDTRTQCTVGPRAVLGWNMDAKVASASAI

SEQ ID NO: 156250 - protein, 88 aa, Glycine max
  Coding DNA Sequence Number=SeqID_64565
MTRRDKIWSFCTLVSSRGGGPDDTRRYLRLSAPLCHPKAAGPMTRRDKIWSFFTLVSSSPGPMTHAEIPYLSVTRCVITERNEISVIP

SEQ ID NO: 156251 - protein, 71 aa, Glycine max
  Coding DNA Sequence Number=SeqID_64566
MEALSFASQVLQGKVAEGPQLFVVSRVVAVAVVVVVVAVAGLVEERRVYLGQQHSENKVVVVAAIVKDSTI

SEQ ID NO: 156252 - protein, 113 aa, Glycine max
  Coding DNA Sequence Number=SeqID_64567
  Homolog annotation: Hit_ID=A5BPC1; Match level="QueryCoverage=100%, HitCoverage=10%, E-value=6e-08, Identity=32%"; Hit description =Putative uncharacterized protein
MGYGDGVKGYRIWSPSKKKVLLSRDRCHSPREKDVESITKDSEKRGHSKTSPVVLQEGEKSKDSSANESYLAAELDHPQLNSGINQRPKRVTKPPERYGFEDMAAYALHAAEK

SEQ ID NO: 156253 - protein, 93 aa, Glycine max
  Coding DNA Sequence Number=SeqID_64568
MWRKSKRGVFAQSAQVGPPEDSSQKAVASGGSNLARLGELSSLGRAGWQAPYLAINRGRSEEEKGSAFLALLSLSKLLRKIIFVKKIQAEVLP

SEQ ID NO: 156254 - protein, 145 aa, Glycine max
  Coding DNA Sequence Number=SeqID_64569
MTRGNPGDLQPFDPELDRTFHRLVRHSVHPGHSVHFEHSKHSVEGDSEYSDFEHSTTNFYTENMAQPSPHERTLREMAAPDFTYESLCIQYPDEGKDPYKHLKEFHIVCSTMKPPDVQEDHIFLKAFPHSLEGVTKDWLYYRGIL

SEQ ID NO: 156255 - protein, 122 aa, Glycine max
  Coding DNA Sequence Number=SeqID_64570
  Subcellular localization annotation: CTP_CleavageSite=51; ConfidenceScore=5.46e-01
MDVWGANTFPVHKYNSRTFHLKVSRSRLFRFFRRFPQINVGGDSARIPFVEHASRESRVALPPKGRLRQGWINRLGFMNQIARSARRVRTNVLSLCKSAGQSGPFVTIVGLCRTRRPAYPHL

SEQ ID NO: 156256 - protein, 49 aa, Glycine max
  Coding DNA Sequence Number=SeqID_64571
KYKLHVLKRDVVTSSTTSVIGIRISDVSLYVLLGFSTYRQQKLYTDNHS

SEQ ID NO: 156257 - protein, 300 aa, Glycine max
  Coding DNA Sequence Number=SeqID_64572
MAKFDPDIVLEFYANSWPTEEGVRDMRSWVRGQWIPFDADAIGQLLGYPLVLEEGQECEYGQRRNRSDGFDEEAIAHLLCIPGQDFARTAAGRQQHPAPATIIPTSPCRSISWCMAPTRHPLDPDKSNRALGFPALITGLCQSFGVPVAPSKVIRPPITRAFIEKYCTQRQVQGDAPQAADALPPHQAGPAGSFDTEQYLRHLVRQQEANHRAHVQTHDCLYQMSLSLQSQGFTSFPCPTLDQFRAEVAWPGDWPEARAGEAPAEAPAEAPDEAPDEADEAREDEEMVDLLDFLGGSGAT

SEQ ID NO: 156258 - protein, 140 aa, Glycine max
  Coding DNA Sequence Number=SeqID_64573
MDCPLCKLCSMECSICGVNEKSESPADKGTRSGICVDARGIAGVGMGGTGVVEEEGAVVFGVAEVVGTYVLLPLAFLDPLNVTVGSSRFQQFFLIYVKLMVGLKFSRDLESDWTPLALHRTVIKAGNPSLDVSCCAVREI

SEQ ID NO: 156259 - protein, 193 aa, Glycine max
  Coding DNA Sequence Number=SeqID_64574
MTLLLSNILPSDHNSDLLLPKCQLVYAILTRINVHVAQLIADAIYLFEGMPPTRHLLDPDKSNRALGFPALITGLCQSFGVPVTPSKVIRLPITRAFIEKYCTPRQAQGGDPQAPDALPPPHQADPARSFDTERYLWHLVCQQAANHRAHVQTYDCLYELSLSLQSQGFTPFPCPTPDQFRAEVAWPGDWPEA

SEQ ID NO: 156260 - protein, 135 aa, Glycine max
  Coding DNA Sequence Number=SeqID_64575
MWAFHKGLQIDWAHLVRYHMHKALRLNAPLPYPYLVTLFLQHFNIPLDSEPYVPIVATCPFAGEQRRGSRVRFPKEERCTESPPMFICGKRRENRRKPVQMKILSSGVVFTLEEGRQKRSFCSYVPSIKEEIRPT

SEQ ID NO: 156261 - protein, 224 aa, Glycine max
  Coding DNA Sequence Number=SeqID_64576
  Homolog annotation: Hit_ID=Q0KIL1; Match level="QueryCoverage=42%, HitCoverage=10%, E-value=4e-07, Identity=34%"; Hit description =Gag/pol polyprotein, 3'-partial, putative
  Pfam annotation: Domain name=G-patch; Domain location=53-92; Score =24.0; E_value=0.00024; Accession=PF01585.14; Description=G-patch domain
EDILVSCPSSTPYVEAAEESLETAFQSFEVVSISSVDSFSGQTCLSDAAVMMARVMLGNGYEPGMGLGKDNGGITSLINAKGNRGKYSLGYKPTQADIKRSIAGRKSGGQSSRLRQESEGSPPCHISRSFISAGMGDEGQVFAIYEDDVPESDDESPEGTNTWDPPIDFEQEMNQTEDEGNEDVGLPPELERMVTHEDQETGPHQEETELVDLGIGSGKREVKI

SEQ ID NO: 156262 - protein, 40 aa, Glycine max
  Coding DNA Sequence Number=SeqID_64577
DRARKTPKGLSIAYTTWPTSRLPSPKPKISISARSVTNKS

SEQ ID NO: 156263 - protein, 196 aa, Glycine max
  Coding DNA Sequence Number=SeqID_64578
MGDQEETQEQMKANMSALKEQMASMMEAMLSMKQLIEKNAATAAAVSSAAEADPTLLATAHHPPSNIVGRGRDTLGHDGSPHLGYNRAAYPYGLPPNYSPPVLQEDAGHIASPVLERKPPQQPDEVHKDSQDYARRDVEFYPPIPEGPAPGTLLQPNIAASPIVLSTEGPHPATEEKRKLDLPKRRLRAVEGFGDY

SEQ ID NO: 156264 - protein, 93 aa, Glycine max
  Coding DNA Sequence Number=SeqID_64579
  Homolog annotation: Hit_ID=A5AKH3; Match level="QueryCoverage=79%, HitCoverage=14%, E-value=5e-12, Identity=43%"; Hit description =Putative uncharacterized protein
MEKLDKKTFKDKKGKKTYITWEDNDMDSSGDSENEVMNLSFMPKNYESKEEDSLKRSWYIDSGCSKLMMRDASKFTHISPKNSGHVTYGDNNK

SEQ ID NO: 156265 - protein, 63 aa, Glycine max
  Coding DNA Sequence Number=SeqID_64580
MQNMQFQQETRASIQSLTNQMGQLATQLNQQQSQILTSYLLKLSKIPKVIGNSSAKDLNAMQI

SEQ ID NO: 156266 - protein, 170 aa, Glycine max
  Coding DNA Sequence Number=SeqID_64581
  Gene Ontology: Mol. function=aspartic-type endopeptidase activity; Biological process=DNA integration
  Homolog annotation: Hit_ID=Q84VH6; Match level="QueryCoverage=70%, HitCoverage=8%, E-value=4e-09, Identity=41%"; Hit description=Gag -pol polyprotein
MAKDTLQTAEHIRVFNSRTRKSLTKGLLDASPARKKDVEEDAESGDNVRSVEKQVKMSHQNSNINQRCWTKRPSIRIARKMHQVCMLLWRSNLPRGHFIREVEKSSQTRFEVLQRLSPRMSKETERINAMQENWSDQLAENLKTAGSPEVNSAHVKASQSSCSIHHNRMA

SEQ ID NO: 156267 - protein, 156 aa, Glycine max
  Coding DNA Sequence Number=SeqID_64582
MEPSKKRKGTSSRSQRHSGSQETPIPSSISFGSLFSSEEQWIRYTNLFSYRSIIDPKFIDMDFFSNESFECFQAFENSNLIPFMSLKLPVYSDLVKAFYSNLEIQEGTLMHEVYGIKIVIDQSLFYDLTQLPSEGVPFEGALIDDWKFDFSVHDAH

SEQ ID NO: 156268 - protein, 117 aa, Glycine max
  Coding DNA Sequence Number=SeqID_64583
CGVEVNGAEGSGKVDEEGAEASGAVEVGGASNLLPLAFLGPLNVTVGSSRFQQFFFIYAKSVRGRDQVGVRKNTPSLSECGHVLSEDLQRLTINIQLKSPPWDAELNNQLLRIRPQE

SEQ ID NO: 156269 - protein, 525 aa, Glycine max
  Coding DNA Sequence Number=SeqID_64584
  Gene Ontology: Mol. function=unfolded protein binding; Cellular component=cytoplasm; Biological process=protein folding
  Homolog annotation: Hit_ID=A7MGD1; Match level="QueryCoverage=52%, HitCoverage=95%, E-value=1e-112, Identity=70%"; Hit description=33 kDa chaperonin
  Pfam annotation: Domain name=HSP33; Domain location=15-283; Score =431.7; E_value=1e-126; Accession=PF01430.10; Description=Hsp33 protein
  Pfam annotation: Domain name=PEPCK_ATP; Domain location=339-525; Score=-28.4; E_value=7.9e-19; Accession=PF01293.11; Description =Phosphoenolpyruvate carboxykinase
  Pfam module annotation: Pfam domain module=HSP33::PEPCK_ATP; Domain location=15-283::339-525
MNNSRPHERNLMSVQDQLHRYLFENVAVRGELVNASQTWRDIVQNHDYAEPVKTLLGELLVATSLLTATLKFDGDITVQLQGDGPLSMAVINGNNRQELRGVARLKEDAEIAAGSSLKQMVGNGYLVITISPEKGERYQGVVGLEADTLAGCLEDYFMRSEQLPTRLFIRTSEKGAAGILLQVLPAQEPNLDDFNHLATLTETVKSEELIELPATDVLWRLYHQEEATVYDPAPVSFKCTCSRERCGEVLKTLPPEEVDEILVEDGKIDMHCDYCGTHYVYDAVDIAAIHFSTCHVPARIFNSLHFSTSLRRVHCARSALHMRVNGLTSQDLETLGISGTTEVVYNPDYATLFQEETRPELEGYARGTLTQSGAIAVDTGIFTGRSPKDKYIVRDDTTRDTLWWNDVGNGKNDNQPLSQETWQALKDRCTQQLSGKRLFVIDAFCGANPDTRLSVRFVMEVAWQAHFVKNMFIRPTEAELAEFTPDFVVMNAAQCTNPDWQAQGLHSENFVAFNLTERMQLIGGT

SEQ ID NO: 156270 - protein, 647 aa, Glycine max
  Coding DNA Sequence Number=SeqID_64585
  Gene Ontology: Mol. function=transferase activity, transferring pentosyl groups; Cellular component=peptidoglycan-based cell wall; Biological process=peptidoglycan-based cell wall biogenesis
  Homolog annotation: Hit_ID=P02918; Match level="QueryCoverage=100%, HitCoverage=77%, E-value=0.0, Identity=75%"; Hit description =Penicillin-binding protein 1A (PBP-1a) (PBP1a) [Includes: Penicillin- insensitive ...
  Homolog annotation: Hit description=transglycosylase (EC 2.4.2.-) (Peptidoglycan TGase); Penicillin-sensitive transpeptidase (EC 3.4. -.-) (DD-transpeptidase)]
  Pfam annotation: Domain name=Transgly; Domain location=18-185; Score =324.3; E_value=2.3e-94; Accession=PF00912.13; Description =Transglycosylase
  Pfam annotation: Domain name=Transpeptidase; Domain location=383-639; Score=33.2; E_value=9.8e-08; Accession=PF00905.13; Description =Penicillin binding protein transpeptidase domain
  Pfam module annotation: Pfam domain module=Transgly::Transpeptidase; Domain location=18-185::383-639
PQLPDVNTLKDVRLQTPMQVYSADGELIAQYGEKRRIPLTLQQMPPELIKAFIATEDSRFYEHHGVDPVGIFRAASIALVSGHASQGASTITQQLARNFFLSPERTLMRKIKEAFLAIRIEQLLSKDEILELYLNKIYLGYRAYGVGAAAQVYFGKPVDQLSLSEMAMIAGLPKAPSTFNPLYSHARALARRNVVLARMLDQNYITQQQYNDARNTPLTASYHGPEIAFSAPYLTELVRQEMVKRYGDSAYDDGYKVYTTVTRHLQEAAQQAVRNNVMAYDMRHGYRGPTNVLWKVGEASWDHTRIVNALKICRADEATAMLKDGSSVSLTLAGVRWARPYKSDTLQGPTPRSVTQVLQAGQQIWVRKVGDAWWLGQVPLVNSALVSLNPEDGAVRALVGGFDFNQSMFNRATQALRQVGSNIKPFLYTAAMDRGLTLASILNDVPISRWDAGAGADWRPKNSPPTYAGPIRLRQGLGESKNVVMVRAMRAMGVDYAAEYLQRFGFPAQNIIHTESLALGAASFTPMQVARGYAVMANGGFLVDPYFIAKIENEQGGVIFQAQPKIACPQCNLPVIYGDTKKSVALNEESVENVATSNQQQNQTVPQPELEQVPAQPQPAGDQQYAPHVINTPLAFLIKSALNSNIF

SEQ ID NO: 156271 - protein, 278 aa, Glycine max
  Coding DNA Sequence Number=SeqID_64586
  Gene Ontology: Biological process=cell division
  Homolog annotation: Hit_ID=Q6CZR0; Match level="QueryCoverage=100%, HitCoverage=82%, E-value=1e-36, Identity=37%"; Hit description=DamX protein
MDEFKPEDELKPDASDRRPTRPRKSSSAPKAKVPVSRQHMMMGIGILVLLILVLGIGSALTGPDEKKPASNSASTGSAAPAGGGSEKNIDLSGSTTMSGQQNATPSAEGTAGNAAPAGSDGQSISMPSVSSTPTQAAPVDTPANQQRVTLPGDLNTALNNQQGSVDAAAQGAQGNSSLPTAPATVSGSAGKAVTPPAVRAETPPRSLGASSSHKTPAASKPAAVKENKTHTTTAHNSAPASSGGASKSLPSGGNYTLQLSGASKEASLNAWAKKQNLS

SEQ ID NO: 156272 - protein, 32 aa, Glycine max
  Coding DNA Sequence Number=SeqID_64587
MVNMEFISGISNDTFILNTLLLPSSYSLYQKT

SEQ ID NO: 156273 - protein, 87 aa, Glycine max
  Coding DNA Sequence Number=SeqID_64588
SAIKNLEVQVGQLAKQLADRSSSSFTANTEKNPKEECKAVMTRSRMAIHLAPKPALEPIFDFVELEEINEEVEDDKEEETPIKEKEK

SEQ ID NO: 156274 - protein, 267 aa, Glycine max
  Coding DNA Sequence Number=SeqID_64589
  Gene Ontology: Mol. function=inositol or phosphatidylinositol phosphatase activity; Cellular component=cytoplasm; Biological process=carbohydrate metabolic process
  Homolog annotation: Hit_ID=A8GHY6; Match level="QueryCoverage=100%, HitCoverage=100%, E-value=1e-135, Identity=88%"; Hit description =Inositol-phosphate phosphatase
  Pfam annotation: Domain name=Inositol_P; Domain location=1-263; Score= 390.1; E_value=3.4e-114; Accession=PF00459.16; Description=Inositol monophosphatase family
MHPMLNIAVRAARKAGNLIAKNYETPDAVEASQKGSNDFVTNVDRDAERLIVEVIRKSYPQHTIITEESGELAGDDQDVQWVIDPLDGTTNFIKRLPHFAVSIAVRIKGRTEVAVVYDPMRNELFTAVRGQGAQLNGYRLRGSTARDLDGTILATGFPFKLKQHATPFINIVAKLFTQCADFRRTGSAALDLAYVAAGRVDGFFEIGLKPWDFAAGELLVREAGGLVTDFTGNHGYMLSGNLVAGNPRVVKAMLASMREELSEALKR

SEQ ID NO: 156275 - protein, 325 aa, Glycine max
  Coding DNA Sequence Number=SeqID_64590
  Gene Ontology: Mol. function=helicase activity; Cellular component =chromatin; Biological process=viral genome replication
  Homolog annotation: Hit_ID=Q2A9E0; Match level="QueryCoverage=100%, HitCoverage=22%, E-value=4e-89, Identity=49%"; Hit description =Putative uncharacterized protein
  Pfam annotation: Domain name=DUF889; Domain location=238-325; Score= -69.7; E_value=9.5e-07; Accession=PF05970.5; Description=Eukaryotic protein of unknown function (DUF889)
MDRPEYVWKQTWQWMANDIVFNHRRQGIQLIDKEKMHLCLTTIENLLQANRKSLRDFPSMPYPLGYAANTHQNNLIYNELAYDGDILAAEFDKCYQWLTDEQASIFNKIMHVVATQSGGVYFLYGYGGTGKTFVWKTLSSAIRSTGGIVLTVASSGIASILLPGGRTTHSKFAIPVPATKNSTCNIHQGSDLAELLHITKLIIWDEAPMCHRYSIEALDKSLQDIMHNSNPFGGKVIVFGGDFHQILPVVPRGNRSDIVYATLNSSYIWNHCQILKLTKNMRLQSNPTDHSNLDELKQFSEWLLDIGDGKLAEPKEGYGEITIPR

SEQ ID NO: 156276 - protein, 61 aa, Glycine max
  Coding DNA Sequence Number=SeqID_64591
MANLCYDAPLPSLNRQSIGHFPPELYAKLSKFNLITMTLVEITFQNLMAISQNCQNCKCIL

SEQ ID NO: 156277 - protein, 189 aa, Glycine max
  Coding DNA Sequence Number=SeqID_64592
  Homolog annotation: Hit_ID=Q2HW90; Match level="QueryCoverage=96%, HitCoverage=36%, E-value=3e-20, Identity=33%"; Hit description =Putative uncharacterized protein
MAEVSIEAIASLAQYYDQPLRCFTFGDFQLSPMVEEFEEILGCPLRGRKPYLFFGFYPFLARIPKIVQISAQELDHRKQVENGMVGVLRKCLEEKARILAGRGKWAPFIDILALLIFGGVLFPNVDGLVDLAAINAFLAFHDYKESPVVAILADLYDTFDRRCEKSSTRIVFCTPALYVWLASHLFRQE

SEQ ID NO: 156278 - protein, 75 aa, Glycine max
  Coding DNA Sequence Number=SeqID_64593
  Subcellular localization annotation: CTP_CleavageSite=22; ConfidenceScore=5.11e-01
LSAHPPLSATSARLGRQKNLASASRLRAKREISALSATDFKQRIGTNSKAHHSAYFGKRALEAARGATFAEIPMF

SEQ ID NO: 156279 - protein, 147 aa, Glycine max
  Coding DNA Sequence Number=SeqID_64594
  Homolog annotation: Hit_ID=Q6WAY6; Match level="QueryCoverage=57%, HitCoverage=14%, E-value=2e-08, Identity=38%"; Hit description =Putative uncharacterized protein
PQGIRTIDGTSPKASLPQGVREDSRFGHSGGIYGSCRIPRPILGPAVEIAAVVGDSAKELDRTKQTRNDVVGLPQKYLEGKARDMASQEKWGPFADILALLIFGVVLFPNVDGLVDLAAIDAFLAYHHSKESPVVAILADLFDTFDR

SEQ ID NO: 156280 - protein, 100 aa, Glycine max
  Coding DNA Sequence Number=SeqID_64595
  Homolog annotation: Hit_ID=Q6WAY3; Match level="QueryCoverage=35%, HitCoverage=1%, E-value=2e-08, Identity=77%"; Hit description =Gag/pol polyprotein
MIAKSRTEDEHLVNLRKLFGRLRKYQLKLNPTKCTLWGEVGEAEDLSRSYGTVTAKRITLLEKIKSLANPGHIKHAQSGRPLFRHDRVAMSSLTGSVGLA

SEQ ID NO: 156281 - protein, 174 aa, Glycine max
  Coding DNA Sequence Number=SeqID_64596
FNKTNVETLQKVRKAWEVLQKKDKELRGSSNNGTIDGYRKWLKAHVQGLDWLPSFRTVKREEVEAPEEDEEVQVLRGELEQAQTVKERFKSAALKIQKENTKLRDVNVATTKALERENMRACREELGRNKFRGALWETNMLANCTKYQEELNLAAVHEHRVADEYDPTVREKGG

SEQ ID NO: 156282 - protein, 143 aa, Glycine max
  Coding DNA Sequence Number=SeqID_64597
DSDLNVWKPVEHSSDAKLAGESDPLGELMKILFYVYQNPVEVSWEASQFGLPDIGATISGDKCLNIVILQLWTIFMNECGRSIADQSLYGLLEPQSIQNAKERRQQCQQYIETWVKESQRQLYLGAYLHQVMFKVEGSSADIM

SEQ ID NO: 156283 - protein, 68 aa, Glycine max
  Coding DNA Sequence Number=SeqID_64598
MMITKDDDKDQSKNNSSESRRIQEFKIRIKKNSRLKKKVKSQESRFKVQDLKNQDQDSRLKIQESKKA

SEQ ID NO: 156284 - protein, 175 aa, Glycine max
  Coding DNA Sequence Number=SeqID_64599
ENAELRDINITTTKALEQETKRARREEHGRNKFRGALWGSNSELKLRREERDQSRVDSLILKDELKVCSRSKRNLSQRLCETETNMLAIISKYQEELNLATAHEHRVADEYAQMYAEKEARGRVIDLLHQEATMWMDRFALTLNESQELSRLLAKAKAMADTYSAPEEIHELLSY

SEQ ID NO: 156285 - protein, 62 aa, Glycine max
  Coding DNA Sequence Number=SeqID_64600
MAEDYESGEENNSRVQDRIKKNSRLKRKVKSQESRFKVQDLKNQDQDSRLKIQESREGLIKI

SEQ ID NO: 156286 - protein, 184 aa, Glycine max
  Coding DNA Sequence Number=SeqID_64601
  Homolog annotation: Hit_ID=Q2HW90; Match level="QueryCoverage=36%, HitCoverage=13%, E-value=3e-07, Identity=45%"; Hit description =Putative uncharacterized protein
RGEWAPLIDILALLIFGGVLFPNVDGLVDLAAIDAFLAYHNHKESRVVAMLADLYDTFDRRCEKSSTRIVCCTPTLYLSSLRTAKREEVEAPEEDEEVQVLRAELKQAQTVKERFKSAAVKIRKENAELRDVNIATTKALEQETKRARREEQGRNKFRGALWGSNSELKLRREERDQSRVDSLI

SEQ ID NO: 156287 - protein, 55 aa, Glycine max
  Coding DNA Sequence Number=SeqID_64602
  Gene Ontology: Mol. function=nucleic acid binding
  Homolog annotation: Hit_ID=A5AYU6; Match level="QueryCoverage=89%, HitCoverage=9%, E-value=4e-12, Identity=59%"; Hit description =Putative uncharacterized protein
MEHLHEPLRKKWYIDSGCSKHMTGDASKFTHISPKKSGHVTYGDNNKGRILGVGK

SEQ ID NO: 156288 - protein, 155 aa, Glycine max
  Coding DNA Sequence Number=SeqID_64603
KLLAEKTKKKLEEAVQLGSVDGVIDPPSPFRCHDSFEEQASQGSFVPHRRQDVLTTAIGCPEHPGRVRAAGAGVTIMKYFRLAPRMSRNSSSLPPEELHQLTQQIRDQLEELITEKVTRQLMTSFSQMQSHFRSQMQSQGLALPPEPLVGSSGPR

SEQ ID NO: 156289 - protein, 145 aa, Glycine max
  Coding DNA Sequence Number=SeqID_64604
EFHVNLYDPEDKSPKHVRVRGHLVKFDEDTLNTFLKTPVILEEGENHCAYYKFALLRPDPQQLAAKLCILGRGFELNDDGQPLKILRKNMTTLAQTWSVLSFSNLNPTSHTSDVTLDRAKLIYGIIMKMDMNVGYLISHQIFLTT

SEQ ID NO: 156290 - protein, 107 aa, Glycine max
  Coding DNA Sequence Number=SeqID_64605
MECLEVHPEQPTRTLQQHVEWILPTPTPYRLVEPVQLIEVSSSEEDLKEDPEELPPEPAVDALDFPEDDEDPLPDVDSPEDIMSASEAGSTEESGPGGTANSDDSSS

SEQ ID NO: 156291 - protein, 44 aa, Glycine max
  Coding DNA Sequence Number=SeqID_64606
FRALLEHKILCSSRASPVSHRRVSSKLLAMASYGGELLLDSSSP

SEQ ID NO: 156292 - protein, 316 aa, Glycine max
  Coding DNA Sequence Number=SeqID_64607
  Homolog annotation: Hit_ID=Q6WAY6; Match level="QueryCoverage=35%, HitCoverage=20%, E-value=2e-12, Identity=34%"; Hit description =Putative uncharacterized protein
EVEQSSWFPRWKEGKEGVLFSCGRYPNIPLVGTRGCINYNPALAIRQLGYPMRGAPTEESMSPFLVRDFGAQNSKTIQRIHKAWETPLKKDQELRGIRNGIIGGYHEWLKVHIRGLDWLAKLKVVSKESFEAPEEDEEVQALKSELGKAKLAKEKFKLAATHVRKECAGLREENAITARALEQETKRARKEEYGRNKFRGALWGSNSELKLRKEERDQSRAHSMTNMLAIIAKYQEELGLAAAHEHRIADEYAQVYAEKEARGRVIDSLHQEATMWMDRFALTLNGSQELPRLLAKAKAMADTYSAPEEIHGLLGY

SEQ ID NO: 156293 - protein, 89 aa, Glycine max
  Coding DNA Sequence Number=SeqID_64608
MWCYEWKKSEALRVGRLNLDSVFVLFACCITWMSGKLGRIDGDPVSRETRIWATWEYVSSVGGGQQGMVGLCAICGCGKLVVHHRPTAI

SEQ ID NO: 156294 - protein, 30 aa, Glycine max
  Coding DNA Sequence Number=SeqID_64609
MDFNSDDFMDKLREALRNVNLRDERWRPRR

SEQ ID NO: 156295 - protein, 69 aa, Glycine max
  Coding DNA Sequence Number=SeqID_64610
MKMLLIPHDVSSIGALEWRKEEREKRRLFKEKMSLEEAHHHRRPWIRAWRKKEMNEGRGREEHEILCSK

SEQ ID NO: 156296 - protein, 136 aa, Glycine max
  Coding DNA Sequence Number=SeqID_64611
MAKFDPDIVLEFYANAWPTEEGVRACGHGQFLGDPLVLEEGQECEFSQRRNRADGFDEEAIAQLLCIPGQDFARTAAERRVRIMRTSMTTLTQMWMTLLLSNVLPSDHNSDLPFPKWSAGVCHPDTDERPCGSVGR

SEQ ID NO: 156297 - protein, 222 aa, Glycine max
  Coding DNA Sequence Number=SeqID_64612
HPGRVRAVGANVTIKKYFGSAPQKSRSSSSLPPEELQQLTQQIRDQLEDSIIEKVTRQLMASFSQMQSQFQSQMQSQGLTLPPEPLVGPSVPRVSTKESCVDPSGNDAETGDSDRCDLYIEAIPAHLVALGRVYEGSTIVHNTPFVSWANALVPVPTDEVSLVGQAIHTFLAWPTHLVKSLSQQAAVSPAKPPQKPDPKVDNPLYLMTLTIPELFLRPYQVT

SEQ ID NO: 156298 - protein, 53 aa, Glycine max
  Coding DNA Sequence Number=SeqID_64613
MEKSEKKFFSENKVKKAYITWDDNDMESSEDSENEEINLCLMAKSYESDEEQV

SEQ ID NO: 156299 - protein, 89 aa, Glycine max
  Coding DNA Sequence Number=SeqID_64614
MTDLVSAEDDVNLRVSKGLSDAIDEGRRRRSFSSYRQQKVYTDNHSGISARQRDSKVSMTDLVSAEDDVNLRMSTGLSDAIDEGRRRRS

SEQ ID NO: 156300 - protein, 111 aa, Glycine max
  Coding DNA Sequence Number=SeqID_64615
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=100%, HitCoverage=55%, E-value=5e-45, Identity=71%"; Hit description=MADS -box protein GmNMH7
  Pfam annotation: Domain name=K-box; Domain location=54-111; Score= -9.1; E_value=0.0027; Accession=PF01486.8; Description=K-box region
  Pfam annotation: Domain name=SRF-TF; Domain location=9-45; Score =31.6; E_value=2.9e-06; Accession=PF00319.9; Description=SRF-type transcription factor (DNA-binding and dimerisation domain)
  Pfam module annotation: Pfam domain module=K-box::SRF-TF; Domain location=54-111::9-45
MARGKIQIKRIENTTKKANELTILCDAKVSIIMFSSTGKLHKIEQSTKQFFDQYQMTLGVDIWNSHYENMQENLKKLKERMGDCLNELGMEDLRLLEEGMDKAAKVVREHK

SEQ ID NO: 156301 - protein, 41 aa, Glycine max
  Coding DNA Sequence Number=SeqID_64616
MSLGYEAWKDASLEEKKEGEKERWGEHEIEGKKEGEKWNFE

SEQ ID NO: 156302 - protein, 86 aa, Glycine max
  Coding DNA Sequence Number=SeqID_64617
MSNQKSTKSTIKNLEVQVGQLAKQLAERPSSNFTTNTEKNPKEECKAVMTRSIMAIQAEESIADQKGKSEANIEKKKKATPIECKE

SEQ ID NO: 156303 - protein, 121 aa, Glycine max
  Coding DNA Sequence Number=SeqID_64618
MKREKHASYSSHDFCKSLSEELSDYYRGFHSSHAKHHSQRREKDRRPQEVNISLPYFHGKDNVEAYLDWEMKVEQLFACHHIGGLLLSIGMILRVPLGRDTFPPTMKGSLWTSSKGLDKGV

SEQ ID NO: 156304 - protein, 78 aa, Glycine max
  Coding DNA Sequence Number=SeqID_64619
  Homolog annotation: Hit_ID=A5BEV8; Match level="QueryCoverage=78%, HitCoverage=7%, E-value=4e-08, Identity=44%"; Hit description =Putative uncharacterized protein
MGAPPSKGFIDHIVDVKADDNCGYRSIAALLGMGEDSWSLVRNELIKELGKWSHDYINLFGGTERFEELRLVWTSGWI

SEQ ID NO: 156305 - protein, 300 aa, Glycine max
  Coding DNA Sequence Number=SeqID_64620
AIGQLLGYPLVLHEGQECEYGQRRNRSDGFDEEAIAQLLCIPGQDFSRTAAGKRVRIMRTNMTTLTQIWMTLLLNNILPSDHNFDLPLPKCQLVYAILTRMSIHVAQLIADAIYIFAGMAPTRHPLDPDKSNRALGFPALITGLCQSFGVPVAPSKVIRHPITRAFIEKYCMQRQVQGDAPQAADAPPPHQAGPAGSFDTEQYLRHLVRQQAANHREHVQTHDCLYHMSLSLYNQGFTSFLCPTPDQFRAEVAWPGDWPEAQAGEEPAEAPAEAPDEADEAREDEEMTDLLDFLGGSGAT

SEQ ID NO: 156306 - protein, 213 aa, Glycine max
  Coding DNA Sequence Number=SeqID_64621
MKRSRKDAAAEGTSAAPEFHCHRFRSAEHQQRFEAIKGWSFHRERRVQLRDDEYTDFQEEIARRHWTSLVTLMAKFDPDIVLEFYANAWPTEEGVRDMRSWVRGQGIPFDADALSQFLGEPLVLKEGQECEFCQRRNRAEGFEEEAIAQLLCIPSQDFSQTADGRRVQIMRTSMTTLTQMWMTLLLSNVLPSDNNSDLPLPKCQLVCHPPGTL

SEQ ID NO: 156307 - protein, 80 aa, Glycine max
  Coding DNA Sequence Number=SeqID_64622
  Subcellular localization annotation: CTP_CleavageSite=30; ConfidenceScore=5.37e-01
MYPLLFSVTTTQVDVPSTCTTTDVPTNVLRQSSQAVSPLKLCERETKDISGGRRETQKEFRRLVLGKFFLAKGEENEKDE

SEQ ID NO: 156308 - protein, 118 aa, Glycine max
  Coding DNA Sequence Number=SeqID_64623
  Pfam annotation: Domain name=Transposase_23; Domain location=2-51; Score=-14.4; E_value=0.045; Accession=PF03017.5; Description =TNP1ENSPM transposase
MGRVYEGSTVVHNTPLLPGQVKVSVEEVTDADAPVPVPTDEVSLVGQALHTFLAWPTHLVKSLSQQWMFPPLELIHKRCTLSCSQSNPSRCTLYLCHKGCTLQCVKTKISGYYTFDTL

SEQ ID NO: 156309 - protein, 68 aa, Glycine max
  Coding DNA Sequence Number=SeqID_64624
MGTNQTDKRFYQVKVKGLHTTSIKELGRLMEPLQMQAFRKTYGKILELTISEVSIEAIASLTQYYHRP

SEQ ID NO: 156310 - protein, 143 aa, Glycine max
  Coding DNA Sequence Number=SeqID_64625
MSDGFCGTHLQIMVGTRRLGRALGQVTRRGVGRGDHDDSDDAPQRRRPTASARRQRVAATADHVDDLVIPDLDVQDDPMEAPAAVEDIPADAGALRISLRDFRERPELKLSSHGRKVHSLGRPTPAIEGLIAGTGLSPLIACS

SEQ ID NO: 156311 - protein, 119 aa, Glycine max
  Coding DNA Sequence Number=SeqID_64626
  Gene Ontology: Mol. function=protein binding; Biological process =xylan catabolic process
  Homolog annotation: Hit_ID=Q9SDM7; Match level="QueryCoverage=83%, HitCoverage=17%, E-value=1e-45, Identity=90%"; Hit description =Putative uncharacterized protein
  Pfam annotation: Domain name=LRR_1; Domain location=36-55; Score =10.8; E_value=3; Accession=PF00560.24; Description=Leucine Rich Repeat
  Pfam annotation: Domain name=LRR_1; Domain location=64-85; Score=5.8; E_value=26; Accession=PF00560.24; Description=Leucine Rich Repeat
  Pfam annotation: Domain name=LRR_1; Domain location=88-110; Score =11.8; E_value=1.9; Accession=PF00560.24; Description=Leucine Rich Repeat
  Pfam module annotation: Pfam domain module=LRR_1::LRR_1::LRR_1; Domain location=36-55::64-85::88-110
  Subcellular localization annotation: CTP_CleavageSite=55; ConfidenceScore=5.00e-01
MAKKAKFCEGFDNVEGSVINLSSNLFKGTLPSVSANVEVLNVANNSISGTISPFLCGKENATNKLSVLDFSNNVLYGDLGHCWVHWQALVHLNLGSNNLSGVIPNSMGYLSQHCKIALQ

SEQ ID NO: 156312 - protein, 58 aa, Glycine max
  Coding DNA Sequence Number=SeqID_64627
TYQGNPCGVYPDLSSFIGSGVYPDLSSLTGSGVYPDLSSFTGSGVIQTFVACIKRSAP

SEQ ID NO: 156313 - protein, 108 aa, Glycine max
  Coding DNA Sequence Number=SeqID_64628
MNSTSFQGLENQKTSESFWYKEEEEVQRDSRLVKDCNEMIGKAFFLSLEFFLILVEVGELICAIARSPPKWYLEICRGSQETLGTSGGVLLPKTKLDQSRPNPGIVSQ

SEQ ID NO: 156314 - protein, 137 aa, Glycine max
  Coding DNA Sequence Number=SeqID_64629
MEEFEEILGCPLGGRKPYLYSGFYPSMVRIAKVVKISAQELDRVKQNRNGVVGIPRKHLGEKAKALVDQGEWASLIDVLALLVFGVILFPNMDGLVDLMQSYPARALDRRLQEDWARDGREDPRVLMSLRVDFGPMG

SEQ ID NO: 156315 - protein, 103 aa, Glycine max
  Coding DNA Sequence Number=SeqID_64630
MAPRKLASKRSRKDKAAEGTSSAPEYDSHRFRSAVHQQRFEAIKGERRIQLRDDEYTNFQEETGRRRWTSLVTPMAKFDPEIVLEFYAKKGPTEEGVRDMRSW

SEQ ID NO: 156316 - protein, 158 aa, Glycine max
  Coding DNA Sequence Number=SeqID_64631
MEACLTVEDLLQQMIDQGRLEVGNEGGEEQHICMQSADEEVSWRYAPPSERKEEATDISSLSAKVTNITGLSGMTRNGRIPDLPTQPANAKGKAKIAEEQNNKVIPAPDEDIPMKVDFNAKLLKVYVDSARVIHQLRGEWETRDHKLIPYQAYIKELA

SEQ ID NO: 156317 - protein, 156 aa, Glycine max
  Coding DNA Sequence Number=SeqID_64632
MEEGFSHGSVPIILGRPFMKIARTKIDVYADTLSMEFGDIVVHFNILDAMKHPSEDHSVFCAEIIDQIVNNYMFDFDSVLYGRKHPFLSDLHTCHSLCIESEFVLDHMFEFDAESESKIDIDYMSGDVLPLEIDFLESDRTNHVSGSAHTSDFLYM

SEQ ID NO: 156318 - protein, 71 aa, Glycine max
  Coding DNA Sequence Number=SeqID_64633
NIDGLELLICPYVHLRLKHDAPHCPSVSDASSIGACRPRIFFINGFLCFLEDKWQRNGEGRERGDATSRRR

SEQ ID NO: 156319 - protein, 71 aa, Glycine max
  Coding DNA Sequence Number=SeqID_64634
MELNLYRCSLETMQANTNADAKIGDFWMREEEGKESVCAESHSCPLPWAFVNAWLSTRITPLSEVCRSEKV

SEQ ID NO: 156320 - protein, 201 aa, Glycine max
  Coding DNA Sequence Number=SeqID_64635
  Homolog annotation: Hit_ID=Q6WAY6; Match level="QueryCoverage=33%, HitCoverage=11%, E-value=3e-10, Identity=49%"; Hit description =Putative uncharacterized protein
IDAFLAYHHTHESPIIAMLVDTYDILDLRCGPICPVQGHRMCAEKGKANWEELLAGFPNVPLMGMRGCINYNLVLAIRQLGYPMRGEPSEKSIAPFITRGSSDPNAKMLQRVRKAWKAVQRKDKELRGSSSGVEVPEGSEEVQALKAELERTRVVKEKFKMITIRVRKECDELRDVNMATSEGRIEGGKYEIRGQVEGLLK

SEQ ID NO: 156321 - protein, 115 aa, Glycine max
  Coding DNA Sequence Number=SeqID_64636
MEVRDKVELLPYRDLDELVQLCIRVEQQLKRKPSSKSYGSHSYPRKDQAHGILGAAPSKPKEDKGYYQEEVYGSQEETTSCPSSSGSEIVRDEESSEEVYPHEEGDLLMVRRLLG

SEQ ID NO: 156322 - protein, 73 aa, Glycine max
  Coding DNA Sequence Number=SeqID_64637
RSFAKRDTQWLSARKNPEEDELSGSLSTPLQVIKCTASAYSLRERSALSQNPLMRAKQFRFALSVRAWTNPLI

SEQ ID NO: 156323 - protein, 68 aa, Glycine max
  Coding DNA Sequence Number=SeqID_64638
MEKLHGNNFFHPKQLKCIAKGVRDIWNNLPSPIYRKKGEEVAAQLSQASWVASSISNSALKIFPDSKI

SEQ ID NO: 156324 - protein, 33 aa, Glycine max
  Coding DNA Sequence Number=SeqID_64639
MAKTSKLCHATCKCLRSTHDHPQKNWTSITVES

SEQ ID NO: 156325 - protein, 204 aa, Glycine max
  Coding DNA Sequence Number=SeqID_64640
MCGNGPEETCLKEIQEEIGRRRWASLVTPMAKFDPDIVLEFYANAWPTEEGVRDMRSWVRGQWIPFDADAISQLLGYPLVLEEGQECEYGQRRNRSDGFDEEAIAQLLCIPGQDFARTVVGRRVRIMRTNMTSLTQIWMTLLLNNILPTDHNSDLPLLKCQLVYVILTRMSIHVAQLIADAIYIFAGMAPTRHPLDPDKSKGIL

SEQ ID NO: 156326 - protein, 303 aa, Glycine max
  Coding DNA Sequence Number=SeqID_64641
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=95%, HitCoverage=50%, E-value=3e-30, Identity=30%"; Hit description=CTV.20
  Pfam annotation: Domain name=zf-CCHC; Domain location=12-29; Score =30.0; E_value=8.9e-06; Accession=PF00098.14; Description=Zinc knuckle
MESPKQKIKTKITCYNCGKQGHISKYCRLKKKLRNLNLEPAIEEQINNLLIETSEEETETETSSSVLSDENLNLIQQDDQLSSTDDDGQINTLTREEDLLFEAINSIPDPQEKKVFLEKLKKTLEVKPRQNDFITNNKFDVSNILKRLENSSTKPTTIQDLQTEINNLKREVKELRQQQEINQIILSQLEEDSDSESAHNSEENQPENLEDDMFMGLINKIKIQNFYINIKIIINDFVLETMALFDTGADSNCILEGLIPTKFFEKTSEKLSTANGSKLKINFKLSNAIIENQGLRINTNFLL

SEQ ID NO: 156327 - protein, 98 aa, Glycine max
  Coding DNA Sequence Number=SeqID_64642
  Homolog annotation: Hit_ID=A5B532; Match level="QueryCoverage=95%, HitCoverage=39%, E-value=6e-08, Identity=32%"; Hit description =Putative uncharacterized protein
MVVGNATIEKSRKQWDEEERRRVQYNLKAKNIITSALGMDEYFRVSSCKNLKEIMNQNETIQDMQKRFTHIVTNLASLGKIFPNEDLINKVLRCLSRE

SEQ ID NO: 156328 - protein, 133 aa, Glycine max
  Coding DNA Sequence Number=SeqID_64643
  Subcellular localization annotation: CTP_CleavageSite=48; ConfidenceScore=5.56e-01
KARGKRSEAPSTAPSEALASSSSTLPPSSSTKIPVIPPASTQIPLPAPLFAGGDASSIGACRPRVFFINGFLSFLEDEWQRNGERERERRCHFKEKMSLEEAHHHRRPWIRAWRKKEMNEGRGREEHEILYSK

SEQ ID NO: 156329 - protein, 77 aa, Glycine max
  Coding DNA Sequence Number=SeqID_64644
  Gene Ontology: Mol. function=aspartic-type endopeptidase activity; Biological process=DNA integration
  Homolog annotation: Hit_ID=A5AZ88; Match level="QueryCoverage=75%, HitCoverage=5%, E-value=1e-11, Identity=56%"; Hit description =Putative uncharacterized protein
ENSEGHFAFKELKNGGIIEKPKVELKTLPAHLKYVFLKDNDSKPVIISSLLKKIEEDQLVQILKRHKAAIGWHIFDF

SEQ ID NO: 156330 - protein, 53 aa, Glycine max
  Coding DNA Sequence Number=SeqID_64645
  Subcellular localization annotation: CTP_CleavageSite=48; ConfidenceScore=5.01e-01
MASYGVESPLSLPSPLRCHSSSKKQRNPLMMKILGLQAPMELTSCGIRASSSR

SEQ ID NO: 156331 - protein, 68 aa, Glycine max
  Coding DNA Sequence Number=SeqID_64646
MAAEWRRKRERRRHFKEKMSLEEAHHHRRPWIRAWRKKEMNEGREREEHEILCSKGALKSEELMKHWA

SEQ ID NO: 156332 - protein, 67 aa, Glycine max
  Coding DNA Sequence Number=SeqID_64647
MSQNLTDCATMLPFDFRYVTELHGLPNDGCQVPRSCQTRVTSQQTDGPRMKLGTKPQDNGGYTWRIR

SEQ ID NO: 156333 - protein, 155 aa, Glycine max
  Coding DNA Sequence Number=SeqID_64648
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=12%, E-value=6e-79, Identity=92%"; Hit description=NBS -LRR type disease resistance protein Rps1-k-1
MAEDLLKKPRKGRTLEEIGHEYFDDLVSRSFFHRSSTNRSSWPHGKCFVMHDLMHDLATSLGGDFYFRSEELGKETKINTKTRHLSFAKFNSSVLDNFDAVGRVKFLRTFLSIINFEAAPFNNKEAQCIIVSKLMYLRVLSFRDFRSLDSLPDSI

SEQ ID NO: 156334 - protein, 28 aa, Glycine max
  Coding DNA Sequence Number=SeqID_64649
MEKNEETTMEEKHACEASLEAGSLSFSE

SEQ ID NO: 156335 - protein, 61 aa, Glycine max
  Coding DNA Sequence Number=SeqID_64650
MYPRLELIHKEFSDGEGKNQKNSQVVSPLNSIGKREGRHKRIQAISPSILLAKEEENEEKE

SEQ ID NO: 156336 - protein, 199 aa, Glycine max
  Coding DNA Sequence Number=SeqID_64651
  Homolog annotation: Hit_ID=Q5NRP4; Match level="QueryCoverage=47%, HitCoverage=6%, E-value=7e-07, Identity=31%"; Hit description =Putative gag-pol polyprotein, identical
MSLHSSSSVNGEGSTPKDPLYKILDELRSLNLWKEKQERKEKGRHRSHLRPHSHWGEKERKPQEANINHPYFHGKDNVEANLDWEIMVEQQLKRKSTSKSYGSHSYPKKDQGQGILGVTPSKPKDDKGKTIEKQPLKASMQEKTSSMKCFKCLGRGHITSHYPTKKTMIMRGQDKYSSQDEASTSPSSSESEEAKGEES

SEQ ID NO: 156337 - protein, 155 aa, Glycine max
  Coding DNA Sequence Number=SeqID_64652
  Gene Ontology: Biological process=transposition, DNA-mediated
  Homolog annotation: Hit_ID=Q1J7G7; Match level="QueryCoverage=26%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIIILGHHTQ

SEQ ID NO: 156338 - protein, 129 aa, Glycine max
  Coding DNA Sequence Number=SeqID_64653
  Pfam annotation: Domain name=zf-CCHC; Domain location=23-40; Score =29.8; E_value=1e-05; Accession=PF00098.14; Description=Zinc knuckle
MRGNQRRQNFKSKRRTKESSQIPKCFECNQPGHLRADCPIFKKKIEKPEKKTIGDKKAKKAYITWDDNDLESFDDSEKEMVNLCLMGKDYESDEEVTSSNKSISFVELQDAVAELHSESIKLAKLVSSS

SEQ ID NO: 156339 - protein, 227 aa, Glycine max
  Coding DNA Sequence Number=SeqID_64654
  Subcellular localization annotation: CTP_CleavageSite=31; ConfidenceScore=5.36e-01
DQGQGQLRFLLHQQLSSSTYDNNTFYPTSCRFSTFRGHASKHTSGADYFTRKPTAGTQPPLHREDEDPAAQVPHQSEDESSNSTTPEPLIRKMRVVVTQEAAATSEKSLEATLELPAPVADTTSPQQAAYPSTLEDQTTLVLSPNTSLVASLVLHLSEEEEGQTQDTYLAPFVVQSVKFRNMPEIKRKHCYAIREIPPTWAFQILPPEGGCFWRKQPGSPGRAELAW

SEQ ID NO: 156340 - protein, 65 aa, Glycine max
  Coding DNA Sequence Number=SeqID_64655
MDAKFTDRCLPKNLLEWPNNYLKGIINSALKGFNDIQGSKPKAIAKWIFQLNVISKEEALSAAII

SEQ ID NO: 156341 - protein, 163 aa, Glycine max
  Coding DNA Sequence Number=SeqID_64656
MSLSGPCLAKRIIASKKRKSIGTKPTSQYDTRRFHFFEAWTRYTNNVLGRHILPKRKVEIYHTELDEFKAELERHNFHKRLTNLVENNIDLALIDAHSLNTFLETLVVLVEGETLLTYSRYYRLPVDIREIEVALCIPGRGFVLNVEGHPGKILRKDLTTLAQ

SEQ ID NO: 156342 - protein, 70 aa, Glycine max
  Coding DNA Sequence Number=SeqID_64657
MASMDISAMVNSKDLSRKSCGRLAFGEAFNLDLVKPLAGMHMTQMQSRNAGSQGIVPFLDTTSRGSKGPQ

SEQ ID NO: 156343 - protein, 22 aa, Glycine max
  Coding DNA Sequence Number=SeqID_64658
CYSFNDVINNNNNLILYSHIHQ

SEQ ID NO: 156344 - protein, 87 aa, Glycine max
  Coding DNA Sequence Number=SeqID_64659
  Homolog annotation: Hit_ID=Q2HW89; Match level="QueryCoverage=66%, HitCoverage=5%, E-value=1e-07, Identity=44%"; Hit description =Integrase, catalytic region; Ribonuclease H
MAEYEVCALAIQAAIDSNVKLLKVYRDSASVIHQLRGAWETRDPKRYPTKPISKSWLTPLMRSPSITSPGRKIKWQMHLPLWHPCSS

SEQ ID NO: 156345 - protein, 151 aa, Glycine max
  Coding DNA Sequence Number=SeqID_64660
MEEGWEAAPSAPSDLSDYEWRLLSFAEIAYFGWSFASLTLLRKVEEEPQLLVVFVVIVVVATAVLEEEHMACLDQQHSEKEGQAIVVVEDLSISDLDDSSNLDCICCLEDHNYSAVVGFAVEEVNYKCLQHKALGCSLTPDCCKEGQRFCM

SEQ ID NO: 156346 - protein, 92 aa, Glycine max
  Coding DNA Sequence Number=SeqID_64661
SAVRASSTIKSYSEPHELIVIHASSTIESGAPRIDCLALFVHPPSSYSEPYELIVIHASSVIKYGTSEKEEGETGITYFKSFWVGTIVIEIN

SEQ ID NO: 156347 - protein, 142 aa, Glycine max
  Coding DNA Sequence Number=SeqID_64662
MTLLLSNIQPNDHNSDLPLPKCQLVYAILTRMSIHVAQLIADAIYLFAVFRHLVRQQAANHRAHVQTHDCLYQLSLSLQSQGFTSFPCPTPDQFKAEVAWPGDWPEARAGEAPTEGPDEADEAREDEEMTDLLDFLGGSGAT

SEQ ID NO: 156348 - protein, 208 aa, Glycine max
  Coding DNA Sequence Number=SeqID_64663
MTDPLDESISCFLIRVNPWGYTPSPWVLVTLTVRGLHVLALRGLHILTIRGLHALTSRGLHVLALRGLHALTLGTSYPHRQRTTRPRLERTTRPHHQRAARPHLQRTIRPRLERATRPHLGGLHVLTFRGLHALAIRGLHVLTFVGLHALTLRGLHVLSIRGLHALTSRGLHVLTLRGLHALTFRGLRVLIFSVLDIHTLKEFKVLCP

SEQ ID NO: 156349 - protein, 75 aa, Glycine max
  Coding DNA Sequence Number=SeqID_64664
MGISFVAFLQGVIGIRREFPLEGRGLAHIFQSGMGSEVRRQAIRVSLRTIPPTEHRQHRFRFPNCIGGGCRGIIL

SEQ ID NO: 156350 - protein, 112 aa, Glycine max
  Coding DNA Sequence Number=SeqID_64665
  Gene Ontology: Mol. function=phosphoprotein phosphatase activity
  Homolog annotation: Hit_ID=A5AWR0; Match level="QueryCoverage=85%, HitCoverage=9%, E-value=3e-14, Identity=39%"; Hit description =Putative uncharacterized protein
  Pfam annotation: Domain name=DUF1723; Domain location=81-112; Score =15.0; E_value=0.0089; Accession=PF08330.1; Description=Protein of unknown function (DUF1723)
MSSSSSSSSSIHIKSAPIDGNVLWMQPKHVSEHVWNGEPDKKLHIRRVVPIYQGQEEIPEEIIPLLRQSGFYWIMKMGYLKINSSLITVLIERWRPETHTFHLRCEEATITL

SEQ ID NO: 156351 - protein, 218 aa, Glycine max
  Coding DNA Sequence Number=SeqID_64666
MLASDHAIPRDRTYQPTKNSLLELTSHDALLAQNKLLSKQLEILTETLGCTMCGEAHETSQCIATNDNTQEIHFMGNQQRQGYTQGGFLGFQQSPYNQQGQWRTHLGNQFNKDQGGSSNRPIHQGPNIFQSTTKLEETLTQFMQVTMSNHKSTESALKNLEVQMGQLAKRIADKSSNSFRANTENNPKEECKAEMTRSKRFVEAEDKENVVDKEPSGE

SEQ ID NO: 156352 - protein, 105 aa, Glycine max
  Coding DNA Sequence Number=SeqID_64667
  Subcellular localization annotation: CTP_CleavageSite=52; ConfidenceScore=5.26e-01
MDKSMIGAASGGTLMDKTHVVAKQLISNMATNYQQFGTIVVVLSRVVANEVSISMVVDNQRLENKLIELASLMRQLAIGQHQNMMTTNQPRLCGIYCASDHPTDA

SEQ ID NO: 156353 - protein, 104 aa, Glycine max
  Coding DNA Sequence Number=SeqID_64668
MERPSKAMREEPARTLQRTVEWILPTPTPYRLVEPVQVIEVMSSEEDPEELPPEPVVDALDFLEGDEDPLPEVDSPEDVMSASEADSTEDSGPGEMATSGGSSS

SEQ ID NO: 156354 - protein, 122 aa, Glycine max
  Coding DNA Sequence Number=SeqID_64669
ETTLVSACYWTLSLTDSKRVCPGYPIGRLRVPMDSWVMVTKDGVVDKSGAFTPTYPQFVLKNSDLRMQGEKVTDAQDFGWQSKGEDHFRRGWAFSLWVKVYGELGFWLKACRTAGHDICQSV

SEQ ID NO: 156355 - protein, 104 aa, Glycine max
  Coding DNA Sequence Number=SeqID_64670
VIPFVVVLMNPTIVFLLKNKRGKLVTWEINRDKDTIKEDFQDSSKVGQLAKLLAEKSSNSFGANTEKNPKEECKAVVTRCRKLVAAEDEDVVAFKDTTVKKKNE

SEQ ID NO: 156356 - protein, 67 aa, Glycine max
  Coding DNA Sequence Number=SeqID_64671
LSQQGQGFVPFACPTPEQFRTEVAWPGDWPEAQAGEAPAEAPGDAEEARMDEEMTGLLGFLGGSGAT

SEQ ID NO: 156357 - protein, 113 aa, Glycine max
  Coding DNA Sequence Number=SeqID_64672
MAPRKLSTKRSRKDAATEGTSAAPEFDSHRFWSAEHQQRFEDIKGYSRVLCQCLAYRGGRAGHAVMGKGPVDSFRCRRPQSVPGIPASIGGGQECKYSQRRTRADGFDEKAIA

SEQ ID NO: 156358 - protein, 162 aa, Glycine max
  Coding DNA Sequence Number=SeqID_64673
MERSMIDAASGGALEDMTPAKARNLIEKMASNSQEFSARSDAIVIRGVHEVATNSSSSAETKKLEGKLDALVNLPEAYATNIYNRPPQPQQQNQPQQNNYDLSSNRPYVPPPIQQQQQEQPQKQQTVEAPPQPSLEELVRQMTMQNMQFQQETRASIQSLTN

SEQ ID NO: 156359 - protein, 79 aa, Glycine max
  Coding DNA Sequence Number=SeqID_64674
MGNYQHPRNPKERMYHTGYDNYNNILLFIHTYTHNNPMNQSHIHAQDKKAEIHTMCDLTSLPETYSQVSEIHSIHTARP

SEQ ID NO: 156360 - protein, 184 aa, Glycine max
  Coding DNA Sequence Number=SeqID_64675
  Homolog annotation: Hit_ID=A7PJZ4; Match level="QueryCoverage=50%, HitCoverage=19%, E-value=4e-11, Identity=41%"; Hit description =Chromosome chr12 scaffold_18, whole genome shotgun sequence
MVRTRGLRRVEGTGRGRDLSQDVAEDVPRRRRPTASARRQRVTQRVEDVPQLAEDVPDASNGSPERTGAADGAESDRVASDGTTADDEGFLGGPRDPSVLIGFADHVAHNIWSGQERPDLKLVSHGRKVDKFGRPAAEIKGMIEATGLDPLIRCSVITTDPGLISAFVERWHRETSSFHLSVGE

SEQ ID NO: 156361 - protein, 126 aa, Glycine max
  Coding DNA Sequence Number=SeqID_64676
MKADLSALKDQMASISEVMLKLQKTIEDKATATASSTVREAEPVLQPALNPGLDRNTAVFGGRYSPQAYSYGQPPDFTPRATPEDLSQFPTFEGQLPPYEDYPEQDDGEGDTHLGPLLHLKDPSPH

SEQ ID NO: 156362 - protein, 65 aa, Glycine max
  Coding DNA Sequence Number=SeqID_64677
KGPEKRGRVRCLGKLPHQASSSQSSYTNNRIQKLENLLGNLVVVLKVRFAEDPQINQVLEAIDQE

SEQ ID NO: 156363 - protein, 97 aa, Glycine max
  Coding DNA Sequence Number=SeqID_64678
  Subcellular localization annotation: CTP_CleavageSite=37; ConfidenceScore=5.51e-01
MGTWGVNAFPMRKQLPNPYFQNLQTYFWSSRAQRTIWAQRASDAKRNFSALSVTREFGRAQESRPLAKHKISSLSEMFISCQAQRVAGAKPIYIYSR

SEQ ID NO: 156364 - protein, 81 aa, Glycine max
  Coding DNA Sequence Number=SeqID_64679
DEVKASEESDEVQALRAELERAWVVEEKFKIHDVGYNVQDILPENTGVAAQCTRQDKRIEAAGSTMSDTMSRTSCPKILDT

SEQ ID NO: 156365 - protein, 206 aa, Glycine max
  Coding DNA Sequence Number=SeqID_64680
  Homolog annotation: Hit_ID=Q6WAY6; Match level="QueryCoverage=75%, HitCoverage=28%, E-value=2e-11, Identity=30%"; Hit description =Putative uncharacterized protein
ALHMGSVLIPTVNKPTEGPCRLLKNLLSHFSKHGNKSNRQEVLPSQGQKPRYHQHQGIRAVDGTPPNASLPQDLRKDLRVDHSRDFQLVPTIEEFEEILGCPLGGRKPYLSSGCLPSLSRIATVVKDSARGLDRIKQTRNGIAGLPQKYLEDKARGMANQGDWVPFMDVLALLIFGVVLFPNVDGLVDLAAIDAFLAYHHSKESPV

SEQ ID NO: 156366 - protein, 130 aa, Glycine max
  Coding DNA Sequence Number=SeqID_64681
  Homolog annotation: Hit_ID=A5C3B5; Match level="QueryCoverage=53%, HitCoverage=5%, E-value=9e-09, Identity=43%"; Hit description =Putative uncharacterized protein
MKEMKREKHGSYSSHDSCKSLSEELSDYYRGRHSSYSKHHSQRREKDRRLQEVNISLPYFHGKDNVEAYLNWEMKVEQLFVCHHISEERKVILATLSFQGYLAPIVRQFVMFRDMSEVKRKRCSTICEVP

SEQ ID NO: 156367 - protein, 104 aa, Glycine max
  Coding DNA Sequence Number=SeqID_64682
  Homolog annotation: Hit_ID=A5AZG1; Match level="QueryCoverage=38%, HitCoverage=12%, E-value=8e-07, Identity=57%"; Hit description =Putative uncharacterized protein
MKREKHASYSSHDSCKSLSEEPSNYYRGCHSLHTKHPSQRREKDRRPQEVNISLPYFHGKDNVEAYLDWEMKVEQLFACHHISEERKVPLATLSQPTLRREGEA

SEQ ID NO: 156368 - protein, 119 aa, Glycine max
  Coding DNA Sequence Number=SeqID_64683
MEHFLKQVAWLEAQLPLVRPDEAAPAEPTTTRVKPKPADPQSLVVNPPFSPKLEVVLPSPPLIIISDSLSRETIAPPDSPAREAVDPPDSPIGKAIDLSYSSSREAVALSDSPVFLSDR

SEQ ID NO: 156369 - protein, 75 aa, Glycine max
  Coding DNA Sequence Number=SeqID_64684
MKMLLIPHDVSSIGASEWRRKRERRRHFKEKMSLEDAHHHGRPWIMAWRKKAMNEGRGREEHGILCSKRALKSEV

SEQ ID NO: 156370 - protein, 289 aa, Glycine max
  Coding DNA Sequence Number=SeqID_64685
  Homolog annotation: Hit_ID=Q83QQ7; Match level="QueryCoverage=53%, HitCoverage=85%, E-value=3e-71, Identity=78%"; Hit description =Putative transporting ATPase
  Pfam annotation: Domain name=DUF462; Domain location=32-204; Score =339.6; E_value=5.6e-99; Accession=PF04315.3; Description=Protein of unknown function, DUF462
  Pfam annotation: Domain name=YfcL; Domain location=198-284; Score =180.0; E_value=5.9e-51; Accession=PF08891.2; Description=YfcL protein
  Pfam module annotation: Pfam domain module=DUF462::YfcL; Domain location=32-204::198-284
MAGQFIGARAGSRLVLSKGQSLIRPMIVIVSAQHHYQQLVEIFDKCFADDFNTCVIKGDDEPIYLPADSEVPYNRIVFAHGFYASALHEISHWCIAGKARREQVDFGYWYCPDGRDAMTQSKFEDVEVKPQAFDWLFCTAAGFPFNVSCDNLEGDFEPDRIAFQRLLSNAAADGRTISVAGRPALKPRSTNERGKTMIAEFESRILALIDDMVDHASDDELFAGGYLRGHLTLAVAELEGEGEHTAQAINDKVASSLEKAISAGELSPPDQILVQGMWNNLYQQAKNQA

SEQ ID NO: 156371 - protein, 167 aa, Glycine max
  Coding DNA Sequence Number=SeqID_64686
MTPTRHPLDPDKSNRALGFPALITGLCQSFGVPVTPSKVIRPPITRAFIEKYYTQRQVQGDASQAADAPPPHQAGPAGLFDTEQYLRHLVRQQATNHRAHSQGFTSFPCPTPDQFRAEVAWPGDWPEDRAGEAPARAPAEAPDEVDQAREDEEMTDLLDFLGGSGAT

SEQ ID NO: 156372 - protein, 189 aa, Glycine max
  Coding DNA Sequence Number=SeqID_64687
MVKEECKEVSVSSKRLAKKESHFAIKTNIKETSLLRQPPHLLLCKRTFFSIAIPLELEVIPQVKELLDKALVCKSLNPCALFVPKIGIMRHQIPMICGMMNVLSGTTLFCKIIHAFNIFMIRIHRDSLGWFVLIFGFNTNLGAHMAHLSDQRVPTNPKRIKSFLSGPLHQHHSMSWGGTIFPHGMMPPK

SEQ ID NO: 156373 - protein, 142 aa, Glycine max
  Coding DNA Sequence Number=SeqID_64688
MDNEEGVQEQMKVDLSALKDQMASISEVMLKLQKTIEDKATATGSSIVREAEPVLQPALNLGRDRNTAVFGLRYSPQAYPYGLPPDFTPRAAPEDLSQAPTFEGQLPPYDDYPGQDDEEGDTHLGPCSTSKIHPRMNYPNQT

SEQ ID NO: 156374 - protein, 202 aa, Glycine max
  Coding DNA Sequence Number=SeqID_64689
MTGRLLAGSLAFESRILPYLIVRILLPRSSNLAQVFEEDLIVMCAFHEGLQIDWAHLVRYHMHKALRLNAPLPYPHLVTFFLQHFNIPLDSEPYVPIKRSFLIGASVIASFGYIKEHDGSWIKKGARNVGEEGHEGEDSSLLSKILEKFDGLQTFVGERFDTLELQVDMRFNEMESRMTKVEEDVSYIRSSFDLPPPPPPSS

SEQ ID NO: 156375 - protein, 115 aa, Glycine max
  Coding DNA Sequence Number=SeqID_64690
MERSMIDAASGRALGDMTPAEARNLIEKMASNSRQFSARNDVIFLRGVHEVATDSSPSTENKKLEGKLDALVNLVTQLAMNQKSAPVARLCGLCSSADHHTDLCPSVQQYECKTA

SEQ ID NO: 156376 - protein, 116 aa, Glycine max
  Coding DNA Sequence Number=SeqID_64691
MEGCRFLVSGKYTALQICDDEDVETMLESFKQQQEMSVLELYIEKDVAGGSMFHSANSLTSCGNYVSNDDTQPPTNMSNLNLDEDDDHDDDDYLTKMTALTVSLIQTMKSSTFLNQ

SEQ ID NO: 156377 - protein, 232 aa, Glycine max
  Coding DNA Sequence Number=SeqID_64692
MAPRKLASKRSRKDKAAEGTSFAPEYDSHRFRSAEHQQRFEAIKGWSFLRERRVQLRDDEYTDFQEEIVRRRWASLVTPMAKFDPDIVLEFYANAWPTEEGVRDMRSWVRGQWIPFDADAIGQFLGYPLVLEEGQEYEYGQRRNRSDGFDEKPSPSCYVWRLPGTLWTRISPTAPITRALIDKYCTQRQAQGDAPQAADAPPPHKAGPAGSFDTEQYLRHLVRQQAANHRAH

SEQ ID NO: 156378 - protein, 174 aa, Glycine max
  Coding DNA Sequence Number=SeqID_64693
LVYAILTRMSIHVAQLIADAIYIFAGMAPTRHPLDPDKSNRALGFPALITGLCQSFGVPVAPSKVIRTPITRAFIEKYCTQRQVQGDTPQAADTPPPHQAGPAGSFDTEQYLRHLGFTSFLCPTPDQFRAEVAWPGDWLEARAGEAPAEAPDGADEAREDEEMTDLLDFLGGSG

SEQ ID NO: 156379 - protein, 239 aa, Glycine max
  Coding DNA Sequence Number=SeqID_64694
MVIDQSLFYDLTKLPSDGVPFEGTLNDDWKFDFSAHDARQLVCTNNADMTGCLLAGSLAFESCILHYLIVRILLPRSSNLAQVSEEDLIIMWAFHTGRQLDWAHLVRYRMHKALRLNAPLPYPQLVTLFFRHFQIPLDSEPYVPIKRSFLIGAAVIASFGCSTADDEGNQPVEDNSSLLRKLLEKFDGLQTFVGDKFDNMELQVDMRFDAMESRITKVEEYVSFIRTCFDPPPPPPSSS

SEQ ID NO: 156380 - protein, 121 aa, Glycine max
  Coding DNA Sequence Number=SeqID_64695
MGDQEEVQEQMRVDMSALKELMASMMDAMLGMRQLMEKNAATAAAVSSAAEADPTLPTIAHHPIPYVVGQERSTLGHIRNPHLGYNGVAYPYGLPPNYTPLVIRDDAGHVPPPILEGEPPQ

SEQ ID NO: 156381 - protein, 129 aa, Glycine max
  Coding DNA Sequence Number=SeqID_64696
  Homolog annotation: Hit_ID=A5BZH4; Match level="QueryCoverage=71%, HitCoverage=14%, E-value=8e-08, Identity=33%"; Hit description =Putative uncharacterized protein
MVRDNVEAFLDWEIRVEQQLKRKSTSKFYGSHYYPKQDEGQGILRVTPSKPKDDKGKTIEKQPLKANMQEKTSSIKCFKCCGRGYITSQCPTKKSMIIRLLLHLPLVKVKKQKGKNLVKKYTPKKKDNL

SEQ ID NO: 156382 - protein, 196 aa, Glycine max
  Coding DNA Sequence Number=SeqID_64697
MAKFDPDIVLEFYANASPTVEGVRDMRSWVRGQWIPFDADALSQFLGYPLVLEEGQECEYGQRRNQADGFDEEAIAQLLCILGQDFARTTAGRRVRIMRTNMTTLTKIWMTLLLSNIQPSDHNSDLPLLKCQLVYAILTRMSIHVAQLIADAIYLFAGMAPTRHPLDPDKSNRALGFPALITGLCQSFGVPVAPTK

SEQ ID NO: 156383 - protein, 104 aa, Glycine max
  Coding DNA Sequence Number=SeqID_64698
  Homolog annotation: Hit_ID=A4DID9; Match level="QueryCoverage=48%, HitCoverage=44%, E-value=2e-19, Identity=86%"; Hit description =Putative uncharacterized protein
  Subcellular localization annotation: CTP_CleavageSite=63; ConfidenceScore=5.13e-01
AHIDGKVWHLDVGSSPPGAVVCSKGWAVRPLKRYVSWVQNVVRQFGPYPDREGRTSGVPVIVPTVNAGASGSTAETAMGSLPQRGWSERSFENSREGHGETSRF

SEQ ID NO: 156384 - protein, 67 aa, Glycine max
  Coding DNA Sequence Number=SeqID_64699
MGRDLKKAHCPTNESWPEKNEKKSHEERRSKKAYIAWDDNDSSDGSEKEINLLSKDYESNENISQED

SEQ ID NO: 156385 - protein, 20 aa, Glycine max
  Coding DNA Sequence Number=SeqID_64700
MASSGTPTSFTKGQVSMYVA

SEQ ID NO: 156386 - protein, 52 aa, Glycine max
  Coding DNA Sequence Number=SeqID_64701
MELERLIKRLIDSGIDDAEEEEEAAEEEEEAAEEEEDAAEDTESDDDSEATP

SEQ ID NO: 156387 - protein, 58 aa, Glycine max
  Coding DNA Sequence Number=SeqID_64702
MADLHSGFPIVVTLTIKDGGLWMEFPSGNRELEEAMNLEIVKLSTRYCRNKLHDDESS

SEQ ID NO: 156388 - protein, 56 aa, Glycine max
  Coding DNA Sequence Number=SeqID_64703
MGITSTISIAQVDVMDEFIQFEDEDMSQEGKSQLDTYLEEANLSNKYHPNLDVLQY

SEQ ID NO: 156389 - protein, 122 aa, Glycine max
  Coding DNA Sequence Number=SeqID_64704
MKIKLVFATRDDVLHWARFVAYETGFVVVIMRSYTNNGIRGRTSFVLIGCERSGQYRAKKEKDLSMVKPRNILLMLKEHNANSYAIIKQIYNARNAYRSSIRGSNIEVQQLMKLLEWDQYIH

SEQ ID NO: 156390 - protein, 136 aa, Glycine max
  Coding DNA Sequence Number=SeqID_64705
MDCGQLEVSIGGKEEPQICMQSEEKKVPLTPKALVICFTRKGTGSTPIYPRAAPKPTPFAYQINKAVPWKYTPPASSKRVATEVDSLSAKVTNITGLSGVTRSGRVFASPHSMELPSKGKAPMVQEPSDIATPSKE

SEQ ID NO: 156391 - protein, 151 aa, Glycine max
  Coding DNA Sequence Number=SeqID_64706
MAPTRHPLDSYKSNRALGFPALITGLCQSFGVPVAPTKARPPPPHQAGQAGAFDMEQYLRHLVRQQAANHRAHVQTHDCLYQMSLSMQSQGFASFSCPTLDQFRAEVAWPRDWPEAQAGEAPSEAPSDGEEAHEDEEMADLLDFLGGSGDT

SEQ ID NO: 156392 - protein, 95 aa, Glycine max
  Coding DNA Sequence Number=SeqID_64707
  Subcellular localization annotation: CTP_CleavageSite=18; ConfidenceScore=5.03e-01
GLFLRTPRKKDISQKDTKARSGSSGINTAGPISIRKGSEAERVLSREKQTLSRSRFDILQKMMNSILGSIGILEGLQDKKLVSSKRPAEYTFTGD

SEQ ID NO: 156393 - protein, 207 aa, Glycine max
  Coding DNA Sequence Number=SeqID_64708
AEVAETLQYMVSPQGRNTWKVDDLVPYVEKITILSEEQERITEPAAHGPTSEHRFPPEVVEAQEYDKQIEERGHGMYYMPPTFAEYPSQMYQYSFQGHHTDMFASSHSFGGVAETHPHFSWPTMAPAQQHDAPMATPDAPLAPQWNVPGAIPDMGDLLDVDLRQEFFAEAEEVQAARYRGRRNPDRQARRWDRPCGTSSRHHGHDNE

SEQ ID NO: 156394 - protein, 209 aa, Glycine max
  Coding DNA Sequence Number=SeqID_64709
  Homolog annotation: Hit_ID=Q2HTA0; Match level="QueryCoverage=55%, HitCoverage=18%, E-value=3e-12, Identity=36%"; Hit description=IMP dehydrogenase/GMP reductase, related
MKGITGAPYRARCDGLTVTDVSWLPYTEHRGVRAFQEISSFQGQLRWGPMIVAVRPERVVRQFGYIQSIPPPPVSARLSQDQIDDRWMEFADHLLPAGQPCLVSGQVSADYIEWFFRISHPFMTPTQAADQQRDAPAADPEDYIQLPSPQDDYEGYEAIAQRLERVLNLRIVTTGTELYDIMQDCLTIARGGPSADGTVRARQRRRTDH

SEQ ID NO: 156395 - protein, 139 aa, Glycine max
  Coding DNA Sequence Number=SeqID_64710
MDFFSDESFECIQAFQNSNLIPFMSLKLPVYSELVKAFYSNLEIQESTLISEVYGIKMVIDQSFFYDLTHLTSEGVPFEGTLDDDWKFDFSMHDACRLVCTNQADMTGRLLASSLALESRILHYLIVHILLPRSLNLAQ

SEQ ID NO: 156396 - protein, 160 aa, Glycine max
  Coding DNA Sequence Number=SeqID_64711
MAKPLKKHKGSLSRSQRHSEAQETQIPSSISSSSLFSSEEQRIRYTNLFSSHSIIDPKFIDMDFFSNKSFECIQAFQNSNLIPFMSLKLPVYSELVKAFYSNLEIQESTLISKVYGIKMVIDQFLFYDLTQLSSESVPFEVGLHQPSGYDRKASCWIIGF

SEQ ID NO: 156397 - protein, 72 aa, Glycine max
  Coding DNA Sequence Number=SeqID_64712
MAEDRPQRMTLEDYSNPIIPQYFTSIVRLEVQAANFSYPYSLIQLIQGNLFHGLPSEDPYAHLATYIDICNT

SEQ ID NO: 156398 - protein, 120 aa, Glycine max
  Coding DNA Sequence Number=SeqID_64713
IIRHQIPMIGGMMNVLSGATLFCKITHAPNIFMIFGHRDSLGRNNQHENKEKGMFYSITFPNFLNSDQGLPMDPKRTKVIPEWPTPPSVEERIHEFQEPLDLRSNPFQGRGNMVLAPLEL

SEQ ID NO: 156399 - protein, 40 aa, Glycine max
  Coding DNA Sequence Number=SeqID_64714
MAGNSPNFSSALRHMPLKSPPMIEWSVQFGHQSEDGSPKI

SEQ ID NO: 156400 - protein, 52 aa, Glycine max
  Coding DNA Sequence Number=SeqID_64715
MMQSYPLRALDKRLQEDWVRDAREGPKVLMSLRVGYPRNVEFFSPCILGHLD

SEQ ID NO: 156401 - protein, 299 aa, Glycine max
  Coding DNA Sequence Number=SeqID_64716
  Gene Ontology: Mol. function=calmodulin binding; Cellular component =integral to membrane; Biological process=response to biotic stimulus
  Homolog annotation: Hit_ID=A9PJ36; Match level="QueryCoverage=87%, HitCoverage=54%, E-value=1e-91, Identity=59%"; Hit description =Putative uncharacterized protein
  Pfam annotation: Domain name=Mlo; Domain location=8-298; Score=301.4; E_value=1.7e-87; Accession=PF03094.6; Description=Mlo family
MSGGGGGEEEATLEFTPTWVVAAVCTVIVAISLAAERLLHYGGKFLKAKDQKSLYEALQKIKEELMLLGFISLLLTVTQNGITKICVRPSLTRHMLPCNLDAGEHSTPESESATKIGYCVRKNKVPLLSLEALHHLHIFIFVLAVVHVSFSLLTVVFGGARIRQWKHWEDSIAKQNYETGRVLKPKVTQVHQHDFIRGRFAGFDKDSAIVGWLLSFLKQFYGSVTKSDYVTLRHGFIMTHCRTNPKFNFHKYMIRALEDDFKQVVGISWYLWLFVVIFLLLNINVNLNNTFCGEKGIEL

SEQ ID NO: 156402 - protein, 99 aa, Glycine max
  Coding DNA Sequence Number=SeqID_64717
  Homolog annotation: Hit_ID=O81129; Match level="QueryCoverage=66%, HitCoverage=3%, E-value=2e-08, Identity=51%"; Hit description =Phosphatidylinositol 4-kinase
METVKMLNVVLPDVLLTSSNCPDSIDLCPKSVVLEFLHFVPISFTQSFWPHPFSVDSIAFFFLDFTSYFSDAHRKHRCGFGFHFFYRSDCGADLVLIFW

SEQ ID NO: 156403 - protein, 162 aa, Glycine max
  Coding DNA Sequence Number=SeqID_64718
MEYRKNQHNFLNSSSSSNPIKQHSGRQHLRRLADAIEHYQIQQKQHRKSPETITKTENRRRNPDLGSATHHHPKTPTTHLLNQQPRRRGRFDLSKDEEEGFVLKNSTTIFECEEVSRNREKKNEEKRQRFCAMLILLQLRRGGCRTPAAARNRDRSSTKRTE

SEQ ID NO: 156404 - protein, 287 aa, Glycine max
  Coding DNA Sequence Number=SeqID_64719
  Gene Ontology: Mol. function=metal ion binding
  Homolog annotation: Hit_ID=A7P8C0; Match level="QueryCoverage=99%, HitCoverage=99%, E-value=1e-52, Identity=44%"; Hit description =Chromosome chr3 scaffold_8, whole genome shotgun sequence
MAIEAQLFPNNAPPFPFYGSKNLMADNSQAAYGHRQQPVEQHHAWQMNQNMSLVDPNFSCFSNSNVHHYALHKNVIQPLASYPQSLAIVFDQQREIDHCIRSQNEKLSILLQEQRKQHVSELLKKVEANALHLLRQKDEEIAQATKKTTELKEFLTRLEVENQSWRKVAEENEAMVLSLHNTLEEMKERALYRVTAEDAESCWDENMRNRAMEEGTGENRLCRGGGVEEVEQIRKRTMDCKCCNSQKSCFMILPCRHLCSCKTCEPFLQVCPVCSMPKKSSIETLIV

SEQ ID NO: 156405 - protein, 1895 aa, Glycine max
  Coding DNA Sequence Number=SeqID_64720
  Gene Ontology: Mol. function=ubiquitin-protein ligase activity; Cellular component=intracellular; Biological process=protein modification process
  Homolog annotation: Hit_ID=Q6WWW4; Match level="QueryCoverage=96%, HitCoverage=96%, E-value=0.0, Identity=66%"; Hit description=E3 ubiquitin-protein ligase UPL3
  Pfam annotation: Domain name=Arm; Domain location=211-251; Score =11.9; E_value=0.34; Accession=PF00514.14; Description=Armadillobeta -catenin-like repeat
  Pfam annotation: Domain name=Arm; Domain location=293-333; Score =12.0; E_value=0.33; Accession=PF00514.14; Description=Armadillobeta -catenin-like repeat
  Pfam annotation: Domain name=Arm; Domain location=336-374; Score =21.8; E_value=0.0026; Accession=PF00514.14; Description =Armadillobeta-catenin-like repeat
  Pfam annotation: Domain name=HEAT; Domain location=216-253; Score =21.9; E_value=0.0023; Accession=PF02985.13; Description=HEAT repeat
  Pfam annotation: Domain name=HEAT; Domain location=341-376; Score =17.2; E_value=0.064; Accession=PF02985.13; Description=HEAT repeat
  Pfam annotation: Domain name=HECT; Domain location=1519-1895; Score =377.5; E_value=2.2e-110; Accession=PF00632.16; Description=HECT -domain (ubiquitin-transferase)
  Pfam module annotation: Pfam domain module=Arm::Arm::Arm::HEAT::HEAT:: HECT; Domain location=211-251::293-333::336-374::216-253::341 -376::1519-1895
  Subcellular localization annotation: CTP_CleavageSite=52; ConfidenceScore=5.97e-01
METRSRKRAEASSAAPSSSSSTTTTTASRSAKCSRLSSSSSSIPNTTTANTRSRSARNNNNNSVSPMDPTNESSGSRRDRRGKNFDRDNSDKGKEKEHDVRIRDAERERALALNLEAEDVGDDDDDNDSEGGVGILHQNLISASTFRGLLRKLGAGLDDLLPATAMGGSVPSSHQTGGLKQILSGLRADGEEGRQVEALTHLCDMLSIGTEDSLSTFSVDSFVPVLVGLLNHESNPDVMLLAARALTHLCDVLPSSCAAVVHYGAVSIFCARLLTIEYMDLAEQSLQALKKISQEHPTACLRAGALMAVLSYLDFFSTGVQRVALSTAANMCKKLPPDAADFVMEAVPLLTNLLQYHDSKVLEHASVCLTRIAKAFASSPDKLDELCNHGLVTQAASLISTSGSGGGQASLSTPTYTGLIRLLSTCASGSPLGAKTLLLHGASGILKDILSGSGVSSNTSVSPALSRPADQIFEIVNLANELLPPLPQGTISLPVSSNLFVKESVVKKSPPSGNPGIQEDTNGNVHEISARAKLLNDKPELLKQFGMDLLPVLMQIYGASVNGPVRHKCLSVIGKLMYFSTAEMIQSLLSVTNISSFLAGVLAWKDPHVLVPALQISEILMEKLPGIFSKMFVREGVVHAVDQLILAGNATNISTQTSSAEKDTDSVSGTSSRSRRYRLRSGNSNPDANRSDDLKSPVPVNVGLPPSSVETPTTNSSIRASISSVANAFKDKYFPSDPGSVEVGVSDDLLHLKNLCSKLNTGVDDQRSKAKGKVEASGFDLDDDSTNTEEYLIGVISDMLKELGKGDSVSTFEFIGSGVVEALLNYFSCGYFSKDRISETNLPKLRQQALTRFKSFVAVALPLSIDNGAVAPMTVLVQKLQNVLSSLERFPVMLSNSSRSSSGSGRLSSGLSALSQPIKLRFCRAQGEKSLKDYSSSVVLIDPLASLAAIEEFLWARVQRGESGLKSTVGTENSESGTTPAGAGVSSPSSYIPSTAFRYSTGSRSRSSVNIGDTPRKEIFQDNGTSSSKSKGKAVLKPAQEEARGPQTRNAVRRRAALDKDAQMKPANGDSTSEDEELDISPVEIDEALVIEDDDISDDEDEDREDVRRDYYLPVYLPDEVHDVKLGDSAEESTVAPATSDSQTNAASGSSSKAGTARGCDSADFRSGYSSSSRGAMSFAAAAMAGLGYANSRGFRGGRDRHGRLLFGSSNDPPKLIFTAGGKHLNRNLTIYQAIQRQLMLDEDDDERLAGSDRVSSDGSSLWGDIYTITYQRAENQPDKASNGGSSSNTSKSAKSGSALNSSSEAKLHQTSVLDSILQGDLPCDLEKSNPTYNILALLRVLEGLNQLAPHLRTQMVSDSFAKGKILDLDELGVTTGARVLPEEFVSGKLTPKLARQIQDALALCSGSLPLWCCQLTKACPFLFPFDTRRQYFYSTAFGLSRALYRLQQQQGADGHGSTTEREVRVGRLQRQKVRVSRNRVLDSAAKVMGMYSSQKAVLEVEYFGEVGTGLGPTLEFYTILSHDLQQVGLQMWRSYSSEKHQMEIDRDEKKKKSDGSGPNLAGDGELVEAPLGLFPRPWPTNSDASEGSRFSKVVEYFRLLGRVMAKALQDGRLLDLPLSVAFYKLVLGQDLDLHDILSIDAELGKTLQEFNALVCRKHYIESIGGSYTDTIVNLHFHGVPIEDLCLDFTLPGYPEYTLKPGDEIVDINNLEEYISLVADATVKTGIMRQIEAFRAGFNQVFDISSLQIFTPQELDNLLCGCRELWESETLADHIKFDHGYNAKSPAIINLLEIMGGFTPEQQRAFCQFVTGAPRLPPGGLAVLNPKLTIVRKLSSTAVNTSSNGNGPSESADDDLPSVMTCANYLKLPPYSTKEIMYKKLLYAINEGRGSFDLS

SEQ ID NO: 156406 - protein, 186 aa, Glycine max
  Coding DNA Sequence Number=SeqID_64721
  Gene Ontology: Mol. function=DNA binding; Cellular component=nucleus; Biological process=regulation of transcription
  Homolog annotation: Hit_ID=Q0PJM0; Match level="QueryCoverage=81%, HitCoverage=64%, E-value=3e-76, Identity=90%"; Hit description=MYB transcription factor MYB48
MAEWHSPYGNGNRITLSISLSITILHTPIFLILPFLNHRWSLIAGRLPGRTDNEIKNYWNTHIRRKLLSRGIDPATHRPLNDSSHQEPAAVSAPPKHQESFHHERCPDLNLELTISPPHHPQPDHPHLKTLVTNSNLCFPCSLGLHNSKDCSCALHTSTANATATGYDFLALKTTVVLDYRTLHMK

SEQ ID NO: 156407 - protein, 629 aa, Glycine max
  Coding DNA Sequence Number=SeqID_64722
  Gene Ontology: Mol. function=binding; Cellular component=vacuolar membrane
  Homolog annotation: Hit_ID=Q9SW41; Match level="QueryCoverage=99%, HitCoverage=99%, E-value=0.0, Identity=70%"; Hit description =Putative uncharacterized protein T11I11.180
  Pfam annotation: Domain name=Arm; Domain location=178-218; Score =31.3; E_value=3.5e-06; Accession=PF00514.14; Description =Armadillobeta-catenin-like repeat
  Pfam annotation: Domain name=Arm; Domain location=219-259; Score =34.7; E_value=3.3e-07; Accession=PF00514.14; Description =Armadillobeta-catenin-like repeat
  Pfam annotation: Domain name=Arm; Domain location=457-492; Score=6.7; E_value=1.6; Accession=PF00514.14; Description=Armadillobeta-catenin -like repeat
  Pfam annotation: Domain name=Arm; Domain location=535-575; Score =22.9; E_value=0.0012; Accession=PF00514.14; Description =Armadillobeta-catenin-like repeat
  Pfam module annotation: Pfam domain module=Arm::Arm::Arm::Arm; Domain location=178-218::219-259::457-492::535-575
MSSIVKEILASPIQMADQVSKLAEEAQNFRQECLELKSKTEKLAGLLRQAARNSNDLYERPTRRIIDDTEQVLDKALVLVTKCRANSLIKKLFTIIPATAFRKTSMQLENSVGDVQWLLRVSASADERDDEYLGLPPIAANEPILCLIWEQVAILLSGASLDERSDAAASLVSLARDNDRYGKLIIEEGGVPPLLKLLKEGRMDGQENAARAIGLLGKDPESVEHIVNAGVCSVFAKVLKEGHMKVQTVVAWAISELAANHPKCQDHFSQNNAIRLLHSKYAIANKHKSIHSVLMASNTTSAQEEEDDKQMVAHPGANQSANLMHNVVSNTMAIKGAMVEEEKANNKKQQQQQQQQQQSGNNSQMSIAGTSIKGREYEDAGTKAQMKAMAARALWQLSRGNLTVCRSITESRALLCFAVLLEKGPDDVQSYSAMALMEITAVSEQHSELRRSAFKPTSPAAKAVVDQLLKVIEKEQPDLLIACVRSVGNLARTFRATETRLIGPLVRLLDEREAQVSMEAAIALNKFACTDNYLHENHCNAIIEAGGAKHLIQLVYFGEQMVQIPSVTLLCYIALHVPKSETLAQEEVLIVLEWCTKQAHLIEEPSIQPLLPEAKSRLELYQSRGRGFR

SEQ ID NO: 156408 - protein, 656 aa, Glycine max
  Coding DNA Sequence Number=SeqID_64723
  Gene Ontology: Mol. function=hydrolase activity, hydrolyzing O -glycosyl compounds; Cellular component=extracellular region; Biological process=carbohydrate metabolic process
  Homolog annotation: Hit_ID=A7P896; Match level="QueryCoverage=80%, HitCoverage=97%, E-value=0.0, Identity=71%"; Hit description =Chromosome chr3 scaffold_8, whole genome shotgun sequence
  Pfam annotation: Domain name=Glyco_hydro_10; Domain location=305-599; Score=151.0; E_value=3.4e-42; Accession=PF00331.11; Description =Glycosyl hydrolase family 10
MAMPGSLYIWSIVVGICYAVPLAITLPTASELFGLKYYGLIYNILIFNLPFGSFLFSGLLAGILYDLEATTTAGGGDTCVGAHCYRLVFIIMAAACVVGFFLDFFFVIQKACMTLLALTSLLHNGILISIDGPLYDSTAYTECKEKPEEPLYGGGLFKTEQHSRRGSIANNSYVPSLVLYNLTQGTIYSFSAWVRVKDSSSAMIRTTLETEKETHDCIGTVSAKHRCWSFLKGGFVLNWPSNLSIIFFQNADGKDINIDVASPSLQPFTKQQWRINQQYIINTQRKRAVTIHVSDSNGRRLEGASICVEQISKDFPFGSAIAKTILGNVPYQNWFVKRFNAAVFENELKWYATEPDQGKVNYTISDQMLQFVRTNNIIARGHNIFWEDPKYTPPWVLNLTGTQLQSAVNSRIHSLMSQYKDEFVHWDVSNEMLHFDFYEERLGPNATLHFFQTAHKSDPLATLFMNDFNVVETCSDVKSTVDAYISRVRELQRNGIFMDGIGLEGHFTIPNPPLIRAILDKLATLGLPIWLTEVDISKTLDRDAQANYSEEVLREGFSHPSVNGIMLWTALHPNGCYQMCLTDNNFKNLPAGDAVDKLLQEWQTGRVEGVSDVHGSYSFYGFLGEYRISVKYGNNTTKSTFSLSRGDETRHFTITI

SEQ ID NO: 156409 - protein, 296 aa, Glycine max
  Coding DNA Sequence Number=SeqID_64724
  Gene Ontology: Cellular component=cellulose and pectin-containing cell wall
  Homolog annotation: Hit_ID=A7PB97; Match level="QueryCoverage=92%, HitCoverage=93%, E-value=3e-66, Identity=48%"; Hit description =Chromosome chr16 scaffold_10, whole genome shotgun sequence
  Pfam annotation: Domain name=Phi_1; Domain location=32-296; Score =246.4; E_value=6e-71; Accession=PF04674.3; Description=Phosphate -induced protein 1 conserved region
MACVYPGQLLLLCLILSVVPIAVSAGNDAAPLTNHGGRLLTGKLNVGILWYGPIPKAQKKAILSFFRSLNMNTPAPDAAKQPQVSSWWNIVESYGAASGNNNNIPVKVVNQVFDPNYSYGKVLIKDFIKPLLPKATGGNKNTLALIIASKGVTVQDMCAGSCAQHGLIENQPYVAVGNPEEECPACAWPFLPSKGKTGAIMKPPNGNVGADAMVKLLAGGLAGAVTNPFGDGFFANAHGGDILEATSKCPDDLFATTKVSVDLKTGGAFNAVGDKGTKFLLPAIWNPKTSSCWTPL

SEQ ID NO: 156410 - protein, 252 aa, Glycine max
  Coding DNA Sequence Number=SeqID_64725
  Gene Ontology: Mol. function=hydrolase activity, acting on glycosyl bonds; Biological process=nucleoside metabolic process
  Homolog annotation: Hit_ID=A9P7V1; Match level="QueryCoverage=100%, HitCoverage=100%, E-value=5e-88, Identity=64%"; Hit description =Putative uncharacterized protein
  Pfam annotation: Domain name=PNP_UDP_1; Domain location=27-236; Score= -4.6; E_value=3.9e-07; Accession=PF01048.11; Description =Phosphorylase family
MAALGEQSEEQAMAAQPKPQNRRPISNIVIVVGVYAQWYRFPRGVPWVRYQGTYKDLNISLIWPGKDPTLGVDSVGTISSALVTYAAIQALQPDLIINAGTAGGFKAKGASIGDVFIVSDCAFHDRRIPIPVFDLYGVGVRKTFEAPNLVKELNLKVGKLSTGDSLDMTQQDESSIIANDATVKDMEGAAIAYVSDLLKVPAMFVKAVTDIIDGDKPTAEEFLQNLAAVTAALDLAVEQVINFINGKCVSEL

SEQ ID NO: 156411 - protein, 138 aa, Glycine max
  Coding DNA Sequence Number=SeqID_64726
MVTTARSASRNSGGERSTVLGGPANGGGDGKGRTVIWKMELGALTKGGSSGKGMTFIWPAGLHGGGKGSGGGATKTLGEFCIVTDKENGGMVGSTVGNLVEDTTKEIRIKWVGGREGGRERWGQRDKMVKGQKQEKEK

SEQ ID NO: 156412 - protein, 152 aa, Glycine max
  Coding DNA Sequence Number=SeqID_64727
  Gene Ontology: Mol. function=catalytic activity; Cellular component =chromatin; Biological process=auxin mediated signaling pathway
  Homolog annotation: Hit_ID=A5BR61; Match level="QueryCoverage=82%, HitCoverage=82%, E-value=1e-33, Identity=58%"; Hit description =Putative uncharacterized protein
  Pfam annotation: Domain name=Auxin_inducible; Domain location=1-80; Score=121.4; E_value=2.7e-33; Accession=PF02519.5; Description=Auxin responsive protein
  Pfam annotation: Domain name=Auxin_inducible; Domain location=82-150; Score=126.7; E_value=6.9e-35; Accession=PF02519.5; Description=Auxin responsive protein
  Pfam module annotation: Pfam domain module=Auxin_inducible::Auxin _inducible; Domain location=1-80::82-150
MAFRLPGFRRSSFSASQASSFKDEEVPKGYLAVYVGEKMKRFLIPVSFLNELLFQELLRKAEEEFGYYHPMGGLTIPFMEDVAEVPKGYLAVYVGEKMKRFLIPVSFLNEPLFQELLSQAEEEFGYCHPMGGLTIPCKEDVFLNIASRLNRL

SEQ ID NO: 156413 - protein, 28 aa, Glycine max
  Coding DNA Sequence Number=SeqID_64728
MDKPQLSEIARVQDQHGLIKRAKHDKTS

SEQ ID NO: 156414 - protein, 59 aa, Glycine max
  Coding DNA Sequence Number=SeqID_64729
MGDGCIYEEAERDRSRGFMWSVGAKGSPRVFWVLPMPTLTWTLSHTLTHNYINYIHSPL

SEQ ID NO: 156415 - protein, 63 aa, Glycine max
  Coding DNA Sequence Number=SeqID_64730
MCNTGLPFQEDQTSGEHLRGSDTAVAETCMKALDISCQKADEDNVKVEQNTVNDLAKETDLKC

SEQ ID NO: 156416 - protein, 49 aa, Glycine max
  Coding DNA Sequence Number=SeqID_64731
MKKEGTQQRSDLHFENSTADATMDIANDKWGQLFQIGKEGLNLLWKKFL

SEQ ID NO: 156417 - protein, 506 aa, Glycine max
  Coding DNA Sequence Number=SeqID_64732
  Gene Ontology: Mol. function=kinase activity; Cellular component =integral to membrane
  Homolog annotation: Hit_ID=A7P8P7; Match level="QueryCoverage=91%, HitCoverage=91%, E-value=0.0, Identity=74%"; Hit description =Chromosome chr3 scaffold_8, whole genome shotgun sequence
  Pfam annotation: Domain name=DUF300; Domain location=23-335; Score =453.8; E_value=2.3e-133; Accession=PF03619.7; Description=Domain of unknown function
  Subcellular localization annotation: CTP_CleavageSite=50; ConfidenceScore=5.18e-01
MNNSSSSSSSSSILIQLLFSSPPAWATLIAAAFLLLTLTLSMYLLFEHLSAYKNPEEQKFLIGVILMVPCYSFESFVSLVNPSISVDCEILRDCYESFAMYCFGRYLVACLGGDERTVQFMERQARLSVKAPLLQLSSSDKAIVNHPFPLNYFLKPWKLGRAFYQIVKFGIVQYMLTKAFTAILAVILEAFGVYCEGEFKAGCGYPYMAVVLNFSQSWALYCLVQFYTVTKEELAHIKPLAKFLTFKSIVFLTWWQGVAIALLSTFGLFKSPIAQGLQFKSSVQDFIICIELTVVRKHFVQPLTVTDSVPGPPWPRMPAKPYERMGDRFSGSVSVLGDYSADCPLDPDEIRDSERPTKLRLPTPDVDTKSGMTIRESVRDVVIGGGGYIVKDVKFTVHQAVEPVEKGITRFNEKLHRISENMKKHDKNGRRTKDDSCIASSSPARRVIRGIDDPLLNGSVSDSGMLRVKKHRRKSGYTSAESGGESSSDQGFGGYQIRGRRWVTKE

SEQ ID NO: 156418 - protein, 153 aa, Glycine max
  Coding DNA Sequence Number=SeqID_64733
CTMCGEAHETGQCIPTEENTREIHFMGELAEARGGSSNKPIQQRPNIFQRTTKLEETLTQFMQVGQLAKQIADKSSKSFGVNMENNPKEECKALMTRSKRLVEAEDEESVVYKEQMGEKKGVEVKENDGKGKENQEKGKKVMVQNKEMENQEK

SEQ ID NO: 156419 - protein, 57 aa, Glycine max
  Coding DNA Sequence Number=SeqID_64734
ENDRSHPAQVVAAQIRTLLFKHEGCTGLSTNHLDVTLTSSVGPECVELISFVQRAIS

SEQ ID NO: 156420 - protein, 190 aa, Glycine max
  Coding DNA Sequence Number=SeqID_64735
NTPLLPGQAILSVDEVKDADVAVPVPTVEVSLVGQALHTFLAWPTHLIKSLSKQVVVSSPKPPPRPDPKVDDPLYLMTLTIPELFLRPYQVRWDATLFGVVNPDFPLYIKHEDLSEIAHGGQCLNISVLRLWIMHLTETCMRAGNSDIYGFLEPQSIQRSGQSQFESESYIKSWMQSSQRDVYLGAYLNG

SEQ ID NO: 156421 - protein, 137 aa, Glycine max
  Coding DNA Sequence Number=SeqID_64736
  Subcellular localization annotation: CTP_CleavageSite=78; ConfidenceScore=5.09e-01
MSRAALGETPLVPPPQILTSGIVLTGPSQPNESKVGLISSCRQDLCPLLGRRSISPLTSRRLLSKARITMELGLRYMQGSIVSPALDGYFFIGESKVVVGRDVIDYTLETLHGYVLCYMGLVQNPDQQLPMRLGVHK

SEQ ID NO: 156422 - protein, 55 aa, Glycine max
  Coding DNA Sequence Number=SeqID_64737
MGEKEGIVASLDKMANSFNRMVEKMDGKVDDEDIQEVLHKGTDYGAKTAMDVDEA

SEQ ID NO: 156423 - protein, 46 aa, Glycine max
  Coding DNA Sequence Number=SeqID_64738
ENDRSYPAQVVAAQIRTLLYKHEGCTSFLPSPRLKIDLYIVQRAIS

SEQ ID NO: 156424 - protein, 37 aa, Glycine max
  Coding DNA Sequence Number=SeqID_64739
MKMLLIPHDMNGSGMEKEEREETPLQGEDESRRSSPP

SEQ ID NO: 156425 - protein, 87 aa, Glycine max
  Coding DNA Sequence Number=SeqID_64740
MARATLNDNLTPKHLWAEVVNFSEIMIPDFLTVGSSSNFVWISLSENGALSAIPTEGNCAEWPKAVLSPIIIEGNSAEQPKGALSEH

SEQ ID NO: 156426 - protein, 121 aa, Glycine max
  Coding DNA Sequence Number=SeqID_64741
MAAQLIRDRVEMECLEGAWETLEGNTRCRFRGTIRFTATSLVHPDEPARTLQRTVEWILPTPTPYRLVEPVQVIEGNAIREGDEDPLLEVDSPEEVMSASEADSMEDGGPGEMAISGGSSS

SEQ ID NO: 156427 - protein, 165 aa, Glycine max
  Coding DNA Sequence Number=SeqID_64742
  Homolog annotation: Hit_ID=A5AK77; Match level="QueryCoverage=55%, HitCoverage=11%, E-value=1e-11, Identity=38%"; Hit description =Putative uncharacterized protein
MTRGNPGDLKPFDPEIDKTFHRLVRHSVHPDHFVHFEHSEYSVASDSKYSDFEHSTTNFYIENMAQPPPHERTLREMAAPDFTYESLCIQYPDEGVPYVLKTGLIRLLPKFHGLASEDPYKHLKEFHIVCFTMKPPDVQEDHIFLKAFPYSLEGVAKIGYTTCSQ

SEQ ID NO: 156428 - protein, 162 aa, Glycine max
  Coding DNA Sequence Number=SeqID_64743
  Homolog annotation: Hit_ID=A2Q274; Match level="QueryCoverage=73%, HitCoverage=68%, E-value=3e-11, Identity=33%"; Hit description =Ovarian tumour, otubain, putative
MDCWGSLADCPSEQQFDECLKKLEIACAPWPMVESAHLSLKRLLQNSIGDLCSVWDAVNNMITLQHTQIKASFEQVHMSLDMCSKKPYTGGCLEWFQERVHYAGKNPSSCGCVMRTTLGLPCACELSKYVGGCIPLDSIHMFWRRLSFSDQGLSEPKVGIKD

SEQ ID NO: 156429 - protein, 70 aa, Glycine max
  Coding DNA Sequence Number=SeqID_64744
MPVDSLGGGRSLYTSPKTEVRSGRAFGHWIGGGGHLVLPIRYSNDGGPGKVGVWLRARNGFRHEQRRTSL

SEQ ID NO: 156430 - protein, 95 aa, Glycine max
  Coding DNA Sequence Number=SeqID_64745
  Subcellular localization annotation: CTP_CleavageSite=23; ConfidenceScore=5.26e-01
MAGRPMVISNSNIVNRGSTNPTRSSNVSNNDSTSGGRPKGMCLIADKLLDVLYDSGATHSFISHACVERLGLCTTKLPYDIVVSTPTNKPVTTSR

SEQ ID NO: 156431 - protein, 78 aa, Glycine max
  Coding DNA Sequence Number=SeqID_64746
MRGLHALALRGLHDLAFRGLHVLAFRGLHVLTFRGLQVVMQSYPARALARRLQLDWARDPRKGPRVLMSLRVDFEPMG

SEQ ID NO: 156432 - protein, 117 aa, Glycine max
  Coding DNA Sequence Number=SeqID_64747
MVKCLVKLQTKFREDPTVNEGWAAFLPRQLHVVFSRSFIKRLLAHSRHLLKDPNDQMIDKCLVKFKAEFREDPTIDEGWAAFLPRQLHVAFSRSFIKRLPLEASSRASLRSFLKRLL

SEQ ID NO: 156433 - protein, 289 aa, Glycine max
  Coding DNA Sequence Number=SeqID_64748
  Homolog annotation: Hit_ID=Q6WAY6; Match level="QueryCoverage=47%, HitCoverage=27%, E-value=7e-10, Identity=31%"; Hit description =Putative uncharacterized protein
MVSIWDLARVEVSMEPIASLAQYYVQPLRCFTFEDFQLVPTVEEFEEILGCPLGGRKPYLFFGFYPSTTRVAKYQGSVWRKGQRPWKIKANGLSFIDILALLIFGVVLFPNMEGLVDLAVIDAFLAFHHGKESPVVAILAMMSKGSLDGTRGCINYNPVLAIRQLGYLMRGVPSDESITPFIARGFSDHNARDRELRGSRNGIIGGYHKWLRVRTQGLDWLPNLKTVRDDEVKASEESDEVQALKAELERARVVEEKFKAAIVSPSSEEVKGIITGQRHDLEGRAKGLP

SEQ ID NO: 156434 - protein, 50 aa, Glycine max
  Coding DNA Sequence Number=SeqID_64749
MGAKHLTRTKQKLHVIKQRHNLHKRLTNLVDGSIDVALVKKFYENLYSSE

SEQ ID NO: 156435 - protein, 81 aa, Glycine max
  Coding DNA Sequence Number=SeqID_64750
MTKDNDCTSKPYTGAMKGPMHKPQANLGVMTKDNDCTSKPYTGAMRGIVHEPQVNIRADQKFSPVDVFKQEKKGRQALEFQ

SEQ ID NO: 156436 - protein, 187 aa, Glycine max
  Coding DNA Sequence Number=SeqID_64751
MASFSQMQSQMQSQGLALPPEPLVGPSGPQVSTKGSCIDPLGNDPETGYSDRCGLYIEADPACLVALGRVYEGSTVIHNTHLLPGQVKVGVEEVIDADAPVPVPTDETTVSLAKPPQKPDPEVDDPLYLMTLTIPELFLRPYQVTWDPTVFGVFNPDFPLYIKHEDLSEIAHGGQCLNISVLQLWIQ

SEQ ID NO: 156437 - protein, 20 aa, Glycine max
  Coding DNA Sequence Number=SeqID_64752
MHEMASEKASLQEIQEGQSG

SEQ ID NO: 156438 - protein, 76 aa, Glycine max
  Coding DNA Sequence Number=SeqID_64753
MAVGNDVCMIHDFEGKCLSRISSIPTINCLKGGDSEVEEEAAEEEEEAAEEEEEAAEEEEDAAEETESDDDSEATP

SEQ ID NO: 156439 - protein, 88 aa, Glycine max
  Coding DNA Sequence Number=SeqID_64754
EHEMELQRLNQNEETDKRKRSIALKASSSMQEEEEEEESDDEEHFSLFVKKFHKFFKNRRMERSHNFNNGKRSQEVSPTLKCYKCNPF

SEQ ID NO: 156440 - protein, 59 aa, Glycine max
  Coding DNA Sequence Number=SeqID_64755
MGKKLISFINRLVVMRLPLLMRMDVPKLQEYLKKHFREFRHVHCCPLKQDWVKDQAANK

SEQ ID NO: 156441 - protein, 229 aa, Glycine max
  Coding DNA Sequence Number=SeqID_64756
MSSFLSDSAIDMGGNDSGDSIQQPLMDQEVIFIGSSSKEDTRCNASDNESSSLERLRVSCHTGGGTSRLHRKTWPSATSPARELIPVIVILSPSFSKGARTSGRDIRASPHVRRSHSVGSPSSSPIVTGYDCVRDDILKYKSSLTFAVSVAAMQCQVKLANLDDSWKVVVQPCRSNDFSFLRAASGNSPFFFIYRCLFEVLDLILPLTASQCALLKHLNVVFSQLHPND

SEQ ID NO: 156442 - protein, 73 aa, Glycine max
  Coding DNA Sequence Number=SeqID_64757
MDAEFTERCVPRSLLEWGFKDSQGSKSKVATRWIIVKSLAHLAWLSICLLHSIATSYSHTLCMSFMLYMSHDT

SEQ ID NO: 156443 - protein, 86 aa, Glycine max
  Coding DNA Sequence Number=SeqID_64758
  Subcellular localization annotation: CTP_CleavageSite=20; ConfidenceScore=5.17e-01
HQVLHSHPPIHLLPRTQGSRSSNDPNTNSTSRGDQSGSQYFARMLQLYGINIGLKEHSNRVTPKAYTPKSSSGPLPPDSGPTQKTF

SEQ ID NO: 156444 - protein, 136 aa, Glycine max
  Coding DNA Sequence Number=SeqID_64759
  Pfam annotation: Domain name=G-patch; Domain location=13-57; Score =27.4; E_value=5.2e-05; Accession=PF01585.14; Description=G-patch domain
METSPLLPCLSSAALMVARVMLRHGYEPGMGLGKDSHGNADVVDIRGNLYKYGLGYEPGKPGRRNAPSRLRADRAWPGHVSQCFISARIMFEEEVVAIGEESPQDPPSFVRPCHPNSQVGNWRLMSQSEVYSAETM

SEQ ID NO: 156445 - protein, 86 aa, Glycine max
  Coding DNA Sequence Number=SeqID_64760
  Subcellular localization annotation: CTP_CleavageSite=48; ConfidenceScore=5.04e-01
LLSPIDLNVVGPLLLAQFLQGMTPILLSNSLYGNSQARKHIAAVGTTSNNMLSKRKTLDEGSLLSSKSETQHDHEFTSTPYVPMDP

SEQ ID NO: 156446 - protein, 288 aa, Glycine max
  Coding DNA Sequence Number=SeqID_64761
  Gene Ontology: Mol. function=motor activity; Cellular component=cell projection
  Homolog annotation: Hit_ID=UPI00016621D1; Match level="QueryCoverage =97%, HitCoverage=40%, E-value=6e-27, Identity=37%"; Hit description =UPI00016621D1 related cluster
RGLHVLAFRGLHVLTFRGLHAFAFVGLHVLNFTGLHALTFRGLHVLIFRGLHVLTLRGLHALTFRGLHAFAFIGLHALSFKGLHVLTFSGLHALTFRGLHILTFRGLHVLTFKGLYVLTFRGLHVLTFRGLHTLAFKGLHRTRCPRLHALAFRGLDALAFKGIHVLTFRGLHALTFRGLHILTFRGLHVLTIKGLYVLTFRGLHVLTFRGLHVLTFRGLHVLTFRELHVLTFRGLRALTFRGLHALAFKRRHVLDFSGLHAFAYRRLCVLTFNGLHICTLREFKVLCP

SEQ ID NO: 156447 - protein, 75 aa, Glycine max
  Coding DNA Sequence Number=SeqID_64762
MASYGGYFDDAKESRVKKNPKIQESSFKNQDSRFKNQALSFKIQDSRFKNQDSRIIKRFKTQDSRITRRLNQDKY

SEQ ID NO: 156448 - protein, 130 aa, Glycine max
  Coding DNA Sequence Number=SeqID_64763
MNFSEYLAPVGQICVMFGQCATYYIDWFYMISHPIMRPAWPEDPTRHPSVMHDDTYVEPDIPQYPVAATTMEEAPADAPSHDVCQEIVERLECLLNLRIVTEGSLEVSLWNAMYMCGRDEGSVWKTPEDI

SEQ ID NO: 156449 - protein, 140 aa, Glycine max
  Coding DNA Sequence Number=SeqID_64764
MTWNGTCPVMPSPISGDFLFSEGEVIVGCDVIDDPLKAFYGDVLGYVSFIQDFYQQSSVRLRAREQLQKGDSRRGLVELLNDFDSLCWIMRRNSPASSSDTSFLPYPSLPSGNSFIGASSFGSGITLTFYPSVKQYARVH

SEQ ID NO: 156450 - protein, 254 aa, Glycine max
  Coding DNA Sequence Number=SeqID_64765
  Homolog annotation: Hit_ID=Q84VH5; Match level="QueryCoverage=92%, HitCoverage=39%, E-value=5e-90, Identity=68%"; Hit description =Envelope-like protein
MIPGQAPVPEKLVPKRQQGVKISENPSLATSPREVDTEMDKKIRSIVSNILKNASVPDADEDVPTSSTPNVSVPDAEKDVPTSSTPNAEALPSPKVESDEEPIANKLAPGIAERLQSRKGKTPVKRSGRIKTMAQKKSTPITPTTSRRSKVAIPSKKRKEISSSDSDDDVELDVSTSKRAKKSGKKVPENVPDAPLDNISFHSIGNAERWKFVYQRRLALERELGRAALDCKEIMDPHHGCWTAEDCHQVGRLL

SEQ ID NO: 156451 - protein, 71 aa, Glycine max
  Coding DNA Sequence Number=SeqID_64766
  Subcellular localization annotation: CTP_CleavageSite=27; ConfidenceScore=5.26e-01
MLSGTEASSTLQTSSQRSQRSDHGQVSCEVANQMSRRSNGERRLSSIFTEAASWCYNLHRLELEAGAGLKA

SEQ ID NO: 156452 - protein, 41 aa, Glycine max
  Coding DNA Sequence Number=SeqID_64767
MYPPDAILPRKGPITRTMSKRLQEDWARAAEEGPRVLMNLR

SEQ ID NO: 156453 - protein, 178 aa, Glycine max
  Coding DNA Sequence Number=SeqID_64768
  Homolog annotation: Hit_ID=A5BSR3; Match level="QueryCoverage=55%, HitCoverage=31%, E-value=1e-07, Identity=38%"; Hit description =Putative uncharacterized protein
MTSEATKEIAKKIDSLEEQVSQGSFVPYGRQDLLTVAIGQPEHPDRVRTAGIGVTIKQYFGSAPQTSRTSSSMAPEELEQLTQQIRGQLEELITEKVTRQLICNHRDLHYLRSLRLVPQLLVSAQMGVVLIPQRSIQTRVTQTNTGCTSKKILPAWLPYEEFMRDPQPFTTSLCCMAK

SEQ ID NO: 156454 - protein, 76 aa, Glycine max; identical to SEQ ID NO: 151804
  Coding DNA Sequence Number=SeqID_64769

SEQ ID NO: 156455 - protein, 68 aa, Glycine max
  Coding DNA Sequence Number=SeqID_64770
MGVQIATRLTWDFQDVPLEGGCFWRKQPSPPGGRREEQKCSTLLVSEIHLKLVRKIVSVKKIQAEALP

SEQ ID NO: 156456 - protein, 243 aa, Glycine max
  Coding DNA Sequence Number=SeqID_64771
  Gene Ontology: Mol. function=protein binding; Cellular component =mitochondrion; Biological process=defense response to fungus
  Homolog annotation: Hit_ID=Q1SWI6; Match level="QueryCoverage=69%, HitCoverage=73%, E-value=2e-38, Identity=52%"; Hit description =Leucine-rich repeat, plant specific
  Pfam annotation: Domain name=LRRNT_2; Domain location=26-66; Score =51.0; E_value=4e-12; Accession=PF08263.3; Description=Leucine rich repeat N-terminal domain
  Pfam annotation: Domain name=LRR_1; Domain location=120-145; Score =10.0; E_value=4.3; Accession=PF00560.24; Description=Leucine Rich Repeat
  Pfam annotation: Domain name=LRR_1; Domain location=147-169; Score =13.8; E_value=0.67; Accession=PF00560.24; Description=Leucine Rich Repeat
  Pfam annotation: Domain name=LRR_1; Domain location=171-196; Score =10.8; E_value=3; Accession=PF00560.24; Description=Leucine Rich Repeat
  Pfam annotation: Domain name=LRR_1; Domain location=198-220; Score =14.1; E_value=0.53; Accession=PF00560.24; Description=Leucine Rich Repeat
  Pfam module annotation: Pfam domain module=LRRNT_2::LRR_1::LRR_1::LRR_ 1::LRR_1; Domain location=26-66::120-145::147-169::171-196::198-220
MNSSIYILVFVQLWLLSLPCRESVCIPSERETLLKFKNNLNDPSNRLWSWNHNNTNCCHWYGVLCHNLTSHVLQLHLNTSHSALYLYYYDDGFHRIFDEEAYRRWSFGGEISPCLADLKHLNYLDLSGNYFLGEGMSIPSFLGTMTSLTHLNLSDTGFRGKIPPQIGNLSKLRYLDLSCNEFLGEGMSIPSFLCAMTSLTHLDLSYTRFMGKIPSQIGNLSNLLYLGLGGSYDLFAENVEWVS

SEQ ID NO: 156457 - protein, 148 aa, Glycine max
  Coding DNA Sequence Number=SeqID_64772
MEDGQPCRMAEFIVGIVIGGGTSGKYISTMYSRLFIKTWLGRQQNDLISNMGSFYQNNWRWDLKWRRHLFEHEEGVVVAFMEEISAYPIECHLKDNFLWKADPTGMYSTRSTYRLLSNLNSFAPDGRNFQLIWKLKIPQRLPFSLGGL

SEQ ID NO: 156458 - protein, 289 aa, Glycine max
  Coding DNA Sequence Number=SeqID_64773
  Gene Ontology: Mol. function=N-acetyltransferase activity; Biological process=metabolic process
  Homolog annotation: Hit_ID=A6TC97; Match level="QueryCoverage=100%, HitCoverage=43%, E-value=1e-109, Identity=70%"; Hit description =Putative acyl-CoA N-acyltransferase
  Pfam annotation: Domain name=DUF699; Domain location=192-289; Score =42.7; E_value=9.1e-13; Accession=PF05127.5; Description=Putative ATPase (DUF699)
METLLDLTAQMAREGIRRLLVLSGDEHWCLAQAVELRERLGGDSLWVGALPQQEPCVASGALKTLLGREFLHAFFDARHGFDVAAFAALGGTLRASSWLVLLAPDFARWPEQADGDSLRWSDTSEPIATPNFVHRCLQLFSADPEVALWRQGDGLRLPEAAPRRDWHAADGYPQAEQAAILSSLLSSPPEIAAVTAGRGRGKSALAGMLIHQLAGSAIVTAPTRDATAVIAAFAGQKMCFMAPDALLASDAKADWLVVDEAAAIPAPTLRQLTARFPHTLLTTTVQGYE

SEQ ID NO: 156459 - protein, 105 aa, Glycine max
  Coding DNA Sequence Number=SeqID_64774
GLEKPIEQCSSLSFIDSDITTILLNFTGCCAADDESDEQNDGDSDEVYFIEALRKRRDREAPFGGGDSDCGDAEVTKVAASDGHVDYKLGVAEGGVEGAKAGNGN

SEQ ID NO: 156460 - protein, 366 aa, Glycine max
  Coding DNA Sequence Number=SeqID_64775
  Gene Ontology: Mol. function=N-acetyltransferase activity; Biological process=metabolic process
  Homolog annotation: Hit_ID=A4W4T4; Match level="QueryCoverage=35%, HitCoverage=87%, E-value=3e-66, Identity=93%"; Hit description=GCN5 -related N-acetyltransferase
  Pfam annotation: Domain name=Acetyltransf_1; Domain location=130-209; Score=35.9; E_value=1.5e-07; Accession=PF00583.15; Description =Acetyltransferase (GNAT) family
GFAVGRRRTHCVTSTQKVYAIEDERAIPARILTGPQFYRRNEVLAETGGAVSALTPEVSTLCYVNPGAGNRRRKGNAMSRLLIEPVTPDEPGYIALKAESIALNFNMLRRLEENWQRGENRFNAPGEKLLGAFLNGKLVGVCGLNRDPFSQQPRAGRIRHLYVSEKCRGLGIGKQLLTVVMADASIWFDFLNTHAPDTAYGFYRRAAAPLRYCAGVAPLLSTVFCCKLAVFSRLLRLTGGVHRAGGEDLSGLRYESNLPADARHRPTAGGADQRPGARRSSLLAGLSRTRDLAGATERLFDLRIYAGGRHRGAALGHCAGLHAVDLLYDRFLPAELGDGGASALSLWLPASALDTGAARAASVPWA

SEQ ID NO: 156461 - protein, 132 aa, Glycine max
  Coding DNA Sequence Number=SeqID_64776
ESYVKQAHKKRKEVVLEHGDDPEHLRTNVFQEGGNDENPEIGQIQAKGPSGEGQRPKWRRIKPPSNPCGVYPYLSSFIGSGVYPDLSSLTGSGVYPDLSSFTGSGVYHDLSSFTGNGVIQTFVACIKRSAPS

SEQ ID NO: 156462 - protein, 143 aa, Glycine max
  Coding DNA Sequence Number=SeqID_64777
MTKNRVLKEHNKTFLNWFKDTIFSDDNAFETLRKHMVTPPSFPPPLPESATPSSSMLKKIIKATWLRSLATRQVGAERLVVHRDPATGKADGPYRKKLRTYLGIVAHDKVDVTYDNLKQVPATQKDLIYEDIQAEFDVPKASN

SEQ ID NO: 156463 - protein, 245 aa, Glycine max
  Coding DNA Sequence Number=SeqID_64778
  Gene Ontology: Cellular component=integral to membrane
  Homolog annotation: Hit_ID=A4TPX0; Match level="QueryCoverage=82%, HitCoverage=99%, E-value=6e-70, Identity=68%"; Hit description =Membrane protein
  Pfam annotation: Domain name=UPF0126; Domain location=131-216; Score =119.3; E_value=1.1e-32; Accession=PF03458.4; Description=UPF0126 domain
  Pfam annotation: Domain name=UPF0126; Domain location=44-129; Score =129.0; E_value=1.3e-35; Accession=PF03458.4; Description=UPF0126 domain
  Pfam module annotation: Pfam domain module=UPF0126::UPF0126; Domain location=131-216::44-129
LLGAAAAGAGDRAERRLVQPRRAAHPVGGAAAVPPAGGDPLMLVFWLDILGTAVFAISGVLLAGKLRMDPFGVLVLGVVTAVGGGTIRDMALANGPVFWVKDPTDLVVAMITCVLTLLLVRQPRRLPQWVLPVLDAVGLAVFVGIGVNKAFAAGTGPLVAICMGVITGVGGGIIRDVLAREIPMILRTEIYATACIIGGIVHATAFYTFSMPLQQAMMLGMIITLAIRLAAIRWHLKLPAFILER

SEQ ID NO: 156464 - protein, 202 aa, Glycine max
  Coding DNA Sequence Number=SeqID_64779
MNAERVEDSLDLERVEDSTNAERVEDSLDLEIVEDSMDIERAKSAALFSLEDQAQFSLSYSSDCSDRIHKRQRDGEEIKPPLVLSSCESFFSLQEYYLENPNGGSVRNYISNNISKFNENPTLKYNVEIPNGENARNWVANVVLKFHDDPTVNESEIVIFLRHVRWLTGKERALGEKRKKRKCEAEEGGRGVRLKTESCCYL

SEQ ID NO: 156465 - protein, 135 aa, Glycine max
  Coding DNA Sequence Number=SeqID_64780
GIEPIDNLQRGLLSGSMNPLVVGKFYMRKILIPRLMVAYQKSPKKDHKVFQKWLRKLASLSDTMVLGKPWSLTTSLKKSFEMWEASSTLWHGIKCAFLLNLSTTIEIESTPLWVLGSPRRKSILMSTQGADGMGK

SEQ ID NO: 156466 - protein, 330 aa, Glycine max
  Coding DNA Sequence Number=SeqID_64781
EIYHQMLSAFENFPHLRTAYIYAALHSPHRRLPAGLDLSSVATDKSLGDRHVLQRLGSVRPTRLDDINCSPSMIGERAFFGGVARGFPMVCAGCVRVIPLWKRRLVDLLGRYHSHLVGDEGWQEVFVRHWDQGELWSWPQGKFLIALKPAPKLALPMGAGALDCTGAELEESPARATKLSCSDPPSVGTCGGDVIELPSLQTYFNSFPGEYQVHEAGRHVPPSLSVLFKGLTFLFNHVLQLSPIGSHIGIVLILPKEGTNQILPSADAGSFQISVPNDHGSSQAILEKICHVRERIVAKAFNSSQSLFDEIEFPSFFRCRARPSVDSGIL

SEQ ID NO: 156467 - protein, 324 aa, Glycine max
  Coding DNA Sequence Number=SeqID_64782
MAQTWSVFSYSNLAPTSPTLNLNIDRARLIYGLITRMDMNIGGLITGQMTMMAQSNSSHLGFPALITTLCRSKGMRYDALTFYENLWPVIDLAYIIRNCWNLNDQTVNFLEVRKTKLRAVDVPFSFAPIAGIPASSTSAPLPALAGLPAQSSQTSDAKFQSLFEGQILIIQSLQELVQQRPIMSVEQFIEKMAWLGAQPSFVGDNESFTAQAPQQHEPEPENDHSSEATIPGVVDFAKRRLETRSNEAAHPGPVPASADAPFRVVDPSSPQHAADASTHVLEIHEGQTIPVLPLDTSPPATLIWHLTDEKDVQIQDNQDQSQEF

SEQ ID NO: 156468 - protein, 97 aa, Glycine max
  Coding DNA Sequence Number=SeqID_64783
  Gene Ontology: Mol. function=catalytic activity; Biological process =cellular metabolic process
  Homolog annotation: Hit_ID=A7Q5D6; Match level="QueryCoverage=83%, HitCoverage=50%, E-value=3e-19, Identity=60%"; Hit description =Chromosome undetermined scaffold_53, whole genome shotgun sequence
  Pfam annotation: Domain name=RNA_pol_III_C17; Domain location=1-87; Score=14.3; E_value=3.8e-06; Accession=PF09417.1; Description=RNA polymerase III subunit C17
MLVLDFLRAKGASKDPTRVIAKVVQSEYKRVYDYLADTTASVQTRESINEFLTSVKQHDLAKVEVLNILNIGPAADFELYLVIIKILIFPFMLHLSI

SEQ ID NO: 156469 - protein, 25 aa, Glycine max
  Coding DNA Sequence Number=SeqID_64784
MTLPRTSYPAVHHTLDPWEPANKME

SEQ ID NO: 156470 - protein, 114 aa, Glycine max
  Coding DNA Sequence Number=SeqID_64785
MSFHCSTVLWECYVRGGICGRDGSNCRVAANNLSLASDVVCNSIIQTKSSLKLCSWQLSQPTLLRASEARLTGTSSIGGKCAESPPMFIERKTLEKPKETGHEEYSRFGSYLYV

SEQ ID NO: 156471 - protein, 378 aa, Glycine max
  Coding DNA Sequence Number=SeqID_64786
MTSKKHKSSDSRPQDQNDSKRFQSEEAWNRYIDNILDRRILPERNVELYHSKFDEFKIELERRNLHKRFANLQEGSIDVAVVKEFYANFYSPADQAPKYARIRGHLIKIDVDSLNEFLQTPVLLEEGESNVNLTGRNSVFSYSNLASTSRTSDLSTDRARLIYGLITRMDKNIGSLITGQMTMMAQSNSSHLGFPTLITALCRSRGVGSDALTSCENLWPTMDLAYIIRNCWNLNDQIVNFLEVAWLGAEPSFVGDNESFTAQAPQQHEPEPENDHSSEATIPGAVDFAKRRLETRSNEAAHPGQVPASADAPFPGVDPSSPQHAADSSTPVLEIHEGQTRESDEKREIDLIIVKDNFAEDEGDGSATDKGKEIPIEV

SEQ ID NO: 156472 - protein, 267 aa, Glycine max
  Coding DNA Sequence Number=SeqID_64787
  Pfam annotation: Domain name=Transposase_23; Domain location=25-95; Score=-2.3; E_value=0.0021; Accession=PF03017.5; Description =TNP1ENSPM transposase
EVGPSAARVSTKESCVDPSPTNPETGDSDKCGLYIEENPSRLVALGRVYEGSTAVHNIPLFHGQVKVGVMEIKDAEASIPVPTDEVQLVGQALNSFLVWPTHLVKRVSKHAAVYLAKPPDRPDPEVDDPLYLMTLTIPQLFLKPLQVMWDATVFGVFNPDFLLYIKHEDLSEIAHGGNSDVYRFLKPQSIQRSGQSQFESESYLKCWMQSSKRDVYLGAYLNGPDNYLKGIVNSALKGLHDTPQPKSNAGARWIVVKYFNDVRPLEA

SEQ ID NO: 156473 - protein, 119 aa, Glycine max
  Coding DNA Sequence Number=SeqID_64788
  Gene Ontology: Mol. function=transporter activity; Cellular component= membrane; Biological process=oligopeptide transport
  Homolog annotation: Hit_ID=A7Q2Q4; Match level="QueryCoverage=49%, HitCoverage=9%, E-value=3e-11, Identity=47%"; Hit description =Chromosome chr1 scaffold_46, whole genome shotgun sequence
  Subcellular localization annotation: CTP_CleavageSite=32; ConfidenceScore=5.32e-01
MGLIVVSLTSWLPELHPPSCTPQQLASCQSLRANSSQIGVLLMGLCFLRSGSTGVRPCTPLSQWYCWTLKQWWSTSLHNHVLCGHKEEETENASSTSSKENLNLIQQDDQPSSTDDNDI

SEQ ID NO: 156474 - protein, 113 aa, Glycine max
  Coding DNA Sequence Number=SeqID_64789
GFDDAKVESNKVASTNIQRLNIASRLIQGQVNKIKQQNIRAQTISLVDQAFSSKHIVSNIQGSETGCLLDCENCNQETGCLLENLEHKGEGSQGVFKVCKGFTEIVKNLKWIA

SEQ ID NO: 156475 - protein, 125 aa, Glycine max
  Coding DNA Sequence Number=SeqID_64790
MWIIHLVLKPKASMPLNPRRDVEIEEAINTARVDKKKQTMTLGCEFPCGDLVPAFGLEVGAILATGGKGGSATLDSIKGRPVRVTMFCENAPTIWDQHRIKGALKPGDPKGLHSEESVRPLLPDS

SEQ ID NO: 156476 - protein, 181 aa, Glycine max
  Coding DNA Sequence Number=SeqID_64791
MKTLKTIVDGKNDQGTPKWIEVKSHAQSGGYACGYYVMYWMWNIISRGLKNDCSLWFADGTPSLHHATNEKLSSIQGAPLFTSNQSIPDFMYSSSNLLTPSCTFLMWQAFSSSMRCLTLALAKPALVPLLPCRVNKLCVSVDFDYSKCGWLIFGGFQALRSVLPAFGTMMRSPPRVNAPKD

SEQ ID NO: 156477 - protein, 217 aa, Glycine max
  Coding DNA Sequence Number=SeqID_64792
MICTGSLSAPLHLSKRTASVHLLSEKESLDWDSELCMSRVSRERKVQVPKSFERFCCVKICRDQSLKQEPASWYGKLDPLLDLPCRAELSCFHEESGCDKLVGYVCLNAVLVEFSLTRGICVRCLIMIRLNYDEESGFSISGDTIRTTMGEGFNYLEKGLKNNLEKYFLKSSPFAKRKPRAKRISVHMLSCESQALSAQPLHLRLIWSAKLAKVELS

SEQ ID NO: 156478 - protein, 73 aa, Glycine max
  Coding DNA Sequence Number=SeqID_64793
  Homolog annotation: Hit_ID=A5BP71; Match level="QueryCoverage=69%, HitCoverage=13%, E-value=1e-08, Identity=49%"; Hit description =Putative uncharacterized protein
  Pfam annotation: Domain name=zf-CCHC; Domain location=46-63; Score =10.4; E_value=0.04; Accession=PF00098.14; Description=Zinc knuckle
NEATIPPSDDAWALIPDPTTIRAKSRPKSTRIRNDMDWLEPSEHRQKCSRCGVKGHNRHRCPMQSDRGSCSFN

SEQ ID NO: 156479 - protein, 128 aa, Glycine max
  Coding DNA Sequence Number=SeqID_64794
  Gene Ontology: Cellular component=integral to membrane
  Homolog annotation: Hit_ID=A7NVD9; Match level="QueryCoverage=64%, HitCoverage=30%, E-value=5e-12, Identity=48%"; Hit description =Chromosome chr18 scaffold_1, whole genome shotgun sequence
MAGIRDAKSILVKLEWFLNWVTFVARSVPHILITAKLIKDTYKFEKGMELPLALLGMAGMNLLNIGLGIDLLKAFMRERRSQQASSMHPDKLSFTNLFLVVPNHAEQDQGGRAEHQPTLRISLAVSVC

SEQ ID NO: 156480 - protein, 64 aa, Glycine max
  Coding DNA Sequence Number=SeqID_64795
  Subcellular localization annotation: CTP_CleavageSite=35; ConfidenceScore=5.14e-01
MSVKNHPGRSGVHNKTHHTMGLSGLKKHSNPVTPKAYTPKSSSGPLPPDSGPTPKIILAHRHCS

SEQ ID NO: 156481 - protein, 169 aa, Glycine max
  Coding DNA Sequence Number=SeqID_64796
MTDEGEAKVEKPMADKDKKSMLEKAYSAIMLSVGDKHQGVVPVVVFHTHVVPTPTRRRLRSCSSAHHFCCWRHCSSSSGRGRWTPSATRRGSAARGTGRTAAVKASPMRTWMSSRPAYIELGFGFDIPPPRLSAINASPILYPLSASTTPSTNATTTPLSYINIIETRL

SEQ ID NO: 156482 - protein, 67 aa, Glycine max
  Coding DNA Sequence Number=SeqID_64797
MDFQKERRYKRCEHDRFKARIVSRGFTQKEGIDFNEIGRSKWNGNMGNWDLVLRVHPPLGTLPSPFR

SEQ ID NO: 156483 - protein, 73 aa, Glycine max
  Coding DNA Sequence Number=SeqID_64798
  Subcellular localization annotation: CTP_CleavageSite=42; ConfidenceScore=5.07e-01
MKKGCHQSDNYQSNGRGIEKLSLAHQWTKRASTAKHSFSALSATEESGRASSSRPRAKCEISALSAAVVFSQA

SEQ ID NO: 156484 - protein, 74 aa, Glycine max
  Coding DNA Sequence Number=SeqID_64799
MKPFKFLRRTGCSSRVGEKDNHIPLDAVKKAIPMDKWMDDQKSKFCLNSCTRNALLCALSEEEYSNVHNFRSAK

SEQ ID NO: 156485 - protein, 126 aa, Glycine max
  Coding DNA Sequence Number=SeqID_64800
MSELDESFAKMKIEDIIKFVVASGQNQTAPNPPMENHPEKVKEPIRAKLSCLTLVTVQNKRSFDVLVKGGKDTKREDKRVFSGFFSRPQLAHASLWLAWAPKWLRAEVISSPERAASPPTALFCYK

SEQ ID NO: 156486 - protein, 116 aa, Glycine max
  Coding DNA Sequence Number=SeqID_64801
KHGHFKSDCPKLEKSKDKYKYYKSKEKKSFVSTWENLGDTTSNEEGKEEANLCLMQFSPAPVLRMTKRTGARASRTNFLFGLDSGEGKGLENLSNPPPNLISFCLMARIIWVYYKK

SEQ ID NO: 156487 - protein, 479 aa, Glycine max
  Coding DNA Sequence Number=SeqID_64802
MAPKKLLTKKARKTTAGEGSIGLSFLKERRVQLREGEYTEFQAEGQWIPYDEDAIKQFLGHPLVKEEGQQCEYSEKRRQVSGFDEEAIGQLLCSLGQDFARSVTGRQVRIMRTSMTTLTQVWMTLLLSNILPSDHNSDLPLPKCQLVYAIQTHISVHSNRALRFSALITGLCQFYGVSIMPPKLIGPPINRSFIEKYCMPRQAQQPGQDQNNPPSASSEEGSPVQITSTTPVTILVVEVMTKDKEPRVRVGHFFDINSPKNANYVIKAHLLLCGINHFFEDPKVIVNKAIIYKEGSKDFLFNAHKFILYHLMKGISFELPQILFNCFGTKVMNDKSIGKDIYHSVILTKMCKTKSTQENISKMRLLNDESFQQVPNVNDSILAELQQKFGLNTGRDDRLDTVWEKATKEERMDKEEEVAPAKQRMKKRMDATPSKAALPQQRPPLTLVAPKAIGVVANVSKRPATKKQQQPSPSTKGKD

SEQ ID NO: 156488 - protein, 264 aa, Glycine max
  Coding DNA Sequence Number=SeqID_64803
  Homolog annotation: Hit_ID=A7PEL3; Match level="QueryCoverage=43%, HitCoverage=40%, E-value=1e-16, Identity=47%"; Hit description =Chromosome chr11 scaffold_13, whole genome shotgun sequence
MVEHSHTSVVDHLGSCIAIWILEPQSIHNAKDRRGQCEEYIGKWLKESQQQVYLGAYLNHAFKALKTTDDGKVPQTTPQWIEVKSHVQQGGYECRYYVMHWIWNIIIGELKTDWSLVPVDGFEGIIDEGVAKVVAGLALKVSDRNKSIEKATEVRLGLPGCESPEREGVFKSVVVSGAKRGFSDAIDGNCNGGGSEKDVAALFSPTSRGAVSVSVSVAKSLTLTTQDYTNHPIALGASVLCETVPHSPKPLHENKPQICAPAAK

SEQ ID NO: 156489 - protein, 200 aa, Glycine max
  Coding DNA Sequence Number=SeqID_64804
  Homolog annotation: Hit_ID=Q9C9E9; Match level="QueryCoverage=32%, HitCoverage=38%, E-value=9e-16, Identity=62%"; Hit description =Putative uncharacterized protein T10D10.2
  Pfam annotation: Domain name=DUF1677; Domain location=34-101; Score =4.5; E_value=8.2e-07; Accession=PF07911.4; Description=Protein of unknown function (DUF1677)
MSAPMIIDPMVISAPETQSAAASILVAQSELEFAEAVKDEIVRFDKLVCIEEAMAKHMNLTNKLKASRPPPNPALHLISAMRQILRRTLDSPKLKRTWDDAAPVVELCKVSKFDRGVQLTLFVFKLIKLGGHELRAGEGNKNRRFNNDPHTIVIENPHDNLDCIMNTSVGKPSQGQARQCWKAFTMRNKASRDKRHKMSE

SEQ ID NO: 156490 - protein, 88 aa, Glycine max
  Coding DNA Sequence Number=SeqID_64805
MTRSARQIRSASGICLARHTTCLADWETLEEDKPKMCSPNAQPARPARTLSLLALSTPYLAKPKIHLLSLSEPVLLSEPAEAERSKSL

SEQ ID NO: 156491 - protein, 159 aa, Glycine max
  Coding DNA Sequence Number=SeqID_64806
MEVNEKMRKVECFTCEEKYNPAHVRKNKQSRLMIMEEEEGDPKKNQWEDREEEEMNTRLDVKECINLYLLSCKIYSSDKIVICLSWGSDLVLGVEWLAGLGEVEVNFEKLTLAVKAAINMKMIRGTKLESDKGFMVELKTIEGENSEEAILDLVVQVLK

SEQ ID NO: 156492 - protein, 69 aa, Glycine max
  Coding DNA Sequence Number=SeqID_64807
MEDGVHCPLEGVRRLASAPDRASGIKRLILVKRHPQIPFVGLNLTRTALRHTYQQLGYRTPIPRDNTIN

SEQ ID NO: 156493 - protein, 119 aa, Glycine max
  Coding DNA Sequence Number=SeqID_64808
  Gene Ontology: Mol. function=aspartic-type endopeptidase activity; Biological process=DNA integration
  Homolog annotation: Hit_ID=A5AT67; Match level="QueryCoverage=72%, HitCoverage=7%, E-value=8e-13, Identity=44%"; Hit description =Putative uncharacterized protein
MTKSEIWHARLGHVHYKRLKDMSKTSMIPPFDMNIEKCKTCMLTKTTRKPFKDVKNEALDKFKIYKKEVELHQNGLIKTLRTDRGGARKKMTTYISMKFSRFKKLGLGFDMLMKDRDTG

SEQ ID NO: 156494 - protein, 163 aa, Glycine max
  Coding DNA Sequence Number=SeqID_64809
MQQGQADILIARFPDPNYGVKTGFVLYRNCKPSWKIPLQSTGSSRWGVSMENNNGLWWLMVAVGDGESAGNFRNGFGRKKEEEMTFFLSYTKAKAELRAHSRDLLKDPNGQIVEKCLVKLQTKVREDPTVNKGWAAFLPRQLHVAFSRSFIKRLPPEASSWLL

SEQ ID NO: 156495 - protein, 550 aa, Glycine max
  Coding DNA Sequence Number=SeqID_64810
  Homolog annotation: Hit_ID=A7R5N2; Match level="QueryCoverage=99%, HitCoverage=99%, E-value=1e-180, Identity=63%"; Hit description =Chromosome undetermined scaffold_1009, whole genome shotgun sequence
MGGVSLRESWCFCKGVSKSERMKAAIFTGKAQAMATIAATAAPNGASGTGFLIHRNLLLTTHANLPSVVAADTAEIRLHNGVAATLAPQRFFITSSVLDLTIVGLDDGDGDSNAQGQCPHYLKTSCKANLDLGSAVYLLGYTEKQELTVGEGKVVIATDNLIKLSTDGIQWSPGSAGFDVHGNLAFMICDPMKLATSPNTKSSSTSTSSSSSSWKKDHPMQFGIPISVICDWLNQHWEGNLDELNKPKLPIMRLMSTGQKSDHSCASFTLRQVFKSTEGDDDGTPSSSNNALKARDQGPSSSAATNTVEEESLITNPNAAHVQGIPTPEIYESPRVTAGPLRRKENIPLQLLDINFPPRTAKHAVFPQLSKPKCAENLAKEPLPENQVEGEQNKHTRPTTPIPDVSSTGSVNGAAQSEVQSSSSPVEVHEMQNGYSSEGETMYSAETAESRNYTSPRELKFQQVGRSQSCVSYNRWGAAPRSQVARGMMVENQRSFMHVKRMYSQGATTSQRSNDYFSPTVSSIMKRNSSSSKPPPRQSAVHSPSPRWMF

SEQ ID NO: 156496 - protein, 57 aa, Glycine max
  Coding DNA Sequence Number=SeqID_64811
MSPKKVAYFGSFQDIVEAKEYLQQKGVDETISHDLFMVVTEVSDVDSDKGSSLIPEC

SEQ ID NO: 156497 - protein, 316 aa, Glycine max
  Coding DNA Sequence Number=SeqID_64812
  Gene Ontology: Mol. function=thiamin-phosphate diphosphorylase activity; Cellular component=intracellular; Biological process =thiamin biosynthetic process
  Homolog annotation: Hit_ID=A7PU60; Match level="QueryCoverage=48%, HitCoverage=19%, E-value=8e-58, Identity=69%"; Hit description =Chromosome chr7 scaffold_31, whole genome shotgun sequence
  Pfam annotation: Domain name=Dynamin_N; Domain location=199-309; Score=-1.3; E_value=8.6e-06; Accession=PF00350.14; Description =Dynamin family
  Pfam annotation: Domain name=MMR_HSR1; Domain location=197-309; Score= 21.7; E_value=1.1e-05; Accession=PF01926.14; Description=GTPase of unknown function
  Pfam annotation: Domain name=Miro; Domain location=198-309; Score= -0.6; E_value=0.011; Accession=PF08477.4; Description=Miro-like protein
  Pfam module annotation: Pfam domain module=Dynamin_N::MMR_HSR1::Miro; Domain location=199-309::197-309::198-309
MVVTPIPTPSCVREPSKLKIQVDMYNFKGFPGIGDTSISGDNLVVWFCPLRKKPDAAIKNASHVQTGNYECGYYVMHWIWCIVSARLKDEWISSTYAFYRYNAYGHCSEGEDTHSGMSNKEANAKFMEAMYMTKYRKAKKGIQFLINGSKVGKILCSLSPFPPVLNEAIEVMKRAAPLILEEVSLLNDAVSQIDEPFLLVIVGEFNSGKSTVINALLGERYLKEITFLRYTDLDIEQQHCERHPDGQYICYIPAPILKEQRLTEEFVPRADLLLFVIFVDRPLTGSEIAFLRYSQQWKKKAVFVLNKADIYQNNHE

SEQ ID NO: 156498 - protein, 193 aa, Glycine max
  Coding DNA Sequence Number=SeqID_64813
  Gene Ontology: Mol. function=helicase activity; Biological process =viral genome replication
  Homolog annotation: Hit_ID=Q2A9E0; Match level="QueryCoverage=95%, HitCoverage=12%, E-value=2e-30, Identity=39%"; Hit description =Putative uncharacterized protein
MQNYQHAKRSRFCKSQDQQKTFSSNFMTPFEDCQSPTNQPVINIEGYSDLGDQLIQCRYCNAQMWYDERISKNKNCHNPRFSLCCGDGKVELSLLQNLPQYLQQLLFHDDTIDSKNYQHNLRAYNMMFAFTSAEIKLDKTINNSKGPPTIRIQGQPCHRIGSLLPMPGKKPKFAQLYIFDTENEVQNRINVMR

SEQ ID NO: 156499 - protein, 327 aa, Glycine max
  Coding DNA Sequence Number=SeqID_64814
MSPAPAAPASPASSRGAGPAAAAHSGRAHQGQETDLLQGHAGHRGPRLQGAAGQGQRQSAGEPQDQQGRDAGTGVDVGYSGNDGLLKRAGRAHGRARRACGILGAGARAVSRRFRMSGRGEAVHRQGAAPAGEGLDLAPFVESGALQDAQAQLAGQLFEVAQRAQVDVGRVVPLVGHLARHRHAPAQDGPAVRPVAEVGKRHHAVARHPRHLAQDVLGAVHGLQRLRQHHGVELLVVEQGQAVFQVLLDHLDPAPHAGDDAGVVQLDARAAHLAVIAQVRQQRAVAATQVQHPAAGFDPAGDARQVGAQRIDGGTGSHGIHAERPSV

SEQ ID NO: 156500 - protein, 73 aa, Glycine max
  Coding DNA Sequence Number=SeqID_64815
MWYHVSEKPHLAPRSTWQDRPHTGRPVRITLFCENASTMWDRHRLKRSLKSGVFTPRPRLRRVRQGLSLLIQV

SEQ ID NO: 156501 - protein, 119 aa, Glycine max
  Coding DNA Sequence Number=SeqID_64816
MVMRGQDIYSSQEETTFFPSSSGSEDEVRDEESSEEVYPQEEGDLLMVPFSIGTVTTYPSAGGRKGQNRWAKAFVSKGENKRSRLADFHPLAKPIWWLSEISSKHNNPQLSTRKDLEEG

SEQ ID NO: 156502 - protein, 108 aa, Glycine max
  Coding DNA Sequence Number=SeqID_64817
  Subcellular localization annotation: CTP_CleavageSite=21; ConfidenceScore=5.07e-01
MTGFLRFFPTFSRNKRWWRLRAFTSFGRCTCEPRFARPQKGRQWRKAGVAAHDVQRYVKESDWAAQCTRQDKMSNEELKLQDPRCRIQCPGHPSRKYWTHKSVISLTD

SEQ ID NO: 156503 - protein, 248 aa, Glycine max
  Coding DNA Sequence Number=SeqID_64818
  Subcellular localization annotation: CTP_CleavageSite=51; ConfidenceScore=5.23e-01
YQQQRQWQNHSGNQFNRDQGGPSSRPQQQMPSLYDRTTKLEETLAQFMQVSMSTQKSTESAIKNLEVQVGQLSKQLAERSSNSFTANTEKNPKEECKAVTTRSRMVIQVEESRADQKVEGFKQQLAAQPALEPLDDFVELEEVNEETEVRPIEKRRSKLLLLKARTYPIHWYLPGKTKRDIWPDFLISSRNWKLPCLFEKNFSKCPSVATYPLAGGRREAHRMHHPLEENARSRQQRSFEENVEKIGK

SEQ ID NO: 156504 - protein, 86 aa, Glycine max
  Coding DNA Sequence Number=SeqID_64819
  Subcellular localization annotation: CTP_CleavageSite=50; ConfidenceScore=5.37e-01
MDTSAPYTGAMKDTMHKPQANLGADQKLSPNRFPATRGLRVLASRGLHVLASRGLYMLAFRGLHVLNFRGLLVLDIRGLHVLASRG

SEQ ID NO: 156505 - protein, 156 aa, Glycine max
  Coding DNA Sequence Number=SeqID_64820
MFMSYTYRSCVTSLLLGGMHGELQGSSICTINLMMPVSALADSLLVTSPCYSVGYTSTFFQLRSAMLIRTTTRCHHSDIPQTLDDSARSDVDEPRHAMEACDAIAERLERHLSLRVVTPGTLTHEVIKKCLKIVRSVTQDRIVYVRSLRRRCMDQP

SEQ ID NO: 156506 - protein, 204 aa, Glycine max
  Coding DNA Sequence Number=SeqID_64821
  Pfam annotation: Domain name=Transposase_23; Domain location=120-187; Score=-17.8; E_value=0.1; Accession=PF03017.5; Description=TNP1ENSPM transposase
MHRLQKFRVEISRISQQASCGFFVAIGRPEHRSHVGVVGVGLTIKKYFGLAPRTSRMSSSMAPEDLEQLMQQIRDQLEESITEKRLALPPEPEVGPSATCANTKESCVDPSGNDPDTGDLDKYRLYIEENPPCLVALGRVYEGSIIVHNIPLLHDQVKVGVEEVRDAYASIPVPTEEVKLVGQALNTFFALPTHLVKGLSEQEK

SEQ ID NO: 156507 - protein, 314 aa, Glycine max
  Coding DNA Sequence Number=SeqID_64822
  Homolog annotation: Hit_ID=Q6WAY4; Match level="QueryCoverage=69%, HitCoverage=53%, E-value=1e-15, Identity=35%"; Hit description =Putative uncharacterized protein
MGTDQTGKRFYQVKIKGLDITSIKELGRLMGPLQMQAFRKAYRKILDLTIAEISTEAITSLTQYYNQPLRCFTFGDFQLVPTVEEFEEILGCPLGGRKPYLFSGFLPSLSKIAIVVRDLARGLDRVKQTRNGIVGLPQKYLEGKARDMENQEEWVPFMDVLALLIFGVFLFPNVDGGRIVNWFPRWKEGKEGVLFSCGGYPNIPLIGMRGCINYNPTLAIRQLGYPMRGAPTEESLSPFLVRDFGAQNFKTFGKSVPGYEKKMQLPQKPLNKKPRGLARKSMAVTNSVEHCGATTVSSSFEGKRETDHEHIAWF

SEQ ID NO: 156508 - protein, 69 aa, Glycine max
  Coding DNA Sequence Number=SeqID_64823
  Subcellular localization annotation: CTP_CleavageSite=45; ConfidenceScore=5.40e-01
MSPPPPEPHNHSQTHLKYSGRPPLQAQFSAGGFFHACALSATLIRLARISEFRLSARFSHSTDVLKRCS

SEQ ID NO: 156509 - protein, 86 aa, Glycine max
  Coding DNA Sequence Number=SeqID_64824
MGPDECRETGTRKAAHKPRKISEAFPPFHVAFLLSSSPPLLPPLKLQIPLPFYPKLRGKALFGVLEHTSTSWGFKFQKTGRDDGES

SEQ ID NO: 156510 - protein, 155 aa, Glycine max
  Coding DNA Sequence Number=SeqID_64825
MIYAIKNLRIPKYLDLEWFSQQGSNFPNLLEAQGMSKLVQMKGTFYPELVKVFYTCARADLEGNLFSTVNGVEMVIDAEVWKEVVGLDMGGVCKFDETTNGYSKMQASRGVLLDPARNLRNCQGVGVLTVEDRMLVYLITYILTLRSSNHAQVLR

SEQ ID NO: 156511 - protein, 107 aa, Glycine max
  Coding DNA Sequence Number=SeqID_64826
  Subcellular localization annotation: CTP_CleavageSite=39; ConfidenceScore=5.25e-01
MFRHENQGNGSNVACPITPKYNLGLRPSPTTSQFNKNKQQSKDKSLTFLSKHMQLRTPKYINGKLESPRMRILGCLAAALSVCPELGKGRRPIGRDPSLYLRPSLST

SEQ ID NO: 156512 - protein, 92 aa, Glycine max
  Coding DNA Sequence Number=SeqID_64827
  Subcellular localization annotation: CTP_CleavageSite=49; ConfidenceScore=5.53e-01
MDSGRFQVSVPGSSYPNKTFLGQVVPLYLSKSRAVNLGMTTFGGISPTACSSLAYLRQDSKLARFWWGISCVSPWVKRHLHDQIEVVGSRWV

SEQ ID NO: 156513 - protein, 61 aa, Glycine max
  Coding DNA Sequence Number=SeqID_64828
MEAPQLGFSSWKQFSSAISREELAIQLAQARQVASSRSNRLLEEESGMPKWAWLLFAPPFY

SEQ ID NO: 156514 - protein, 74 aa, Glycine max
  Coding DNA Sequence Number=SeqID_64829
TNLPGRAAFAPSAHFPINRHAKEVEEGFQGSKVDGIERIKKEEERRGNEAEALPNRDRNHSLNRSLFDVLRVTV

SEQ ID NO: 156515 - protein, 139 aa, Glycine max
  Coding DNA Sequence Number=SeqID_64830
  Homolog annotation: Hit_ID=A5AZ88; Match level="QueryCoverage=35%, HitCoverage=5%, E-value=6e-08, Identity=50%"; Hit description =Putative uncharacterized protein
MLRLQEFDLEIRDRSGAQNLVADHLSRIERVSDADSPIRDDFPDDHLYILYMIRSLDGAFQIMRLTQSCSSVILPHREVIWVFKGQLAKCLIVVFIGPPSLKMHGRAAALVSSVREQEIHLHGDNKCLSNLCYSVRCLM

SEQ ID NO: 156516 - protein, 187 aa, Glycine max
  Coding DNA Sequence Number=SeqID_64831
  Gene Ontology: Mol. function=GTP binding; Cellular component =intracellular; Biological process=positive regulation of transcription, DNA-dependent
  Homolog annotation: Hit_ID=A7P1S1; Match level="QueryCoverage=82%, HitCoverage=50%, E-value=1e-45, Identity=59%"; Hit description =Chromosome chr19 scaffold_4, whole genome shotgun sequence
  Pfam annotation: Domain name=PPR; Domain location=11-45; Score=14.5; E_value=0.15; Accession=PF01535.11; Description=PPR repeat
  Pfam annotation: Domain name=PPR; Domain location=115-149; Score =21.9; E_value=0.0024; Accession=PF01535.11; Description=PPR repeat
  Pfam annotation: Domain name=PPR; Domain location=80-114; Score=21.9; E_value=0.0025; Accession=PF01535.11; Description=PPR repeat
  Pfam module annotation: Pfam domain module=PPR::PPR::PPR; Domain location=11-45::115-149::80-114
MSERGCEPNVATYKSLIKYICKIQQMEKVYELVDEMEKKKGSCLPKVVTYCYLLKSLKEPGEICRVLERMERNGCGMNDDVYNMVLRLYMKWDDGDGVRKTWKEMERNGWGPDRRSYTIMILENFEKGRVKDAVCYLEEMISKGMVLEPRTKKLRVPVLQRFQRLVELLEGNMVMEMSKNTRSSNGN

SEQ ID NO: 156517 - protein, 122 aa, Glycine max
  Coding DNA Sequence Number=SeqID_64832
  Homolog annotation: Hit_ID=A5BTR2; Match level="QueryCoverage=75%, HitCoverage=4%, E-value=1e-11, Identity=45%"; Hit description =Putative uncharacterized protein
  Pfam annotation: Domain name=zf-CCHC; Domain location=51-68; Score =17.0; E_value=0.004; Accession=PF00098.14; Description=Zinc knuckle
MWVQEEEKLVMEMGESALLTTTCGKNKTTRSQANKKGNDKIPPQVDIKKVTKCFFCKKKRHTKKNCPKFQKWLEKKGNENSSMLWPWRLGDISIERIKRLDLCGLHERYGCTWSEIFYHLYR

SEQ ID NO: 156518 - protein, 37 aa, Glycine max
  Coding DNA Sequence Number=SeqID_64833
MSRNYADYLTLDVKYLEEVKQRLQAIKKWSPDKIRGT

SEQ ID NO: 156519 - protein, 147 aa, Glycine max
  Coding DNA Sequence Number=SeqID_64834
MSSRKRARTNDIPSSSIPAPQPAAIEPDNKPIVPLEYFLEKVVWPEAQLPLVRTNEATPLEPTPAQVEPMPAEPRTPVVNPPPSPELEVVPPSPPLIIISYASSNEAVAPSNSPAEETVDPPASPVGGIVDLSDSSSGEVVALTDSP

SEQ ID NO: 156520 - protein, 212 aa, Glycine max
  Coding DNA Sequence Number=SeqID_64835
  Gene Ontology: Mol. function=RNA-directed DNA polymerase activity; Biological process=regulation of transcription, DNA-dependent
  Homolog annotation: Hit_ID=A7QL19; Match level="QueryCoverage=95%, HitCoverage=36%, E-value=4e-39, Identity=41%"; Hit description =Chromosome undetermined scaffold_116, whole genome shotgun sequence
TVKTDLNGKVITNDNNKEIPDAVNTLIFTIAQHFIGDPSLWKDRFAELLSNLKCRTLADFRWYRDTFLTRVCTREDSQQPFCKENFLVGLPRSLGDKARDKIRSQSVNGDIPYESLGYDQLISYVQKMALKICQDDKIQRQLAKEQAQTKRDLGSFCEKFGLLACPKQKKKQNSRKEIHENKPVHKKRFPRRRFSHKSSTSKELENPRQKSQ

SEQ ID NO: 156521 - protein, 91 aa, Glycine max
  Coding DNA Sequence Number=SeqID_64836
MDSDITTILLNFTGCCAPDDESDEQNDGDSDKVYFIEALRKRRDREAPFGGGDSDCGDVEVTKVAASDGHVDYKLGVAEGGVEGAKAGNGN

SEQ ID NO: 156522 - protein, 316 aa, Glycine max
  Coding DNA Sequence Number=SeqID_64837
  Gene Ontology: Mol. function=siderophore-iron transmembrane transporter activity; Cellular component=cell outer membrane; Biological process=siderophore transport
  Homolog annotation: Hit_ID=A6T5W5; Match level="QueryCoverage=50%, HitCoverage=21%, E-value=1e-66, Identity=81%"; Hit description =Putative TonB-dependent receptor
  Pfam annotation: Domain name=Plug; Domain location=218-316; Score =59.6; E_value=1.1e-14; Accession=PF07715.6; Description=TonB -dependent Receptor Plug Domain
MTGLHYSEQTQRVYAANGSGEILVINPRSNRIEKRWKPLGDQPALLLNMAEDEATGRLFVTDNSKAKTTLVLDIHTGKLLKRLDVGDSLAVVFNPRRNEIYISQRESGNVLSLDATTYAVKQRWPLPPNPNSLLLSADGQTLFVTVKQPFNKDHSTQGPDSVGALAADGGAKKNQEDTLVVRAEKHGDFNSGGNDLVPAYLDGQVAHGGRLGMLGEQKAMDVPFNVIGYTAKLVQDQQAKTIADVVSNDAGVQAVQGYGNFAETYRIRGFQLDGDDMTMGGLPGVVPRQVMDTQMLERVEIFKGANALLNGLASSG

SEQ ID NO: 156523 - protein, 576 aa, Glycine max
  Coding DNA Sequence Number=SeqID_64838
MGEHAYQIQRVVRRRDFAFAERLPFDEALDGFQQGEDADFIPYLHDFANATPDRQTDGFIKFTRHLGLAIPHDLLVTLDAPERFLPRCGGGDGTMKNDLAAAIAIGCVLLFALAYLAVIFRGPVRGRSPRLSPRLRIFAPIACPRDKISQIAVDESPCPPVKPRGARSDAGDVITVVPPPLHRSAGYRAAGDPGCRLPHSLFSARHSDPVAGRHRAGLSAGVADRAPAAHRLFAHLGGEHHAAGVRGRRHAAALPGAGGCRHHRHDGGKPAQPAVRHGRVGGEILAGVAGRPADVGYLPDPGADDDVLPAERQRAAAERGAPRAAAQSRPGGAGLERDESADHQLHSWQGAGDGDCRRGDLPGVRRAGHALFAAAGGAGGLLGADPLHRRGAGHHTGGGGGAVPVGRRRRFLDADRRLSGGAGAGRQPAGADPVLRSGQPASAGDYPFCDRVRRDVGLLGGVFRHSAGDAGEGVQNDVVVIGGFEIIKHFFNLAFGVDQETDAVNTVVGLAHEGFLAPHAKLLRHLMIFIRQQREVEQLLFGEARQFFRFVGADAQHFDAGLFQFVHVVPQAAGLH

SEQ ID NO: 156524 - protein, 318 aa, Glycine max
  Coding DNA Sequence Number=SeqID_64839
  Gene Ontology: Mol. function=transporter activity; Cellular component= integral to membrane; Biological process=transport
  Homolog annotation: Hit_ID=A8GHK1; Match level="QueryCoverage=90%, HitCoverage=83%, E-value=1e-148, Identity=89%"; Hit description =Multidrug efflux protein
LSRVRHNGLDDSPQLQIDIDQRKAQALGVSIDDINNTLSTAWGSTYVNDFVDRGRVKRVYVQAAAPFRMLPEDINKCSHWEYGSPRLERYNGNSALEIVGEAANGVSTGTAMAEMEKLVSQLPTGFGLEWTALSYQERLSGSQAPALYAISLLVVFLCLAALYESWSIPFSVMLVVPLGVIGAVAATWLRGLENDVYFQVGLLTIIGLSAKNAILIVEFANELNHKGQDLMSATLDASRMRLRPILMTSLAFIFGVLPMATSSGAGSGSQHAVGTGVMGGMISATLLAIFFVPLFFVLVRRRFPGKAHPAGNTTAAGE

SEQ ID NO: 156525 - protein, 1098 aa, Glycine max
  Coding DNA Sequence Number=SeqID_64840
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A8GE24; Match level="QueryCoverage=34%, HitCoverage=78%, E-value=1e-162, Identity=76%"; Hit description=PTS system, maltose and glucose-specific IIBC subunit precursor
  Pfam annotation: Domain name=A_deaminase; Domain location=771-1095; Score=389.9; E_value=4e-114; Accession=PF00962.13; Description =AdenosineAMP deaminase
  Pfam annotation: Domain name=Aminotran_1_2; Domain location=403-757; Score=224.8; E_value=2e-64; Accession=PF00155.12; Description =Aminotransferase class I and II
  Pfam annotation: Domain name=Beta_elim_lyase; Domain location=414 -707; Score=-116.7; E_value=0.009; Accession=PF01212.12; Description =Beta-eliminating lyase
  Pfam annotation: Domain name=PTS_EIIB; Domain location=320-354; Score= 70.2; E_value=6.9e-18; Accession=PF00367.11; Description =phosphotransferase system, EIIB
  Pfam annotation: Domain name=PTS_EIIC; Domain location=1-229; Score =154.9; E_value=2.2e-43; Accession=PF02378.9; Description =Phosphotransferase system, EIIC
  Pfam module annotation: Pfam domain module=A_deaminase::Aminotran_1 _2::Beta_elim_lyase::PTS_EIIB::PTS_EIIC; Domain location=771 -1095::403-757::414-707::320-354::1-229
NNVQNILGIQSIDTGILGAVIVGIVVFWLHERFHNIRLPDALAFFGGTRFVPIITTVVMGLLGLVVPLIWPFFARAITGLGWMINSAGEFGPMIFGTGERLLLPFGLQHILVAIIRFTDAGGTMEVCGHSVSGALTIFQAQLACPETQGFAESATRFLSQGKMPAFLGGLPGAALAIYHCARPENRHKIKGLLISGVVACVVGGTTEPIEFLFLFVAPVLYLIHALLTGLGFTVMAMLGVTIGNTDGNVIDFFVFGVLHGLSTKWYWVPVIAAVWFVGYYAIFRFAITRFNIKTPGREAETSRVEQQVSRAGVGKSGYNTPAILAALGGVDNITSLDNCLTRLRLSVADMSKVDDAALKANGAIGVVHLNQTNLQAFNFDRVVDRHGSWCTQWDFVADRFGVADLLPFTISDMDFATAPCIIDALQQRLNHGVLGYSRWQHEDFLSALQHWMRSRFASEIAAESLVYGPSVIYMVAQLLRHWTQAEDEVLIHTPAYDAFYQTIIGNQRRVLELPLQRAGDTWRCDMAELETLLARPRCKVMLLCSPHNPTGKVWQRAELQQMAALCERHGVSVISDEIHMDMVLSEARHTPWCEVAQGRWALFTSASKSFNIPALTGAWGIIPDADDRRAWFHALKQQDGLSSPAVMALAATIAAYRHGAPWLDALRDYLRANMQHIAQRLNAAFAGLNWQPPQATYLAWIDTAPLAIDDVALQQRLIQQHKVAIMPGSTYGSASRSYLRLNAGCPRSKLDDGLDRLIAALQSECDMIDAKLPLTDLHRHLDGNIRAQTILDLGRQFNLALPADTLDTLRPHVQVTANQPDLVSFLQKLDWGVKVLGDLDACRRIALENVADAAQAGIHYAELRFSPGYMAMNHQLPIAGVVEAVIDGVRAGVQQYGVDVKLIGIMSRTFGEEACLRELEGLLAHRDGITAVDLAGDELGFPGSEFLSHFNRARDAGFRITVHAGEAAGPESIWQAIRELGAERIGHGVKAIEDRALMDFLAEQRIGVESCLTSNIQTSTVASLASHPLKAFLQHGILATINTDDPAVQGIELAHEYEVAAPQAGLSAAEMRQAQENGIAIAFLTEAEKAALRQRVAA

SEQ ID NO: 156526 - protein, 326 aa, Glycine max
  Coding DNA Sequence Number=SeqID_64841
  Gene Ontology: Mol. function=mannose-6-phosphate isomerase activity; Cellular component=cytoplasm; Biological process=carbohydrate metabolic process
  Homolog annotation: Hit_ID=A8GE38; Match level="QueryCoverage=99%, HitCoverage=82%, E-value=1e-126, Identity=70%"; Hit description =Mannose-6-phosphate isomerase
  Pfam annotation: Domain name=PMI_typeI; Domain location=1-291; Score =301.1; E_value=2.2e-87; Accession=PF01238.12; Description =Phosphomannose isomerase type I
VATLGAAVAQRFGELPFLFKVLCADQPLSIQVHPSKTAAEAGFARENAAGIPLSAAERNYKDANHKPELVYALTPFQAMNGFRELPEIVSLLEPVAGAHPQIAHFLENASEAALAKLFATLLSLKDESKTRALGVLKSALNAREGEPWQTIKTIANDYPDDNGLFSPLLLNVITLQPGEAMFLFAETPHAYLKGVALEVMANSDNVLRAGLTPKFIDIPELLANLKFEAKPAATLLTQPQTQGDSLNFPIPVEDFAFAIHTLSATPQTLAQHSAALLFCIEGQAVIEKAGQQLVLQPGESCFVAASESPVSAAGNVRLARVFNALT

SEQ ID NO: 156527 - protein, 96 aa, Glycine max
  Coding DNA Sequence Number=SeqID_64842
AADAPPPHQAGPAGLFDTELYLRHLVRQQAANHRAHSQGFTSFPCPTPDQFRAEVAWPGDWPEAQVGEAPAEAPDEADEAREDEEMTDLLDFLGGS

SEQ ID NO: 156528 - protein, 110 aa, Glycine max
  Coding DNA Sequence Number=SeqID_64843
VPTDLKRIKVIPEWLTPPTPLVELVRNHVPSWEDAQKKGVDGRSPEFQEPLDLRDAGESLGVLMSLKGCVFPWGELNYWRGVTLASQGSFSRKLSSFMYFGMRVSLAIGG

SEQ ID NO: 156529 - protein, 38 aa, Glycine max
  Coding DNA Sequence Number=SeqID_64844
MRLQSRTSTEEVTQVRPDQALKGLSLAYDESLRPESGL

SEQ ID NO: 156530 - protein, 497 aa, Glycine max
  Coding DNA Sequence Number=SeqID_64845
  Homolog annotation: Hit_ID=A7Q1N2; Match level="QueryCoverage=80%, HitCoverage=93%, E-value=5e-60, Identity=38%"; Hit description =Chromosome chr7 scaffold_44, whole genome shotgun sequence
MGCFLHCFGSSKSTKPRRKAQHHHHRIARDRLEQPTACCSVQDYSETVVLSTASQEVQAKPLEQINVSPKKKVTFDVNVKTYEPEPDEVADYQLVRSEEGREESAFVEKLSQTKSYSEVSSVTSARSYPTNHRYHSCTCSDDEDGAMEYWDSDVTDEDEDDDDDGDSDMGEEYDEVEEDFEDGIVYSRSRNGANQVVVGEVESPIPMHDKDLKSIGLNSNVRDRSVYVNPLLNPVENLTQWKTVKAKRAPPLVSQKENLVLNQESRAAFGAETETPKKLNREIAVDASLSNWLGSSETTPVVSKGLYAGTPERSSSSSQGSNSVVSHEDRPILGALTVEELKHFSASSLPRKSPRDEMMPIIGSVGSYWNCGGYAEDSGSANRVRSRKGVSALCFGYKDLTMGIDNSLDIEIVLMSGHINLIVHHKGRLERDDHGTLEYVDNEFYVWENCEVDLMTLWIVLDLCKSRGGIAHHDKDVHVYFEHIVDDFPNLVGGESN

SEQ ID NO: 156531 - protein, 577 aa, Glycine max
  Coding DNA Sequence Number=SeqID_64846
  Gene Ontology: Mol. function=transporter activity; Cellular component= membrane; Biological process=oligopeptide transport
  Homolog annotation: Hit_ID=A7Q1N5; Match level="QueryCoverage=95%, HitCoverage=98%, E-value=0.0, Identity=71%"; Hit description =Chromosome chr7 scaffold_44, whole genome shotgun sequence
  Pfam annotation: Domain name=MFS_1; Domain location=43-487; Score= -3.0; E_value=0.024; Accession=PF07690.7; Description=Major Facilitator Superfamily
  Pfam annotation: Domain name=PTR2; Domain location=105-479; Score =355.9; E_value=6.6e-104; Accession=PF00854.12; Description=POT family
  Pfam module annotation: Pfam domain module=MFS_1::PTR2; Domain location=43-487::105-479
MAVVEEKGFASGREDYTQDGTVDLKGRPVLRSNTGRWRACSFIVGYEMIERMAYYAIASNLVQYLTKKLHEGTVKSSNNVTNWSGTVWIMPAAGAYIADAYLGRYWTFVIASAIYLLGMCLLTLAVSLPALRPPPCAPGIADKDCQRASSFQVGIFFFALYIIAAGTGGTKPNISTMGADQFDEFEPKERSQKLSFYNCPTLLVYIQDKVGFGLGYGIPTIGLAVSVLVFLLGTPLYRHRLPSGSPLTRMVQVLVAAMRKWKVHVPHDLNELHELSMEDFLDKAAVKTGQTSPWMLCTVTQVEETKQMMKMIPILITTCIPSTIIAQTTTLFIRQGTTLDRNMGPHFEIPPACLIAFVNIFMLTSVVIYDRLFVPAIRRYTKNSRGISLLQRLGIGLVLHVIIMLTACFVERKRLSVAREKHLLGAQDTIPLTIFILLPQFALTGIADTFVDVAKLEFFYDQAPEAMKSLGTSYFTTTISIGNFLNSFLLSTVSDLTLRHGHKGWILDNLNVSHLDYYYAFLAVLSSTNLLCFVVVAKLYVYNDDVTQTKMELGMNHASSKGNTGISLSSPQPDDKS

SEQ ID NO: 156532 - protein, 542 aa, Glycine max
  Coding DNA Sequence Number=SeqID_64847
  Gene Ontology: Mol. function=protein serine/threonine kinase activity; Cellular component=phragmoplast; Biological process =protein amino acid phosphorylation
  Homolog annotation: Hit_ID=Q9LW99; Match level="QueryCoverage=92%, HitCoverage=88%, E-value=0.0, Identity=83%"; Hit description=Protein kinase MK6
  Pfam annotation: Domain name=Pkinase; Domain location=120-418; Score =291.1; E_value=2.2e-84; Accession=PF00069.16; Description=Protein kinase domain
  Pfam annotation: Domain name=Pkinase_C; Domain location=436-485; Score=55.2; E_value=2.3e-13; Accession=PF00433.15; Description =Protein kinase C terminal domain
  Pfam annotation: Domain name=Pkinase_Tyr; Domain location=120-404; Score=15.2; E_value=2.5e-13; Accession=PF07714.8; Description =Protein tyrosine kinase
  Pfam module annotation: Pfam domain module=Pkinase::Pkinase _C::Pkinase_Tyr; Domain location=120-418::436-485::120-404
MDSARSWLQKFQPRDKLRASTRNKDDTNGTNEIPNVPMDDTSLSNVTKQKVTAAKQYIENHYKEQMKSLQERKERRTILEKKLADADVSEEDQNNLLKFLEKKETEYMRLQRHKMGVDDFELLTMIGKGAFGEVRVCKEKATDHVYAMKKLKKSEMLRRGQVEHVRAERNLLAEVDSNCIVKLYCSFQDDEYLYLIMEYLPGGDMMTLLMRKDTLTEDEARFYVGETILAIESIHKHNYIHRDIKPDNLLLDKYGHLRLSDFGLCKPLDCSTLEETDFTTGQNANGSTQNNEHVAPKRTQQEKLQHWQKNRRTLAYSTVGTPDYIAPEVLLKKGYGMECDWWSLGAIMYEMLVGYPPFYSDDPMSTCRKIVNWKSHLRFPEEARLSPEAKDLISKLLCDVNQRLGSNGADEIKAHPFFNGVEWDKLYQMEAAFIPEVNDELDTQNFEKFEESESQTHSSSRVSPWRKMFSSKDLNFVGYTYKNFEIVNDYQVPGMAELRKKNSKAKKPSVKSLFDGESEAFEASESTTSITRKYDDLPPMSE

SEQ ID NO: 156533 - protein, 380 aa, Glycine max
  Coding DNA Sequence Number=SeqID_64848
  Gene Ontology: Mol. function=oxidoreductase activity, acting on CH-OH group of donors; Biological process=electron transport
  Homolog annotation: Hit_ID=A7NXF0; Match level="QueryCoverage=98%, HitCoverage=71%, E-value=9e-72, Identity=58%"; Hit description =Chromosome chr5 scaffold_2, whole genome shotgun sequence
  Pfam annotation: Domain name=GMC_oxred_C; Domain location=219-373; Score=-43.1; E_value=0.0038; Accession=PF05199.4; Description=GMC oxidoreductase
  Pfam annotation: Domain name=GMC_oxred_N; Domain location=49-238; Score=139.5; E_value=9.4e-39; Accession=PF00732.10; Description=GMC oxidoreductase
  Pfam module annotation: Pfam domain module=GMC_oxred_C::GMC_oxred_N; Domain location=219-373::49-238
MQTVKSLTEKGLEVTEDKRQNLYKVKCDVVIMGSGCDGGVAAAVLANSAHKLYESGGIMPSLDGKMMILAGSTVGGGSAVNRSASIRTPDSVLREWSKKYKIPLFASSDYQSAMESVCRRIGVTEKCKKESFQDQILIQGCEKMSSKVDSVAINSSEDHYCGSCCYGCRTGDKKGTDSTWLVDAVGNGAVILTGGIITSIHKEYAVDSTPRFIIETLSLGPGSFLAFVPWLSGEVKAEGRVTYRLDQADKESLRVGLRMALRILVAAGAVEVGTYRSDGQRIKEEELEEFLDTVTIVGGPKSRNEVWTVFATAHQMTSCRMVATEEEGALDENGESWEAKGLYVCDGSVLPSAVGVNPMVTIQSTSYCIATKIAESLSKP

SEQ ID NO: 156534 - protein, 732 aa, Glycine max
  Coding DNA Sequence Number=SeqID_64849
  Gene Ontology: Mol. function=dolichyl-diphosphooligosaccharide -protein glycotransferase activity; Cellular component=oligosaccharyl transferase complex; Biological process=protein amino acid N-linked glycosylation via asparagine
  Homolog annotation: Hit_ID=A7Q1R4; Match level="QueryCoverage=100%, HitCoverage=100%, E-value=0.0, Identity=60%"; Hit description =Chromosome chr7 scaffold_44, whole genome shotgun sequence
  Pfam annotation: Domain name=Ribophorin_II; Domain location=6-726; Score=910.3; E_value=8.7e-271; Accession=PF05817.5; Description =Ribophorin II (RPN2)
MARNLGGLLALLFAVSICGAVTIPGPVSDAHRSAALELFDGSFSSLEEAYEALRVFEILTIGNKPDVSTTTCKKVVENLGSSSPVKDLFYALKVNDILKCKVNGDVFKDIALRLKATVNDASTLVEMYYSIGSLVLIKDQASDVDVLLTDADGSFHSIKALSQSDGRWRYSSNNPESSTYAAGLALEALAGVISLASSEIDQSRESWHFYRYLISVPFCQVNTVKNDILKLFDSIEKYDDGTFYFDEKFVGGREHQGSLSTTSSVVRGVTAFAAVTSGKINLPGDKILGLANFFLGIGIPGDAKDFFNQVESLALLENNKQGFDPIGTVTSCNGLFIIQKRSAQAPVKIQCCFLVLNYTWENMTNFYFQMNQVRVNTVLGSAAPPLTVKLVQAFRSNAKDSAIESKELQYDQNNGIHFLEAFPDNVDVGTYVFVFEIALHDSAGEKVYATGGQIHVPIYVTGIIKVSNAEIAVLDSDLGSVETQKTLDLAGNDDVSLSANHLQKLRFSFQLTTPHGHAFKPHQAFFKLKHETKHEHIFVVGNTGRKFEIILDFLGLVEKFYYLSGRYDIELTVGDTVMENSFLRLLGEVDLDLPEAPEKAARLPPLPVDPYSRYGPKAEIAHLFRAPEKRPPQELSLTFLGLILLPFIGFLVGLLRLGVNLKNFPSSAVPATYAFLFHLGIAAVLLLYVLFWLKLDLFTTLKTVGFLGAFLLFVGHRILSHLASTSSKLKSA

SEQ ID NO: 156535 - protein, 1454 aa, Glycine max
  Coding DNA Sequence Number=SeqID_64850
  Gene Ontology: Mol. function=nucleotide binding; Cellular component =myosin complex; Biological process=regulation of transcription
  Homolog annotation: Hit_ID=A2XB11; Match level="QueryCoverage=96%, HitCoverage=99%, E-value=0.0, Identity=58%"; Hit description =Putative uncharacterized protein
  Pfam annotation: Domain name=DIL; Domain location=1275-1382; Score =138.4; E_value=2e-38; Accession=PF01843.10; Description=DIL domain
  Pfam annotation: Domain name=IQ; Domain location=679-699; Score=21.7; E_value=0.0027; Accession=PF00612.18; Description=IQ calmodulin -binding motif
  Pfam annotation: Domain name=IQ; Domain location=702-722; Score=23.5; E_value=0.00077; Accession=PF00612.18; Description=IQ calmodulin -binding motif
  Pfam annotation: Domain name=IQ; Domain location=727-747; Score=28.2; E_value=3e-05; Accession=PF00612.18; Description=IQ calmodulin -binding motif
  Pfam annotation: Domain name=IQ; Domain location=750-770; Score=3.4; E_value=18; Accession=PF00612.18; Description=IQ calmodulin-binding motif
  Pfam annotation: Domain name=IQ; Domain location=775-795; Score=21.6; E_value=0.0029; Accession=PF00612.18; Description=IQ calmodulin -binding motif
  Pfam annotation: Domain name=IQ; Domain location=798-818; Score=21.8; E_value=0.0025; Accession=PF00612.18; Description=IQ calmodulin -binding motif
  Pfam annotation: Domain name=Myosin_N; Domain location=66-107; Score =23.2; E_value=0.00097; Accession=PF02736.10; Description=Myosin N -terminal SH3-like domain
  Pfam annotation: Domain name=Myosin_head; Domain location=71-663; Score=741.0; E_value=8.2e-220; Accession=PF00063.12; Description =Myosin head (motor domain)
  Pfam module annotation: Pfam domain module=DIL::IQ::IQ::IQ::IQ::IQ::IQ ::Myosin_N::Myosin_head; Domain location=1275-1382::679-699::702 -722::727-747::750-770::775-795::798-818::66-107::71-663
MGTILMSFSKPVAPPTTNLTVVVVDTQEATRSISLIGGDREGVAKGIGGELRRRRCEAVVANPVVGSHIWVEDPDVAWIDSEVLEVKGEEIKVLCTSGKTTYTGNILIAVNPFIKLPHLYDSHMMAQYKGAAFGELNPHPFAVADAAYRLMINEGISQSILVSGESGAGKTESTKLLMRYLAYMGGRAAVAEGRTVEQKVLESNPVLEAFGNAKTVRNNNSSRFGKFVEIQFDQSGRISGAAIRTYLLERSRVCQVSDPERNYHCFYMLCAAPPEDIKKYKLGDPRMFHYLNQSNCFELEGFDESKEYRDTRRAMDIVGISSEEQDAIFKVVAAILHLGNIEFAKGKEIDSSVPKDEKSWFHLQTAAELFMCDAKALEDSLCKRVIVTRDETITKWLDPEAAALSRDALAKIVYTRLFDWLVDKINNSIGQDPESKSLIGVLDIYGFESFKTNSMFPRSTHETFAQKLYQTFKNHKRFSKPKLSRSDFTICHYAGDVTYQTELFLDKNKDYVVAEHQALLYASKCPFVSGLFPPSPEESSKQSKFSSIGSRFKQQLQSLLETLSATEPHYIRCVKPNNLLKPSIFENKNVLLQLRCGGVMEAIRISCAGYPTRKTFDEFVDRFSLLSPEALTGSSDEVTACKRILKNVGLEGYQIGKTKVFLRAGQMAELDTRRSEILGRSASIIQRKVRSYLARQSFILLRLSTVQIQAACRGQLARQVYEGMRQEASSLVIQRCFRMHIARKAYKDLYTSAVSIQTGMQGMAARSELHFRRQTKAAIAIQSHCRKYLAELHFAKLKKAAIATQCAWRGKVAQRELRKLKMAARETGALQAAKNKLEKQVEDLTLRLQLEKRLRVDIEEAKAQENQRLQSALQEMQLQFKETKFLLEKEKEATKRAAERVPVIQEVPVVDNALLEKLRSENEKLKNMVSSLEKKIDETEKRYEEANKVGEERLKQALDAESKVIQLKTAMQRLEEKFIDMESANHILQKQSLLNSSVKTIAEHLSSPLDEKLENGHHAAEEKKAVDTFVTPVKQFGTESDSKLRRSYIERQHESVDSLVNCVMKNIGFNHGKPIAAFTIYKCLLHWKSFEAERTSVFDRLIQMIGSEIENQDDNDHMAYWLSNTSALLFLLEQSLKSGSSANATPARKPPNPTSLFGRMTMSFLSSPSSANLAAPPADVVRKVEAKYPALLFKQQLTAYFEKIYGIIRDNLKKDLTPILALCIQAPRTSKGGLRSNRSLAKDSPMVHWQSIIESLNMLLCTLKENFVPPVLIQKIFSQTFSYINVQLFNSNGEYVKAGLAELELWCCQAKEELQLIALSTNLQYAGSSWDELKHIRQAVGFLVIHQKYRISYDEIINDLCPILSVQQLYRICTLYWDANYNTRSVSPDVLSSMRMLMAEDSNNAQSDSFLLDDSSSIPFSVDDLSTSLQEKDFSDMKPADELLENPAFQFLNE

SEQ ID NO: 156536 - protein, 349 aa, Glycine max
  Coding DNA Sequence Number=SeqID_64851
  Gene Ontology: Mol. function=transferase activity; Biological process= D-ribose metabolic process
  Homolog annotation: Hit_ID=A7Q1H4; Match level="QueryCoverage=84%, HitCoverage=93%, E-value=1e-108, Identity=60%"; Hit description =Chromosome chr7 scaffold_44, whole genome shotgun sequence
  Pfam annotation: Domain name=PfkB; Domain location=50-339; Score= -2.2; E_value=1e-06; Accession=PF00294.15; Description=pfkB family carbohydrate kinase
MSRDCDSLPENTIVVSPLGSLYSAPTLFIFQAENGIFVCNCVCVQVGCGAAGVDFLATVATYPKPDDKIRSTSFKIQGGGNAGNALTCTARLGLKPRIISKVADDTQGREILHELEVDGPDDLPESNLLTALNGARIVYLDGRLHETALVVAHEAVKKNIPILIDAERLREGLDDLIKLADYVAWTEASTVSKALVCMLLRLPNIKFVIATLGKDGCIMLERCVNEDPSAEEVVVDKLLESLEMRKNGSTHIPTCISSPVTKLHAEGIGTVCSRLYIGTAKNIPPSELIDTTGAGDAFIGAVLYAICANFEPEKMLCFAATVAASKCRALGARSGLPYRIDPCLASFMQ

SEQ ID NO: 156537 - protein, 89 aa, Glycine max
  Coding DNA Sequence Number=SeqID_64852
  Subcellular localization annotation: CTP_CleavageSite=26; ConfidenceScore=5.07e-01
MEDGGSVKAAGSTTMSSFRIGSRSVRSNSGVEIFANSSFHQEDHEEALRSMFINLGRNKGEVCLRDRPESPKRTMRSSCSIKLRDRIDR

SEQ ID NO: 156538 - protein, 191 aa, Glycine max
  Coding DNA Sequence Number=SeqID_64853
  Homolog annotation: Hit_ID=A7PGI7; Match level="QueryCoverage=60%, HitCoverage=100%, E-value=4e-45, Identity=76%"; Hit description =Chromosome chr17 scaffold_16, whole genome shotgun sequence
  Subcellular localization annotation: CTP_CleavageSite=53; ConfidenceScore=5.09e-01
MEEEGDIYDGAPAQFPISFGKQSKPQTPLEAIHTATRRSNSNPKTANDLPSISSSSRECLLVDHDFKFLEHKKSTSMDSQGQTTSLQRLQNVEKRIVKVLELAGGVMDELASPVGPRKDVVQNHCLEFMQLIKDIQVALRDEIKSACEYRPFEKCDYGSRIANEICHKKVEFIMSQLDAIKQTVDEYHVAV

SEQ ID NO: 156539 - protein, 38 aa, Glycine max
  Coding DNA Sequence Number=SeqID_64854
MREMNGNREESRIDHEEGYGDCVKRKERSVQRLENNNF

SEQ ID NO: 156540 - protein, 189 aa, Glycine max
  Coding DNA Sequence Number=SeqID_64855
  Gene Ontology: Mol. function=protein dimerization activity; Cellular component=nucleus; Biological process=regulation of transcription, DNA-dependent
  Homolog annotation: Hit_ID=A7NXJ0; Match level="QueryCoverage=66%, HitCoverage=43%, E-value=7e-22, Identity=50%"; Hit description =Chromosome chr5 scaffold_2, whole genome shotgun sequence
  Pfam annotation: Domain name=AUX_IAA; Domain location=4-187; Score= -51.5; E_value=9.3e-06; Accession=PF02309.7; Description=AUXIAA family
  Subcellular localization annotation: CTP_CleavageSite=42; ConfidenceScore=5.62e-01
MSKDDNSSSLDSSSSDLQLSLSLTLSPYATTSSPSSISHSCSAALATAASQVVGWPPLGAYRMNIYNSQAKSPATEVFNSTVDNKRASNSTGVRKTADGGSDSSNIIFKEKGNLRSSLFVKVKMDGIPIGRKVDLGAHGSYETLAQTLEDMFDESATVLTHKGGKGAPQNPTGGFYQPISIGMDIFGMT

SEQ ID NO: 156541 - protein, 1425 aa, Glycine max
  Coding DNA Sequence Number=SeqID_64856
  Gene Ontology: Mol. function=nucleoside-triphosphatase activity; Cellular component=integral to membrane; Biological process=transport
  Homolog annotation: Hit_ID=Q1M2R7; Match level="QueryCoverage=98%, HitCoverage=98%, E-value=0.0, Identity=92%"; Hit description=PDR -like ABC-transporter
  Pfam annotation: Domain name=ABC2_membrane; Domain location=1170 -1364; Score=157.0; E_value=5e-44; Accession=PF01061.15; Description =ABC-2 type transporter
  Pfam annotation: Domain name=ABC2_membrane; Domain location=499-712; Score=184.9; E_value=2e-52; Accession=PF01061.15; Description=ABC-2 type transporter
  Pfam annotation: Domain name=ABC_tran; Domain location=174-397; Score= 58.4; E_value=2.4e-14; Accession=PF00005.18; Description=ABC transporter
  Pfam annotation: Domain name=ABC_tran; Domain location=883-1073; Score=99.8; E_value=8.5e-27; Accession=PF00005.18; Description=ABC transporter
  Pfam annotation: Domain name=PDR_assoc; Domain location=717-781; Score=144.5; E_value=2.9e-40; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1170 -1364::499-712::174-397::883-1073::717-781
MEGGGSSFRIGSSSIWRNSDAAEIFSNSFHQENDEEALKWAAIQKLPTVARLRKALITSPDGESNEIDVKKLGLQEKKALLERLVKTAQEDNEKFLLKLKDRIDRVGIDLPTIEVRFENLSIEAEARAGTRALPTFTNFIVNILEGLLNSLHVLPNRKQHLNILEDVSGIIKPGRMTLLLGPPSSGKTTLLLALAGKLDPKLKFSGKVTYNGHGMNEFVPQRTAAYVNQNDLHVAELTVRETLAFSARVQGVGPRYDLLAELSRREKEANIKPDPDIDAYMKAVASEGQKANMITDYILRILGLEVCADTVVGNAMLRGISGGQRKRVTTGEMLVGPAKALFMDEISTGLDSSTTFQIVNSLKQYVHILKGTTVISLLQPAPETYNLFDDIILLSDSHIVYQGPREHVLEFFELMGFKCPQRKGVADFLQEVTSRKDQEQYWAHKDQPYRFVTAKEFSEAHKSFHIGRSLGEELATEFDKSKSHPAALTTKMYGVGKWELLKACLSREYLLMKRNSFVYTFKLCQLAVLAIIAMTIFLRTEMHRDSVTHGGIYVGALFYGVVVIMFNGLAELSMVVSRLPVFYKQRDYLFFPSWVYALPAWILKIPLTFVEVGVWVFLTYYAIGFDPYVGRLFRQYLVLVLVNQMASALFRLVAAVGREMTVALTLGSFTLAILFAMSGFVLSKENIKKWWLWGFWISPMMYGQNAMVNNEFLGKRWRHFLPNSTEALGVEILKSRGFFTQSYWYWIGVGALIGYTLLFNFGYILALTYLNPLGKHQAVISEEPQINDQSGDSKKGTNVLKNIQRSFSQHSNRVRNGKSLSGSTSPETNHNRTRGMILPSEPHSITFDDVTYSVDMPVEMRNRGVVEDKLALLKGVSGAFRPGVLTALMGVTGAGKTTLMDVLAGRKTGGYIGGNITISGYPKKQETFARISGYCEQNDIHSPHVTVYESLLYSAWLRLSPEINADTRKMFIEEVMELVELKALRNALVGLPGINGLSTEQRKRLTIAVELVANPSIIFMDEPTSGLDARAAAIVMRTVRNTVDTGRTVVCTIHQPSIDIFESFDELLLMKQGGQEIYVGPLGHHSSHLINYFEGIQGVNKIKDGYNPATWMLEVSTSAKEMELGIDFAEVYKNSELYRRNKALIKELSTPAPGSKDLYFPSQYSTSFLTQCMACLWKQHWSYWRNPLYTAIRFLYSTAVAAVLGSMFWDLGSKIDKQQDLFNAMGSMYAAVLLIGIKNANAVQPVVAVERTVLIELPYVLVQAVVYGIIIYAMIGFEWTVTKVFWYLFFMYFTFLTFTYYGMMSVAVTPNQHISSIVSSAFYAVWNLFSGFIVPRPRIPVWWRWYSWANPVAWSLYGLVASQYGDIKQSMESSDGRTTVEGFVRSYFGFKHDFLGVVAAVIVAFPVVFALVFAISVKMFNFQRR

SEQ ID NO: 156542 - protein, 117 aa, Glycine max
  Coding DNA Sequence Number=SeqID_64857
  Subcellular localization annotation: CTP_CleavageSite=75; ConfidenceScore=5.38e-01
MPATLGKTGNKEPKSCALISFVIPGTSGLLVLGALASTSIASSAASALARRRTSAAQPAIPAPSRRLGGILWPLSVAAASNVTAGYRCQRYAAMAFSGGQRCIGFTLAIDPAGAGSI

SEQ ID NO: 156543 - protein, 67 aa, Glycine max
  Coding DNA Sequence Number=SeqID_64858
MFISLLHLNDANPKTSPVKQEASQTEDEEDEDVGLPPELERIIAQEDREMRPHQEETKLIDLGVDSE

SEQ ID NO: 156544 - protein, 49 aa, Glycine max
  Coding DNA Sequence Number=SeqID_64859
MSRNFTDCLTMGVKYLEVVKRGSHPNKQMIPGRNQAKHQLNQSLNMEHE

SEQ ID NO: 156545 - protein, 96 aa, Glycine max
  Coding DNA Sequence Number=SeqID_64860
MTRGNTGDLQPFDPEIDRTFHRLVRHSVHPSHFVHFEHPDHFEHSVAGDSEYSDFEHSAVNFHTKNMAQPPPRERTLREMDALDFTYESLCIQYPD

SEQ ID NO: 156546 - protein, 203 aa, Glycine max
  Coding DNA Sequence Number=SeqID_64861
  Gene Ontology: Mol. function=RNA-directed DNA polymerase activity; Biological process=RNA-dependent DNA replication
  Homolog annotation: Hit_ID=A5ANW2; Match level="QueryCoverage=28%, HitCoverage=3%, E-value=1e-10, Identity=57%"; Hit description =Putative uncharacterized protein
MRHPVEEHFVFLVDIIDDAINGVDICTNLLYDFSIFYDFDLRSFDCTCDDSDESATVYSICAKISLPLIVNLPLPSTIQSPSLELKPLLDHLKYAYLDDAQKLPVIISNNLSLEHEDTLLHVLRGLKKAIRWTLFDLLVEASFMMMNQVDSSIFDDKKKPKTMISRLSQQVQDQDYIKINFKIQEMTSRRIKIQEKMISQGKY

SEQ ID NO: 156547 - protein, 238 aa, Glycine max
  Coding DNA Sequence Number=SeqID_64862
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=5e-20, Identity=31%"; Hit description= UPI00006A17C9 related cluster
  Subcellular localization annotation: CTP_CleavageSite=70; ConfidenceScore=5.30e-01
MLVRMIRTRLFAAARVKSCPGMHSSCVIASLSGCARTVGPPPISGGGPGTVRMWSTLKMRTRSPLKVRACSALKARMCSPLEVGACSPLLARTCSPLKVRACSPTKVSTCSPLMARACSPLKVRTCGPLKVRSSPLKARTCSPLEVRTCSPLKARTCSPLEVRACNPLMVRARTCSPLEVRACSPLMVRTCSPLKARTCSPLNGEGDRYKYPRVHPYEKARDRLIERAGHPKSTRFGH

SEQ ID NO: 156548 - protein, 168 aa, Glycine max
  Coding DNA Sequence Number=SeqID_64863
MKLTDLNEKGPITDCHADAEKGIEGEHEKALPLEVSMPHNNILNITNPSMVYAASGQHDLKVASEEMGQQTCGPTLSATKVYVRRKEVLRSNSKAQQFEKSIVDFNPTSITDPLPSLHEDFIELQCALLKEMGLTYGEDDNKVKGLLLDMENKDNMMAAEKGIKIQQL

SEQ ID NO: 156549 - protein, 41 aa, Glycine max
  Coding DNA Sequence Number=SeqID_64864
MGAKYLEVVKRGSHPNNEWSPDEIRMSMVGENRVVKEFKHL

SEQ ID NO: 156550 - protein, 124 aa, Glycine max
  Coding DNA Sequence Number=SeqID_64865
MGDCLEDMIRDLGQESFQQAHAPMYEGLQSDSKNPLYTGCKNYLMLLSVVLSLIDSRCFDDNKDDDKNPMRMISRLSQEQFKNQEKFQVSSFQESRTINIKIQESRKGSIKISTKKFFKTLSST

SEQ ID NO: 156551 - protein, 141 aa, Glycine max
  Coding DNA Sequence Number=SeqID_64866
MATSDHAILRDHTYAPTKRSLLELTTQDATSAQNKLLSRKIEALIETLNQLPQQLQAVGGCHICGGTHKPGQCVVQQDPSREIGQLAEPVAERPTETFVVNTEMKPKEDCKVLLEYMSFMASLAKRRKCKEDVFYMTFMPP

SEQ ID NO: 156552 - protein, 225 aa, Glycine max
  Coding DNA Sequence Number=SeqID_64867
  Homolog annotation: Hit_ID=A6BLN7; Match level="QueryCoverage=73%, HitCoverage=33%, E-value=3e-09, Identity=29%"; Hit description =Putative transposase
  Pfam annotation: Domain name=Rep_fac-A_C; Domain location=60-192; Score=-66.3; E_value=0.05; Accession=PF08646.1; Description =Replication factor-A C terminal domain
MYRLSELGIEIRSVFTRRSQWSSQPSGSAQLSSRETFISKSEAKTISEINNLCEEFVCVTVGTIMRVVMDNHSWCYAACIQCHKKTDVYTEPFVCPCGKHNDLAVLRYRVEVMINYKDESTKFLLWDRECTELIGQSADEVNTLKIEDGDLDLNASPKALDKLLGHLLAFKVKIQPQYKNSAVLKFSTDLTLINDVLDMLPDVETCSKIKVTTPFDSNDPVHYES

SEQ ID NO: 156553 - protein, 501 aa, Glycine max
  Coding DNA Sequence Number=SeqID_64868
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=72%, E-value=0.0, Identity=84%"; Hit description =Photosystem I P700 chlorophyll a apoprotein A1
  Pfam annotation: Domain name=PsaA_PsaB; Domain location=32-501; Score= 773.1; E_value=1.8e-229; Accession=PF00223.10; Description =Photosystem I psaApsaB protein
MIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGGGFRGIQITSGFFQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNWVWRPQDMFSDTAIQLQPVFAQWIQNTHALAPGTTAPGATTSTSLTWGGDNLVAVGGKVALLPIPLGTADFLVHHIHAFTIH

SEQ ID NO: 156554 - protein, 199 aa, Glycine max
  Coding DNA Sequence Number=SeqID_64869
KLPTQLHSAQTSHSSILQVAGCTIYGGAHESRCCIPNEEQFAQEVNYMGNHPRGNFNADGFFGFHNRQQYQQQRQWQNHPGNQFNRDQGSSSTRPQQQTPSLYDRTTKLEETLAQFMQVSMSNQKSTESAIKNLEKNPKEECKAMMTRSRMTIQVEEGRADQKVEGFKQQLAAQLALEPVDTFVELEEIVEEAEDDKEE

SEQ ID NO: 156555 - protein, 281 aa, Glycine max
  Coding DNA Sequence Number=SeqID_64870
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPEFDKIGLACSVQSPRERMNMVYVTRELSKIRKFFLAAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTW

SEQ ID NO: 156556 - protein, 81 aa, Glycine max
  Coding DNA Sequence Number=SeqID_64871
MADEPRRVTLEDYSSTSVSQFFTSIARPEVQAQNITYPYSLIQLIQNNLFHGLPNEDPYAHLATYIKICNIVRLASVPEDA

SEQ ID NO: 156557 - protein, 169 aa, Glycine max
  Coding DNA Sequence Number=SeqID_64872
  Homolog annotation: Hit_ID=A5B3J2; Match level="QueryCoverage=92%, HitCoverage=29%, E-value=6e-13, Identity=33%"; Hit description =Putative uncharacterized protein
MGSQQKYLWHCCRGSKLRPSVGDLIPIDLEINATCRRRNQERIRKNLQDLEVVAIPEEEPQSSEASSSFPIVEHSHLDPSEDYIMAEEPRRVTLEDYSSSNVPQFFTSIAQPEVQAQTITYPPSLIQLIQNNLFHGLPNEDPYAHLATYIEICNTIRLAGVPEDAIRLS

SEQ ID NO: 156558 - protein, 108 aa, Glycine max
  Coding DNA Sequence Number=SeqID_64873
MTRIPYNFQPSIILNGHQTILRWFYEKLPHCTEVPLRACGNHMTVLRRHGPPLQWKVETLNPAIGGKGVVQPWYDFLQEMDFDDGDEISIYYRYYEKFWDIIIRRQED

SEQ ID NO: 156559 - protein, 147 aa, Glycine max
  Coding DNA Sequence Number=SeqID_64874
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKDMQKHHWAAAT

SEQ ID NO: 156560 - protein, 129 aa, Glycine max
  Coding DNA Sequence Number=SeqID_64875
  Gene Ontology: Mol. function=RNA-directed DNA polymerase activity; Biological process=regulation of transcription, DNA-dependent
  Homolog annotation: Hit_ID=A5AZJ8; Match level="QueryCoverage=63%, HitCoverage=11%, E-value=1e-10, Identity=44%"; Hit description =Putative uncharacterized protein
MVSLMDRNILDSLFLNIHFHGLDMKEGSIPAALIYRIQYKVMNTCASRVLLKPQKGETTLFITNMTKANISLPRTIKWDEIKDGEVIQLELPPKTQYQLPKAKENSDKPVMATPFKTKDVDKEITPEGY

SEQ ID NO: 156561 - protein, 46 aa, Glycine max
  Coding DNA Sequence Number=SeqID_64876
MCAVKKRYHPLRKTYCGSRDYQQQHVIKEKNSRLGFTVIKQVGDPA

SEQ ID NO: 156562 - protein, 91 aa, Glycine max
  Coding DNA Sequence Number=SeqID_64877
MESPFVATYPSAGGRREGSRVRLPREEGTRSRHQRLFEEKVGKSGKKRQGIGPLTISWGGRQKRGFCSYVFSIAMRKSDLRSSCKNGKVTC

SEQ ID NO: 156563 - protein, 252 aa, Glycine max
  Coding DNA Sequence Number=SeqID_64878
  Gene Ontology: Mol. function=structural constituent of ribosome; Cellular component=intracellular; Biological process=translation
  Homolog annotation: Hit_ID=A9PB43; Match level="QueryCoverage=53%, HitCoverage=59%, E-value=9e-42, Identity=53%"; Hit description =Putative uncharacterized protein
  Pfam annotation: Domain name=Ribosomal_L18p; Domain location=31-166; Score=-30.3; E_value=0.0039; Accession=PF00861.13; Description =Ribosomal L18pL5e family
LPVEDYEGGVAEEVGVVRSAVVDVVLSPAVEGQEGVAGKEATKCSGVAGFSDGGAQVGYHGSSYCVEAYAAAKFAGACLCGLKGEVGVTEGSNRSSSIPKVLFQMYRRFEKFYLLLVLATGEDYSMEPAESRRPFCALLDVGLIRTTTGNHVFGALKGALDGGLDIPHSDKRFVGFYKEKKELDAENGIEALYKKVHAAIQADPTLKKSDKQPPKEHKRYNLKKLTYEDRKAKFISRVATLNSTADNNEDDE

SEQ ID NO: 156564 - protein, 45 aa, Glycine max
  Coding DNA Sequence Number=SeqID_64879
MAGIFLKEQNSLEGHHTEYEEPQDLRSNPFQGGGNDAILPRKGIG

SEQ ID NO: 156565 - protein, 40 aa, Glycine max
  Coding DNA Sequence Number=SeqID_64880
GRHRILGCLPAVLPACPELGVGRRSIDHGPSIYLRSSLST

SEQ ID NO: 156566 - protein, 66 aa, Glycine max
  Coding DNA Sequence Number=SeqID_64881
MRLFHSLAEDTDISGKGAQHEDDSRSKDTDISRKGADDDLKEADISGKGVDDDVSHCMLPDFESAG

SEQ ID NO: 156567 - protein, 53 aa, Glycine max
  Coding DNA Sequence Number=SeqID_64882
MIPLKLLQEHNKGLDQTYLREVAKEKKHRLLTILECDEHDAQMQTRTLKVDGD

SEQ ID NO: 156568 - protein, 252 aa, Glycine max
  Coding DNA Sequence Number=SeqID_64883
  Homolog annotation: Hit_ID=A5BZX9; Match level="QueryCoverage=49%, HitCoverage=11%, E-value=5e-07, Identity=30%"; Hit description =Putative uncharacterized protein
MTHAQPGPVDGSLLCLQDNHISNQAFTHLDRIDNRVKNLITLTGFGHVINVGKVDINQHLALLGETPPDKYSKGKMIYLSWLRQNFQQLLIDVDDVAIAQHARAHIMMLISGYLMPDTSEPNVPPVHVPGFMSQHHPSQAQYQSTNFSGYASQGCQQSFQPVGFSLCMPQYSFQVPSTSNVFCGPSQMFATTFNIPSSTYNLPPSTSCYHPSLSTQMCGMGHEDEEEDDDDNNYNDDDGDDDDNGSDYVPQQ

SEQ ID NO: 156569 - protein, 77 aa, Glycine max
  Coding DNA Sequence Number=SeqID_64884
MPHPIRALCPDVLQHMGDQSGSRYFVRMLQPYGISIGLKEHSNPVTPKAYTPKSPSGPLPPNSSPTPKIILAHRHCS

SEQ ID NO: 156570 - protein, 699 aa, Glycine max
  Coding DNA Sequence Number=SeqID_64885
  Gene Ontology: Mol. function=protein binding; Cellular component =nucleus; Biological process=guanosine tetraphosphate metabolic process
  Homolog annotation: Hit_ID=A7PLU3; Match level="QueryCoverage=75%, HitCoverage=99%, E-value=0.0, Identity=68%"; Hit description =Chromosome chr14 scaffold_21, whole genome shotgun sequence
  Pfam annotation: Domain name=Ank; Domain location=18-48; Score=3.8; E_ value=9.4; Accession=PF00023.21; Description=Ankyrin repeat
  Pfam annotation: Domain name=Ank; Domain location=195-227; Score=1.8; E_value=18; Accession=PF00023.21; Description=Ankyrin repeat
  Pfam annotation: Domain name=Ank; Domain location=229-258; Score =18.2; E_value=0.031; Accession=PF00023.21; Description=Ankyrin repeat
  Pfam annotation: Domain name=Ank; Domain location=262-295; Score =24.6; E_value=0.00037; Accession=PF00023.21; Description=Ankyrin repeat
  Pfam annotation: Domain name=Ank; Domain location=344-378; Score =20.5; E_value=0.0064; Accession=PF00023.21; Description=Ankyrin repeat
  Pfam module annotation: Pfam domain module=Ank::Ank::Ank::Ank::Ank; Domain location=18-48::195-227::229-258::262-295::344-378
MPNTYFPLRWESTGDQWWYASPIDCAAANGHYDLVRELLRIDNNHLFKLTSLRRIRRLEVVWDGEEEQQFSDVAKCRSQVAQKLLLECESKRGSSSSSKNSLIRAGYGGWLMYTAASAGDLSFVQLLLERNPLLVFGEGEYNVTDIFYAASRGRNCEVFRLVFDFAVSPRFITGKGGVLEEHVGGDVPPVYKWEMSNRAVHAAARGGSVEILVEYLANCSDVLAYRDAQGSTLLHSAAGRGQVEVVKYLTSSFDIINSTDHQGNTALHVAAYRGQLAAVETIVSASPALISLQNNAGETFLHKAVSGFQSTSFRRLDRQVELLRQLVSGKKFHIEEVINAKNTDGRTALHIATIGKIHTDLVKLLMTAPSINVNVSDANGMTPLDYLKQNPNPAASNVLIRKLIAAGGMFHHHSSRKAIASHMKMHSIGGSPGTSFRISDTQIFLYTGVENASDASTDQGSAGMSSTSSEHTAYDSAAENRPSTTSKRPSVAAGLKRVLQWPLVKDKKSEGIRKSIDEGSLDSCRKWDISDEIPTPLRQKFFRHSALPNNKRNLSVRSYQSSPNAKKRFASGLVHVKVSRRSSSSSFSISSFSSPRSIDNKQKGFCVDNDVAGPSCSSHKNDKSTNSGKRASVSKKLRGHYFCFSKASVDKEQESHCYKDHDVFAGYCQIQKRKRCRINAKLHCRDLRASSAFIVCKFF

SEQ ID NO: 156571 - protein, 73 aa, Glycine max
  Coding DNA Sequence Number=SeqID_64886
MAQHGLIKYQGSNGPWHGMMENALVRATYDKLNKYFVDCGTQADAMIASGKVYTLIASKFITEGETKSNTHFV

SEQ ID NO: 156572 - protein, 137 aa, Glycine max
  Coding DNA Sequence Number=SeqID_64887
  Gene Ontology: Mol. function=protein transporter activity; Cellular component=cytoplasmic vesicle; Biological process=intracellular protein transport
  Homolog annotation: Hit_ID=A7P7E9; Match level="QueryCoverage=80%, HitCoverage=10%, E-value=1e-51, Identity=90%"; Hit description =Chromosome chr9 scaffold_7, whole genome shotgun sequence
MVSELWTKKNAVGKQEVAKLVDDMFRVVIGYDEGTIMVKLGREVPVASMNNSGKIIWFKHNEIQTVNIKSVGAYVEVADRERLPLAVKELGTCDLYPQNLKHNPNGRLVVVCGEGEYIIYTALAWRNRSFGSALDIQ

SEQ ID NO: 156573 - protein, 52 aa, Glycine max
  Coding DNA Sequence Number=SeqID_64888
  Homolog annotation: Hit_ID=Q8GYT7; Match level="QueryCoverage=78%, HitCoverage=3%, E-value=3e-08, Identity=68%"; Hit description =Putative uncharacterized protein At2g48160
MPPSRRKGRKKSNSDAAACQQFKLGDLVLAKVKGFPAWPTMAPRGAVEKVKD

SEQ ID NO: 156574 - protein, 65 aa, Glycine max
  Coding DNA Sequence Number=SeqID_64889
MELLLSTRQGSNEGKINEFKGCMMAEFEMSDLGSLPTYWEMKLFQQIKECACTRKGRPKKAMKIL

SEQ ID NO: 156575 - protein, 196 aa, Glycine max
  Coding DNA Sequence Number=SeqID_64890
  Homolog annotation: Hit_ID=A5BQY8; Match level="QueryCoverage=16%, HitCoverage=8%, E-value=3e-07, Identity=78%"; Hit description =Putative uncharacterized protein
MAIVHTILTRDLTEDLVPVDTNANKLRGEMLDLQHVILFWNSFMGAHGGGGGRSCAKKTWIRVLIFEASASGNLEAERLHKQMCCHCVDSLFLLILLFLKNIIFVSVPASVPPPPPCPPPPTRLRKCQLSVEDDQKEGGRLNWFRKLETAIADEMTTFKEEWEAVLDDLEIESAHLLELRSFKNASDFYLTLVPCI

SEQ ID NO: 156576 - protein, 168 aa, Glycine max
  Coding DNA Sequence Number=SeqID_64891
  Subcellular localization annotation: CTP_CleavageSite=70; ConfidenceScore=5.41e-01
PPSKTRQKNLAKGFSSCGSDSDKVLLIHRWILLNRCFSSKSSSSSLGTRSTKSTMDGTQDSGNTDRGEIRASLHGLTQYMDDNWDDTSHVGIGHDALFLAYITHDILFQRTSSHTVLVLGLTLPLSLLSLHGLTQYMDDNWDDTSHVGTRHDALTNHGYNSALVKNVK

SEQ ID NO: 156577 - protein, 74 aa, Glycine max
  Coding DNA Sequence Number=SeqID_64892
FLGKRYGDAILPKKGLVTRAMSKRLQEDWARATEEGPRVLMILRGPVTRTMSKRLQEDWARAAEEGPRVLMNLR

SEQ ID NO: 156578 - protein, 144 aa, Glycine max
  Coding DNA Sequence Number=SeqID_64893
METLLVFYYEKMVGYMPSSFVDLVFVGKRIEAGLRKGTFSYVASVNPGNEGPERSGERKKEGESHVVVVVPAWPNFSLAPYNPILFAQVSCAPELISKSAQSKMSCSTRLVAVPYLSRTYIVSFISSCYKDVTNDNSGYLRTLH

SEQ ID NO: 156579 - protein, 88 aa, Glycine max
  Coding DNA Sequence Number=SeqID_64894
MQHRHNGGTEEAQWCKRKKKVETKVIRARSATDEGPEVTTGVTTNGCDGLDRGTTTMKCQASPENEKKMEEREENKKRMMECENKIKH

SEQ ID NO: 156580 - protein, 74 aa, Glycine max
  Coding DNA Sequence Number=SeqID_64895
MNFAWQSKIPFEPREGGSLHDDGDGGHKREPVVHAAGEGTEGGGGRWRQRRRVGEVFRMDGFGAMLGVVEEGLI

SEQ ID NO: 156581 - protein, 57 aa, Glycine max
  Coding DNA Sequence Number=SeqID_64896
MHLVDQPSTQVIHGKRWGSTHPLGTLTPISIVSQIYNLIMRNQPGKIPERDIPSAPS

SEQ ID NO: 156582 - protein, 97 aa, Glycine max
  Coding DNA Sequence Number=SeqID_64897
MKHPSEDHSVFRAEILDQIVNDYMFDFDSLHGSTYTFDLLYEVQAEEPSSSSPTLVPPTVQPLPTPELKPLSVNLKYAYLEDKEKFSVIISASLAVE

SEQ ID NO: 156583 - protein, 255 aa, Glycine max
  Coding DNA Sequence Number=SeqID_64898
  Gene Ontology: Mol. function=molecular_function; Cellular component =cellular_component; Biological process=biological_process
  Homolog annotation: Hit_ID=A7PLV0; Match level="QueryCoverage=89%, HitCoverage=97%, E-value=5e-73, Identity=62%"; Hit description =Chromosome chr14 scaffold_21, whole genome shotgun sequence
  Pfam annotation: Domain name=UBX; Domain location=102-180; Score=3.5; E_value=0.034; Accession=PF00789.11; Description=UBX domain
MLNCTKPNMSIKTATKRKNKKYRNTKTEAKLAAVKERFGREIHVFETSVVSLSSKAALSNGEETDDFYEFTAEDYYRLLATKKEDKFLKTRKIREAEEAARRSRITKAVIRVRFPDNHTLEVTFHPSETIQSLIDLLTKVIAQPEQPFYIYTTPPKKVINDMSRDFYTAGFCPGAIVYFSYNVPKGDSTVGDHTSPYLQEEILSLKDLHDAIDQGQQSEPVVQSEPEPAVATHPHPVEERKPAEKKVVKPKWLKM

SEQ ID NO: 156584 - protein, 76 aa, Glycine max
  Coding DNA Sequence Number=SeqID_64899
  Gene Ontology: Mol. function=indole-3-glycerol-phosphate synthase activity; Cellular component=chloroplast; Biological process =tryptophan metabolic process
  Homolog annotation: Hit_ID=A3AUP1; Match level="QueryCoverage=78%, HitCoverage=7%, E-value=8e-23, Identity=81%"; Hit description =Putative uncharacterized protein
MQCPLLCKEFIIDAWQLYYARTKGADVVLLIAVVLPDLDIKYMIKICKLLGLTALVEWHNAVCFMEMIRSGERTIT

SEQ ID NO: 156585 - protein, 873 aa, Glycine max
  Coding DNA Sequence Number=SeqID_64900
  Gene Ontology: Mol. function=kinase activity; Cellular component =nucleus; Biological process=DNA mediated transformation
  Homolog annotation: Hit_ID=A7PLT9; Match level="QueryCoverage=100%, HitCoverage=99%, E-value=1e-116, Identity=52%"; Hit description =Chromosome chr14 scaffold_21, whole genome shotgun sequence
  Pfam annotation: Domain name=Bromodomain; Domain location=177-266; Score=117.3; E_value=4.7e-32; Accession=PF00439.16; Description =Bromodomain
MAKSRLSGGYFGNALDTAGESEGSGSSGRIDTEITVSEDSSIPARKCISLNSSRHDVFGAPVQVVPLSNMPLSHRKDLGQRLRSELEQIRLLQKKIEQQRTTAVVLSSSSDILSCSNGNNGHRVERDKKPAMSSSAPRNKAKPGNKNQKPRGWNRGSSGKFESAVQSASPSTANAMLMKDCELLLKRLMNHQYAWVFNTPVDVVKLNLPDYFTIIKRPMDLGTVKNKLASGEYAGPLEFADDVKLTFSNAMDYNPSGNDVHLMADTLNKYFELRWKAIEKKLQKSDFLPLPANPDNSEGVKTKRQAPLSKKRKIASLPPQPEVMPPTKKVMSDQEKHDLGRELESQLGEMPMHIIDFLKEHSSNGRECGDDEIEIDIDDLSDDTLFTLRKLLDDFLQKKQKNKAKVEACEVEVLNDSGPSNSSLQPFKGNDPADEEVDIGGNEPPVSSYPHVEIEKDTTYGMNKSLSPGSSNGNVDFIFTKVYELIFIQWCSTVNPIPDVGMFNNQIAAFPISDGVLLNGGTMDAMAECMVDFFANRRIPPSAIDNIGEVVLLSSKQMLMVFLLVYWLALPEDMALSLINSSLWVVLAYDTVALCFRAKVISRNTDSDSSSDSEADDVKARPANAAKAPENLGSEAQLDEMTMAAASLERNQSVSGLDQLDDNSQHKPSSFDSDCQQDGDSAATERQFSPDKLYRAAVLKKRFLDTILKAREKTLTQGEKGDPEKLRQEREKLEMEQKKGDLGIVLARLQAEAKAAEDARKQAEEEAAAEARRKRELEREAARQALLQMEKTVEINENSRILEDLELLRAVPTEQLPSSVDETSPAHSQDGLGSFKFGSSNPLEQLGLYIKADDEEEEGEPPCIPNPVNDVEE

SEQ ID NO: 156586 - protein, 122 aa, Glycine max
  Coding DNA Sequence Number=SeqID_64901
  Gene Ontology: Mol. function=protein dimerization activity; Cellular component=nucleus; Biological process=regulation of transcription, DNA-dependent
  Homolog annotation: Hit_ID=A7PPH0; Match level="QueryCoverage=37%, HitCoverage=19%, E-value=8e-08, Identity=63%"; Hit description =Chromosome chr8 scaffold_23, whole genome shotgun sequence
MFQALYEELTRKVVTLVAENENLKREKELALKEYESLETTNKNLKTQIAKSINTEVEKTPVEPVSSVAEITPSSEEDKKAFEMTESKEATLLEAEKISCRKSEVDFKKLDDLMVQLLQQLRL

SEQ ID NO: 156587 - protein, 38 aa, Glycine max
  Coding DNA Sequence Number=SeqID_64902
MKKILGLQAPMELTPCARKFHWLPLASKGIPLLVDFPC

SEQ ID NO: 156588 - protein, 68 aa, Glycine max
  Coding DNA Sequence Number=SeqID_64903
IKLKTLDEAMELIENMAASDHAILRDRVNTPIKKSLLELTSQDALLALNKLLAKQLETLIETLSKLPQ

SEQ ID NO: 156589 - protein, 216 aa, Glycine max
  Coding DNA Sequence Number=SeqID_64904
  Gene Ontology: Mol. function=structural constituent of ribosome; Cellular component=intracellular; Biological process=translation
  Homolog annotation: Hit_ID=A7QF16; Match level="QueryCoverage=92%, HitCoverage=100%, E-value=2e-59, Identity=56%"; Hit description =Chromosome chr16 scaffold_86, whole genome shotgun sequence
  Pfam annotation: Domain name=Ribosomal_L9_N; Domain location=44-80; Score=28.6; E_value=2.4e-05; Accession=PF01281.10; Description =Ribosomal protein L9, N-terminal domain
MKFVVRKEVTWNLNPNLMGYLQFGRHGVKQIIRFRDASYDNVVDIDKLGKAGDTVKVAPGYFRNHLMPKLLAFPNIDKFAYLLNEQRKIYQPTEEENQEDVTLVKESKEDMMKEYEKAALRLDKAKLVLRRLINVQKAKSRESKEDPLELRYPVTKDILVAEVARQLCVNVAPDNLHLPSPLSTLGEYEVPLRLPRSIPLPEGKVNWSLKVKIRSK

SEQ ID NO: 156590 - protein, 84 aa, Glycine max
  Coding DNA Sequence Number=SeqID_64905
  Pfam annotation: Domain name=zf-CCHC; Domain location=67-81; Score =8.8; E_value=0.071; Accession=PF00098.14; Description=Zinc knuckle
MEMSNFASKLKSLKLELGEDLLMHLVLISLPAHFGQFKNKKRKKTKGVAEGTSQQKKQKKDEKFTYYLCKKSRHMKKECPKYAA

SEQ ID NO: 156591 - protein, 45 aa, Glycine max
  Coding DNA Sequence Number=SeqID_64906
MPMTESLTRGTFVEGHGKQGGWHLLFEEPGHGYAISRSSMQLHCW

SEQ ID NO: 156592 - protein, 119 aa, Glycine max
  Coding DNA Sequence Number=SeqID_64907
  Gene Ontology: Mol. function=aspartic-type endopeptidase activity; Biological process=DNA integration
  Homolog annotation: Hit_ID=A5B0V5; Match level="QueryCoverage=98%, HitCoverage=10%, E-value=1e-33, Identity=63%"; Hit description =Putative uncharacterized protein
MALEEGKVKIKKFDGTDFNFWKMQIEDYLYQKKLYQPLSRVKPDDMKQEEWNLLDRQTLGVIILTLAKNIAFNIVNKKKTTIGLMKAQSDMYEKPSATNKVYLMRQLFDLKMGRKYLRN

SEQ ID NO: 156593 - protein, 299 aa, Glycine max
  Coding DNA Sequence Number=SeqID_64908
LIGIALANPRTRQERAPRRAPGVLAHFAVLRPGHPGHQPADPLHRSATAQERPGRHQREPLHPGLRARGPAVGRRRDERRGADLGAVGRQLGHVRLHAHALYAGLPAHGAAHVLVRQQARRAHDGPAGHHGRGCAVLSDQHLQPPAGLHLAAESVGHDGLHRLAGHRHQPLPLPQGLRGPGPGPEPAALPCIVVPVRPHLRLRAVHGDHAGPELRGLHGRPHRLDRRGRHLYRPAVVPADLGRLPPGQGHAHREVQGHATGLQRRLTPGPVPMKNSPQMRAVAFRHRPTTRPARSRPDR

SEQ ID NO: 156594 - protein, 136 aa, Glycine max
  Coding DNA Sequence Number=SeqID_64909
MFLLHPLLLYNNFFLLLLLMGRLFGLDLSLLLPKDPFNLHSKAKSFQSLVFISNSLGQFLLPLLLNVILVYNTEVLLSSDEAALVDNGLLGVIIHSFEDMEDLVFQKNFVDEGGIVDVIHSSQSLHIPQDVDLDCV

SEQ ID NO: 156595 - protein, 181 aa, Glycine max
  Coding DNA Sequence Number=SeqID_64910
  Homolog annotation: Hit_ID=Q6WAY6; Match level="QueryCoverage=94%, HitCoverage=29%, E-value=3e-20, Identity=33%"; Hit description =Putative uncharacterized protein
MGQLQRQAFCKAYGKIWDLAMVEVSTETIASLAQYYDQPLRCFTFGDFQLSPMVEEFEEILGSPLRRRRPYLFSGLYPSLARISKIVQILAQELDHRKQVENGVVGIPIKCLEAKARNLAGKGKWAPFIDILTLLIFGGVLFPNVDGLVDLAAINAFLAYHDHKESPVVAMLADLYDTFDR

SEQ ID NO: 156596 - protein, 100 aa, Glycine max
  Coding DNA Sequence Number=SeqID_64911
MANTVARQEEERVDTETYQESIFQVTSIHHQMTTEEEMSEVSSTPEYSCSAAAGYVRGIEKGRLELTIEDRKVSFDLFEAMKHSDMGDACSEEEEVEQEI

SEQ ID NO: 156597 - protein, 54 aa, Glycine max
  Coding DNA Sequence Number=SeqID_64912
MASYGDLKNTKESIDEEDPRPTSSTWSYIMWYQEHLHLGDVLLLPLSFCSVNSL

SEQ ID NO: 156598 - protein, 213 aa, Glycine max
  Coding DNA Sequence Number=SeqID_64913
  Homolog annotation: Hit_ID=Q2HW90; Match level="QueryCoverage=85%, HitCoverage=36%, E-value=2e-24, Identity=33%"; Hit description =Putative uncharacterized protein
MAEVSTEAISSLAQYYDQPLRCFTFGDFQLTPMMEEFEEILGCPLGGRKPYLFSGFYPSLARISKIVKISTQELNCGKQVENGVVGVPRKCLEVKARVLASQDEWDPFMDIMALLIFGVVLFPNVDGLVDRTAIDVFLAFYDRKESPVVAILADLYDTFNRRCEKNNARIICCTPALYIWLVSHFFRQEMRHVCPLERHRSCTEKKRQTGTDS

SEQ ID NO: 156599 - protein, 58 aa, Glycine max
  Coding DNA Sequence Number=SeqID_64914
MKLASTVSCYGPYTQVHGNIGSGVKPHLEFFLFDDTLLLVVPTIAMLDIKGDDISRNL

SEQ ID NO: 156600 - protein, 42 aa, Glycine max
  Coding DNA Sequence Number=SeqID_64915
MPPPPPSYGILGCLAATFSAGPASGRGDDWSVVALSSICLHP

SEQ ID NO: 156601 - protein, 179 aa, Glycine max
  Coding DNA Sequence Number=SeqID_64916
MERSMIDASSGGALGDMTPVEARNLIEKIASNSQQFSARNDAIVLRGVHDMATNSSSSAKNKKLEGKLDALVNLVTQLAINQKTASAPVTVARVCGLCFSADHHTDLYPSLQQSGVNEQPEAYAANIYNRPPQQQNNNSRIIMIFQATDTIQQQQPVPPFQNATGPSRPYVPPAMQQQQ

SEQ ID NO: 156602 - protein, 217 aa, Glycine max
  Coding DNA Sequence Number=SeqID_64917
  Gene Ontology: Mol. function=transcription repressor activity; Cellular component=flagellin-based flagellum; Biological process =regulation of transcription, DNA-dependent
  Homolog annotation: Hit_ID=P26477; Match level="QueryCoverage=46%, HitCoverage=100%, E-value=1e-25, Identity=63%"; Hit description =Negative regulator of flagellin synthesis
  Pfam annotation: Domain name=FlgM; Domain location=10-94; Score=82.4; E_value=1.4e-21; Accession=PF04316.4; Description=Anti-sigma-28 factor, FlgM
  Pfam annotation: Domain name=FlgN; Domain location=80-211; Score =64.0; E_value=5e-16; Accession=PF05130.3; Description=FlgN protein
  Pfam module annotation: Pfam domain module=FlgM::FlgN; Domain location=10-94::80-211
  Subcellular localization annotation: CTP_CleavageSite=28; ConfidenceScore=5.42e-01
MSIDRTQPLKPVSTVQTRDSSDNQAKVRQNSAPAASTSQNGAEVTLSPAQAQLMQPGSKDINTARVEQLKTAIRNGELKMDTGKIADALIADTRAFLEEQQQLSAGRINGNLLQRITEDKSALLTTLNYLDEMRRKTELSLGTKAPYRGHIDIARRWHSIQQHTQRLRDANQHNGMLLQHQMTFTEQALSVLKPHQTQSFYGPDGRGLGQATLSRKG

SEQ ID NO: 156603 - protein, 1117 aa, Glycine max
  Coding DNA Sequence Number=SeqID_64918
  Gene Ontology: Mol. function=hydrolase activity, acting on glycosyl bonds; Cellular component=flagellin-based flagellum; Biological process=peptidoglycan catabolic process
  Homolog annotation: Hit_ID=A1JT00; Match level="QueryCoverage=27%, HitCoverage=100%, E-value=1e-106, Identity=63%"; Hit description =Flagellar protein FlgJ
  Pfam annotation: Domain name=DUF1078; Domain location=204-242; Score =77.4; E_value=4.6e-20; Accession=PF06429.4; Description=Domain of unknown function (DUF1078)
  Pfam annotation: Domain name=FlgH; Domain location=252-458; Score =272.9; E_value=6.5e-79; Accession=PF02107.7; Description=Flagellar L- ring protein
  Pfam annotation: Domain name=FlgI; Domain location=466-789; Score =590.3; E_value=1.9e-174; Accession=PF02119.7; Description=Flagellar P-ring protein
  Pfam annotation: Domain name=Flg_bb_rod; Domain location=1-17; Score =12.3; E_value=0.033; Accession=PF00460.11; Description=Flagella basal body rod protein
  Pfam annotation: Domain name=Glucosaminidase; Domain location=960 -1100; Score=208.1; E_value=2.1e-59; Accession=PF01832.11; Description=Mannosyl-glycoprotein endo-beta-N-ace
  Pfam module annotation: Pfam domain module=DUF1078::FlgH::FlgI::Flg _bb_rod::Glucosaminidase; Domain location=204-242::252-458::466 -789::1-17::960-1100
MDVIANNLANVSTNGFKRSRAVFEDLMYQTLRQPGAQSSEQTTLPSGLQIGTGVRPVTTERLHNQGNLSQTSNSKDVAINGQGYFQVQMPDGTSAYTRDGSFQVDQNGQLVTNAGFPVQPGITIPANATSITIARDGVVTVTQQGQTQPAQVGQLTLSTFMNDAGLDSVGENLYQETQASGAPTESTPGQNGAGLLYQGYVETSNVNVAEELVTMIQTQRAYEINSKAISTSDQMLQKLTQLSELRGEASDSQAWALGATTAEPTPSAPPVVNGSIFQGVAPLNYGYQPLFEDRRPRNIGDTLTITLQENVSASKSSSANASRDGSNSFGLSAIPTGLAGLVGAGGEKAALDANGKNDFAGKGGATANNTFTGTITVTVNQVLSNGNLRVVGEKQIEINQGTEFIRFSGVVNPRTISASNAVLSTQVADARIEYVGNGYINEAQTMGWFQRFFLNVSPILMAQADRIRDLTSVQGVRDNQLIGYGLVVGLDGTGDQTTQTPFTTQTVSNMLSQLGITVPAGTNMQLKNVAAVMVTAKLPSFARQGQTVDVVVSSLGNAKSLRGGTLLMTPLKGVDNQVYALAQGNILVGGAGASAGGSSVQVNQLNGGRITGGATVERELQSNFGSQNTINLQLNNEDFTMAQRIADAINSRGVGSALPLDARTVQIRVSPNNSSQVRLLAEIQNIDVSVPLEDAKVIINSRTGSVVMNREVTLNTCAVAQGNLSVTVNQQQNVSQPDTPFAGGQTVATTQTQIDLRQSGGALQRVNASANLNNVVRALNALADVDSAIDGERGLPAREAGNYLMTDTQSLMNAAYDSRSLNELKRQAAVDPKGKALQVAKQVEGMFVQMMLKSMREALPQDGMLSNDQTRLYTSLYDQQIAQEIGKRGLGLADTIVKQMQPAQAPDESAGTVPMKLDNSFIYSSMAPTQLEQMVRKAVPRLPVSPASLPGDSNEFIAQLAQPAKVASQQSGIPHHLILAQAALESGWGQRQILTRDGKPSYNVFGIKASGDWKGETTDIMTTEYEGGEAKKVRATFRVYGSYFEALSDYVRLISSNPRYAAVANAPSAEQGARALQAAGYATDPKYAQKLVGMIQQFKNMGEKVVKAYSQDFTDLF

SEQ ID NO: 156604 - protein, 295 aa, Glycine max
  Coding DNA Sequence Number=SeqID_64919
  Gene Ontology: Mol. function=structural molecule activity; Cellular component=flagellin-based flagellum filament; Biological process =ciliary or flagellar motility
  Homolog annotation: Hit_ID=P16326; Match level="QueryCoverage=100%, HitCoverage=91%, E-value=2e-99, Identity=64%"; Hit description =Flagellar hook-associated protein 3
  Pfam annotation: Domain name=Flagellin_N; Domain location=1-136; Score=64.9; E_value=2.7e-16; Accession=PF00669.11; Description =Bacterial flagellin N-terminus
  Subcellular localization annotation: CTP_CleavageSite=40; ConfidenceScore=5.21e-01
GEQLSTGRRVTNPSDDPIAASRAVVLSQTQARDSQFALARSFANQGLSLEESTLSDVTTAIQSAQSTLISAGNGSLSDDDRASYATQLEGIRSQLLNLANSKDGNGRYLFAGYASDKPPFTEDASGKIIYSGGSDAITQKVDSERTMTVGHTGNSIFDQLTSNAKPEPDGSASQTNLFDMLDDAIAALKVPQNDADDATKQTFSAAMDKANRGFSNSLNNVLAVRSEIGTQLDELDTLDAKGDDRKVTLKDQMSTLVNVDYTEAISTYTMQQQLLQASYTTFSDMSKMSLFQMNK

SEQ ID NO: 156605 - protein, 93 aa, Glycine max
  Coding DNA Sequence Number=SeqID_64920
MYQYPFEGHDTDMSASEHSFGGVAETHPHFSWPTMTSSQQHDGPMATPNAPLGPQWDGGDSAQEEIQIVKPEGGIDHVAHPHATTDTIMTDFD

SEQ ID NO: 156606 - protein, 80 aa, Glycine max
  Coding DNA Sequence Number=SeqID_64921
RIGAVGAPDGPWRRWAATAVVEDDPFLFFDGSAILMKFHWISIGGSERGVKKRKIRLYGTRFGEDLSKIRSLEDLGMEET

SEQ ID NO: 156607 - protein, 213 aa, Glycine max
  Coding DNA Sequence Number=SeqID_64922
  Gene Ontology: Mol. function=structural constituent of ribosome; Cellular component=ribonucleoprotein complex; Biological process =translation
  Homolog annotation: Hit_ID=A7ZSJ8; Match level="QueryCoverage=48%, HitCoverage=100%, E-value=4e-50, Identity=98%"; Hit description=50S ribosomal protein L24
  Pfam annotation: Domain name=KOW; Domain location=116-146; Score =32.8; E_value=1.2e-06; Accession=PF00467.20; Description=KOW motif
  Pfam annotation: Domain name=Ribosomal_L14; Domain location=1-122; Score=213.8; E_value=3.9e-61; Accession=PF00238.10; Description =Ribosomal protein L14pL23e
  Pfam module annotation: Pfam domain module=KOW::Ribosomal_L14; Domain location=116-146::1-122
MIQEQTMLNVADNSGARRVMCIKVLGGSHRRYAGVGDIIKVTIKEAIPRGKVKKGDVLKAVVVRTRKGVRRPDGSVIRFDGNACVILNNNSEQPIGTRIFGPKYSKERTMAAKIRRNDEVIVLTGKDKGKRGKVKNVLTSGKVIVEGINLVKKHQKPVPALNQPGGIVEKEAAIQVSNVAIFNAATGKADRVGFRFEDGKKVRFFKSNSETIK

SEQ ID NO: 156608 - protein, 100 aa, Glycine max
  Coding DNA Sequence Number=SeqID_64923
PFGQFARLAVIRIEFAKQIAQCQCVAAHLQFRWEITGVFQQSPGTAQFRRHTTVIVQRERRTFTRQIAQLALFLSGADVLLSQLIDKPHRNLLQACLPTA

SEQ ID NO: 156609 - protein, 342 aa, Glycine max
  Coding DNA Sequence Number=SeqID_64924
  Homolog annotation: Hit_ID=B0H6W1; Match level="QueryCoverage=9%, HitCoverage=78%, E-value=5e-08, Identity=90%"; Hit description =Putative uncharacterized protein
PAGGAVPVLVEWYGTNLRNIAAGAAAALWPTIRAGCGCPEPDIHLSSRHNYWPNKAAFTGWHQAAGANHHLIFDDRAIQQDRAHTHQHAVANGAAVQHCFMAHRHVFTDDQWKAIGITAGFMRNVQHAAILDIAAFTNHHFIHVTADCYQWPDADIISQLDFANDHATAIHHHTLAGMRNMLLIRAQGYRHSISPFLMFPASLRLPVRESVIYATSRQQAERRVAPLFNNLSDNLLNAGGRPNTCKSNGSTEELALWVASGGRVSNVWETARWRGITTGNATLELRHGPDSYGRQQWGILHNGRKPDAAMPQEAPANSVPAAAVIRRVQALIGITGRKAHAG

SEQ ID NO: 156610 - protein, 107 aa, Glycine max
  Coding DNA Sequence Number=SeqID_64925
MSRNEVQRSSPYYAVDLITSCMRGNSSAGNLAPLDLEIEATCRRNNVEKRRKFLQERTTQPSSVEVQSSSAFPELRDFEVGASEAHIMVEDQPRRLTLEDYSSSIMS

SEQ ID NO: 156611 - protein, 160 aa, Glycine max
  Coding DNA Sequence Number=SeqID_64926
MLTSSERAQTTTLVFAYQSELGSPNDEDGVVNKSGAFAPTYPQFEMRNLDLRSSYKAMTTLASACQSDLGSPNDKVRITVRCLRMLPDSQVMIAKGGSRLEDADIFGKGVDDHIGLYVSIGLGDSKKYARITIGCLRVPPDSQVTIAKGGVVDKSGAFAP

SEQ ID NO: 156612 - protein, 174 aa, Glycine max
  Coding DNA Sequence Number=SeqID_64927
  Gene Ontology: Mol. function=transcription factor activity; Cellular component=intracellular; Biological process=negative regulation of transcription, DNA-dependent
  Homolog annotation: Hit_ID=Q57JC8; Match level="QueryCoverage=100%, HitCoverage=66%, E-value=5e-79, Identity=87%"; Hit description =Transcriptional regulator nanR
  Pfam annotation: Domain name=GntR; Domain location=29-92; Score=93.7; E_value=6e-25; Accession=PF00392.12; Description=Bacterial regulatory proteins, gntR fam
  Pfam annotation: Domain name=LexA_DNA_bind; Domain location=26-90; Score=0.6; E_value=0.013; Accession=PF01726.7; Description=LexA DNA binding domain
  Pfam module annotation: Pfam domain module=GntR::LexA_DNA_bind; Domain location=29-92::26-90
MSAFDHSSDDTQETIGNSLRRRPLARKKLSEMVEEELEQMIRRGEFGEGGQLPSERELMAFFNVGRPSVREALAALKRKGLVQINNGERARVSRPSADTIISELSGLAKDFLSAPGGIAHFEQLRLFFESSLVRYAAENATDEQISLLSKALEINGQSLDDNAQFIRSDVDFHR

SEQ ID NO: 156613 - protein, 146 aa, Glycine max
  Coding DNA Sequence Number=SeqID_64928
  Pfam annotation: Domain name=Rep_fac-A_C; Domain location=40-145; Score=-62.6; E_value=0.027; Accession=PF08646.1; Description =Replication factor-A C terminal domain
IEVRAILVPIGQGSSQVSGSSQLSSKDAFLSKTEEFVCVTVAKITTIVMDNYSWCYPACGQCYKKADMQTVSFTCPCGKENDQPVLRVNKPNFFIWDRECAQLIGQSADEVNRLKIEDGGVDLNAYPQALDRLLGCFLAFKVKVQA

SEQ ID NO: 156614 - protein, 107 aa, Glycine max
  Coding DNA Sequence Number=SeqID_64929
  Subcellular localization annotation: CTP_CleavageSite=50; ConfidenceScore=5.61e-01
MHTRSFTNPQFLKSRPNSQKVPSGVANYRNVPFAGERGRGSRMRFPKEERCAESPPTFICGKRRENQRKPVKMRILSSGVVFTLEEGRQKRGFCSYVPSFGEEIRPT

SEQ ID NO: 156615 - protein, 52 aa, Glycine max
  Coding DNA Sequence Number=SeqID_64930
MGLRSRIILSNGQMSGQIQRQRPIKVNGNAATVCRTMSFPTFKYLGMDASRG

SEQ ID NO: 156616 - protein, 294 aa, Glycine max
  Coding DNA Sequence Number=SeqID_64931
MASKKRKAPSTPTQARFDRSRNVILHHSDFDEFTEELKCRNWHKELKNFVDGSIDVAIVKEFYANLYDPKDKPPKGRTFQYTPGSVIQSQNHRNWQLDYASLEGSDGLPLKILLKNLTTLAQTWSVLSFSNLVPTSHTSDITLDRARLGFPALITTLCKARGVVSNSLTLESLGLAINVAYEKKNYWNLDDLSVTFRGPRKAKGKRPEAPPSSEIPFSSTPTPIPAAPSTSTFVLPGLGFPSIMSMEEFNAQVAWPGAQSSPSGGGGASIAQEPAFEEPAIAATAEGEDELTSP

SEQ ID NO: 156617 - protein, 50 aa, Glycine max
  Coding DNA Sequence Number=SeqID_64932
PYGACRPWIFFINGFLGFLRSDFSGMEKEKDEWRHYLLPTSAPNRTSSIK

SEQ ID NO: 156618 - protein, 196 aa, Glycine max
  Coding DNA Sequence Number=SeqID_64933
MVSNPSRAQKKAKTSKRKQGEWSQDALNRLDTWFTDESKKNDYKMIYAMKNVRISKYLDLEWFSQQGFNFSNLLEAQGLSKLVQMKGIFYPKLVKVFYTCAHADLEGNLFSIVNGVEMVIDTEVWKEVAGLDMGGVCEFEETTNGYNKMQTNGGMLLDPTRNLRNHLGVGGMSTEEKMLVYLITYILSLRSSNHAQ

SEQ ID NO: 156619 - protein, 78 aa, Glycine max
  Coding DNA Sequence Number=SeqID_64934
ASNKIPEACRLSDGPTGSVVVHFVVMFSMFLIVQVAIRNVMKVHHQKAYVTQARTAATETTKSYVTHADCSKMKGREI

SEQ ID NO: 156620 - protein, 167 aa, Glycine max
  Coding DNA Sequence Number=SeqID_64935
MASGNRLPRVGNRLKGLKMETGGKDGLWLENEVRKLREPLRDGSLVIDYQIVMAAQLIRDRVEMECLEGVWETLEGNTRCRFRGTIRFTATSLPVQVIEVTSSEEDPEEDPEELPPEPAVDALDFLEGDEDPLPEVDSPEEVMSASEADSTEDSGPGEMAISGGSSS

SEQ ID NO: 156621 - protein, 68 aa, Glycine max
  Coding DNA Sequence Number=SeqID_64936
MHMTQMQFHEYGSLGNCLLLRYNVWGSTAPDVCILEGDTDPPMVCQSEGIKTKPAHDAYAKGTTRGCT

SEQ ID NO: 156622 - protein, 65 aa, Glycine max
  Coding DNA Sequence Number=SeqID_64937
  Homolog annotation: Hit_ID=A6FJQ2; Match level="QueryCoverage=58%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLDCNHEGWV

SEQ ID NO: 156623 - protein, 120 aa, Glycine max
  Coding DNA Sequence Number=SeqID_64938
MPEVEREHCRTIRKVPQHSGSQRGDGCVIALLLEEATLGELGGNLLPLFPIKRQKGVVPRVPDPPSYAFQLFWVKKNCFREENPSRGASVTLPRCFREQIREGFSSFFICSSFVLRSSTL

SEQ ID NO: 156624 - protein, 173 aa, Glycine max
  Coding DNA Sequence Number=SeqID_64939
HPLDLDKSNRAMGFSALITGLCQSFGVPVAPSKVIRLPITRAFIEKYCTQRQVQGDAPQAADAPPPHQAGPAGSFDTEQYLWHLVRQQAANHRAHVQTHDCLYQMSLSLQSQGFTSFPCPTPDQFRAEVAWPGDWPEAQAGEAPAEAPDEADEAREDEEMTDLLDFLGGSGAT

SEQ ID NO: 156625 - protein, 196 aa, Glycine max
  Coding DNA Sequence Number=SeqID_64940
  Gene Ontology: Mol. function=protein serine/threonine kinase activity; Cellular component=cytosol; Biological process=protein amino acid phosphorylation
  Homolog annotation: Hit_ID=Q2QM68; Match level="QueryCoverage=71%, HitCoverage=58%, E-value=2e-51, Identity=61%"; Hit description =Putative uncharacterized protein
  Pfam annotation: Domain name=Lactamase_B; Domain location=60-194; Score=-1.7; E_value=0.1; Accession=PF00753.18; Description=Metallo -beta-lactamase superfamily
MATFNGFVDGTPSESALIFLGTGCSSMVPNLMCLLQPSDPPCPVCVQSLSIPPERNPNYRCNTSLLIDYGAAAANGGDRKYILIDVGKTFRETVLRWFVAHRIPRIDSIILTHEHADAVLGLDDIRAVQAFSPTNDIDPTPIYLSQHSMDSKLTQKEEVVPLAVMVSQLKLRRLSIDQYGSLIFNMDDVIQVAITG

SEQ ID NO: 156626 - protein, 633 aa, Glycine max
  Coding DNA Sequence Number=SeqID_64941
  Gene Ontology: Mol. function=mannosyl-oligosaccharide 1,2-alpha -mannosidase activity; Cellular component=membrane; Biological process=protein amino acid N-linked glycosylation
  Homolog annotation: Hit_ID=Q93Y37; Match level="QueryCoverage=99%, HitCoverage=99%, E-value=0.0, Identity=72%"; Hit description =Endoplasmic reticulum alpha-mannosidase, putative
  Pfam annotation: Domain name=Glyco_hydro_47; Domain location=145-629; Score=596.0; E_value=3.6e-176; Accession=PF01532.11; Description =Glycosyl hydrolase family 47
  Subcellular localization annotation: CTP_CleavageSite=22; ConfidenceScore=5.33e-01
MSKSLPYSTKDVDYDNAKFRPRSFFKVATQNLLTSNLRRDCGSCSTGKFLFLILIFGVAYLMLAHTSSGGVVSDDEAIVNRNSYANSSIVNGAGKIKRFWRRPPRLPPRLSPDEKGSGNGNDHVSGNPDVVRSMWIARQKKVKEAFVHAWSGYKKFAMGYDELMPLSQHGIDGLGGLGATVVDALDTAMIMGLDEVVAEAGSWVEEHLSERISKKGQVNLFETTIRVLGGLLSAYHLSGGEKGTNLTHAGPKPAVYLETAKDLADRLLSAFTASPTAIPFSDVILHEKSAHPAPGGLSSTSEVSTLQLEFNYLSQISGDQKYSLEAMKVMEHMKTLPKIEGLVPIYISPHSGEFSGENIRLGSRGDSYYEYLIKVWLQSGASSNSNTSYLYEMYNEAMNGVRHLLVRKSIPNGLVFVGELPYGSNSNFSPKMDHLVCFLPGTLAIGATKGLTKKQAMKNNMLNFEDLENLKLAEDLTKTCFEMYAVTSTGLAPEIAYFHTEEFSEQGHDGGNKSSEFVNDIIIKPADRHNLLRPETVESLFVLYRITEDPKYREWGWQIFEAFEKHTKVDTGGYCSLDDVTIVPPHRRDKMETFFLGETLKYFYLLFADSSLIPLDKFVFNTEAHPIPINLKK

SEQ ID NO: 156627 - protein, 689 aa, Glycine max
  Coding DNA Sequence Number=SeqID_64942
  Gene Ontology: Mol. function=acyl-CoA binding; Cellular component =microtubule cytoskeleton; Biological process=lipid transport
  Homolog annotation: Hit_ID=A7NW70; Match level="QueryCoverage=99%, HitCoverage=98%, E-value=0.0, Identity=63%"; Hit description =Chromosome chr5 scaffold_2, whole genome shotgun sequence
  Pfam annotation: Domain name=Kelch_1; Domain location=136-182; Score =18.6; E_value=0.018; Accession=PF01344.16; Description=Kelch motif
  Pfam annotation: Domain name=Kelch_1; Domain location=187-233; Score =22.1; E_value=0.0021; Accession=PF01344.16; Description=Kelch motif
  Pfam annotation: Domain name=Kelch_1; Domain location=239-284; Score =19.1; E_value=0.016; Accession=PF01344.16; Description=Kelch motif
  Pfam annotation: Domain name=Kelch_1; Domain location=289-334; Score =18.1; E_value=0.021; Accession=PF01344.16; Description=Kelch motif
  Pfam annotation: Domain name=Kelch_1; Domain location=78-123; Score =33.4; E_value=8.1e-07; Accession=PF01344.16; Description=Kelch motif
  Pfam annotation: Domain name=Kelch_2; Domain location=136-182; Score =22.3; E_value=0.0019; Accession=PF07646.6; Description=Kelch motif
  Pfam annotation: Domain name=Kelch_2; Domain location=187-233; Score =20.6; E_value=0.0058; Accession=PF07646.6; Description=Kelch motif
  Pfam annotation: Domain name=Kelch_2; Domain location=238-284; Score =22.5; E_value=0.0015; Accession=PF07646.6; Description=Kelch motif
  Pfam annotation: Domain name=Kelch_2; Domain location=289-334; Score =3.5; E_value=17; Accession=PF07646.6; Description=Kelch motif
  Pfam annotation: Domain name=Kelch_2; Domain location=78-123; Score =23.4; E_value=0.00083; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=136-182::187-233::239-284::289-334::78-123::136 -182::187-233::238-284::289-334::78-123
MSQDKFNRLKVQLSDTTQGTRSPIRHHKRNGDRVAGTSGHSEEIDCPLSSAAPEMHTCTAGSSENWMVLSIAGNKPTPRSHHAAAVIQNKMIVVGGESGSGLLDGVQVLNFDRFSWTTASSKLYLSPSSLPLKIPACKGHCLVSWGKKALLIGGKTDPASDKISVWAFDTETECWSLMEAKGDIPVARSGHTVVMANSVLILFGGEDAKRRKLNDLHMFDLKSLTWLPLHCTGAAPCPRFNHVAALYDGKILFIFGGASKSRTLNDLYSLDFETMAWSRIKIHGFHPSPRAGCCGVLCGTKWYITGGGSKKKRHGETLVYDVVKSEWSVAITSPPSSITTNKGFSVALVQHKDKDFLVAFGGSKKEPSNQVEVLITEKIESVLGRRPTSTKDPRSILLEKHSLSAGLASQLKNDSSQHLINSVARQNLASVIEHSSERKSLSESLLVQDSNSLPTNISLRRQFDHDEECNADVRIDKHSEDESSFPRNSLQAADHKTNQNDPRNHMSRSGAKTNMEEQVSVSRSSNQKNLGFGNPVLESDDVSFPENSKSGSLSAASDIHHYYETKVASLMRKFGILEGQLAVALASREASEKSLASAFKSRQEMERKLADTLKEMELLREKLVSAELVQEEANNLSNMVHADNVRLEHDVAFLKAVLDDTQKVEVFHLKQRLQSMEKRAPTPRKPFQV

SEQ ID NO: 156628 - protein, 167 aa, Glycine max
  Coding DNA Sequence Number=SeqID_64943
MGEGYCTQPYPCICKEAVSGFEPMTNKSPRHNFTAAPGLALVHMHKCSRKILYRGKGNQTMIHQNCQTSHAIPSSSDKQQNKWSLSAYYGNATKYYRKASSRIAVNRNAEEKQKTHLSNNYCVPFLYTKFHERLVHTTSLKNTLESSLQINVPVKDPQISMKLDMNG

SEQ ID NO: 156629 - protein, 126 aa, Glycine max
  Coding DNA Sequence Number=SeqID_64944
MCSQKYWFVTYEKQSGGNVLLGYVLIRMHDNDVRTLIKVRHMAKLKKNLVFMGVMDFKRVPSLEVWSNNPTEYSMLKVYGCLTYYYASEVGRQHFNTTKIEYMTLVEASKEGMWLKDLINNVGFTQ

SEQ ID NO: 156630 - protein, 1462 aa, Glycine max
  Coding DNA Sequence Number=SeqID_64945
  Gene Ontology: Mol. function=ATPase activity, coupled to transmembrane movement of substances; Cellular component=integral to membrane; Biological process=transport
  Homolog annotation: Hit_ID=A7Q1B7; Match level="QueryCoverage=71%, HitCoverage=97%, E-value=0.0, Identity=74%"; Hit description =Chromosome chr10 scaffold_43, whole genome shotgun sequence
  Pfam annotation: Domain name=ABC_membrane; Domain location=841-1113; Score=87.6; E_value=3.9e-23; Accession=PF00664.14; Description=ABC transporter transmembrane region
  Pfam annotation: Domain name=ABC_tran; Domain location=550-714; Score= 70.3; E_value=6.6e-18; Accession=PF00005.18; Description=ABC transporter
  Pfam annotation: Domain name=MMR_HSR1; Domain location=1190-1279; Score=-13.0; E_value=0.017; Accession=PF01926.14; Description=GTPase of unknown function
  Pfam module annotation: Pfam domain module=ABC_membrane::ABC _tran::MMR_HSR1; Domain location=841-1113::550-714::1190-1279
MAFEPLNWYCRPVANGVWTKSVENAFGAYTPCAVDSLVISVSNLILLGLCIYRIWLIMKDFTVKRFCLRSNLYNYILGLLALYCVAEPLYRLIMGISVLNLDGQTQLAPFEALAWCSILILIGIETKVYIREFRWFVRFGLIYAIVGDAVMFNLIISAKEFYSSSVLYFYISEVVGQVLFGILLLVYVPTLDPYPGYTPIGTEMITDATYDELPGGDMICPERSANILSRIMFSWMNPIMKLGYERPLTEKDIWKLDTWERTETLINKFQKCWVEESRKSKPWLLRALNASLGGRFWWGGFCKVFGVLCEAQYFQNVMRVGYRLRSTLVVKELLDSIILNHLVSAGVAVQVAAVFRKSLRLTHEARKQFATGKITNLMTTDAEALQQICQSLHTLWSAPVRIVVAMVLLYQQLGVASLLGALMLVLMFPLQCNGFILNSIPVFVTVITFGVFTLLGGDLTPARAFTSLSLFSVLRFPLFMLPNTITQVVNANVSLKRLEDLLLAEERVLLPNPPIEPGLPAISIKNGYFSWDAKAERASLSNINLDIPVGCLVAVVGSTGEGKTSLVSAMLGELPPMADSSVVLRGTVAYVPQVSWIFNATVRDNILFGSVFDPARYQRAINVTELQHDLELLPGGDLTEIGERGVNISGGQKQRVSMARAVYSNSDVYIFDDPLSALDAHVARQCSNSKVICYGIVFGHLRASPGAAVKLCLGDLLVMGSNPETASLHMQGIILVHEGMVKEEGTFEELSNHGPLFQKLMENAGKMEEYEEEEKVDTETTDQKPSSKPVANGAINDHAKSGSKPKEGKSVLIKQEERATGVVSLNVLTRYKSALGGFWVVFVLFACYVSTETLRISSSTWLSHWTDQSATEGYNPVFYNMIYAALSFGQVLVTLTNSYWLIISSLYAARRLHEAMLSSILRAPMVFFQTNPLGRVINRFAKDLGDIDRNVAPFVNMFLGQVSQLLSTFILIGIVSTMSLWAILPLLVLFYVAYLYYQSTAREVKRLDSISRSPVYAQFGEALNGLSTIRAYKAYDRMADINGKSMDNNIRFTLVNMSGNRWLAIRLETLGGLMIWLTATFAVMQNGRAENQQEFASTMGLLLSYALNITSLLTGVLRLASLAENSLNAVERIGTYIDLPSEAPSVIDNNRPPPGWPSLGSIRFEDVVLRYRPELPPVLHGLSFTIFPSDKVGIVGRTGAGKSSMLNALFRIVELEQGRILIDDYDVAKFGLADLRKVLGIIPQSPVLFSGTVRFNLDPFNEHNDADLWEALERAHLKDVIRRNSLGLDAEVLEYDTPEELLSNEGSAFSKMVQSTGAANSQYLRSLALGGDKSEREENKHLDARRKWLASSRWAAAAQFALAVSLTSSHNDLQRLEVEDENSILKKTKDALITLQGVLERKHDKEIEESLEQRQISPDGWWSSLYKMIEGLAIMSRLTVNRFHQSDFGFEDRSINFDQVDM

SEQ ID NO: 156631 - protein, 511 aa, Glycine max
  Coding DNA Sequence Number=SeqID_64946
  Gene Ontology: Mol. function=transcription factor activity; Cellular component=nucleus; Biological process=regulation of transcription
  Homolog annotation: Hit_ID=Q8LP36; Match level="QueryCoverage=27%, HitCoverage=93%, E-value=7e-44, Identity=69%"; Hit description =PlCYC4 protein
  Pfam annotation: Domain name=TCP; Domain location=54-288; Score =143.1; E_value=7.7e-40; Accession=PF03634.4; Description=TCP family transcription factor
MEEDEIQACKFPRVGNGRSSDQYQEEEEEGDLRRKGVGGGGGSDASTNHFHQSSWHYSSRIIRVSRASGGKDRHSKVMTSKGLRDRRVRLSVTTAIQFYDLQDRLGYDQPSKAVEWLIKAASEAISELPSLNNPFPDTPKQPSDEKRPTSGGGQQQQQQGFDDADGDTNYQQNQSQNLSLSKSACSSTSETSKGSGLSLSRSEIRVNRVKARERARERAAKEKEKEKEKESDFNIAHHHHHHNVNNMSHTASFTELLTGGIGSTVTVNPNTTTTTTTTATSPNGSSVHQIHEGHDHEANLFNKGSQQQQQQQHHHWSQTVTPMDYFSAGLLVGPSSSASTQQHQSSGQFQLGHGHAHAHALSISPFSGENHSEQMQHFSFMPDHLNNMPSSAASASQHSEGDNNNYNLNFSISSSGLAGYNRGTLQSNSPSSSFLPLLQRFQPLVDGSSNLPFFIGAAPPSSAPPTMDNNNSNNSNNHHHLQFSPIFDGRLQLCYGDGTRQHSDHKGKGKN

SEQ ID NO: 156632 - protein, 175 aa, Glycine max
  Coding DNA Sequence Number=SeqID_64947
MSGGGGDEGAYGPNDAQFEAAVGVEGVRDASIVVVCVAIGGGGLAAGELDPEEANLVEVLEDLGWGVVGDAAVRVFVGTDGEGGGGGRGCGGGGGSGGGGGGAFGAEKLAEGLNGFHDSAEDEAEEVPEGAAGLVGGGGGGGRVVVGDDAVDADDDVFDLRDEGVEAARDDAAAA

SEQ ID NO: 156633 - protein, 256 aa, Glycine max
  Coding DNA Sequence Number=SeqID_64948
  Homolog annotation: Hit_ID=A5C7U3; Match level="QueryCoverage=77%, HitCoverage=82%, E-value=9e-21, Identity=41%"; Hit description =Putative uncharacterized protein
  Pfam annotation: Domain name=DUF761; Domain location=21-252; Score= -136.4; E_value=0.034; Accession=PF05553.2; Description=Cotton fibre expressed protein
MAKPLYLEEDYKPKDYTPKAKSLSFFASIFSLFIYICVFYTFNLSPYSLLKNNIFWFFMSNTLILIIAADYGAFSSSKKKQNLYEEYVQHSQARNYVPSSYVPKYYEQVDKQCINPKQELGCELLEKKKETISDQDIPERVLEIVTVLNQPKKPSECSNVKKPTLHLQVDDGSEKIEEIKAVPARIYPRSKSDRPNRVKYVVNEERVNKVQRSETMIKVDANVVEEENEFSTMSNEDLNRRIEEFIQKFRSQATRN

SEQ ID NO: 156634 - protein, 405 aa, Glycine max
  Coding DNA Sequence Number=SeqID_64949
  Gene Ontology: Mol. function=protein binding; Cellular component =actin cytoskeleton; Biological process=red or far red light signaling pathway
  Homolog annotation: Hit_ID=A5BWU1; Match level="QueryCoverage=100%, HitCoverage=100%, E-value=0.0, Identity=81%"; Hit description =Putative uncharacterized protein
  Pfam annotation: Domain name=F-box; Domain location=51-98; Score =38.8; E_value=1.9e-08; Accession=PF00646.24; Description=F-box domain
  Pfam annotation: Domain name=Kelch_1; Domain location=146-193; Score =24.5; E_value=0.0004; Accession=PF01344.16; Description=Kelch motif
  Pfam annotation: Domain name=Kelch_1; Domain location=195-241; Score =51.0; E_value=4.1e-12; Accession=PF01344.16; Description=Kelch motif
  Pfam annotation: Domain name=Kelch_1; Domain location=243-289; Score =6.6; E_value=0.49; Accession=PF01344.16; Description=Kelch motif
  Pfam annotation: Domain name=Kelch_2; Domain location=142-193; Score =9.4; E_value=3.2; Accession=PF07646.6; Description=Kelch motif
  Pfam annotation: Domain name=Kelch_2; Domain location=195-241; Score =18.3; E_value=0.029; Accession=PF07646.6; Description=Kelch motif
  Pfam annotation: Domain name=Kelch_2; Domain location=243-289; Score =3.2; E_value=19; Accession=PF07646.6; Description=Kelch motif
  Pfam annotation: Domain name=Kelch_2; Domain location=292-332; Score =8.8; E_value=3.8; Accession=PF07646.6; Description=Kelch motif
  Pfam module annotation: Pfam domain module=F-box::Kelch_1::Kelch _1::Kelch_1::Kelch_2::Kelch_2::Kelch_2::Kelch_2; Domain location=51 -98::146-193::195-241::243-289::142-193::195-241::243-289::292-332
  Subcellular localization annotation: CTP_CleavageSite=28; ConfidenceScore=5.01e-01
MQRVRFSSQQAPVHKLGDPQMTLSPKFRLAVIQSSLANPSPELELSLREEPLIPGLPDDVALNCLLRLPVQSHSSCRAVCKRWHMLLGNKERFFTNRKQFGLKDPWLFVFAYHKCTGKIKWQVLDLTHFSWHTIPAMPCKDKVCPHGFRCVSIPCDGTLFVCGGMVSDVDCPLDLVLKYEMQKNRWTVMNRMITARSFFASGVIDGMIYVAGGNSTDLYELDSAEVLDPLNGSWRPIANMGTNMASYDAAVLNGKLLVTEGWLWPFYVSPRGQVYDPRTNNWENMAVGLREGWTGSSVVVYGHLFVVSELERMKLKVYDPETDSWEAIEGLPLPEQIRKPFAVNACDCHIYVVGQNLVVGVGHITRLNPKESCKEKWNFSVRWHVIDAPESVSDLTPSSSQVLFA

SEQ ID NO: 156635 - protein, 466 aa, Glycine max
  Coding DNA Sequence Number=SeqID_64950
  Gene Ontology: Mol. function=catalytic activity; Cellular component =nucleus; Biological process=metabolic process
  Homolog annotation: Hit_ID=A7QEG3; Match level="QueryCoverage=97%, HitCoverage=79%, E-value=1e-160, Identity=60%"; Hit description =Chromosome chr1 scaffold_84, whole genome shotgun sequence
  Pfam annotation: Domain name=PPR; Domain location=142-176; Score =23.1; E_value=0.001; Accession=PF01535.11; Description=PPR repeat
  Pfam annotation: Domain name=PPR; Domain location=218-252; Score =11.6; E_value=0.33; Accession=PF01535.11; Description=PPR repeat
  Pfam annotation: Domain name=PPR; Domain location=319-353; Score =46.6; E_value=8.7e-11; Accession=PF01535.11; Description=PPR repeat
  Pfam annotation: Domain name=PPR; Domain location=354-388; Score =12.3; E_value=0.27; Accession=PF01535.11; Description=PPR repeat
  Pfam annotation: Domain name=PPR; Domain location=390-423; Score =11.5; E_value=0.33; Accession=PF01535.11; Description=PPR repeat
  Pfam annotation: Domain name=PPR; Domain location=40-74; Score=16.9; E_value=0.077; Accession=PF01535.11; Description=PPR repeat
  Pfam module annotation: Pfam domain module=PPR::PPR::PPR::PPR::PPR::PP R; Domain location=142-176::218-252::319-353::354-388::390-423::40-74
MVKTGLDNVPFTLSKLLAASIIDMDYAASIFSYIQTPNLFMFNAMLRGYSLSNFPNKALPFFNELRNRAIWLDQFSFITVLKACGRVSEVGVGQGIHGVAVKSGNRVFVDVKNALLHFYCVCKRIEDARKLFDEFPEGNDLVSWNTLMGGCVSVSQPCLVFGLFRKMCWVGLEASVATVLSLLSAAGYIGNFGVGKSLHGYCIKIGFSSNLNDITALIDLYAKVGNYARNGMVGEALASFEQMSVRGMKPNSSTLSGLLSACPASGSVQVVRHVASFVEEQKVKLDAVLGTALVDVYAKCGFLDEAMDIFERMEDKDVKSWTAMISGLGVHGQPKNAIRLFNRMEKEGFKPNEVTFLAILTACSHGGLVVEGMEVFKLMVQEYGFSPQVEHYGCLIDLLGRAGMLHEAHKLIDSLPIKGDATAWRTLLSACRIYGDVKLGKCVKDVLKSIYAEHLCRASYRFPPHF

SEQ ID NO: 156636 - protein, 119 aa, Glycine max
  Coding DNA Sequence Number=SeqID_64951
MDGFYMISHPFMSPTQPRDPPRVSPVQEYDTFVEPDVHQQPVEAATPDEVDADVHHLGHAVDAFAAIADKLERLLKLRILTEGTKACIVAEEYVGIVRRFIRQPTVDHRSRCRRRMDDH

SEQ ID NO: 156637 - protein, 250 aa, Glycine max
  Coding DNA Sequence Number=SeqID_64952
  Gene Ontology: Mol. function=helicase activity; Biological process =viral genome replication
  Homolog annotation: Hit_ID=A2Q378; Match level="QueryCoverage=84%, HitCoverage=12%, E-value=3e-46, Identity=43%"; Hit description =Putative uncharacterized protein
MLNQLMNDLKHVNVFSNIIGSTLLNDQNQNGAHFQVQDELKHYLDCRSMFVCPFTRYVSPPEACWKIFAFPMHGHSPAVERLYFHLENQQPVYWTDSQQIGAVLSKSTIKESMFTAWMHSNKIYPYGRDLTYPQYVSKFVYVACKRCWQPRKQGNTIGMFIWVPPSSGELFYLRMMLSSAKGPQSYKDIRTVDNVVYDTFRKACFAKGFLGSDQEFISALREANSWGTAHYLRKLFVKLLFMNTMDKPEY

SEQ ID NO: 156638 - protein, 115 aa, Glycine max
  Coding DNA Sequence Number=SeqID_64953
MDEDEWMYEIMSKQADMDYENEEACGVNEPHVDCSDAFNTSQARSVAHENGFVEVILRSNTNTGSRGRTTFVLIGCEKSGEYRCRKKEFIRRDIGTRKCGCPFKLRCKPVVGGEG

SEQ ID NO: 156639 - protein, 128 aa, Glycine max
  Coding DNA Sequence Number=SeqID_64954
  Subcellular localization annotation: CTP_CleavageSite=39; ConfidenceScore=5.34e-01
AIHASSTKEFGAPRSYCVALFANSPFSNLIRRPMNLLPSAVHVSSVIKRGASGDWEICFSPDRKKEGVETRVVITERAGRTKSVSYLCFPLISDERYLAPFVAQYVKSRDVPKIKRKQAYAIRENSVM

SEQ ID NO: 156640 - protein, 189 aa, Glycine max
  Coding DNA Sequence Number=SeqID_64955
MKFVFCVFSRKRDELAKRVCCAKRIHQKCLNMTSRKRKRTASRPQAQYDTRRFQSLEAWNRYTNNILNRRILLERNVKIYHTEFDEFKAELERRNLHKRLANLQDGSIDVAMVKEFYANLYSSEDQSPKQVRVRGHSIKIDADSLNTFLETPIVLEEGETLPTYSRFTRMRIDPQELLPISASLVGVLF

SEQ ID NO: 156641 - protein, 24 aa, Glycine max
  Coding DNA Sequence Number=SeqID_64956
MAVSKIRNDEKVSSRCGVTMENNG

SEQ ID NO: 156642 - protein, 76 aa, Glycine max
  Coding DNA Sequence Number=SeqID_64957
MLEIGLLKEEATARQAPPRFLKNGFQGFRGFRKISENLGDYVEILHHSSPFFIRSSSFFSLQPLNFAYFQFSFLPL

SEQ ID NO: 156643 - protein, 69 aa, Glycine max
  Coding DNA Sequence Number=SeqID_64958
  Subcellular localization annotation: CTP_CleavageSite=45; ConfidenceScore=5.34e-01
MKKIQGLQAPHGATSPKTYTLKSPSGPLPPDSAEITKPRSLVRPNQSKLRPQIPLVGLGPIEIALLGLD

SEQ ID NO: 156644 - protein, 171 aa, Glycine max
  Coding DNA Sequence Number=SeqID_64959
MEAMKEQMATMMEAMMSMKKIMEANAVAVAATSAVAKVNRMPPSGLNQMNHPTSARVGKDLGSTGDPHYAQIQNKHAFPPYGLPPNYTPPNVAYTPNEDEIPHHNLADFKPCLGYPTERQAVGGIPLHFTAGKIPQFRPQPQPLHFTVGKIPPIMEGKGKVGSSGGKAQGH

SEQ ID NO: 156645 - protein, 303 aa, Glycine max
  Coding DNA Sequence Number=SeqID_64960
  Gene Ontology: Mol. function=phosphoglycolate phosphatase activity; Cellular component=cellular_component; Biological process=metabolic process
  Homolog annotation: Hit_ID=A7MGA4; Match level="QueryCoverage=68%, HitCoverage=92%, E-value=5e-82, Identity=72%"; Hit description =Putative uncharacterized protein
  Pfam annotation: Domain name=Hydrolase; Domain location=95-290; Score= 117.9; E_value=3.1e-32; Accession=PF00702.17; Description=haloacid dehalogenase-like hydrolase
VAVQHRGRSRVPAPRLCASAATAADYRTGAACGDDAVAGGTRLQSARHCAVSAAGFSSGQRAAKLLSHRQRARGCHHHGAHALTLFKRGTMLNDWDCILFDADDTLFHFDAFAGLQRMFASYDVHFSDQDYADYQAVNKPLWVDYQNGTISALQLQTRRFTLWGEKLRVAPEVLNSDFLNAMAEICLPLDGAARLLDTLKGKVKIAIITNGFTALQQARLERTGFRDYFDALVISEQVGVPKPDAAIFDHTLQLLGNPDRRRVLMVGDTPESDILGGMNAGVKTCWIDHGTRPLPAHITPTWQ

SEQ ID NO: 156646 - protein, 74 aa, Glycine max
  Coding DNA Sequence Number=SeqID_64961
MLATGNRLLPSGNRLPESKTLGVEGRIPEYDEPQDLRSNPFQGGGMMQSYPPRVWIEDSKRLGLELLKKALGFS

SEQ ID NO: 156647 - protein, 60 aa, Glycine max
  Coding DNA Sequence Number=SeqID_64962
MYYLCNQGRTPHYKHTQTNRPKKRRFTQLMTRLARWIYSASDICLARHPARLADENPRRG

SEQ ID NO: 156648 - protein, 99 aa, Glycine max
  Coding DNA Sequence Number=SeqID_64963
TIRGEKSFFWGCSDTHQHGWRGAALALVLVLFGFLLGFPFTVFVSAFLGHSYKSRQVDCENQPRAVHVSSTFEFGVVFHDCLSADPQGNPPFSPFFGAP

SEQ ID NO: 156649 - protein, 196 aa, Glycine max
  Coding DNA Sequence Number=SeqID_64964
  Gene Ontology: Mol. function=protein binding
  Homolog annotation: Hit_ID=Q09HM7; Match level="QueryCoverage=25%, HitCoverage=12%, E-value=9e-13, Identity=73%"; Hit description =Putative F-box and leucine-rich repeat protein
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMDDELRSILERVESEKDSETFRLVCKQWLQVQSTERKKLAACAGPHML

SEQ ID NO: 156650 - protein, 75 aa, Glycine max
  Coding DNA Sequence Number=SeqID_64965
MTLRQHGISSFFHGLFPSGWRLLSPLLFCLPLHLHGGKSPLKDLIEAQRSSLHRSPTSKLQSLQGEDESSTSSPP

SEQ ID NO: 156651 - protein, 201 aa, Glycine max
  Coding DNA Sequence Number=SeqID_64966
MAKYDPEIVMEFYANTWLTKERVMDKRSWVRGQWIPYDEDAINQFLGHALVLEKGQHCEYTKRRSQVLGFDEEAIGQQLCFPGQDFARSVTGRRVRIMRTSMTTLTQIWMTLLLSNILPSDHNFDLLLPECQLLISDVIYQFVGIAPPRHPVDPEKFNRALGFPALITGLCQFYKVSVSPTKLIWPPINRAFIEKYRMPRC

SEQ ID NO: 156652 - protein, 202 aa, Glycine max
  Coding DNA Sequence Number=SeqID_64967
  Homolog annotation: Hit_ID=A5B5G7; Match level="QueryCoverage=98%, HitCoverage=13%, E-value=2e-08, Identity=26%"; Hit description =Putative uncharacterized protein
MALKKRKEPAIPSQVQYDRSRLTSPEAWERYTDIVVTRKVLPERNVVIYHIEFDEFKEELERRKWDKELTSFDEGSIDVAIVKEFYANLYDLEDKSPKQVRVRGHLVKFDADTLNTFLKTLVIIEEGEELPAYSRFALLRLDPQELAAKLCILGRGFELNADGQPLKILRKNMTTLAQTWSVLSYSNLVPTSHTSDITLDRA

SEQ ID NO: 156653 - protein, 175 aa, Glycine max
  Coding DNA Sequence Number=SeqID_64968
MSASDHAILCGRTHQPTKKSLLELSSHDALLAQNKLQVVPPVVRLMKQTDVFPLKKTLKKFIIWEINNDKGILKEDFQASSRVLIINKDSGGHTLAISSTKTKVTMSNHKSIESALKNLEVQVGQLAKQIADKSSNNFVENTEKNPNEECEAVMTRNKRLVEAEDEECCAQEESC

SEQ ID NO: 156654 - protein, 238 aa, Glycine max
  Coding DNA Sequence Number=SeqID_64969
MTGFLRFFRRFPQINVGGDSAHFPPLENAPVSLASLARKRACCDTMNQKFALVARQSGVNEQPEAYAANTYNRPPQQQNQQQQNNYDLSSNRYNPGWRNHLNLRWASPPQQQQPVPLFQNVAGPSKPYVPPPIQQQQQQQSQQRQQATEAPPQPSLEELVRQMTIQNMKFQQETRASIQSLTNQMGQMATQLNQAQSQNSNKLPSQTVQIRKNGSAITLWSGNQIQVAPTVAAPAPEP

SEQ ID NO: 156655 - protein, 49 aa, Glycine max
  Coding DNA Sequence Number=SeqID_64970
MHWMSTIILGSFRNNWEAYFNDPRPLEPERLKAIQIQWAQYYLRIRAKS

SEQ ID NO: 156656 - protein, 147 aa, Glycine max
  Coding DNA Sequence Number=SeqID_64971
  Subcellular localization annotation: CTP_CleavageSite=88; ConfidenceScore=5.12e-01
MGRRPLPSSGKMESAAARQPMGSSEQHSAQCVFKGSRPQDTQWTRRSPTRPWGFQLWLRASVTPIGCPSPPARSCHRDIGIAPARLLVDPEKSNRVLGFPTLITGLCQFYRVLVAPNKVIRPLLTGLSSRSTAPPGRCRARHHDNGQ

SEQ ID NO: 156657 - protein, 240 aa, Glycine max
  Coding DNA Sequence Number=SeqID_64972
GDVVETLQYMVSPQGRNTWTVDDLAPYVDKLAIISEEQERITEPVSHGPASEREFPAQEFHILQSSVETRGIGRRRELVEAEQYSQQMMERGHGMYYMPATFSEYPSQMYQYPFEGHHTDTSASEHSFGGVAETQAHFSWPTMTPSQQHDAPMATPNTPFAPQWNVPGAIPDMGDLLGVDLRQEFSAEAEQAEAGRQHGRRNPDRQARRWDRPWARVFGGLRVSVLDYGLGLAFRVRVKA

SEQ ID NO: 156658 - protein, 151 aa, Glycine max
  Coding DNA Sequence Number=SeqID_64973
  Homolog annotation: Hit_ID=Q2HW90; Match level="QueryCoverage=41%, HitCoverage=13%, E-value=9e-09, Identity=41%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFLWVLSLHDKELPSVLFPNMEGLVDLAVIDAFLAFHHGKESPVVAILAMYDTFDRGCEKEQRKNCLLCTNSWLAWRGVC

SEQ ID NO: 156659 - protein, 246 aa, Glycine max
  Coding DNA Sequence Number=SeqID_64974
  Homolog annotation: Hit_ID=Q3JV35; Match level="QueryCoverage=88%, HitCoverage=32%, E-value=6e-08, Identity=26%"; Hit description =Putative uncharacterized protein
  Subcellular localization annotation: CTP_CleavageSite=56; ConfidenceScore=5.01e-01
MSILRGKQPRLGAAVNALVQNRPMLQQLTLAGRSACARQIVRRGAKHHTLAAHRPVAERGGQIWRTADAHRDINTLIKQINKAVRKGQAEFHIRMLLTERNQQRHHAEPAIGIRHCQPQSPGRNGALRRQHCFGFRQLLHNAQAGLIIGAAGVGERQAAGGALQQARAEPRFQPRHAFADGGTGQVQTLSGSGKTAAFNTGDKRNDVFQTLIVHRRFDMQKQALIVGISGVIGRALAERLQSEGWQ

SEQ ID NO: 156660 - protein, 49 aa, Glycine max
  Coding DNA Sequence Number=SeqID_64975
MKLEKSRGEHGLERREHNRGTKQSKEAKNLSFQEDLWLITERCCLVMEG

SEQ ID NO: 156661 - protein, 77 aa, Glycine max
  Coding DNA Sequence Number=SeqID_64976
MAVATPDKAVDVHHLRHAVDGYVAIAGKLERLLNLRILTEETEAYIVAEECLGIARSYIRQPTVGHRSRHRRRTDGH

SEQ ID NO: 156662 - protein, 163 aa, Glycine max
  Coding DNA Sequence Number=SeqID_64977
MWKSCIKRLKKYQMSALMKSMILFVGGRPCSSQNTLTDYKKKNGHAASKVQILSCPLNENSCALQQHDHALVYVTRHSVRALLNWGACEKDYEGFEVLAAGVSLSEACALSKNHALSEALSLLSELGESGGESKKHLHAQHVISSLSEVFVSSRSKCAQLAQQ

SEQ ID NO: 156663 - protein, 85 aa, Glycine max
  Coding DNA Sequence Number=SeqID_64978
  Gene Ontology: Mol. function=DNA binding; Cellular component=nucleus; Biological process=regulation of transcription
  Homolog annotation: Hit_ID=A7QJG5; Match level="QueryCoverage=52%, HitCoverage=13%, E-value=5e-14, Identity=73%"; Hit description =Chromosome chr8 scaffold_106, whole genome shotgun sequence
MLPGLAGVPMLKITKFSLRMTAQEREIGTTPCCDEANVKRGPWSTEDDSKLKEYINKYGIRGNWIGLPLKAVESLNQMRHLRGVH

SEQ ID NO: 156664 - protein, 43 aa, Glycine max
  Coding DNA Sequence Number=SeqID_64979
MTVMTMSVTAKTTVTIDGSDNNWLRRIIAAMRVVSVAPADPDF

SEQ ID NO: 156665 - protein, 174 aa, Glycine max
  Coding DNA Sequence Number=SeqID_64980
MEHATGEIDRELMLPFLFNTPVLVTGEVPTKPHALPGFRIKLYLVDDQGSNLRHFVHSHELSAFSSYETSDGEAPGELTLTKGGHQVHVPFGLCSLTYKAEEWTGVRMDGVGLDLESLEGFLVQDINWIALIDEGLGHYEVRNDDGDNHRVVLVDRVDALEVPVREGDRRETSL

SEQ ID NO: 156666 - protein, 43 aa, Glycine max
  Coding DNA Sequence Number=SeqID_64981
MKFSSLRFTSVKGEEARLVMEICESALLTTACGKNKVTKSQAN

SEQ ID NO: 156667 - protein, 105 aa, Glycine max
  Coding DNA Sequence Number=SeqID_64982
MTEGCGEGFCLANLPVCGAAWFSHCLSFSMCPVVGFGPWLGLGKPLVEILPPGQTSWFLPVVGLARVGGAGLWPRAKFRIGWPPPPPRDQFCCQDFANFGLRPVG

SEQ ID NO: 156668 - protein, 18 aa, Glycine max
  Coding DNA Sequence Number=SeqID_64983
MATETSASDHASTIDERT

SEQ ID NO: 156669 - protein, 297 aa, Glycine max
  Coding DNA Sequence Number=SeqID_64984
  Gene Ontology: Mol. function=phosphoinositide phospholipase C activity; Biological process=intracellular signaling cascade
  Homolog annotation: Hit_ID=A2Q4S5; Match level="QueryCoverage=71%, HitCoverage=36%, E-value=4e-22, Identity=32%"; Hit description=IMP dehydrogenase/GMP reductase, putative
  Pfam annotation: Domain name=DUF1723; Domain location=167-216; Score =59.6; E_value=1e-14; Accession=PF08330.1; Description=Protein of unknown function (DUF1723)
MSDGFCGTHLQIMVRTRGLGRALGQVTRRGVGRGDHDDSGDAPQRRRPTTSARRQRVVVTADHVDEPVIPDPDVQDDPMEAPATVEDIPAGAGAEAAEDQPQGFSGGPSDPSVLTAYADHVACSERPELKLSSHGRKVHSLGRPILAIEGLIVGTGLSPLIACSVDTDDQGLLSAFVERWHRETSSFHLPVGELTITLDDVSSLLHLPVIGNFHAFEPLHVDDAVQMLVDLLMVSPESARAKIVQCRGPYVRLQWVREVYQRRCQTVHWTAAARAYLLHLLGCTLFANKSATNVHVV

SEQ ID NO: 156670 - protein, 178 aa, Glycine max
  Coding DNA Sequence Number=SeqID_64985
  Homolog annotation: Hit_ID=A5AK53; Match level="QueryCoverage=65%, HitCoverage=15%, E-value=1e-08, Identity=37%"; Hit description =Putative uncharacterized protein
MRLDKSFHSIIADVRGYEKFPSSERDARNYIAKKRHAIDKGGDGKVVKGYLARMIQYKVMNTCASKVLLKPQRGNTTLFITDMTKVNVSLPRTIKWDEITLPKKWVMDKATLSVPRPAPTIEQIKQDNSGKVEITFNRRNSFSSRIEASKSEYESARRSFSVRTRSIPVGLTRSESHN

SEQ ID NO: 156671 - protein, 88 aa, Glycine max
  Coding DNA Sequence Number=SeqID_64986
MVGAFSQYSVTLTDLPIILPSDRHELSLLVVRPLQGEEQFNQSRILKTQLEDLVENRASNPSFTVSSRLYVWMNSREPKRSQNNAARN

SEQ ID NO: 156672 - protein, 192 aa, Glycine max
  Coding DNA Sequence Number=SeqID_64987
  Homolog annotation: Hit_ID=Q2R2H8; Match level="QueryCoverage=32%, HitCoverage=16%, E-value=5e-08, Identity=42%"; Hit description =Retrotransposon protein, putative, Ty1-copia subclass
MRKDTPLKEHFDELNSILMELCDIDFKMEDKDLTMILLASLPHSYENFVSSLSVGKGSITLEEASGNGDEASMSGLLVTNSTKAKVVRRAKLVLRTFEITTTNQKSLDCHHQKGGECECMMILMMPKKNQTRPLQRISICFKIASKNKALFQDSLKIKPCLKTKGFKVMQGSGNRLPGSVIDYQKGRLKKSY

SEQ ID NO: 156673 - protein, 122 aa, Glycine max
  Coding DNA Sequence Number=SeqID_64988
  Homolog annotation: Hit_ID=A5AV22; Match level="QueryCoverage=91%, HitCoverage=9%, E-value=3e-11, Identity=37%"; Hit description =Putative uncharacterized protein
MKDKWNVHELHNVLVQEETRLKNQGSHSVHYVSHQGNQGVEKKFIKKHGKGKHPLKINDDSLLIHKKGFLTIQTISPNEKFVFMRNRVKASVEVVGTYRLKLDTGHHLDLMETFMYLVYLGI

SEQ ID NO: 156674 - protein, 58 aa, Glycine max
  Coding DNA Sequence Number=SeqID_64989
MQMIDEVALHIKIGHNVYIKVSIHPGIIQIEALPGLFVVKQPLHNEPMQCMQSICMNC

SEQ ID NO: 156675 - protein, 134 aa, Glycine max
  Coding DNA Sequence Number=SeqID_64990
MAMMTGGKYLIDTATKFIFDEEAKANLYHVLEFDQQNTFFLVEESFHPSEWLLPKKKYDVDLAKQCLVVHEESDIEAFDDEDVFDDSDNDCSEKDNKVFEACNQNTRHRVACLSCIPWWQTKEVDKTEACACIL

SEQ ID NO: 156676 - protein, 141 aa, Glycine max
  Coding DNA Sequence Number=SeqID_64991
  Homolog annotation: Hit_ID=A5BP71; Match level="QueryCoverage=53%, HitCoverage=19%, E-value=8e-13, Identity=49%"; Hit description =Putative uncharacterized protein
  Pfam annotation: Domain name=zf-CCHC; Domain location=114-131; Score =18.2; E_value=0.0027; Accession=PF00098.14; Description=Zinc knuckle
MKGKYIVQSLLKNLEKIKNKLVRTLFACMTSTPQACGYVSLNYYQYIDVVYTNEHILKAYSPQWWPLGNEAAIPPSNDAWTLIPDPTTIRAKGRPKSTRIRNEMDWVEPSDHRKKCSRCGAEGHNRRRCPMQSERGSCSNH

SEQ ID NO: 156677 - protein, 330 aa, Glycine max
  Coding DNA Sequence Number=SeqID_64992
MVRTRGLGRVLDRVIGKALGREDNHDFDKVSQRRRPTASAHRQCEAIAIAEDAPHVADAAEEVFQQLEEVVVDAQGFPGRLHNTLVLTVYADHERPELKLSSHGRKVQKFGRPTAEIEGLVAATGLTIEDLYRLLWRGDIRKLAVGEVTITLDEVASLLHLPIIGTFPSFETLHVDKAVLMLVELLEVSGDEARAKIMKFVQCWIYKQFPSIVVAFTDEDYDERSPRAYRWTSTKALPTSTYCKHLDRLITTDKIPPYSPGSRLCLEDIDDRWMHFSYYLAPMGNIYVVPGQCAPDYMDWFYMISHPFLRLTQPEDPPRHPPVVQDETYV

SEQ ID NO: 156678 - protein, 127 aa, Glycine max
  Coding DNA Sequence Number=SeqID_64993
MVNHKEESTKFLLWDRECTELIGQSTNEEGDVDLNVSPQALDKLLSYVLAFKVKVQPKFNNVVVLRYSNDIDLINAVVDMLPDAEAISKVHGPIFDSDNPPMILPNLNLILFKNSIASNSKFSLLIS

SEQ ID NO: 156679 - protein, 165 aa, Glycine max
  Coding DNA Sequence Number=SeqID_64994
  Gene Ontology: Mol. function=helicase activity; Biological process =viral genome replication
  Homolog annotation: Hit_ID=A2Q378; Match level="QueryCoverage=48%, HitCoverage=5%, E-value=2e-19, Identity=58%"; Hit description =Putative uncharacterized protein
MCLGFCISSSGSLFGPAECLFNGPWVVLFFAGRVRGRGRGRYNNPIPVLLPDLWTSGKTQTRTHTRSTRILPIKVGTDSGGYPRTRSWHLRKKGYTIGRLIWVLPTTGELFYLRMMLIGCKGATSFEDIRTVTNIQYPTYREACFAMGFLQDDREFIEAIKEVKD

SEQ ID NO: 156680 - protein, 335 aa, Glycine max
  Coding DNA Sequence Number=SeqID_64995
  Gene Ontology: Cellular component=endoplasmic reticulum
  Homolog annotation: Hit_ID=A7Q765; Match level="QueryCoverage=54%, HitCoverage=53%, E-value=1e-33, Identity=46%"; Hit description =Chromosome chr5 scaffold_58, whole genome shotgun sequence
MLLQEVGVVVSVLLGFAPPSTFFAASSSKVLEIIHDVLFLLEVNGINAHGKIVQDNPMFGNSFWSTNLDKVAIEFPDETDVSVVSLDEQLEDWTDKEISDFSSLIGGSYAPDALEPLNGVLTIPLTNGASVNLHMSKKAERKFIVGLMSLTHNVQSAIQMHGNLSQSAKGPAELLTGCFNGFKGCKSRGIKLCGPLAATGMIAAWTSKCLPNYQREKYDAWTSSHSEQNAEHSTSVIRTIDVECFIVDGSKDQPVLEWVDFYIGCPNNRCRMSKFHSGRSTVVVRQWTFNIAGTYCTLHCLNGALPVEEALGFYVRYVQSLLYNAKPWGGDSPIP

SEQ ID NO: 156681 - protein, 197 aa, Glycine max
  Coding DNA Sequence Number=SeqID_64996
  Homolog annotation: Hit_ID=A5BZC7; Match level="QueryCoverage=75%, HitCoverage=61%, E-value=7e-15, Identity=30%"; Hit description =Putative uncharacterized protein
  Pfam annotation: Domain name=DUF716; Domain location=34-187; Score= -33.8; E_value=0.048; Accession=PF04819.3; Description=Family of unknown function (DUF716)
MASLVTHFCLFSSSFLYLHNPSHFHSKLWYFSDPKWKTLDLYALLIAHPIFSFAKFSLFFSFSGHYPTYKFSFFHQPMTLLAFWYFVMRKRVSSLVGSVYGFLGGLTLGTWLLQVGFSLYTDVFGLKGCGKITFLGKESVDVQCDLNEDILRGVALMHFLFIVHAIGVMVLAIGGPLLVEVESASSRMLALADLEMG

SEQ ID NO: 156682 - protein, 136 aa, Glycine max
  Coding DNA Sequence Number=SeqID_64997
  Gene Ontology: Cellular component=chloroplast; Biological process =electron transport
  Homolog annotation: Hit_ID=A9PF36; Match level="QueryCoverage=80%, HitCoverage=87%, E-value=2e-31, Identity=64%"; Hit description =Putative uncharacterized protein
MATSLSATGCVGTSFYGSWGTSIVGEDYTMLAKSVPSQVRMGRGKPVRLQPMMKNVNEGKGIFAPLVVITRNIVGKKRFNQLRGKAIALHSQRLVSTMSEKGSRTRNPAGAAAGKDGGEFKKGTWKVNIWRKLFDG

SEQ ID NO: 156683 - protein, 44 aa, Glycine max
  Coding DNA Sequence Number=SeqID_64998
MEGRLAEWRRKRERRHHFKDKMGLEEAHHHRRPWIRALEEEGDE

SEQ ID NO: 156684 - protein, 52 aa, Glycine max
  Coding DNA Sequence Number=SeqID_64999
MGKGVALAPTYPQANGHFGAVAAGLGKLKLSAEAMSLPRRAGFFTMKLFGGS

SEQ ID NO: 156685 - protein, 70 aa, Glycine max
  Coding DNA Sequence Number=SeqID_65000
MRSFNGDFPPWRRGERRHHPLGNKPWKKELHHQDQPWIRSLEGCFNGGKERGREREMGEHEIEGIKEGEK

SEQ ID NO: 156686 - protein, 63 aa, Glycine max
  Coding DNA Sequence Number=SeqID_65001
MTHENPRAFSCISGPIFLESSIQCPWGLSMSSNCCYSHQEFSFTENFWIIEPVRKLRQVIMNL

SEQ ID NO: 156687 - protein, 192 aa, Glycine max
  Coding DNA Sequence Number=SeqID_65002
  Gene Ontology: Mol. function=molecular_function; Cellular component =nucleus; Biological process=endoplasmic reticulum organization and biogenesis
  Homolog annotation: Hit_ID=A7NTU8; Match level="QueryCoverage=84%, HitCoverage=47%, E-value=1e-73, Identity=82%"; Hit description =Chromosome chr18 scaffold_1, whole genome shotgun sequence
  Pfam annotation: Domain name=LNS2; Domain location=15-147; Score =156.6; E_value=6.8e-44; Accession=PF08235.4; Description=LNS2 (LipinNed1Smp2)
MEDVPSLDLMTGSFVVLRALPNLTSVLLLLENGYQLLFLSARSISQAYITRQFLLNLKQDGKVLPDGPFVISPDGLFPSLDREANKRVPHEFKIACLEDIKAHFPFYSSPFYVGFGNRDTDEISYLKVGIPLGKIFTINPKGEVVINHHVDTKSYTSLHALVNGMFPPTSSSEQEDFNSWNFWKLPPPAIDI

SEQ ID NO: 156688 - protein, 89 aa, Glycine max
  Coding DNA Sequence Number=SeqID_65003
MAVKEQMMRRFSERVAEATPGGQNATPFGELVIHGHSLKQIRKGGCNEEGELAKSQRWDNPSTSVRVPLNISVLEFEEEAHKLQSSLWS

SEQ ID NO: 156689 - protein, 73 aa, Glycine max
  Coding DNA Sequence Number=SeqID_65004
MDTLQQMVADILNNAQVVKDEGPEVEALLRILIVAVDNVGPKQHKMDGQNRIEGVKLNVPPFKSRSDPDAYLD

SEQ ID NO: 156690 - protein, 236 aa, Glycine max
  Coding DNA Sequence Number=SeqID_65005
  Homolog annotation: Hit_ID=A5C0G0; Match level="QueryCoverage=98%, HitCoverage=29%, E-value=1e-12, Identity=27%"; Hit description =Putative uncharacterized protein
MTRRTKTILKPRWRAREVKFKYERLEAFCYYCGLLGHNDDSCKKLFPMQLDDGFRAWGLDIWADTRNSGGLDGLKWLCEEGATINHGHVPYNFSLDSSTKNVKNITNHNNHGAIIEEDQKRNDLLLLVSKNPCLLFPQLAKSGNNVPINDNDEIQQINGDNMDTDLIVTDKKRKHDREGNWHHQLRSEFHHCQPHFTNNNRNLEAFFIDRAWQPGLPKAMSLLAWNCRGLGNPQRW

SEQ ID NO: 156691 - protein, 112 aa, Glycine max
  Coding DNA Sequence Number=SeqID_65006
MCTGCINSICAKDHKKKKKKQKEEAECKEGEGFRVRLRNAFTQARDRREEPHHSCIISICIKDHAGLDKQKLHYLARTKALTQCPLSDLNAENIITASFLCTIQDKNKVGQT

SEQ ID NO: 156692 - protein, 305 aa, Glycine max
  Coding DNA Sequence Number=SeqID_65007
  Homolog annotation: Hit_ID=A2X4N4; Match level="QueryCoverage=31%, HitCoverage=21%, E-value=3e-07, Identity=32%"; Hit description =Putative uncharacterized protein
MEDANTCGGEEGNQISKRERRSLLSNTQKTKEEDEPFWKEKNETKEEEACGEVAGKFIQLLGAPSNSPTIEGVALWLRVMLDLDRGGVSVVVLEDGVGSHNNVRGWGWSRAWKEVSVSSLARLRSDHNPILVKFDTKMRNVRRKERLYRFQQMWQNESECDDVVSHSCKKGGNLIANIDRIGANLEMKASQRRKINTIDYLKDDEGVLYDDEEEIADVLTACLMDDFKSEKVVVALKQMHPTKGPSPNGTPALFYKHSWEIVGRSKTQILKVVRVWKKLKGWKERVLSKAGREVLIKYVMRFLVT

SEQ ID NO: 156693 - protein, 312 aa, Glycine max
  Coding DNA Sequence Number=SeqID_65008
MSKTHTLQSRLANNISHIDLSLQQYKLQRDAVNSFIGWPRHLVKPLSYDSDLNVRKPVEHSSDAKLAGESDPLGELMKILFYVYQNPVEVPWEANQFGLPEIGAKFYITHADLAEIISGDKCLNIAILQLWTIFMNECGRSKADQSLYGLLEPQSIQNAKERRQQCQQYIETWVKESQRQLYLGAYLNQAHWQLFVLHPRENTIVWFCSLRKKPDINIKGAINSAMKTITSSFEGMSNQVAPRWVEPKTNVQSGGFECGYYVMHWMWCIVTAGLKDDWHKWFSDGSSLDVEAITSVRQKWATYFLSFRKSSC

SEQ ID NO: 156694 - protein, 49 aa, Glycine max
  Coding DNA Sequence Number=SeqID_65009
MRKDINIRTWALLADIESSLKAKEAVNKTSSVNLSNIDYWKVLWSGPRT

SEQ ID NO: 156695 - protein, 362 aa, Glycine max
  Coding DNA Sequence Number=SeqID_65010
  Homolog annotation: Hit_ID=A5BCE4; Match level="QueryCoverage=67%, HitCoverage=33%, E-value=1e-18, Identity=23%"; Hit description =Putative uncharacterized protein
  Pfam annotation: Domain name=DUF659; Domain location=157-242; Score= -42.7; E_value=0.00068; Accession=PF04937.6; Description=Protein of unknown function (DUF 659)
  Pfam annotation: Domain name=zf-C2HC_plant; Domain location=35-89; Score=60.5; E_value=5.6e-15; Accession=PF07567.3; Description =Protein of unknown function, DUF1544
  Pfam module annotation: Pfam domain module=DUF659::zf-C2HC_plant; Domain location=157-242::35-89
MNGSGSNSSGGDTTMGGSSSVARSKYKNAPGNKTDIGWKHGIDVGGNGKKVKCKYCSKIVSGGVFIFKRHLAGTREYSKSCATVLDEIKLLMMKIVAESKAAKEKKNRLNSIDEDEESAEGAKATNFVIPFNAIKNPAFLKMCEMIGKYGLGYKTLSCHDVREKMLKQAVQKTDDSLQEFRDEWKRTNTSNISKTTDKVFKMLDDIVTFVGEENVVQLITDNDLEKHLKVHEVTIKQGRKITTYIYGRTMLIGMLKKYTNGRNLVRPDMESDDEWITEEGDEIFYEDNLRVEQKQPLGERGSGSNIDLVGGSLTDPTLDAFDIDNLVLNDNVEDHFSTEEKLEDDGGGGDIGDDFIRGLMDI

SEQ ID NO: 156696 - protein, 95 aa, Glycine max
  Coding DNA Sequence Number=SeqID_65011
MRKYSDIQLRLMERPILQPEVTITDLMNMRQMVHESTIDFIERFRKAGSRCSVKLPEVECAVMATGIMHPELKKTLVAQEYGDLSQLVSKANRIE

SEQ ID NO: 156697 - protein, 39 aa, Glycine max
  Coding DNA Sequence Number=SeqID_65012
MAVCCYTVGVVVVVVRACFHWDKNCMAKETTTIRAQVST

SEQ ID NO: 156698 - protein, 298 aa, Glycine max
  Coding DNA Sequence Number=SeqID_65013
MDDFSKDEDQRFFDHINHQSDNEGVGGPTSPPLQYHQPRCPVDLNLDHLPHYIDRHHFIQQQHNIQPPTGALEFGMAFDEKAQCIRAVKEYNIINHFDCKTIYSNQKRLNFECESHENGCTWSLEIKPFMNYTPSYKKTWLARALEIIHRNWEESYAKLPKLLGALQSCVPGTVIAAQTESVCLKGEKSYRAKECLKVSFGHLAHSTSRWYFTGNRNPSIISAYNNPSNLWVQDTSHFFYLRHIAQNFLRGYVYTEKMHCRHILGIFVRIRQVQLNDWISYPKKIGYNASMWGNVGDI

SEQ ID NO: 156699 - protein, 200 aa, Glycine max
  Coding DNA Sequence Number=SeqID_65014
MWSMQNCNLMIIGIVNPYSVYRLSILIVEDVTNVDNAADEPHEEPQDPIKEDERIELKLAFHGRKMEKFGRHAPEIKDIRGGTRKLEVSIYPSRWLQFSQYLALVEEFCSFHGQCAAGYMEWFYMISHPFMSSPQLGEPPRPPPMSTSEKIAESLQHMINMRMVTARTYAYTIIEHYLTLVRVVTEQENVYVCLRRRRDT

SEQ ID NO: 156700 - protein, 135 aa, Glycine max
  Coding DNA Sequence Number=SeqID_65015
MDNQYLQNKNSKNLTNDQGFIDKLKESTKQQKKEKKEGEEERRKEKEKRKKERNEMKGMRGYLNVLSPFLAIVSNNAMDDSQLIEEGYTYAEDGDTFTEEGGDTFAKEGGDMHKVDFDKLESVLCLLKTTCCICH

SEQ ID NO: 156701 - protein, 255 aa, Glycine max
  Coding DNA Sequence Number=SeqID_65016
  Homolog annotation: Hit_ID=A7UQU7; Match level="QueryCoverage=44%, HitCoverage=20%, E-value=1e-14, Identity=41%"; Hit description=IMP dehydrogenase/GMP reductase, putative
  Pfam annotation: Domain name=DUF1723; Domain location=172-221; Score =49.8; E_value=9.7e-12; Accession=PF08330.1; Description=Protein of unknown function (DUF1723)
MTTKSIGHKNIGGLENPTKNDHLGQETEQVNIVMNLCGLVMKFVVDICRSWPTASARRQQEAAPVAEDEPMVTEDEPVVTTDEPVVAVDVHAPGADAADDVDGFLGGPRDPSVLTEYADHVVVRVWNEEDRLELKLSSHGRKVQKFDRPALEIEDLVAATGLSHLIACSVDTGDRRLISSFMERWHRETSSFLFTVGEVSITLDDVASLLHLPIVGAFHTFQPLHIDEAVLMLVELLEVSGEEARAEIAHCHGPY

SEQ ID NO: 156702 - protein, 168 aa, Glycine max
  Coding DNA Sequence Number=SeqID_65017
  Homolog annotation: Hit_ID=Q2HTA0; Match level="QueryCoverage=37%, HitCoverage=9%, E-value=2e-10, Identity=57%"; Hit description=IMP dehydrogenase/GMP reductase, related
  Pfam annotation: Domain name=DUF1723; Domain location=34-83; Score =47.4; E_value=4.9e-11; Accession=PF08330.1; Description=Protein of unknown function (DUF1723)
MLQSAYGTERPAPEIEGLVAATGLSPLITCSVDTGNWGLISAFVERWHRETSSFHLPVGEVSITLDDVASLLHLLIVGAFHTFEPLHVDEAVLMLVELLEVSGEVARAETAQCHGPYCRIYEHFPSLVECMADPDYDEVSPRLCRWIAMKAIAKVHIHSDIQAASAST

SEQ ID NO: 156703 - protein, 175 aa, Glycine max
  Coding DNA Sequence Number=SeqID_65018
IQGTNRLRILCLNTLERTSFVVQVERTSTWIVILKQERVHLLWISSSGVYIHLVVQREQGRVHPLWIFACKGFYKVIGNLKNRCLRPLDPTRIPQVPEPATTSTHAHSYVEQPRHAVEACHAIAERLECHLNLRIVKAGTETHEVMEECIRIARGVTEDCIVYARSRRRRRTDEA

SEQ ID NO: 156704 - protein, 250 aa, Glycine max
  Coding DNA Sequence Number=SeqID_65019
  Homolog annotation: Hit_ID=A5BEV8; Match level="QueryCoverage=82%, HitCoverage=29%, E-value=3e-23, Identity=30%"; Hit description =Putative uncharacterized protein
MRTTHGLPCACELSKYVVGCIPLDSIHMFWKRLSFLDQGLSEPEVTIKEEMETISKRFEELDLWEIAYHDQNSMCPPPTKVNIKVRRSTSSSEKPNPRRIMPMLDQFQPFIHDFIDNIVDVKLDGNCGYRLVADLSSMGEDSWLLVTMDKWMDITDMGYVIASRYNVTFVSLSQQQSMTFFPLRTQPPPDSSMHRIICIDHVYNNHFVQHCYGLAIVILRRSSGQLQILVECSIIEASRCSKETVDINDD

SEQ ID NO: 156705 - protein, 86 aa, Glycine max
  Coding DNA Sequence Number=SeqID_65020
MLNMLVWFNVYFLVNKFKQLCKGYALVDHESFCIVTNEGGAFISVTDLAVVVNTNIYSWVTHCGRGVHCAVTCIGKWHVSLSSTWP

SEQ ID NO: 156706 - protein, 179 aa, Glycine max
  Coding DNA Sequence Number=SeqID_65021
  Homolog annotation: Hit_ID=A5BP98; Match level="QueryCoverage=97%, HitCoverage=50%, E-value=5e-09, Identity=27%"; Hit description =Putative uncharacterized protein
  Pfam annotation: Domain name=zf-CCHC; Domain location=63-80; Score =25.4; E_value=0.0002; Accession=PF00098.14; Description=Zinc knuckle
MSLATLFGKLQEHQMELMRLNQHEENDKKKKGIALKASSSIQEESDKKDLNEIEEGEDSSSIPKCYECNQPGHLRVYCPSFKKRREKSDRKTLNDKKAKKAYITWEDNGMDSSSDSENEIINLGLMAKDYESEKETPLQGEDDSRTSSPPYEATDKSLKVGEDKWREIEKRGGQNLCLK

SEQ ID NO: 156707 - protein, 151 aa, Glycine max
  Coding DNA Sequence Number=SeqID_65022
MGAHCRETPTKEGHATIRIRSEYSCRGYRFRLSFEKLTTGGCTTQTILHQQGRFVLCQDNDTYVEPHIPEVPVAPSAALAHAPSDVEQPRHAVEACQAIAERLKCLLNLRIVTTGTKIHEVMEDCIRIARGVTPDGNVYVRLRRRRRTDQL

SEQ ID NO: 156708 - protein, 216 aa, Glycine max
  Coding DNA Sequence Number=SeqID_65023
  Gene Ontology: Mol. function=nucleoside-triphosphatase activity; Cellular component=integral to membrane
  Homolog annotation: Hit_ID=A7QB63; Match level="QueryCoverage=67%, HitCoverage=17%, E-value=4e-48, Identity=65%"; Hit description =Chromosome chr4 scaffold_73, whole genome shotgun sequence
MRYAKISGQVFVRKLDYINSIVCACAPRLIEEEMFGIGNLCWISTKATLEASKRAEFLIMQTGMTSFGKAYYKNYSGLVPNSFVQLAMKLEALRDEYMRYATEKCSYMLKEYHLAVETITGLGQIKVEEIWDIYRGAPCVAQPIIQGSATLAEPSGKAGVAAHDVQRYVKESDWAAQCTRQDKMSNEELKLQDPRCRIQCPDILPENTGHINLLYL

SEQ ID NO: 156709 - protein, 87 aa, Glycine max
  Coding DNA Sequence Number=SeqID_65024
MGGRTSTEVKVNAYLIEVTRRWPHVFGDFMDMFVLELVRVIFTVDDFLVRAIVVDNISVLIRKVDVDIDLLECVIGGGGGHRRGSVA

SEQ ID NO: 156710 - protein, 301 aa, Glycine max
  Coding DNA Sequence Number=SeqID_65025
  Gene Ontology: Mol. function=nucleic acid binding
  Homolog annotation: Hit_ID=A7PCT9; Match level="QueryCoverage=45%, HitCoverage=18%, E-value=6e-38, Identity=51%"; Hit description =Chromosome chr17 scaffold_12, whole genome shotgun sequence
MANDFSFSTNGLNGSSSEKDPPDGGGVVEKLNMIEYKNGNPLNPMIHIVDWVYEGLCAPWQDALVIKLLGRNLGFQILHERLTRLWKLFAGFEMLDIYNGTATRLLLLHHPSALLHYWELDPAIIQVAREYFNLACLERDYQDRLFIYVDDALNTTVPNGFSGGGRIMVNVGGSCVEAENRLRDGKVVMEETLGAMKEVFGKKVFVLSLGNRKDDSSLTLTGDLPHLEEWKKLLPGPFKCYANIVNSFLATKFYEVSGDCVGGTDNRCDCGVYAKETCSVEMSRTISHTWVFYKIGLASTG

SEQ ID NO: 156711 - protein, 154 aa, Glycine max
  Coding DNA Sequence Number=SeqID_65026
MVSILYSVQLGQVPGMPLVFGHAEYLDIAITLSFQVGSCWYQVFSHAKYTSISVLSFNTYFPLILVAGAQSCQMPEYHIYYTWNLKHSVQVRLLLIPIYYPYYCSQLRPYLSIDVHFAEKRMVATKSMMEAQQAVQQLTTEQDPKVRTPSPHLN

SEQ ID NO: 156712 - protein, 278 aa, Glycine max
  Coding DNA Sequence Number=SeqID_65027
TTSISSFVPHGREDILNIVIGRSEHPGRVCVAGSSITISQYYGRASRGSNSSSTSITQQQLAEIIGSLKEEWRNEIIGNLKEEVGNEIEEENKQSLEKMKQELKDAIKIDFFQRGSQYSPLIEVDIQTLGARVSIKGSNVETVVNPLDEEHDGHVIPTMGLYVQRENCTHLVALGKIYEGGSSIHRVAYANDVDSHISPKKLFEPVQRLNNVSTGLGCRSKCLWCFDDDHDDLMQMMQMGFSSLNSRQRFKNTRHNIKMITSILGREFLIDLAKGLAK

SEQ ID NO: 156713 - protein, 447 aa, Glycine max
  Coding DNA Sequence Number=SeqID_65028
  Homolog annotation: Hit_ID=Q5XM22; Match level="QueryCoverage=27%, HitCoverage=96%, E-value=2e-12, Identity=33%"; Hit description =Resistance-like protein HAAS-2
  Pfam annotation: Domain name=DUF1723; Domain location=127-173; Score =18.9; E_value=0.0031; Accession=PF08330.1; Description=Protein of unknown function (DUF1723)
MVRTRGLGCALGHVTGRVPITTADDEPVVPATKADGASIVAKVYVDEPMAGGDVQDTGADTLADASAQAAEDEPERFLGGLSDPSVLTEYVDHVTGSVWTEEERPELKLSSHGRKVHSLGRPILAIEGLVAGTGLSPLIETSSFHLPVGEVTITLDDVASLLHLPAAKAETGQCHGPYVRMQWVGDIYEYRYQAGHWTTAAHAFLLHLLGCTLFANKSATHVHVVFLEALRDLGQTGSRQLGGYITLLQCWIYKHFPLVAESTADPNYAPRPTLDFGFLLDPIWGAPTGPGLPYDFMLFWSAMLGAHCCVLSTREGHATVWIHPDHSCSARRFMVCNDYRDWFFCISHPFMTPGQPSDPQADGHATQPRVAPQDPGTDVRPVTEPAALSTSVSTSAIDVDEPRHAVEACYAIAERLECHLNLGVITPGTLTHEAAHGSVVVYLHILY

SEQ ID NO: 156714 - protein, 210 aa, Glycine max
  Coding DNA Sequence Number=SeqID_65029
  Subcellular localization annotation: CTP_CleavageSite=38; ConfidenceScore=5.25e-01
MSLLQRNCHEWIFIILWFQVVSHFIPFLSSPCVCSSPRVFFVSTFHSLAFVPLFSLHPSTPLRPLFESDPPLHRERVTLDHALLALRKRAKERESDDVVRRDLLSYSRSGEMVSVRSEAMDIIPSSRQQSHSSGSTFQQGNIDSLEENDGYCSKKVDGLDRATTLSDGEICGGSNSKVNKDVGKLDTEVLVKDTPSTGNGSSLKSKYVRV

SEQ ID NO: 156715 - protein, 215 aa, Glycine max
  Coding DNA Sequence Number=SeqID_65030
MQAIPAPCPQVFSAMAEEFMNGFVHQNGIAVITHNPLKAIPAPRPQVAEDEFLPQHIHLKRFRLHARKLLRTSFYRNTFTSVFFAMAEEFVNGFVHQNGIAVITHNPPKGDGEKKTKIWIILAVVVGLICLGIHIFLVWRFKRKPKAISSAFGYNNNIETCFSSWHETFFSSNSRKGKETRDMNDEPHTHRVLLLPLGRWSTFHSYSKEYCIFLL

SEQ ID NO: 156716 - protein, 175 aa, Glycine max
  Coding DNA Sequence Number=SeqID_65031
  Gene Ontology: Cellular component=integral to membrane
  Homolog annotation: Hit_ID=A7Q8D6; Match level="QueryCoverage=69%, HitCoverage=52%, E-value=3e-34, Identity=59%"; Hit description =Chromosome chr5 scaffold_64, whole genome shotgun sequence
  Pfam annotation: Domain name=MtN3_slv; Domain location=4-107; Score =75.1; E_value=2.2e-19; Accession=PF03083.7; Description=MtN3saliva family
MEEHDLSLSSNTCSISGSTPLETSTLILSFGSASTSCRPMFWKIKKHGSTEDFSSLPYICTLLNCSLWTYYGIIKAREYLVATVDGFGIVVETIYVILFLIYAPKGIRGRTLILAVILDVAISAVAVVTTQLALQREAHGGVVGVMGAGLNIVMYFSPLSAMVLKLVFKFENKVE

SEQ ID NO: 156717 - protein, 209 aa, Glycine max
  Coding DNA Sequence Number=SeqID_65032
  Subcellular localization annotation: CTP_CleavageSite=15; ConfidenceScore=5.29e-01
MAESSKKRKGSSSTTTAAGQCRHGTSGDSPTPNPPSFSSPESLTLFSSYDQHQSHDACKMVYNDHADMTGRLLAGSFTIKCRIMHYVLCRVLLPKSTNLAQVSEEDSILLWAFQTGRQIDWAHLVRYRVHKALWANAPLLYPHLVTLFLQHFNVPLKDEPFVKVKRSFAIGVGAVTSFGYRKNMDGQWVHKQDLPPLIPNECTPSPPPQ

SEQ ID NO: 156718 - protein, 76 aa, Glycine max
  Coding DNA Sequence Number=SeqID_65033
  Subcellular localization annotation: CTP_CleavageSite=48; ConfidenceScore=5.20e-01
MHLHDQGSLLYNKEKNKMKDCKNTSGEDVSFTSRISQPLTNSSQALKTASSSSSGLCRSSQSKISQNSLELGPFSL

SEQ ID NO: 156719 - protein, 537 aa, Glycine max
  Coding DNA Sequence Number=SeqID_65034
  Homolog annotation: Hit_ID=Q6ASX1; Match level="QueryCoverage=72%, HitCoverage=75%, E-value=1e-50, Identity=28%"; Hit description=FYVE zinc finger containing protein
MEDVYGNVEKTHRFSTTFNTMYILIATVFASLKVRIHKFLEKTRSHPSKPRLVIKTCFDAPSLEHCICNLPKRGSLTVITVGGVGESFVAVVLNKEWFYVDKVIRLPGKGSLKSAPRDENEVLNHILGQASDKVPSRQRSFGISSSSIKDDLTSELRELGWSDMDLHNEDKKSSNLSLEGEFSSPIGEAFTKTGEQKDNKIDKSQVVALKKKNALMLKRKAISINCSMNNDKELSNMHDHRDGFDFEHLLAIVDDLHGNFEVTDEDMMDPAIASNVEEAMKFLKKAKLLERGLNNSGPEDYNTMSQKSTVVRKGVSFEIAGTRSDSIQLDKRNTSATNNVASRVAPKSRLMIQRELLSLKKKALTLRREGKMNEAEKEMQKGAALECQLMEMDKAMNEGSEDDVTDQDMSDPTHLSLLRDLGWNDDNNDVSNSLSKPLKKYDDHFVPFNDASLSKHSTNILVQAPRSKAEIQKELLGLKRKALAFRREGKVEDVEEVLKMAKASEAQIVEMDTAKSKARVEIVVMKDRLFNPLVDEE

SEQ ID NO: 156720 - protein, 327 aa, Glycine max
  Coding DNA Sequence Number=SeqID_65035
MASKKRKSSISRPQEPYDTTRFISEVAWERYEQNMHSRNILLERNVDLYVTQYDEFRKELERQRWHKTLTMQPDGHIDVALVKEFYANLYNPEDKSPRQCRVRGKLIKFDAEKLNAFEEIPVFLEPGVRYSTYSRFFRTHPDPQELTARLCIPGHGFVLNAKENPNDPTITFLGTHKTRARGASNASTSAPTSTSAPAPTPAPPQITAPSSPSAQSSDVLVSMLQSLHHSLCLVMQSIHDLAQHRPILSMEDFMAQVAWPGVQPSPTGGGEAPIAQEPHLELEDTPDETPEDILAATPLEATEEGDGATDTDYAAKQRKAPGTLGPL

SEQ ID NO: 156721 - protein, 87 aa, Glycine max
  Coding DNA Sequence Number=SeqID_65036
MDYALWNWQTSRGQDCQEFKGREIANSDLYWFGHTLVPTSSPQATRLRVPLSCKSLLQDLNHTRTTLPLCSDFFTTRDPRSLNPFSE

SEQ ID NO: 156722 - protein, 190 aa, Glycine max
  Coding DNA Sequence Number=SeqID_65037
MTLRLSPSFKGKLIAPQHEGVSLMSRRILRGMVSGSLILLFMVHWCKSSRYLPLQFPNTPEELLESKFIVEDNQYDSSYGEETDLHLLIDCGVVQQIWKPAQRHSVLPSRWHILFGATIWSIWKGRNSKVFKNNEKLHLEECGLDCPTNGMLKLNVDGSIIQGGRKGCAYGHPDRAEIGLGKGFQECLVG

SEQ ID NO: 156723 - protein, 553 aa, Glycine max
  Coding DNA Sequence Number=SeqID_65038
  Gene Ontology: Mol. function=helicase activity; Cellular component =nucleus; Biological process=viral genome replication
  Homolog annotation: Hit_ID=Q9LTU4; Match level="QueryCoverage=94%, HitCoverage=44%, E-value=1e-118, Identity=40%"; Hit description =Helicase-like protein
  Pfam annotation: Domain name=DUF889; Domain location=278-469; Score =230.6; E_value=3.7e-66; Accession=PF05970.5; Description=Eukaryotic protein of unknown function (DUF889)
MLATKRTRKYNRQTYMGPTFNWRIVLPQNDVFLCIREACFAKGFLGSDQEFIGALRKANSWGIAHYLRKLFVKLLFTNTMDIPEYVWQQTWQWRGQMILNSIIENKVFSLLKRKQSIYAGLKLKICCKPTEKAYEIFLPYEQKSIVDTIIRVVDTQSPGVYFLYGYGGTGKMFVWRTLSFAICSNGGIVCTVASSGIASLLLPGGRTTHSKFAIPVPATQNSTCNIHQGSDLAELLKITKQIVWDKAPMCHKFTFEALDKSLKDIMHNNLPFGGKVIVFGGDFRQILPIVPRADDGCSEITIPDKFLIKDYTDPIQAIVEATYPNLIHNYSNTNYLQKRVVLASKKDIVEKINDYVLSLVPNDQKEYCSADSVDKSDELLNPAFGLLTPEFLNSLQTSGIPNHKLKLKVGTPIMLVRNLDQADGLCNGTRLIVTKLGSNVVETEVITGPNTGDRTYIPRMNMSPSDSLWPFKLIRRQFPFIFSYAMTINKSQGPSLEHVGLYLPHPIFSHGQLYVALSRVKSKKGLHILIHDNQGIPKNLTTNVVYKEVFANL

SEQ ID NO: 156724 - protein, 65 aa, Glycine max
  Coding DNA Sequence Number=SeqID_65039
MKIAQTPLHQHVTQGNDYRLPRKFHDAILPTKGPVTRAMSKRLQQDWARTVEEGLRILMNLRVDF

SEQ ID NO: 156725 - protein, 168 aa, Glycine max
  Coding DNA Sequence Number=SeqID_65040
MRGTEFGSILGRIDSLLKGNPSLVLEVMDLFRSWRESITMAIGWTSKKSGADTEVEEPTDLRSNPLQGGGDDAILPRKGPVTGAMSKRFQEDWARAAKEGPMVLMNLRVYRVPYKLRLPPKLLIQGTFLEVKLLLPWLILQRMAPPITSSPLSFTATPWLKITIEGPY

SEQ ID NO: 156726 - protein, 109 aa, Glycine max
  Coding DNA Sequence Number=SeqID_65041
MDYLTPTLGEANTIPDLPEGVTFDFKHGFLQMLENNLFSGVAHKDPRQHLRKFIKLTYIVRRNQVPTEYIRLYVFLSLSMGRHGIDCAHYLRTVSLHGTSAQVSSYKGI

SEQ ID NO: 156727 - protein, 132 aa, Glycine max
  Coding DNA Sequence Number=SeqID_65042
  Homolog annotation: Hit_ID=A2Q4P8; Match level="QueryCoverage=61%, HitCoverage=31%, E-value=4e-11, Identity=44%"; Hit description=IMP dehydrogenase/GMP reductase, related
  Pfam annotation: Domain name=DUF1723; Domain location=15-64; Score =54.2; E_value=4.4e-13; Accession=PF08330.1; Description=Protein of unknown function (DUF1723)
MGGRLSSLITCSLDTGDRELSYAFAKRWHKETSSFHLPVGEVTITLDDVASLLHLPITSAFHTFDALDVHQVVELLVEMLEVSTQEAKDETEQCRGAVGSTSISLQLFPLLLIRITMKENHVLVDGSLGRHY

SEQ ID NO: 156728 - protein, 514 aa, Glycine max
  Coding DNA Sequence Number=SeqID_65043
  Gene Ontology: Mol. function=nucleic acid binding; Cellular component= intracellular; Biological process=transport
  Homolog annotation: Hit_ID=A7NXI7; Match level="QueryCoverage=93%, HitCoverage=96%, E-value=1e-127, Identity=51%"; Hit description =Chromosome chr5 scaffold_2, whole genome shotgun sequence
  Pfam annotation: Domain name=NTF2; Domain location=33-170; Score =82.5; E_value=1.3e-21; Accession=PF02136.11; Description=Nuclear transport factor 2 (NTF2) domain
  Pfam annotation: Domain name=RRM_1; Domain location=359-429; Score =46.3; E_value=1.1e-10; Accession=PF00076.13; Description=RNA recognition motif. (a.k.a. RRM, RB
  Pfam module annotation: Pfam domain module=NTF2::RRM_1; Domain location=33-170::359-429
  Subcellular localization annotation: CTP_CleavageSite=24; ConfidenceScore=5.39e-01
VRALKGFSIFFNGHALSHSRHRSSGSSSSSLLVGTYFVGQYYQVLQSQPEFVHQFYSDASTMLRIDGNARETAAAMLCAVVVLSETSDVVVRVGGKLVSKYAWDLCGGVVYARIEIKTAQSLESWSGGVLVMVSGSVQVKDYSRRRKFMQTFFLAPQEKGFFVLNDIFHFVEEDPVHQQQPVLLPQSNLDSKLNASSATNKPVSNYLLGGDIQARDYVATNEVKENGVVDNYGFSEQRMQRAPDTEHIREDNTVEESNGSLQSSVNAVQDHVPVSPDEPAGEPQKHTYASILRVAKGLSTPVASQPSHKNVSPSEWDHAPHSSSQQQQTIASANAFERSETDAVEEFPATEDEDEIKSVYVRNLSPAVSPSEIEDEFKNFGRIRPDGVVVRSRKDVGVCYAFVEFEDMTGVHNAVKAGSVQIAGRQVYIEERRPNSNIPSRGGRRGRGRGSYQSDAPRGRFNSRNFGRGNGQDGGDRDYNKSKGNGFYRPSPHQERGHSGHHQVPRNGQNLAES

SEQ ID NO: 156729 - protein, 257 aa, Glycine max
  Coding DNA Sequence Number=SeqID_65044
  Gene Ontology: Mol. function=solute:hydrogen antiporter activity; Cellular component=integral to membrane; Biological process =regulation of pH
  Homolog annotation: Hit_ID=A7R3F8; Match level="QueryCoverage=91%, HitCoverage=25%, E-value=8e-22, Identity=22%"; Hit description =Chromosome chr4 scaffold_519, whole genome shotgun sequence
MADFRPPYSISNLPPDAIPELACYNSTVDLSDNIWKRGNVIGEAVPLLSIQIAYIVLLSSIFHRIFKPFHLPLMVSQILNDIVLRSSKKAITIALVCILIPMLAGASFLALEHRVSGGSPNPTVSTKVLARLLSGLKILYRRLGKDALTATMLIDAYGWIMFTILIPYSHDGGKPLLSAICTFLFIVFCFCVVHPTLTRVIERKIRLETWDSSSLLDVMIGLFICSWIIDLLGAHHVVGAFVYGLILTSGKFVVGNL

SEQ ID NO: 156730 - protein, 99 aa, Glycine max
  Coding DNA Sequence Number=SeqID_65045
MRRALRSGDGRKWKKVRQERGGGGWGDQGVVEFGIGVVEEGKDYGVGELEVLWGWRREGGEFAEDSREGLPGMGTHWFSFSLQKRKGGGKIMGKRVQEF

SEQ ID NO: 156731 - protein, 117 aa, Glycine max
  Coding DNA Sequence Number=SeqID_65046
MSDRHIRARIGGCQGQNHEALRRLSPSDSFRSRESVNDRPYCVRVCGLSSFVPHRLVCKTCVVLVPHRLFRGGSGSNGIRRGEGEDREVRWQRFQLLEDADRGLSISEEAVSALIRG

SEQ ID NO: 156732 - protein, 152 aa, Glycine max
  Coding DNA Sequence Number=SeqID_65047
  Homolog annotation: Hit_ID=A5B5G7; Match level="QueryCoverage=46%, HitCoverage=5%, E-value=2e-07, Identity=35%"; Hit description =Putative uncharacterized protein
MRTFVDQIEMLNTHRRIIHKVSLHFGRKSAKKHKMRGELSLGGTLVKLKDPASVEASQASFHQECEVILTRSKITEGLVGDELMEGVVEDKLKITIPFGETLQHMPMYTKFLKDLLTKKGKYINNESIVVEDNCSVVIQKNLPNKHSKPPEV

SEQ ID NO: 156733 - protein, 107 aa, Glycine max
  Coding DNA Sequence Number=SeqID_65048
MRLNLYESSKQYKQKMKAYHDKEACEEEFPAKPTSSVIQLKAQIVSWQDQSSFYKTLMSLSLLLTHKNPNRATGGGALESTRDATIANGERSRDYIEVRDELFTLGD

SEQ ID NO: 156734 - protein, 47 aa, Glycine max
  Coding DNA Sequence Number=SeqID_65049
MYEKEGGSVKWRGGGGRKEKEEEHGREEKKKVGFTEVCKPHILLQPP

SEQ ID NO: 156735 - protein, 80 aa, Glycine max
  Coding DNA Sequence Number=SeqID_65050
  Gene Ontology: Mol. function=nucleoside-triphosphatase activity
  Homolog annotation: Hit_ID=Q9SB66; Match level="QueryCoverage=76%, HitCoverage=21%, E-value=6e-10, Identity=45%"; Hit description =Putative uncharacterized protein F22K18.90
MELTTDQNGAAYQHSLPVPEDKVLVPVEVTLKPSSTTKIDDVGSAVEGEEGPCEDISSDDQSSSFNEWILPAKEFDGLWE

SEQ ID NO: 156736 - protein, 356 aa, Glycine max
  Coding DNA Sequence Number=SeqID_65051
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A5ASG7; Match level="QueryCoverage=50%, HitCoverage=9%, E-value=3e-29, Identity=42%"; Hit description =Putative uncharacterized protein
  Subcellular localization annotation: CTP_CleavageSite=27; ConfidenceScore=5.24e-01
MCNHRPSYKQKFAVLLVKDPHQRFRMVANLAKHRHVAGHCSSILAFNTKNPTTSSESPSSPLLLVPYTPLPPARTSSSKSYIAIDTRDVEECIRSDIARIVKDQDLMHDCINFHPKDKLLMIQFLQEKGKVVAFIGTRLITSYISILKVADVGIVLDSVSRIVDRDSSDITIKRFNALEPILMAGRSKYHNIQNFIQLHLTFTISGLVITLITTICTGDFPLAQFQLIWVNVLVCILGGLMMVMKLTHEEQLAKQQSAHRNHPIITTEIWKSIVIQVLYQASVSMILEFGGHVTADRLCLLFNLLNIMQLLKKEVLKVVVQSFCFLGALGGCFLMQVLLIEYAKGRADCMRLNATR

SEQ ID NO: 156737 - protein, 170 aa, Glycine max
  Coding DNA Sequence Number=SeqID_65052
MVRIKGLCQALGRVLGRALGREVSGDEEEAPLRQRLTPLAHRQWATVAVVEDIEHVDDVAGKAHEDSHDLGFPGEPQDTLVLASYVDHVTAKVLAGKECTELKLASHERKVEKLGMSTPKIEGLVVGAFHTYDAIDVDQAAKFLVELLGVTTQEVIDKTKQCRGAYVCLI

SEQ ID NO: 156738 - protein, 161 aa, Glycine max
  Coding DNA Sequence Number=SeqID_65053
  Homolog annotation: Hit_ID=A5AII0; Match level="QueryCoverage=86%, HitCoverage=78%, E-value=4e-21, Identity=39%"; Hit description =Putative uncharacterized protein
MGYKQITFKEGVSLNRPLLFKGEHFSFWQKRIEIFIQSINPSAWNAIVKGSFIPTKEVNGELVPKEWDEMKNDEKRKNGEANLELQTRFTHIVNHLLGLGKMFEDDELNIKILNYLTRTWDPKITMIYESDDLASMSMEALFRKLLAYEHELIQQSHAEET

SEQ ID NO: 156739 - protein, 56 aa, Glycine max
  Coding DNA Sequence Number=SeqID_65054
  Homolog annotation: Hit_ID=A5B8P9; Match level="QueryCoverage=85%, HitCoverage=5%, E-value=4e-08, Identity=54%"; Hit description =Putative uncharacterized protein
MNKIRGHRRWGYSQSFGVDYQETFAPVAKGYTQSFGVDYQETFAPVAKLNTMRVLL

SEQ ID NO: 156740 - protein, 229 aa, Glycine max
  Coding DNA Sequence Number=SeqID_65055
MYNFTMFDDIVSGSISTNFLIDVIGEVVEIGQGNLHGKPKKVVFAMKNGWFRVDIKVGQPNESIIFTLWDRECYALIKETTYEIRQKMINEDGVFDARDIPEELDRVLGKRLAFKFKVVLGNTCHSVSQLSNDDDLINFVLSKLPTLQHQDEASPFVSMMQEINDVGDSQCLSATAESDPTLLGSITPAKRIFPLSHSQLDGIPFEDLSSIQLSSTRLGKKHIKTELSP

SEQ ID NO: 156741 - protein, 160 aa, Glycine max
  Coding DNA Sequence Number=SeqID_65056
MYPPLFSLNLVDVPSTRTNPQEMYPLLFSVNNPSRCTLYLEREESKEFSDCVVLNSLTREKGDTKEFRQLVLCSFGKGRRETQKEFRRLVLGKFFLAKGERNEKMNSTSFQGLKNHKTLERFWYKEEEKVQRDSRLVKDCKKLIGKVFKIIEMQNKALLL

SEQ ID NO: 156742 - protein, 214 aa, Glycine max
  Coding DNA Sequence Number=SeqID_65057
  Homolog annotation: Hit_ID=Q9ZPW2; Match level="QueryCoverage=15%, HitCoverage=17%, E-value=8e-08, Identity=81%"; Hit description =Anaphase-promoting complex subunit 10
MKTEPSLEDEDGSSHAQRQRPAPPTPLLTTVNLTTNTCATTTPVELNIGFLRNRRYLVEVNIGFYKTDVNRFILTSIILKKPMLNLLSKKSRRKPYIAVGIVGRRKPYTALGTTVGAQSSKLSTLPVNKLIVLYVVFKLDESYTPSKVSILAGDGFHNLKKQGFMVNVIQRTSQENQEFKNQEEFKTHEESLESRIKIQDLKNQDQDSRLKIQE

SEQ ID NO: 156743 - protein, 318 aa, Glycine max
  Coding DNA Sequence Number=SeqID_65058
  Homolog annotation: Hit_ID=A7UQU7; Match level="QueryCoverage=45%, HitCoverage=25%, E-value=5e-15, Identity=38%"; Hit description=IMP dehydrogenase/GMP reductase, putative
  Pfam annotation: Domain name=DUF1723; Domain location=159-208; Score =29.1; E_value=1.6e-05; Accession=PF08330.1; Description=Protein of unknown function (DUF1723)
MVDWTTEITSDTENNRGVGRGDRDDSDDAPQRRWPTTSTHRQRVVVTAEHDEPVVPTVEADVFPDEPMAGGDVEDTGVDIPAHTGAQAAENEPEGFPGGPSDPSVLTQYADHVAGSECPELKLSSHGRKVHSLGRHVPAIEGLVPGIGLSPLIACSVDTGDRGLLSLFIERWHRETSGLHLPMGEVMIVLDDVSSLLHLPVVGDLHAFQPLHVDDARLPGLRQCIVVDRMYACNGYVISMSADARQALRDLSQTGRYAWGVATLVHMYDHLNDASISTSRSLACWIHEHFPSVAKSLLIRTTTRIHRAPVGGLLRRRS

SEQ ID NO: 156744 - protein, 425 aa, Glycine max
  Coding DNA Sequence Number=SeqID_65059
  Gene Ontology: Mol. function=hydrolase activity; Cellular component =cellulose and pectin-containing cell wall; Biological process =negative regulation of Wnt receptor signaling pathway
  Homolog annotation: Hit_ID=A7PRH0; Match level="QueryCoverage=98%, HitCoverage=99%, E-value=0.0, Identity=74%"; Hit description =Chromosome chr14 scaffold_27, whole genome shotgun sequence
  Pfam annotation: Domain name=PAE; Domain location=45-409; Score =930.8; E_value=5.9e-277; Accession=PF03283.4; Description =Pectinacetylesterase
MRTGNLFWLGIVAALVFSFWVDAFSANQYYPHHHFNETEFSSLESQEQAHSSLLGRTPLMVGLTLIQSAAAKGAVCLDGTLPGYHLHRGYGSGANSWVVNLEGGGWCNDVRSCVYRKKTRRGSSTFMEKQIPFTGILSNSAEDNPDFFNWNRVKIRYCDGASFAGDGEDKVAQLQFRGQRIWLAAMEDLKSKGMRFAKQALLSGCSAGGLATIIHCDEFRGFFPETTKVKCLSDAGLFLDAIDVSRGHTIKNLFSGVVRLQGVQKNLPHFCTNHLDPTSCFFPQNLIAGIRTPLFILNTAYDSWQVQTSLAPSSADPHGFWHDCRLNHAKCTSSQIQYLQGGFRNQMLNAIKGFSRSPQNGLFINSCFAHCQSERQDTWFADNSPVIGNKAIALAVGDWYFDRAVVKAIDCPYPCDNTCHHLVFR

SEQ ID NO: 156745 - protein, 324 aa, Glycine max
  Coding DNA Sequence Number=SeqID_65060
MALHSLAQSSVEGGYNDWWAAMEVMKMMIGKREVCRGNVDMEICIGFIFLKQSVKLWWDDEMERRPLYAEDKLWVLPPSTKITTGCKAMWPTRRNVSGARVVFKRLFIVRNEQKGLGGTLVATMKFFIAFENRGHIHVSREKETLELGRKEMEVVYYGRNDNHPPVSPLANAPSPPPGPGSEVAELVPPGECPSRVVILGGGEPGLKCLKERGPRSELTITGHPLKPRQSSTFHVAGSYSKAFMCAEDGETRIRIAVDNEGMEFVNELIELKGHGMQGFTEGYLVALNESTINVRHRGLELDFRGPASKGQGCQVSIKAVRGSP

SEQ ID NO: 156746 - protein, 195 aa, Glycine max
  Coding DNA Sequence Number=SeqID_65061
MDSAIGIGRQAGDKVAKSASRPLEVVLEGFLPKVNSYGEIPEPKCIEESRQLCPIGTHVASYGGRVILCEQARNKRRPQGQPNATTFKTTMVCKNGEKVTQKILSPFLYRDSNGEEFPHISGSLKEFGDNTAPMPAPDASVYNVKVRVKSNKCRTGAVVSAFFNSLKASSVAEGCNGSIVANKPTIKLGEAEETT

SEQ ID NO: 156747 - protein, 34 aa, Glycine max
  Coding DNA Sequence Number=SeqID_65062
MTMKPTDNDESDGITVGITKLTFNDNAMAAKQLV

SEQ ID NO: 156748 - protein, 82 aa, Glycine max
  Coding DNA Sequence Number=SeqID_65063
MADYQQHFEKLSNHAFGLNGETLLNCFLFILALDIRRKLLIHKLFSIHQAIGLAKLVEAKIKDTKPKPSAKFLNPATPSATS

SEQ ID NO: 156749 - protein, 58 aa, Glycine max
  Coding DNA Sequence Number=SeqID_65064
  Homolog annotation: Hit_ID=A2Q2U3; Match level="QueryCoverage=100%, HitCoverage=12%, E-value=2e-23, Identity=91%"; Hit description=CENP -B protein; Homeodomain-like
MTSHLKGVAKSTMSDQIRKKLCEYKKDNPASTQKDLQRWLEGKFELKVSQGTISNTLK

SEQ ID NO: 156750 - protein, 115 aa, Glycine max
  Coding DNA Sequence Number=SeqID_65065
  Subcellular localization annotation: CTP_CleavageSite=14; ConfidenceScore=5.11e-01
MVFSLNFLDPSSPKLAYGSPGPPNYFRMKEPTHLGEPVTSGVSINSLGRATIAPTAHFPINRRAREAEGRVQGSGIEGIETREKEEETKSRRYRIATAIIPYIVFLFCVLRATVG

SEQ ID NO: 156751 - protein, 128 aa, Glycine max
  Coding DNA Sequence Number=SeqID_65066
MIRKKHNSFPIAVSAIAGNNGGKKKVHGAYLDYGRSRSSLDGGRRRRSRNAKKKHHDTRRRSRRMATMAAMAWEAKREVHLGGPRRFTTTITTRMKKTLKMQKNEEAQRFEEEEACGAGEREARVIFF

SEQ ID NO: 156752 - protein, 459 aa, Glycine max
  Coding DNA Sequence Number=SeqID_65067
  Gene Ontology: Mol. function=translation initiation factor activity; Cellular component=protein complex; Biological process=translation
  Homolog annotation: Hit_ID=A7PAB0; Match level="QueryCoverage=100%, HitCoverage=100%, E-value=1e-167, Identity=64%"; Hit description =Chromosome chr14 scaffold_9, whole genome shotgun sequence
  Pfam annotation: Domain name=PCI; Domain location=306-408; Score =72.6; E_value=1.3e-18; Accession=PF01399.18; Description=PCI domain
MATVVPTSEEDAALSVVRFASELAWADAGPEVTFFLFLLSNPFLAFFLALTGLSVLDYFLLLLLCALMHLVILFPILVCQVAEPQVSRLCVEAEEFIVMGKWLELASLMITSAELIFSKVSEKDIESIFTIICNLVTKTENPDEVMEIVKVITTKILQQPNEKPAVRLKIMISLYNLLETPYCQFYVYMKLLNLAVDGKVTEHIIPSFNKIDNFLKDWKIGIPEQRELFLAVSNILKENKSMSKDAFKFLTSYLATFSGDDSHVLSEAKEEAARAIVEFVRAPDVFQCDLLDLPAVTQLEKDAKYALLYQLLKIFLTQRLDAYLDYHAANSTLLKSYGLVHEECIAKMRLLSLVDLSSDGSGQIPYELIRDTLQISDDEVELWVVRGLTANLIDCKMDQMNQVVVVSHPTERVFGQHQWQALRTKLVTWRGNIANVISTIQANKITEDGSQAAQGLVVR

SEQ ID NO: 156753 - protein, 62 aa, Glycine max
  Coding DNA Sequence Number=SeqID_65068
MGLVLGLNPNTWLLYMMTIPVWRPCLTLESLKKFGNLTMLNSRHMTTPPSSPPPPTFFAEED

SEQ ID NO: 156754 - protein, 121 aa, Glycine max
  Coding DNA Sequence Number=SeqID_65069
MGLLDSRLKGKHIMKEANKQIYDKEDRAEQQAKSIQCGPQLGQLTDLPYEPQTYLDHTPSTHKKPTGGNWQVYSRGSWSNRRHQRSGSFEGNHMPLSIIQQSSSRNSSGTATGNISIDLQQ

SEQ ID NO: 156755 - protein, 80 aa, Glycine max
  Coding DNA Sequence Number=SeqID_65070
MDCLALHGHEGLKYIKGLKDEGIRNEGSLSYFFALSRHSPAKRHSSLSELDLLSANYQASTSLSIPCLYICKIKSSNSMN

SEQ ID NO: 156756 - protein, 63 aa, Glycine max
  Coding DNA Sequence Number=SeqID_65071
  Subcellular localization annotation: CTP_CleavageSite=15; ConfidenceScore=5.03e-01
MGNNKRRQSHSTAKQIMMKGATSGSGKVLIKKAGTSSVKTDDVAHQVFDNLSECSAEAESSPK

SEQ ID NO: 156757 - protein, 141 aa, Glycine max
  Coding DNA Sequence Number=SeqID_65072
  Homolog annotation: Hit_ID=A5BP71; Match level="QueryCoverage=53%, HitCoverage=19%, E-value=4e-11, Identity=45%"; Hit description =Putative uncharacterized protein
  Pfam annotation: Domain name=zf-CCHC; Domain location=114-131; Score =18.9; E_value=0.0021; Accession=PF00098.14; Description=Zinc knuckle
MKDKYIVLSLLKNLEKIKNKLVRTSFACMISTQQACGYVSMNYYQYIDVVYTNEHILKAYSTQWWPLGNEAAIPPSDDAWTLIPDPTTIRAKGRPKSTRIRNEMDWLEPSDHRQKCSRCGAEGHNRRRCPMQSDRGSCSFN

SEQ ID NO: 156758 - protein, 194 aa, Glycine max
  Coding DNA Sequence Number=SeqID_65073
MCSATDYKTKSIGGMCILIQMWAWERCITLAPKRTPPLVENKPLGHRWLQHGNQHIGNDDLRVFRRKLDIMKRHEFVWKPYTTNWNNQVDFRVNGYPRQEGLLSSNSDYMVWYRRKTKMIVDPQNANTATLAEVAETLQYMVSPQEKNIWIVDDLVPYVEKITILSKEQERITEPVSHGPATEHQFPAQEFHML

SEQ ID NO: 156759 - protein, 71 aa, Glycine max
  Coding DNA Sequence Number=SeqID_65074
MKEIALNQLEEKMWISDVGSLNFRLGYACEVLRCRGTKVVLQGDPPWLIFCHDVSSKLGCGKDDDIENDGS

SEQ ID NO: 156760 - protein, 134 aa, Glycine max
  Coding DNA Sequence Number=SeqID_65075
  Homolog annotation: Hit_ID=A5B1P9; Match level="QueryCoverage=87%, HitCoverage=9%, E-value=4e-14, Identity=36%"; Hit description =Putative uncharacterized protein
MERNLLENLMQKPMRQFFLGYSLQCKAYRVFNMRTLCVEEFVCVCDETNFLVQENALQDENVGFQDKDTTLEDEIKVKDLEQSKEITATPPKDLSMEWRAQRYLSLDNTIGEISKGVSTRSRLRTLCNNMAFVS

SEQ ID NO: 156761 - protein, 174 aa, Glycine max
  Coding DNA Sequence Number=SeqID_65076
  Gene Ontology: Mol. function=transcription regulator activity; Cellular component=nucleus; Biological process=regulation of transcription
  Homolog annotation: Hit_ID=A5B706; Match level="QueryCoverage=96%, HitCoverage=87%, E-value=9e-31, Identity=45%"; Hit description =Putative uncharacterized protein
MADTFLFFAVFASVSTEIDIPGDAVACQENTKKRFCDLSSVLEPGRPVRTDKPAILDDAIRVLSQLKTEAQELKKTNEKLLEEIKCLKAEKNELREEKLVLKADKERIEKQLKALPVAPAGFMAPPVAAAAAAYQAGVNKMAVYPNYGYIPMWQYLPQSVRDTSHDHELRPPAA

SEQ ID NO: 156762 - protein, 75 aa, Glycine max
  Coding DNA Sequence Number=SeqID_65077
MPAEAEAAARDSVAVNCGECTVVKRKTCEMINIITIQVLLGASGQRLSKHALIRKLGRVKVHLETNPISNYKEAN

SEQ ID NO: 156763 - protein, 527 aa, Glycine max
  Coding DNA Sequence Number=SeqID_65078
  Gene Ontology: Mol. function=zinc ion binding
  Homolog annotation: Hit_ID=A7UQU7; Match level="QueryCoverage=52%, HitCoverage=56%, E-value=2e-29, Identity=29%"; Hit description=IMP dehydrogenase/GMP reductase, putative
  Pfam annotation: Domain name=DUF1723; Domain location=85-134; Score =35.5; E_value=2e-07; Accession=PF08330.1; Description=Protein of unknown function (DUF1723)
MKLSIGEGSQHPHVGNEKLSLLLRMLLTWMAQLKRPCDTSVLTAYADHVAIIVWNGKKFGRPIADIEGLVDATRLSLLITYPLDTGDQGLISTFMERRHKETSSFHFLVGEVTITLDDVASLLHLPIICVFHSFKTLYDDEAVLMVVEMKPKLRHYIVMGHMYNYLGYEIFIIANVSATHVHVVFLDAFRDLNQSGSYAWGTAALVHMYDNLNDACKSSNKQLDGYITLLQCWIYEYFPSIAEVFTNEDYDERPPHDCRWTSTKASMKALSVSTYRKRLDRLTTADVCWIPYGDHRAVREFNLISCFYGHIQWGPVDQRGLCGSLGMFRRFLHTIQVKDYALKILTTDECISLTTLHWPTQLGDPPRHPPVVQDETYIEPDMPQYPVVAATIEEAPAHAVVTYIFILLLMSIAERLERLLNLRIVIEGTKTYDVMQDCLRIARGVIVDHNVYVRPPNQSQKNDDLEPVHRWIVVKFEYHVRNTTPSLLTVGNFDIMEKNESHEDSTSGGFNLFSVSLTFGNSIGAVG

SEQ ID NO: 156764 - protein, 115 aa, Glycine max
  Coding DNA Sequence Number=SeqID_65079
MGRQRIWWEQWHSLAARRRWRDEWRPLDDTEMKKENNNGERITNFAYVVPLCKENGYPVLESQEELATWTAAKQKENKQNKQHDAKALLFIQQGVSRRSFQESCKQKIQRRCGRL

SEQ ID NO: 156765 - protein, 204 aa, Glycine max
  Coding DNA Sequence Number=SeqID_65080
  Subcellular localization annotation: CTP_CleavageSite=37; ConfidenceScore=5.50e-01
MAKSSKKRKGSSSTTAAAAGHRRHGPSGALTAPIHPSLSSPRSPTLFSSDDQRQSQGVPFEGTIVDDWKFNYSSHDTHCMVCNDQADMTGKLFAGSLTFDCRIMHYIIVRILLPRSFNLAQASEEDLILMWAFDTGRQIDWAYLVRYRMHKALRVNAPLPYPQLVTLFLHHFQIPLNDEPFVQVKRSFAIGVGVVTSFGYRITT

SEQ ID NO: 156766 - protein, 76 aa, Glycine max
  Coding DNA Sequence Number=SeqID_65081
MAPWTLASQSRENGYESGVIQTQFLGEKQREAPLNKDYEYFVGFNGDDNASPKRSFLDALSDPETEESLQEKNNNK

SEQ ID NO: 156767 - protein, 91 aa, Glycine max
  Coding DNA Sequence Number=SeqID_65082
  Homolog annotation: Hit_ID=Q5Z7K6; Match level="QueryCoverage=48%, HitCoverage=11%, E-value=8e-08, Identity=61%"; Hit description =Putative coclaurine N-methyltransferase
MHDDQIHILLLLSCQGSSSAKYTIHLPTGYFFLKDKNEDDWIRRYFFAGATVPSANLLLYFQSPIKFCYVLKDKDEGKFYRKKDDVTVINH

SEQ ID NO: 156768 - protein, 74 aa, Glycine max
  Coding DNA Sequence Number=SeqID_65083
  Subcellular localization annotation: CTP_CleavageSite=41; ConfidenceScore=5.38e-01
MWNTLALTYEGLSQLKCNKLSFLTPKPSSTYKESSSRPTSRSSSKAVNIDTPSNDQSNGEGSYEDDQLVFIMRK

SEQ ID NO: 156769 - protein, 109 aa, Glycine max
  Coding DNA Sequence Number=SeqID_65084
ARKDGDILEAKSPARTTTSPSKAAPATAPEHLSLRLKPTPAMLEVAVATCHVSSHKESTNGAGVFACPPHKKTAPSWNNFQNNPSSGISLKKAPNWSICRIVMTMGEVK

SEQ ID NO: 156770 - protein, 162 aa, Glycine max
  Coding DNA Sequence Number=SeqID_65085
MASRNKNVPVIVYYDAYVADCDEGVEFKGRNNVLVSMRRGMTLNALKTKIQCLSSFAPIPYTITNDYYVPHFESTEFDTRISSYTQLFGGSSNYCEATPQLNEPSHLNVDPTTDIHVVQSKRNEMSHDYHAQNGLPDEVVGDFSDDEDEILADNNDNSDNDT

SEQ ID NO: 156771 - protein, 1078 aa, Glycine max
  Coding DNA Sequence Number=SeqID_65086
  Gene Ontology: Mol. function=nucleic acid binding; Cellular component= nucleus; Biological process=response to DNA damage stimulus
  Homolog annotation: Hit_ID=A5AF76; Match level="QueryCoverage=83%, HitCoverage=74%, E-value=0.0, Identity=60%"; Hit description =Putative uncharacterized protein
  Pfam annotation: Domain name=DEAD; Domain location=396-635; Score= -20.1; E_value=0.0013; Accession=PF00270.20; Description=DEADDEAH box helicase
  Pfam annotation: Domain name=HIRAN; Domain location=195-291; Score =40.1; E_value=7.7e-09; Accession=PF08797.2; Description=HIRAN domain
  Pfam annotation: Domain name=Helicase_C; Domain location=947-1025; Score=96.2; E_value=1.1e-25; Accession=PF00271.22; Description =Helicase conserved C-terminal domain
  Pfam annotation: Domain name=ResIII; Domain location=392-629; Score= -16.7; E_value=0.0012; Accession=PF04851.6; Description=Type III restriction enzyme, res subunit
  Pfam annotation: Domain name=SNF2_N; Domain location=398-762; Score =184.1; E_value=3.6e-52; Accession=PF00176.14; Description=SNF2 family N-terminal domain
  Pfam annotation: Domain name=zf-C3HC4; Domain location=842-881; Score= 48.7; E_value=2e-11; Accession=PF00097.16; Description=Zinc finger, C3HC4 type (RING finger)
  Pfam module annotation: Pfam domain module=DEAD::HIRAN::Helicase _C::ResIII::SNF2_N::zf-C3HC4; Domain location=396-635::195-291::947 -1025::392-629::398-762::842-881
  Subcellular localization annotation: CTP_CleavageSite=37; ConfidenceScore=5.14e-01
MAEEEPSITSPPARTLHKFLSRSGKTVIAAQPLAVVRATTSTGGARVLAAPPNSNDDPTPPQEEEGEGETGFDASHHHERILLQRELTVSFDEFLEVTNTKVATEEEALKSVMAPLEEETEEGEEAESSQAQSAQPVQPVPRGPQLFRPVQKKKAVTGDDVEVVEVRKPVEKKNIPNISNLEDGEFPEESGWFLLGRKVEVAVSTARGVNRLVDNEIVHFNFPIPSYSSKSQWIVRASTKRSGEVGRMPMEWAEAMITVMQSGRVKVRGRCIAVPDKLQMMQEIMFLVSFYVHHSVFAERVDTSWRLEACGKIDDTVYPLLALLKMLEIKPSQKADPDEAAALPLIKRRKGGEPLPEQNNDEQALSESALNKLVGAAEIYDLKEKEAPETLVCNLKPYQKQALHWMTEIEKGMDIESVERNLHPCWSAYTICKGRTIYLNIFTGEASKKFPKATQMARGGILADAMGLGKTVMTIALILSNPGRGNSENNDVENGDDNFITNKRKNANTLHKFEGGTLIVCPMALLSQWKDELETHSKEGSISIFVHYGGARTTDPWMISGHDVVLTTYGVLQAAYKNDGENSIYNKVKWYRVVLDEAHNIKAHRNQTAQSAFVLSSHSRWCLTGTPLQNSLEDLYSLLRFMRVEPWCNLAWWQKLIQRPYENGDPRSLKLVKAILRMLMLRRTKETKDKKGRPILFLPPIDFQLIECEQSESERDFYEALFERSKVQFDQYVAQGKVLHHYANILDLLMQLRRCCNHPFLVMCGSDTQKRADLSRLARKFFQTNTEFPDESNQNDPRQQAELNKLASRLLLKSASSLHSVQPHAYIAEVLENIQKGDIIECSICMESPEDPVFTPCAHKFCRECLFSCWGTSVGGKCPICRQLLQKDDLITYSSESPFKVDIKNNVTESSKVSKLFEFLQRILNTSSEKSIVFSQWTSFFDLLENPLRRRGIGFLRYDGKLTQKQREKVLDEFNETREKRVLLMSLKAGGVGLNLTAASNVFIMDPWWNPAVEEQAIMRIHRIGQNRRVVVRRFIVKDTVEDRLQQVQARKQRMISGTLTDDEVRTARIQDLKMLFT

SEQ ID NO: 156772 - protein, 180 aa, Glycine max
  Coding DNA Sequence Number=SeqID_65087
  Gene Ontology: Mol. function=phosphoprotein phosphatase activity
  Homolog annotation: Hit_ID=A7R978; Match level="QueryCoverage=86%, HitCoverage=77%, E-value=5e-21, Identity=37%"; Hit description =Chromosome undetermined scaffold_3458, whole genome shotgun sequence
MCEQCLGVVPPKGEVIVGSAIKLKWLQDNMSSLPAEPTQQVLMLDKTRNRVHLMYLTVLADLNQVRWYSWGPACLAMLYREMCWATDADAKTMVGYASLLQSWVWYRMPFIATRVNRTPSYPLVTRWSGGGLSFTGTPHGDVIGYRMRLNHMTTEQNGTKRIELNFNSTSDKTYQIPHET

SEQ ID NO: 156773 - protein, 89 aa, Glycine max
  Coding DNA Sequence Number=SeqID_65088
MAPFLFLMVLKGLADLVRQALASGKLKGIQIGKDNVDGVGVMGCWSVNFFDGGNGLPGKCPWWKISYKRCTWSCYMNMSKMLSPRNVAQ

SEQ ID NO: 156774 - protein, 85 aa, Glycine max
  Coding DNA Sequence Number=SeqID_65089
MVSYFVQEFKKKNKMGISENPKEVENWMRIEERPMDQVTKFVSEDDIEDDFMAYDIHSGDKKKPAKSTEDHVKPKKKEGPKVVNF

SEQ ID NO: 156775 - protein, 867 aa, Glycine max
  Coding DNA Sequence Number=SeqID_65090
MQSQFQSQMQSQRLALPPEPEVGPSTACASTKESCVDPSGNDPDTGDSDKCGLYIEENPPHLVALGRVYEGSTTVRNIPLLHDQVKVGVEEVKDEDAPIPVPTDEGAVGPAKLANRLDHEVMWDAIVFGVFNEDFPLYIKHEDLSEIEHGGQCLSISVIYRHLNETSMRVGNFDVYGFLEPQSIQRFGQSQFESESYMKNWMQNSKRDVYLGAYLNSAHWQMVIILPKENLVVWFCSLHNRPDNYLKGIINSALKGLDNTPQRKSKAGARRRNKVGRRYGFVRYMKLSNPTEVERQLDSLYISNEKLFVNLPRFHKEAAKVTPGKEPTKKKDWRRWGKEKIRGENVSKGWIEGEEPNSGCWGHWIVREELCWYMGDEKVLLTQIEEGKSLGELVAEKTEWILCTGLPLQFWKAESDEESTIYEKVYGDENSRFSECYLGDNNLLVDGDCLGRLDDSGEIALESTTTMGSHEKLSVDTFLSTTDKETQALNANRRENKILGGSNQSQERGEFFKENMPKENQPSQSENQHVVTSIPDTSFLSQDKKEEDEGHMGQDNGEDICKKGATKKLEVNKKELVGLLTKGLEETAFEKEKEGQMGDTNLGLIEKDMINMVAYGEVDTERKDNGKAKLIEKEYNNQGMIKKDVDEAKMDKTEGGSEKKFIKEGKKYGSLTTNAAGGLLCIWKDDETFFGLGYLGIKALRLLHLGLAWSVVGDFNAMRSHEEKRNSRNEKVGERDMLEFDAFIHNMELVDISLVGKDKVVRKISEFDLKDDLEDISEEHIDCNPIFFHAMVKGERNANGLKGILDYGWEEDPSQVEKKIYSFFKERFEEQSGRRPKFDGNPFSHITVEDNVKLCIPFEELEIKEAI

SEQ ID NO: 156776 - protein, 221 aa, Glycine max
  Coding DNA Sequence Number=SeqID_65091
MSTSPMEALRRLGIILAGVKLEVEKKHDPKLGLPSQGVSLTACKYVYVVWGEGEGDLKKDEDMFDPPNLSQKNDDLGLVHRWIVVKFEYHVRKKNLAYSTMSQLGYMMEKKESHEDSTSGGFNLFSVSLTFGNSIGTVGGITEGISGNRYRCYYRWLKTRESAQREKKESHEDSTSGGFNLFSVSLTFGNSIGTVGGITEGISGNRYRCYYRWLKTRESAQ

SEQ ID NO: 156777 - protein, 50 aa, Glycine max
  Coding DNA Sequence Number=SeqID_65092
MGEGCCTQPYPCIFKEAVSGFEPMTNKSPREVTAWWISNAVPLQVNAILS

SEQ ID NO: 156778 - protein, 353 aa, Glycine max
  Coding DNA Sequence Number=SeqID_65093
WPLGREKPQHLGPKSPMTPPGSHLRALGIDIHRTFTPETSFRRGMRNWHKALTQHMDGHIDVALVKEFYPKLYDPEDKSPKQPGEHLTAYSRFCRTRTDPQELASKLCIPGRGVCFHTPTSPPTSHTFDLTMDRARLDFPTLITALCVARGVVSDSLTFESLSPAINLTYIKKNCWNLDDPTIVFPGTRKARARGPSEASTTSPSSAPASTSASLTSLPPSSVPAPADTSALSFDVTVPMLQSLHHGLCLVAWPGVQPSPLGGGEASAAQEPQSEVAHEATPETTPQVSPAISPVVEVFEDEEGAEDTNYAADLQATQSTWDPWPTAAQETPQPAQDTPSSPHGEQTSPQEEL

SEQ ID NO: 156779 - protein, 121 aa, Glycine max
  Coding DNA Sequence Number=SeqID_65094
MIDAECQDNLVFEEPMPSEKRKEKRRKEFVLLCYRILELVILVSSFLNIKSHNIIPSRSGFLKRNLAGLAIFLLIMLAICTSVSAYFASASCTPVSVVLSSVSTVSFSGPSKTPYPQGVGL

SEQ ID NO: 156780 - protein, 165 aa, Glycine max
  Coding DNA Sequence Number=SeqID_65095
  Homolog annotation: Hit_ID=A5AK77; Match level="QueryCoverage=52%, HitCoverage=10%, E-value=5e-09, Identity=37%"; Hit description =Putative uncharacterized protein
MTRGNPSDLQPFDPEIDRTFHRLFRHHYVPFEHPEHSVIGETEHFVVDNFEHPDFEHYSFEHSDFERSKNMAQPPPHERTLREMAAPDFTYESLCIQYPDEDVPYVLKTGLIHWLPKFHGLAGEDPHKHLKEFHIVCSTMKPPDVQEDHIFPKAFPYSLEGVAKD

SEQ ID NO: 156781 - protein, 282 aa, Glycine max
  Coding DNA Sequence Number=SeqID_65096
MINQASIVALNQRWSVVFQGRNMHGSDKNQDSTLDIPETHILLTQTPNLIQFDEVYGVYATRDDNDEEMWENIHADKRKEKKEQKVQAHNLYLHTLSRGGYDRLRLKIMQDKMKVWALGNTLDYLPVMALPQQLSPIVNRVSTRWSFVDVDPLGEDNYINIHNLCELYIDVDPLILVPIGNVYNLGLTIQHKKIKDDSVSIVMEEVKDSNAQVPFPTDEVQTMGHAPNHFIQWPRKLVKSISTKIMEQCCKDIQHKKLEPKLDSLEHLLMVASQNKDPIQLH

SEQ ID NO: 156782 - protein, 334 aa, Glycine max
  Coding DNA Sequence Number=SeqID_65097
  Homolog annotation: Hit_ID=A5B249; Match level="QueryCoverage=16%, HitCoverage=23%, E-value=3e-11, Identity=62%"; Hit description =Putative uncharacterized protein
MVEDKERATLRLPLKSKLRTPLESCVGIEEIVVVVMVGVVNDIVLGEEVLESHHLVVTIIYVVDLVATILWEQEGVQQRVVDIWLKRGVRVEEGEKMNWRRERENLSHLSHVMLPSLTNKKPKGTTITLAKAKKAEAQAVAVEPQSFPNLKEALNSKPKKKKGTTITLSEFNHGGFSQGLMCDEMLALPTGPKEHSTEEMQFNPLAVVSPPMTALVVAHATAAITKVRGGKGGRRSYGGFNEERKGPNPRVSVLVFAISEWSLIDGREAVHRGWYSLDTVIAAESLALILQAFGDTKDSKELLERCLNVRKDLLPDDHIQSRCKLTSSSKSGNA

SEQ ID NO: 156783 - protein, 260 aa, Glycine max
  Coding DNA Sequence Number=SeqID_65098
MEDIGGGRRPPNRGGEGRGVGGSAPTSFESFTYSIHILTSETTDYLHLSYPPTLMLEHPNDQRSWLHAEKRKVISNIIKRKFDEPSPTWKKVDVASCRACRPWIFFINGDLCFLKINDSGMKKEESLLVMTLVMGPFLGRISSKVPLEKEYRWDPQQEQVIKSIFGTKLCKFQEQELHCQGKSTVDSGASTYCDGSISTATYYEKLTDEYQRALTTWEVVKRTKKLKTEAWANDKTKDLFISKMSRRVATMSYDRRHTYT

SEQ ID NO: 156784 - protein, 46 aa, Glycine max
  Coding DNA Sequence Number=SeqID_65099
RDVVTSGTTSVIGIRISLCKTSFTESEPHRNNSSLVFRNPYNLRDR

SEQ ID NO: 156785 - protein, 444 aa, Glycine max
  Coding DNA Sequence Number=SeqID_65100
  Gene Ontology: Mol. function=RNA-directed DNA polymerase activity; Biological process=RNA-dependent DNA replication
  Homolog annotation: Hit_ID=A5BE85; Match level="QueryCoverage=37%, HitCoverage=56%, E-value=1e-17, Identity=28%"; Hit description =Putative uncharacterized protein
WRLQSSFFLLHSASIDIKEAKDSIDEEDPRPTSSTWSYIKSSLEFCLQANITLAKGNSNLKEHVLVLEVEMKALETRVLDVEASIKTNKEEVDSGEPTTPFGETQMTNLRKEDGDKDDEEDIKRFLMDFHCNGIFPKGCNASFMSLIPKVEDPQGLGDYRPISLLGFGGKLIGWIRQCLVSTHISVLVWGFYEGIFPQRGLRQGDPLVPFLVTIIVKGLSGMMREIIFKDMFEGFLVGNSFGGIGVGKEQLEKFVDILNCRLMPLPFTYLDFPIGTNLRKRDMWEPIVLNEGGLCLMIMIPHGRKSLHQSMMGGWGLMERWISLLHYGGETRDKCVVRSAWIGGSKDWGCRLLDQPMDKLQSCNFVQGERDFWLWPYDNSCLFSVTSASATLHDLRMGSEVDEILRRVWDLEIPLKTQFMMLRLLLDRLPTKEVGDVEARLHGE

SEQ ID NO: 156786 - protein, 121 aa, Glycine max
  Coding DNA Sequence Number=SeqID_65101
MQAILSIFQNVSASTESSDFESMGILAKSGSHLIGESVDNDQTDEAVKIVVGDAGVHHFNGTRWEAEGHGPNKVATSPIHQTVNLQHHELCQLRHVGRKGSTTRWKGKCERRELRRESEKA

SEQ ID NO: 156787 - protein, 136 aa, Glycine max
  Coding DNA Sequence Number=SeqID_65102
MDDALFFVEKSIQNIMCLKAMLRCFELALGLWVKRISGYDLAWWKDPVVVCGVGRDSWFDKNVAWKGTHEFGEKEMWVGEMGSWDNGVWSKELVWKRPWFTWELPMVESFMADLHRISRDHQEMDCLVWKTASIGP

SEQ ID NO: 156788 - protein, 89 aa, Glycine max
  Coding DNA Sequence Number=SeqID_65103
MTNMVAQRWIWQFQIFPPFGEYEEAEEWGKRGDGGWTMGGGLGDSENLLTEEGNSALCARFSKEKVWDCGGDKSPDQAISTSILSRNIG

SEQ ID NO: 156789 - protein, 150 aa, Glycine max
  Coding DNA Sequence Number=SeqID_65104
MSKYDPEANAWPIEEGVIDKHSKVRGQWIPYDIDAINQFLGNPLILEEGQQCEYTARRGQTTGFDEEAIDVIHQFIGTEPPRHPVDPKKSNKALQFPASVIVTVAWPKDMPIFQKEVGPADAQGAAQGDGGRAEEDEDMADLVDYFIGGD

SEQ ID NO: 156790 - protein, 499 aa, Glycine max
  Coding DNA Sequence Number=SeqID_65105
  Gene Ontology: Mol. function=two-component response regulator activity; Cellular component=endoplasmic reticulum membrane; Biological process=two-component signal transduction system (phosphorelay)
  Homolog annotation: Hit_ID=Q949H5; Match level="QueryCoverage=87%, HitCoverage=57%, E-value=0.0, Identity=76%"; Hit description =Ethylene receptor
  Pfam annotation: Domain name=GAF; Domain location=228-374; Score =43.5; E_value=7.7e-10; Accession=PF01590.17; Description=GAF domain
  Pfam annotation: Domain name=HisKA; Domain location=410-475; Score =33.6; E_value=7.2e-07; Accession=PF00512.16; Description=His Kinase A (phosphoacceptor) domain
  Pfam module annotation: Pfam domain module=GAF::HisKA; Domain location=228-374::410-475
MGLWDDERVLFFQKMKMFIEFSVEALEVDFEISGMIIRFWCLLDLVVFLWLGSYQETIVEEATLGVGDNGFPRCNCDDESSLWTIETILECQRIGDFLIAVAYFSIPIELLYFVSCSNFPFKWVLFQFIAFIVLCGMTHLLNGWTYGPHTFQLMVALTVFKILTALVSCATTITLLTLIPMLLKVKVRELMLKKKTWDLGREVGIIMKQKEAAMHVRMLTQEIRKSLDRHKILYTTLVELSKTLGLQNCAVWMPNVEKTEMNLTHELNGRNVNCSIPITNPDVVRIKGSDEVNIIDSDSILATASSGVYGGAGPVAAIRMPMLQVCNFKGGTPELRQTCYAILVLTLPSAEPRSWGAQELEIIKVVADQVAVALSHASILEESQLMREKLEEQNRALQMEKMNTMMASQARASFQKVTSNGMRRPMHSILGLLSMMQDDNLKSEQKLIVNSMLRTSTVLSNLINDAMDYSTRDDGRFPLEMKPFGLHAMVKEAACLAKC

SEQ ID NO: 156791 - protein, 178 aa, Glycine max
  Coding DNA Sequence Number=SeqID_65106
MQSQGLALPPESKVGLSAARVSIKESYVNPLGNDPDTSDSEKSRLYVEENSPFLVALGRLYEGSTTVHNIPLCNDQVKGVVGPAKPVDRSDHDVNDPLYLMTLTIPQLFLNSLQVMWDATVFGVFGQCLSIFVIQLWILHMIETSMRAGNAGVYGFLEPLSIQRSGQLQFESESYIKN

SEQ ID NO: 156792 - protein, 184 aa, Glycine max
  Coding DNA Sequence Number=SeqID_65107
MRIPKYLDLEWFSQQGGMLLDPARNLRNRLGVGGLTVEDKMLVYLITYILTPRSSNHAQVTNDDLQIVYGLKSSINMNWVLLIEDIMLKSRRLVDYEYPYVVLASRLIDYFNDDVSNEIVDFTKVASEIIKRHLKKLGMRFVDHEWIMAGEPTIGNFDQMEEDDKAEAPQELAHQWSPFKSLMI

SEQ ID NO: 156793 - protein, 50 aa, Glycine max
  Coding DNA Sequence Number=SeqID_65108
MEVGESLIGLRLPLHYRADTGQVDFVANLMVVFVDDWAFLVGRVVSNGKD

SEQ ID NO: 156794 - protein, 160 aa, Glycine max
  Coding DNA Sequence Number=SeqID_65109
MEAMKEQMTTMMEAMMSMRKMMDDNTATVVATSTATKIDLIHLTGFNIVNLPVSDVVGQGGEAAKNACGPHHVQVQSKHSFPPYGLPPSYTPPTIVYTSGENISNSAPVLIENQQPQFDHAHVSQPMGKHMKFPKTILWLGLGFIQDIPLKGRHFLASLC

SEQ ID NO: 156795 - protein, 60 aa, Glycine max
  Coding DNA Sequence Number=SeqID_65110
  Subcellular localization annotation: CTP_CleavageSite=23; ConfidenceScore=5.20e-01
MGNLYRDGGVQSKSVAMIGPDPKAAASSCRNLPFGGRATRDSRDACSTKGIRAESPPTFI

SEQ ID NO: 156796 - protein, 90 aa, Glycine max
  Coding DNA Sequence Number=SeqID_65111
MFQRWPPGRGKSQHPSHRSPMIPLDSTLRGSGNLIKRNWHKALTQFMDGHIDVALVKEFYSNLLCTDPYELASKLCIPSYRFVLSAEGAP

SEQ ID NO: 156797 - protein, 52 aa, Glycine max
  Coding DNA Sequence Number=SeqID_65112
MWEEKEILETSDREVEEGSCCDSKDNDSLKKSSGSRDQKNDDEVLFSDMRIA

SEQ ID NO: 156798 - protein, 113 aa, Glycine max
  Coding DNA Sequence Number=SeqID_65113
  Gene Ontology: Mol. function=protein serine/threonine kinase activity; Cellular component=cytoplasm; Biological process=protein amino acid phosphorylation
  Homolog annotation: Hit_ID=B0L641; Match level="QueryCoverage=100%, HitCoverage=18%, E-value=8e-42, Identity=73%"; Hit description=WNK1
MKTMYRAFDELVGIKVAWNQVKLGDVFHSPEQLQRLYSKVHLLKHLNHDSMMIFYGSLIDVNNITFNFVTELFTSDTLRECRQKYKRVDIRPVKNWTRQILSGLEYLHSHILP

SEQ ID NO: 156799 - protein, 144 aa, Glycine max
  Coding DNA Sequence Number=SeqID_65114
  Subcellular localization annotation: CTP_CleavageSite=43; ConfidenceScore=5.34e-01
MACLVKLSLSLFDLQVGIRASSPATIVAAAVRRRPSPPPPSVAAAAIRRCRRQIRRRVQGFVRLEERDTTPQTAWRDSPPRAALQQRLFPAREAHASTSGHRNRTGLVSKGAPSSLVFVPASGAVFTCYFVLPPLYSVRFFVFP

SEQ ID NO: 156800 - protein, 74 aa, Glycine max
  Coding DNA Sequence Number=SeqID_65115
MNEYEKSTKEPDTYNVEPQQQAYTATTPTPTDIEAAMDTLNITSPDPNWYMDTGATSHMMSTSGFSDRDASNEV

SEQ ID NO: 156801 - protein, 75 aa, Glycine max
  Coding DNA Sequence Number=SeqID_65116
MDTRLHVIGDPMNGIQRIPLNESDDNYCRGGGHNPLFEDSPSECGGGAATMRYGLISKGHSRNKIQAQGRVTHYH

SEQ ID NO: 156802 - protein, 140 aa, Glycine max
  Coding DNA Sequence Number=SeqID_65117
MVVALESKNKDHFLFGTLPCPPPTDPMHEAWRRCNCMLFKSGKISKIDFHILISFALMIFKIKSKIVPSNSGKGPKGNKLCTHCGKTNHTIETCFFKHGFLVGYRNHGKGGSSNFKSSASMAEVDFDITSQIVALEDSST

SEQ ID NO: 156803 - protein, 366 aa, Glycine max
  Coding DNA Sequence Number=SeqID_65118
  Gene Ontology: Mol. function=triacylglycerol lipase activity; Cellular component=chloroplast stroma; Biological process=lipid metabolic process
  Homolog annotation: Hit_ID=A7QDM5; Match level="QueryCoverage=91%, HitCoverage=84%, E-value=4e-93, Identity=53%"; Hit description =Chromosome chr10 scaffold_81, whole genome shotgun sequence
  Pfam annotation: Domain name=Lipase_3; Domain location=129-294; Score= 179.2; E_value=1e-50; Accession=PF01764.16; Description=Lipase (class 3)
MDSIARKWRDLSGQSNWQGLLDSLDIDLRRYILHYGQLAQATYDAFNSENGNCRYPMSDFFSKVGLENGNPFKYVVTKFLYATSQTSAPRACILNLFSKKEWNTRTNWIGYVAVATDEGKEALGRRDIVVTWRGTIQASEWVDNLNFDLDPAPEMFAVDSPFQVHDGFYSMYTSNNPEDVQFGLTSVRNQVQEEVKRLVEEYKNEEISITVTGHSLGAALATLSALDIVAQKWNISKDQQPSKACPVTAFLFASPRVGNSHFGKIFNEYKDKNLRALRIRNKKDNVPKVPFRLFPWGFTHVGEELVIDTRKSEFLKSDASSHSLEVYLHGIAGTKEKKSDGTWPIMDQIHDDVQAIHVETGLAQAA

SEQ ID NO: 156804 - protein, 292 aa, Glycine max
  Coding DNA Sequence Number=SeqID_65119
  Gene Ontology: Mol. function=nucleic acid binding
  Homolog annotation: Hit_ID=A5AFS9; Match level="QueryCoverage=83%, HitCoverage=78%, E-value=2e-59, Identity=52%"; Hit description =Putative uncharacterized protein
MKVMKKGKRPSHSGEKKKNKRNREQNPDVEIIVATQNGNVDSANGMHVREAKKEKTSINKKRKSKDKNLVRKRKPKGQEVDLDEQSDGVVDNPHSKAEEIQGLDGHIDSDSGAAIKPCRSKKDKKKRKEVQDSPEKEGEGCNQEEVYIISSVDDDCSKGMKKWIMEYHQSRPGLDVLQNQIDDFITAQEVKLEEERKEKEALAAEGGWTVVVHHKGRKKTTDSESGIAVGSVAQAAVENKMTKKKHKEVGQDFYRFQRREAQRNEIMTLQSKFEEDKKRLQQMRAARKFRPY

SEQ ID NO: 156805 - protein, 828 aa, Glycine max
  Coding DNA Sequence Number=SeqID_65120
  Gene Ontology: Mol. function=extracellular matrix structural constituent; Cellular component=proteinaceous extracellular matrix; Biological process=multicellular organismal development
  Homolog annotation: Hit_ID=A5BGM0; Match level="QueryCoverage=69%, HitCoverage=74%, E-value=3e-52, Identity=32%"; Hit description =Putative uncharacterized protein
MAEQNKESSASDPKEKKSSLDDEIGNEFLGSWKSMSMADDDAMDFSFDTVSKGKKKTFDFEKLDMNFNLDGEFDKISSFKLDMSDLDFTCPPKKNSQSKDKKGEVSGAKAGKQDGFNFSFDFNELDSFNLHSSFMKEDTTSNSSPKKKGVTTEGSDKGGKMPKTNDDEGAHASNDSTAVKSHASERLETLKVETMVGIPGNLVSKQDGSVSKISSSGNLDMPMENQTLDTNKHKSTEEIDQERDLPEKTKLTESKSEQVINMACSQSVGQSDSDQHTISDQHTNVFSSGTRVSNVSGDKQEVNDKTTYQCKKMFSSGTREINVSGDIQEVNDKATNMKSDSVDLQLVHSSPHHITKSDSSVGEPITLGSSTQEVTNDPQPEKRNTSCENINKTDALKKISCDNGNRENKNTTSVCHLAPANSKPVVEKMMLMKDKKLQDMQSNMFSTPEGKRSLKQPSSTVGTKGCSLGNKKNAEMLLGPITQARENFRSNDTRLGSKLVGDSLTYSSKLTRDAAALLGSKDNLISSRNTREGNVSDATTCSGKLAGNKKSFSDEVNKGKTTFLEIGMSTKDVSMSSSQVNPSCLTEKTARITTQVSANSQPEASGKESYQKSKIASIEGNKLSSFKNCKITPALSSLKTSRNFGANRVLTTLNQKETNSLVSSGQSMDIQGITASKNDHPIDSGDNQKPSTPFLKRKTTEASEADFQSLRPLKRISQSPISYIGTSGQVTILNCRNSKESSEEFVGEVESMPNNLLYNHSTSGLTSPPAIKVTEVEIPDSILMEDNSNVEKAEAYMKELEDHCIRYFEVSVSHERWEYESNKSQLYN

SEQ ID NO: 156806 - protein, 80 aa, Glycine max
  Coding DNA Sequence Number=SeqID_65121
MKTKFISTHDSRIACFTLTLNAQLLATASTKGTLIHIFKTNHGSFLRELRRDAKLRMLLTVLRSIVGKYYKRSSVDDARY

SEQ ID NO: 156807 - protein, 43 aa, Glycine max
  Coding DNA Sequence Number=SeqID_65122
MDEDQLTYYSVMSKEVDMDFQDEQDCGVNEGHVDCSDVFNTSQ

SEQ ID NO: 156808 - protein, 663 aa, Glycine max
  Coding DNA Sequence Number=SeqID_65123
  Gene Ontology: Mol. function=binding; Cellular component=spliceosome; Biological process=anti-apoptosis
  Homolog annotation: Hit_ID=A7P1V9; Match level="QueryCoverage=96%, HitCoverage=92%, E-value=1e-148, Identity=57%"; Hit description =Chromosome chr19 scaffold_4, whole genome shotgun sequence
  Pfam annotation: Domain name=API5; Domain location=10-659; Score =743.5; E_value=1.5e-220; Accession=PF05918.2; Description=Apoptosis inhibitory protein 5 (API5)
MSDPAEEAAFIEKLYEYGEQLNNAKDKSQNVQDYQGIIDAAKTSVKAKQLAAQLIPRFYKFFPDLSSPALDAHLDLVEAEELGPCGSGLCWFVRLKAKLIREVELKRVSEGYTGRKIVPFVEIKRDIGNWEVRVQAIRGLPLFCKDTPENIGKMVDILVQILGSEEFVERDAVHKALMSLLRQDVKDIVGVKGVFGNLFGALSLEVTTFQSPKPSLTALFKHIGSVEEPSTDDVIREKVINFVRDKVFPIKAELLKPQEEMERHITDLIKKSLEDVTGIEFRMFMDFLKSLSLFGEKAPAERMKELIGIIEGQADLDAQFNVSDADHIDRLISCLHMALPFVVLPGERKVDLLRSLAEFSPYTTPQDSRQMLPSIVQLLKKYMTWKKTGEEMNFTYVECLLYTFHHLAHKVPNATNSLCGYKIVTGQPSDRLGEDFSEHYNDFTESENEKTANARRRRRERSCQRKEPRSCEPVTKQELDDDGSGHAQSSNGLDLVQPPGCGWSRFPNYGLRLNNVEEFTRATIKKLTQGMDENNKSMAGAKTDEEKEKIKTKKQNATTGLRTCNNILTMTKPLHAKVPSFIGDKRINLSWKEATKAASTAPAAGAKRPANAANGSNNIASKKGRGAGGLQNQLVNRALEGLSGGGRGEEEEEGIGNFVADVM

SEQ ID NO: 156809 - protein, 87 aa, Glycine max
  Coding DNA Sequence Number=SeqID_65124
  Gene Ontology: Mol. function=oxidoreductase activity; Cellular component=extracellular region; Biological process=hydrogen peroxide catabolic process
  Homolog annotation: Hit_ID=A7QPN6; Match level="QueryCoverage=98%, HitCoverage=24%, E-value=1e-25, Identity=62%"; Hit description =Chromosome chr10 scaffold_138, whole genome shotgun sequence
MDPKLLHALRIYCPNFDGDSDIVAPFDATTQFLFDHAYYGNLLKKLGMLASDQALALEPRTKSIVQDLAKDKQKFIQAFVGAMDKLS

SEQ ID NO: 156810 - protein, 197 aa, Glycine max
  Coding DNA Sequence Number=SeqID_65125
MITYIYAIIRALSNPTKLTRSYRNINLEQAGITPFELIEYQATDCFDFDIQQHFLDLFLEKVGSLAIVGVPLVVDMNTTAIDGEGGSAREDEKQGYLRKGIKRSFEERTTSALSTDFEFKLGVSALREVVVPVVREFQSCKRLQIRVRKRSSESKSQKGFKIVVGQRTTKRGLKGERDHPTLSAYARGGLGSFLVDE

SEQ ID NO: 156811 - protein, 215 aa, Glycine max
  Coding DNA Sequence Number=SeqID_65126
MEIREVGKNMFTFCFLERRDKDQILRGYQWSFEWKLIVLNELEKEVNPKEGMMMMMTLSGYNMEHGWGIPNQSKYYCGQKTRSGLWEGTTKTCARECARESINSAKSRKDQAVKNRRGRNRRNIIRFGLGCGSILGRMQYGQKCTSQGERNTPTDSTEINPLKNLKNTSEQSEVQNLASQKQKVDECPTEQIISTPTKEFWQPDHPNSPENSRMG

SEQ ID NO: 156812 - protein, 100 aa, Glycine max
  Coding DNA Sequence Number=SeqID_65127
MKKGGEENEQQQHIQHQQLERAARCRYGGISVGGGNAFRRGTFERERKGTNRVLVWVLVEGELGVEGGKDGGGGRDREQRKRGGRRGIREGRVGKEKREK

SEQ ID NO: 156813 - protein, 497 aa, Glycine max
  Coding DNA Sequence Number=SeqID_65128
  Gene Ontology: Mol. function=GTPase activity; Cellular component =plasma membrane; Biological process=immune response
  Homolog annotation: Hit_ID=Q9FNL5; Match level="QueryCoverage=94%, HitCoverage=44%, E-value=1e-156, Identity=60%"; Hit description =Similarity to guanylate binding protein
  Pfam annotation: Domain name=GBP_C; Domain location=79-378; Score =122.0; E_value=1.8e-33; Accession=PF02841.5; Description=Guanylate -binding protein, C-terminal domain
  Pfam annotation: Domain name=TBPIP; Domain location=203-342; Score= -53.4; E_value=0.075; Accession=PF07106.4; Description=Tat binding protein 1(TBP-1)-interact
  Pfam module annotation: Pfam domain module=GBP_C::TBPIP; Domain location=79-378::203-342
MAGPITRPARLCHRIPIRDSIRALFPDRECFTLVRPLNNENDLQRLDQISMDKLRTGFREGLDALTKFVFERTRPKQVGATMMTGPVLVGITESYLKALNEGAVPTISSSWQSVEEAECHRAYDSATDVYMSSFDRSSPPEEVALREAHEQAKQKSMAAFNAIAIGVGSARKTYEALLLKFFKKAFEDYRKDAFMEADLQCSNAIQSMEKRLRAACNASDAKIDNVAKVLDALLSEYEKTIQGPGKWQKLAVFLQQSFEGPVLDLVKRLIATVESEKRSHALQCRSIEEKVDLLTKRLEATEGEKSNYIKRYEDAINDKKKLMDEYKNCITDLQANRRSLDERYSSLLKTLDSTKQESMDWKRKYEQVLSRQKAEEDQASSEIAALKSRSGAAEARLAAAKEQAQSAQEEAEEWKRKYDIARREAQSALQKAANVQERTNKQTQLREDALREEFSGTLAEKEDEIKEKTAKIEHAEKCLTTLNLELKWCRPCTWMEA

SEQ ID NO: 156814 - protein, 328 aa, Glycine max
  Coding DNA Sequence Number=SeqID_65129
  Gene Ontology: Mol. function=DNA binding; Cellular component=nucleus; Biological process=regulation of transcription
  Homolog annotation: Hit_ID=A7QPR4; Match level="QueryCoverage=98%, HitCoverage=96%, E-value=1e-125, Identity=71%"; Hit description =Chromosome chr10 scaffold_138, whole genome shotgun sequence
  Pfam annotation: Domain name=NAM; Domain location=70-211; Score =192.4; E_value=1.2e-54; Accession=PF02365.6; Description=No apical meristem (NAM) protein
KEMTWCNDSDEERGIDQLVAPTITPTSTNNTTVLTDHRTKASEIRTLTCPSCGQNIEFQDQTGINDLPGLPAGVKFDPNDQEILEHLEAKVLSDVPKLHPLIDEFIPTLEGENGICYTHPEKLPGVRKDGQIRHFFHRPSKAYTTGTRKRRKVHTDEEGSETRWHKTGKTRPVFVGGAVKGFKKILVLYTNYGRQKKPEKTNWVMHQYHLGTSEEEKDGELVVSKVFYQTQPRQCGNSIIKQDLYDEERLMTNQSVHNDDDNNIIPRNNNASALMDYYNPSFINYDQLGGRSNRENSPQLIPNLVMQGDSSSFIRLAMDATKAKMDRK

SEQ ID NO: 156815 - protein, 87 aa, Glycine max
  Coding DNA Sequence Number=SeqID_65130
MATPMSTACYMDKDKTGQSIDIKKYRVCCLRPVPKKLTWEFHYLANPLHFLKHTRTAIPLCSDALRQETLSLLALLLEREEGEDDLS

SEQ ID NO: 156816 - protein, 33 aa, Glycine max
  Coding DNA Sequence Number=SeqID_65131
MAQNRSAVADALNLFETMADIKHGTAFGRGSSR

SEQ ID NO: 156817 - protein, 153 aa, Glycine max
  Coding DNA Sequence Number=SeqID_65132
MGLKAEINQGKTITRPQFAVQYCFLLSVNIGCLIYPEGVRVSSPGRSTPARDGLKEGEGNVFFTQNSPPPPPHFQKTQSHETCCFCAPKPPLVSFCFHFCTFAHSLQGMAVGLFYILKCMGMLHCPRASFFHVQPCAHQVFGEMPQWHLRMIL

SEQ ID NO: 156818 - protein, 277 aa, Glycine max
  Coding DNA Sequence Number=SeqID_65133
  Homolog annotation: Hit_ID=Q11JC6; Match level="QueryCoverage=48%, HitCoverage=55%, E-value=2e-10, Identity=30%"; Hit description =Putative uncharacterized protein
  Subcellular localization annotation: CTP_CleavageSite=30; ConfidenceScore=5.09e-01
MALCISTDCKYMDAKCGDSYTPPARHPAPACAARQTRRAAAGCRVVRACRRAVDPTLPVRPLYLILKSVAQHVRLVSTQVVRVVRGADARVPSFPRDTGAPDRRGGAATGVVVAFFTRDSIYETEKNRLLRSAQRLGLAVDAEPIESTGSWVRNASMKPSVLVAMRRKHAGPMLYVDVDAVFHRDPWPALAAMDCDIAAYYEPQGHLLSGTLFINHTPAATALLQAWAQACAENPDEWDQLVLERLLDSDAARAEPRYRLARLPVAYCWIFDKTDNA

SEQ ID NO: 156819 - protein, 195 aa, Glycine max
  Coding DNA Sequence Number=SeqID_65134
  Gene Ontology: Mol. function=RNA binding; Cellular component =cytoplasm; Biological process=translation
  Homolog annotation: Hit_ID=Q5PFG2; Match level="QueryCoverage=81%, HitCoverage=99%, E-value=3e-82, Identity=92%"; Hit description=SsrA -binding protein
  Pfam annotation: Domain name=SmpB; Domain location=12-80; Score =147.4; E_value=3.9e-41; Accession=PF01668.9; Description=SmpB protein
MTKKKAHKPGSATIALNKRARHEYFIEDEYEAGLALQGWEVKSLRAGKANIGDSYVILKDGEAYLFGANFTPMAVASTHYVCDPTRTRKLLLNQRELDALYGRINREGYTVVALSLYWKNAWCKVKIGVAKGKKQHDKRTDVKDREWAVDKARIMKTPGGNPPSLRASSPGPTLYCCCRCFFTRYAARILASRGW

SEQ ID NO: 156820 - protein, 79 aa, Glycine max
  Coding DNA Sequence Number=SeqID_65135
  Subcellular localization annotation: CTP_CleavageSite=64; ConfidenceScore=5.26e-01
MSPPPLGISQSLKNSQMLKKGLPVCKGAVSTILALSSKGTTVSLSELHTHWAPAGVEELSSGLSSVAKPQLSHLAVWSR

SEQ ID NO: 156821 - protein, 99 aa, Glycine max
  Coding DNA Sequence Number=SeqID_65136
MVEEFEEILGCPLGGRGPYLFSGFYPSLARTSKIVQISAQELDHRKQVENGVVGLPRKYLEAKARILAAIDAFLAYHNHKESPIIAMLADIYGTFDRRC

SEQ ID NO: 156822 - protein, 29 aa, Glycine max
  Coding DNA Sequence Number=SeqID_65137
MALTAPLHDWQAGCTRVIPFWEHRLEDLS

SEQ ID NO: 156823 - protein, 180 aa, Glycine max
  Coding DNA Sequence Number=SeqID_65138
  Subcellular localization annotation: CTP_CleavageSite=42; ConfidenceScore=5.06e-01
MSFPAFSVLAHSVQKLSTKRSRRDATGERSSVAPEFDSHHFRSAEHQQRFEAIRGWSFHRERRVQLREEEYTDFQEEITRRCWTPLVTPMAKFDPEIVLEFYANAWPTKEGVRDMRSWMPSANSWVTPWFWRKASSVSLAIGGTGPTGSIRKPLPSCCAHRDRISPRLLQGGGCGSCAPA

SEQ ID NO: 156824 - protein, 108 aa, Glycine max
  Coding DNA Sequence Number=SeqID_65139
MRGADSVAPIRLTATSLQPVEWILPTPTPYRLVESVQVIEVSFSEEDLEEDPEELPPEPAMDALHLPEDDEDPLPDVDSPEDNMSASEAGFTEESGPGGTTISDDSSS

SEQ ID NO: 156825 - protein, 85 aa, Glycine max
  Coding DNA Sequence Number=SeqID_65140
MLVTHVWAIRQASAKDPGRSVNSDPHDHTQYPTYEHGQKLVPKTLEGQCKVPPTNIHNMHMPMHFQHQSTFNFHVILNINIISSQ

SEQ ID NO: 156826 - protein, 505 aa, Glycine max
  Coding DNA Sequence Number=SeqID_65141
  Gene Ontology: Mol. function=DNA-directed RNA polymerase activity; Cellular component=cytoplasm; Biological process=aerobic respiration
  Homolog annotation: Hit_ID=A9CJZ8; Match level="QueryCoverage=27%, HitCoverage=68%, E-value=5e-71, Identity=91%"; Hit description =Putative uncharacterized protein
  Pfam annotation: Domain name=Sua5_yciO_yrdC; Domain location=392-505; Score=0.4; E_value=1.2e-05; Accession=PF01300.9; Description=yrdC domain
RGSRDAAGIVERADLPVAATNDDNRIGADLHGEIAAGLLYLTIMADKQPVAIPDGFHIQLEVIRVRVEGLFQAKTFAAVFQLAQYGITQFHGQILDQTALPDTNCGGCGSMSSSNHRRSFAAAQTATSASALATNCDIHCPPIKKQGLQRNGVLTHPKLSYRIDSNEGVPGGEGDTHTLFRCEQAFGRISRYEERWLPKERVYYSHDEVAALTGRKLEAAADATHSRLNGFHQSIRFPKMVFHHLLNDRPHLGYCHVTAATTSFDAERHVLWSFYFANFFAELSGAENFFENIDARYSRMYFAVAINALPDQEIAVDTSDHQGDIAATKPPGTSSFFLRHVVVPKPTTSFGQCALALSILPGNTLLTALKGSIMARHIHIENERETALQAAVTELAAGQPIALPTETVYGLAADATNPAAIARIYETKGRPQFNPLICHMADIAMAERYAIFDPMSLDLAQAFWPGPLTLVLPLKPASDIHALATAGLDTVGIRVPQGFAGDLIR

SEQ ID NO: 156827 - protein, 265 aa, Glycine max
  Coding DNA Sequence Number=SeqID_65142
  Gene Ontology: Mol. function=mannonate dehydratase activity; Cellular component=membrane; Biological process=glucuronate catabolic process
  Homolog annotation: Hit_ID=A6EIC5; Match level="QueryCoverage=92%, HitCoverage=62%, E-value=6e-89, Identity=63%"; Hit description =Mannonate dehydratase
  Pfam annotation: Domain name=UxuA; Domain location=1-264; Score=93.3; E_value=3.1e-27; Accession=PF03786.4; Description=D-mannonate dehydratase (UxuA)
MEDGSKALYFDWIDLAYFDIHLLQREGAINDYSDPILKAVDKKKKSITAEERKVLSENILMGIPGEKNITLESLRKSIDVYKNIGTEGLRANLKHFLESIASVCRKEKIKMTIHPDDPPYPILGLPRILSHKEDFEYLLNTINDEFNGVCFCTGSLGAGIHNNIPEIFDLVKDRVNFIHLRNVKKDKIGNFYEADHLNGDVDMYHIMKAITTENQKRSIPIPFRPDHGHQMMDDMNKITNPGYSAIGRLRGLAELRGLEMGILGQ

SEQ ID NO: 156828 - protein, 152 aa, Glycine max
  Coding DNA Sequence Number=SeqID_65143
  Subcellular localization annotation: CTP_CleavageSite=69; ConfidenceScore=5.21e-01
MTIQNMQFQQETRASIQSLTNQMGQMATQLNQAQSQNSDKLLSQTVQNPKNVSAITLRSGKQIEVPSPVAAPAPEPVKLHSTADKEDELAAQKRKLPDHKGANKNFHASGPSSSSSNLQQPPIPLPFPPRAIPNIKMEEVDKEILETFRKVE

SEQ ID NO: 156829 - protein, 93 aa, Glycine max
  Coding DNA Sequence Number=SeqID_65144
MTHRRAKSSVGSSLSPTGNLVPLDLEILRGFHPLFNHIAPNGLLNYLRVWRSKGCKGADKHIAEIEICLEMRECRGLGAKLATQVPLPLRFKN

SEQ ID NO: 156830 - protein, 40 aa, Glycine max
  Coding DNA Sequence Number=SeqID_65145
MQEQIEEGKEHHVDEDALIPHNVAACRACRPWIFFINGVL

SEQ ID NO: 156831 - protein, 96 aa, Glycine max
  Coding DNA Sequence Number=SeqID_65146
MYHYPFEAHQSDTSASKHSLGGVAETHANFSWPTMTPSQQHDVPIETPNAPLDGSSQSISFLILVDFGRPFARIVLGSGISAHGSLEGGITASFLR

SEQ ID NO: 156832 - protein, 104 aa, Glycine max
  Coding DNA Sequence Number=SeqID_65147
GDRSCGGVHDPYSSPCSGWVKSCPGMHSSCAIASLSGYARTVGHPLISGGGPGTDKSKLLAPHPGASCPDMQSSCAIASLSGCARTVARLPISGGGPRTNKANY

SEQ ID NO: 156833 - protein, 143 aa, Glycine max
  Coding DNA Sequence Number=SeqID_65148
  Gene Ontology: Cellular component=chloroplast thylakoid membrane
  Homolog annotation: Hit_ID=A7QHR3; Match level="QueryCoverage=69%, HitCoverage=45%, E-value=7e-38, Identity=73%"; Hit description =Chromosome chr8 scaffold_99, whole genome shotgun sequence
IHRCKSKWQKTNESSENQWFWSLTDFYFIIPNKSNQILQSNTFLPKDASTAINSEGFVLLDIRPTWEREKARVAGSLHVPMFVEDTDNSPITLLKKWVHFGYIGLWTGQYLTTLNSEFLIQVENSIPTGKETKLLVACGGGLR

SEQ ID NO: 156834 - protein, 146 aa, Glycine max
  Coding DNA Sequence Number=SeqID_65149
MRLPGKESLLMKSSIAINEILDVSISFLNDHLEETLGSTKIEEIHSKCINLAQCGAKKSLAHGILVDNQREKTILGRGFLFFFCSFGDNSVLFRYHLVQGPLGTFLLGKDYGESGFWLKTCRMARHDTCQGLVWFKDKKGCPTLFP

SEQ ID NO: 156835 - protein, 127 aa, Glycine max
  Coding DNA Sequence Number=SeqID_65150
MSSWVLLLGFALVAGRISKEGQLSYPNFVRGPLFIGMQSSFDHLKMFNTHRGGIRKVPRCFGEEPDKNTKAGVNLSNMGGALRKLHPEHSRRWGELINYGVHSGIFHKKPLGGNHLHFVKKWHPGLP

SEQ ID NO: 156836 - protein, 354 aa, Glycine max
  Coding DNA Sequence Number=SeqID_65151
  Homolog annotation: Hit_ID=A7UQU7; Match level="QueryCoverage=56%, HitCoverage=45%, E-value=6e-11, Identity=40%"; Hit description=IMP dehydrogenase/GMP reductase, putative
  Pfam annotation: Domain name=DUF1723; Domain location=22-71; Score =60.2; E_value=7.1e-15; Accession=PF08330.1; Description=Protein of unknown function (DUF1723)
PEIEGMIAATGSSPLIRCSVITTDPGLISAFVERWHRETSTFHLLVGELTVTLDDVSSLLHLPITSALHAFEPLVTSDAVGLLTELLEVTPEEATAETRQATAALVHLYEHLNEASQTPTRQMAGYITLLQCWIYEHFLTVQQCVVDDAYVEASPRASRWLTGKAHMTGIKGAPYRARMEALIVTDVCWMPYAEHRGLRGFDLILSYTGQLNWAQIVIYTVPPPLVHDSLMNADIDDRWLHFSDNLMPAREICVVLGQVAPDYMDWFFWISHPFVTSTEDSAELRHPPTPHDEELIEPPILEVSVASDLFTHSVDLGAIAEDLERVINLGMVTKGTDLYDIMTRCLRRARGDAA

SEQ ID NO: 156837 - protein, 61 aa, Glycine max
  Coding DNA Sequence Number=SeqID_65152
MKGRRHKYGFNNNKREKAKKKRVVDDETGDKHQLDEVLRMPCGTLVVLYLISSVPLKKTYD

SEQ ID NO: 156838 - protein, 48 aa, Glycine max
  Coding DNA Sequence Number=SeqID_65153
SALFKSKPNSGFKPKLMQSYPARALDRKLQVDWARDAREGPRVLMSFR

SEQ ID NO: 156839 - protein, 208 aa, Glycine max
  Coding DNA Sequence Number=SeqID_65154
KKEKTSKRKQGECSQVALNHLDTWFTDESKKNDYKMIYVSKNMKGTFYLELVKVFYTFAHANLEDNLFSTVNRVDMVINATVWKEVVNLDMGGVRKFDETPDGMIAEDRMLVYLITYILTLRSSNHAYSRRLVDYKFPYIVLASRFIDYFNVDVSNEIVDFTKASSEITERHLKKLGMRFVDHEWIMVGELTVGNFDQMEDAEVEALQ

SEQ ID NO: 156840 - protein, 266 aa, Glycine max
  Coding DNA Sequence Number=SeqID_65155
  Homolog annotation: Hit_ID=A1FR74; Match level="QueryCoverage=90%, HitCoverage=33%, E-value=1e-118, Identity=90%"; Hit description =Putative uncharacterized protein
  Subcellular localization annotation: CTP_CleavageSite=26; ConfidenceScore=5.39e-01
MAPPIAACWPCSSTWPTTCACRPACRQSPAQAANSGTVRGEWTFTSLNWIPALFVRKPWLQLDGGGTLKADLRLRNGELSEGSTVDIPSAEAVAEVAGVRLAGAASAHGELKSGAPNLALLAVRLPRFTARPTDAKDVRLFDGRDLALDLTGDGRLQELRKGVRAHLSFSEATIPDLSVYNRYLGSKQVRLLRGTGSLSGDATLDTDGRVGHGTARLLGRNASAKVAGLDMGGDVDVNATLRRGDFNQRHFDLSGTTVELRNVQVA

SEQ ID NO: 156841 - protein, 66 aa, Glycine max
  Coding DNA Sequence Number=SeqID_65156
MLQARDHQLGIRNRPKGRSSQYGGAGRTQSCRDLILGRGPRAQARAEPEAQPLPSGRGEGSDSADP

SEQ ID NO: 156842 - protein, 96 aa, Glycine max
  Coding DNA Sequence Number=SeqID_65157
VDSRGSPVRQQAANHWAHVQTHDCLYQLSLSLQSQGFTSFPCTNPDQFRAEVAWPGDWPEARAGEAPSEAPDEADEAREDEEMTDLLDFLGGSGAT

SEQ ID NO: 156843 - protein, 129 aa, Glycine max
  Coding DNA Sequence Number=SeqID_65158
MSVWQRERSTCTKVIDSLLNWYDVHQLLFLILVSTLAKLIGQSTDEVKRLKIEDDDVDLNASPQALDRLLGCFLAFKVKVQPRFRNSVLKYLDESDLINVVLDMLPDSEPCCKIENSILESTDPTELES

SEQ ID NO: 156844 - protein, 308 aa, Glycine max
  Coding DNA Sequence Number=SeqID_65159
ARLHAGIRARPGRRRPAGRKPRRHHPGRRPAPGHVRLQGDRRSQVQQAAGSGIPALARQWLAAAGLLPPAVDQHLAQPDRSGAAGGRGRGSRRGVIFRNARGPAHAPTRAPTAPPASPVGAEFQHRAIGPLVAGRVGRRRTARVQQQARHGVRLADQRGRQARIVHVMPRPLAHIMRRGQPVRLALAHDDLGICGAGPEAVIRRAHQQDRARIAFNRNAGALERRGIAAGAQKRMGLPVRRVRGVGRFPIGAGVVLPQVRQGLAALAPDLRIASGARLARADHAVRHGRRHVGHQRAHQVGIVRRHQQ

SEQ ID NO: 156845 - protein, 206 aa, Glycine max
  Coding DNA Sequence Number=SeqID_65160
MDMNVRAFISGQITLMVQSNSSRLEFPALITALCMARGVTLDSLTFESLIPTINLAYIKKNCWNLDDPTVSFPGTRKARARESEGPSSAAPQTSTTPAPTPSALVAWPGVQPSSHGGGEASTAQEPQPDPETRPVAQKDDLEATPLESFVPETDPEADPMIAEASPQASPISKPVLELSTPHGSPVGTPVLHLTDDEAMDQDTPQD

SEQ ID NO: 156846 - protein, 287 aa, Glycine max
  Coding DNA Sequence Number=SeqID_65161
  Gene Ontology: Mol. function=4 iron, 4 sulfur cluster binding; Cellular component=integral to membrane; Biological process =tricarboxylic acid cycle
  Homolog annotation: Hit_ID=A5FII7; Match level="QueryCoverage=98%, HitCoverage=30%, E-value=1e-143, Identity=89%"; Hit description =Aconitase
  Pfam annotation: Domain name=Aconitase_2_N; Domain location=1-287; Score=216.7; E_value=5.4e-62; Accession=PF06434.4; Description =Aconitate hydratase 2 N-terminus
MKGGPSIEVLLDLALGNDISIAKEAANVLKTQVFLYDADTNRLKEAFNNGNEIAQEIVESYAKAEFFTKLPEIADEIKIVTYIAGEGDISTDLLSPGNQAHSRSDRELHGKCMITPQAQEEIKALQAQHPDKSVMLIAEKGTMGVGSSRMSGVNNVALWTGKQASPYVPFVNIAPIVGGTNGISPIFLTTVDVTGGIGIDLKNWVKKLDENGNPLRNENGEPILEEAYSVATGTVLTINIKEKKLYKGDQELIDISKALTPQKMEFIKAGGSYAIVFGKKLQTLGIL

SEQ ID NO: 156847 - protein, 528 aa, Glycine max
  Coding DNA Sequence Number=SeqID_65162
  Gene Ontology: Mol. function=polyphosphate kinase activity; Cellular component=polyphosphate kinase complex; Biological process =polyphosphate biosynthetic process
  Homolog annotation: Hit_ID=Q6D2D2; Match level="QueryCoverage=82%, HitCoverage=62%, E-value=4e-96, Identity=43%"; Hit description =Polyphosphate kinase
  Pfam annotation: Domain name=PP_kinase; Domain location=1-451; Score =157.5; E_value=3.7e-44; Accession=PF02503.8; Description =Polyphosphate kinase
MDLDNDIKTNFAEKIEKGLKNRRKGKPTRFVFDKDMDKALLELLIRKLNLTKKDSIIPGGKIHNFKHFMDFPDVFEAYARPVERTSFSHQAFEHGERVTDVIMKNDVLLTFPYHKYNPVIDLLREAAMDPDVKSIQITAYRLASSSKIINALIYAARNGKEVTVMLELQARFDEESNLEWKEMLEPEGITVLVGIPDKKVHAKLCVIKKRAHNKTIQYGFISTGNFNEKTARIYGDHLLMTADRGIMADINKVFNVLKKPKEDYLAVLKTCKSLMVCPQFMREKIVHHIDKEIEEAKAGRRAEIIVKANSVSDRALITKLYDAALAGVVIKTIVRGIYCAVNQKEFKEKIKGISIVDEYLEHARVMYFYNKGAEDMYISSADWMTRNLDYRIEAAVKITDKELKKELKDILDIQLRDNVKARILDKKLSNEYIAAIDIGSNAARLLINEVKDNGKHPEFIKLNLLRIPLRLGMDVFTRGEIGPEREKMVIDSMKIFSDLMKIYKVEHYRACATSAMRDAVNGKDIIEQ

SEQ ID NO: 156848 - protein, 184 aa, Glycine max
  Coding DNA Sequence Number=SeqID_65163
MEFTNHYLLDDCSFDNQYQGVLCLICHGGHHVETGVGPIQYCGKVENIVDAIRDKQRQVGGFSMDEADDESFADAADGNVVGDEENGNNERIKHVKAQFDGGDVDPKEFGIEFDQERPRPVATKARKWVRRSTTAHDPSPEKRKRIVPPPSPGTELLERGFDENAVEVSASGEKLCNEGKTREG

SEQ ID NO: 156849 - protein, 31 aa, Glycine max
  Coding DNA Sequence Number=SeqID_65164
MAVLTLQLRATSTSPLLTMSSEHKCNKISRP

SEQ ID NO: 156850 - protein, 83 aa, Glycine max
  Coding DNA Sequence Number=SeqID_65165
  Homolog annotation: Hit_ID=A5AZ88; Match level="QueryCoverage=78%, HitCoverage=6%, E-value=8e-08, Identity=35%"; Hit description =Putative uncharacterized protein
MDIEEDYDIPLILGRSFMSTASYMVDMGKKMLQMGIEDQKISFDLFHEDKDPLDQNVCLKVHVMDERRPEKKVLEVGTLLEPG

SEQ ID NO: 156851 - protein, 328 aa, Glycine max
  Coding DNA Sequence Number=SeqID_65166
MIIEEGETLSAYSRFSLLRHDPQELVAKLCIPGRGFELNADGQPLKILRKNMTTLAHIWSVLSYSNLVPTSHTFGITLDRAKLIYGIIMKMNMNLGYLISHQISIIAQHDSSRLGFPALITTLCKARGVTSDSRSLESLSPAINLAYIKKNCWNLDDPIVTFRGPRKARDPSAPSTSTPYLPQFLVQLPASSAPASDFLFTLEMLHAIMQSLHRGQVAWPGVQPSPSGRGGTSAAQEPECTEDQTPAVEDELTPPEPFSFVSNSVVAQEEVHSSELILEPSPAPISEDTLPSAPILEQEQPSSQDLPAALVLDLNEHAEDQQQDDQEF

SEQ ID NO: 156852 - protein, 203 aa, Glycine max
  Coding DNA Sequence Number=SeqID_65167
  Gene Ontology: Mol. function=phosphoprotein phosphatase activity
  Homolog annotation: Hit_ID=A7Q685; Match level="QueryCoverage=67%, HitCoverage=41%, E-value=5e-17, Identity=35%"; Hit description =Chromosome undetermined scaffold_55, whole genome shotgun sequence
MCRATDPDAKTMGDCVSLLQSWAWYRMSFIVVRVNRTPSYPLVMRWSGGGLSFIGTPHGDVIDYRMRLDHMTTEHSIAFVESFIWTTYTPLICFLIVEWHQEDRVKLQFRLRQDIPDPPRNMDKLHKIDMRGLTDTNWDEKTCKMDKGQPIIRHAKHPQEYMACQDVEENNPSLHDIADQRPHQNPGRNRRRPPCGTEHHYGN

SEQ ID NO: 156853 - protein, 188 aa, Glycine max
  Coding DNA Sequence Number=SeqID_65168
  Gene Ontology: Mol. function=chitin binding; Cellular component =extracellular region; Biological process=chitin metabolic process
  Homolog annotation: Hit_ID=UPI000066154C; Match level="QueryCoverage =79%, HitCoverage=97%, E-value=1e-20, Identity=40%"; Hit description =Homolog of Homo sapiens "Keratin-associated protein 10-1
  Subcellular localization annotation: CTP_CleavageSite=62; ConfidenceScore=5.70e-01
MCSPLKARACSPLKVRTCSPLKVRACSPLMARTCSPVQVRTCNPLKATMSSPLKAREFSPLKARMCSPLKARTCSPLKVRVCSPLKVRAWSPLKVKACSPLKVRTCSPLKARACSPLKARTCSPLKVRTCSPLKARTCSPLKARACSPLKVRIDCPFERGDNSCNLILSFANLSGNSLRVYDQFDLNT

SEQ ID NO: 156854 - protein, 185 aa, Glycine max
  Coding DNA Sequence Number=SeqID_65169
  Gene Ontology: Mol. function=ATP-dependent helicase activity; Cellular component=intracellular; Biological process=RNA processing
  Homolog annotation: Hit_ID=Q2HTA7; Match level="QueryCoverage=38%, HitCoverage=3%, E-value=2e-30, Identity=92%"; Hit description =Helicase, C-terminal; Argonaute and Dicer protein, PAZ; Ribonuclease III, bacterial
  Pfam annotation: Domain name=Urease_gamma; Domain location=29-119; Score=-39.6; E_value=0.0038; Accession=PF00547.9; Description=Urease, gamma subunit
MSSNVIVGYNNTDLVLSLVKIVFPDKLRLEKLDLHNAGYLAQKRLACGLRLNYVETVAQKLDLFILRHKYYACLWTFQIGTMFGCDKYNIKPDLVSLAKALSSAYLPIGAVLVLVMTPQILLNILRHSIIKMEAINLLILDECLHAMKKHPYSLVMSEFYHTTPKENKPSVFGMTASPVNLKGSY

SEQ ID NO: 156855 - protein, 79 aa, Glycine max
  Coding DNA Sequence Number=SeqID_65170
MGGNKRNRRREKWIKGLAHERRLSDKVGSHCPWTIMDSKLEVWNMSVLNCSLLFRGCNWWQVKWFGNCGALNATSKDWT

SEQ ID NO: 156856 - protein, 95 aa, Glycine max
  Coding DNA Sequence Number=SeqID_65171
MLSQGVVIYGGAGAGAGAEVEAGAEVEASEGPRALVLQVPRKVIVGSFGFQQFFRIYAKLMAGLKDSKVRELGTAPLAMYNAVIKAGNPSREELD

SEQ ID NO: 156857 - protein, 49 aa, Glycine max
  Coding DNA Sequence Number=SeqID_65172
MAGTFFLLKQQNSLEIMSEIGINQHMLWHHLVGATKIVYGKTWCLAKPL

SEQ ID NO: 156858 - protein, 131 aa, Glycine max
  Coding DNA Sequence Number=SeqID_65173
  Gene Ontology: Mol. function=nucleoside-triphosphatase activity; Cellular component=protein complex; Biological process=protein catabolic process
  Homolog annotation: Hit_ID=P46466; Match level="QueryCoverage=78%, HitCoverage=44%, E-value=2e-18, Identity=66%"; Hit description=26S protease regulatory subunit 4 homolog
  Pfam annotation: Domain name=AAA; Domain location=4-131; Score=-28.2; E_value=0.0059; Accession=PF00004.20; Description=ATPase family associated with various cellular activities (AAA)
MVLYQVLSVVGLLQDEVDPLMVSVMKVEKAPLESYVDIGGLDAQILEIKEAVELPLTKRTMMELLNQLDGFDSRGDVKVILATNRIESLDPTLLRPGRIDRKIELVLLGRATESVPVDIDLGKGGHGNAIS

SEQ ID NO: 156859 - protein, 67 aa, Glycine max
  Coding DNA Sequence Number=SeqID_65174
MRLFLLDIFFLLRAPQLLLQEDYSRRKEGQIKYTHAHVEARDLCSGNCPSPPLNTCFHIPVTSPAKL

SEQ ID NO: 156860 - protein, 877 aa, Glycine max
  Coding DNA Sequence Number=SeqID_65175
  Gene Ontology: Mol. function=protein binding; Cellular component =cytoplasm; Biological process=protein metabolic process
  Homolog annotation: Hit_ID=A5BAL3; Match level="QueryCoverage=100%, HitCoverage=78%, E-value=1e-167, Identity=40%"; Hit description =Putative uncharacterized protein
  Pfam annotation: Domain name=AAA_2; Domain location=505-658; Score= -30.7; E_value=0.0024; Accession=PF07724.5; Description=ATPase family associated with various c
MGVYAKTALRSFVEVVKKNGKGGVLPCELNGLSVVSVEKEIGEFLREGGRGEMIFEHVGHLVEHGGGGVVVCYGEIEVFVGGYKEEGSVGFVVSQLTRLLGVHGGGKVWLLGVAGTSEDYSKFLRLFPTVDKDWDLHLLTMTSATPSIEKLYPKSSLMGSFVPFGGFFSTPSEFKNPVSCTNASSSSLLTRCDTCNESCEQEVADILKVGPAATSTSVYSSTSLPRLQKVNVDSDRGLDVAKNELHHPVQTNEENTSLNIKIFGLQRKWSDICQRLHQNRSLPEFDITKTRFQAPSHEGFQFGPGSSSRGPLHSEIQYSDHISYMSKESQSAFPFKQILPVSVPFDTVSITDEADQIPKVSKTDMHGTWVSPSPKANISLLDPTTFSSVTPVTTDLGLGTIYTSAAHEPDTPKLSDHKKPLHHLSDSLSTDFDAMNENTSHQIARSSSCSGPNLEGRFETVDFKSLYHLLTEKVGWQDEAIYAINRTVSRCRSGAGKLSSGSHVRADIWLAFLGPDRLGKRKIASALAEILFGNKQSLITVDLSSQDRCYPSYSIFEFQNSYCHDVLMRKTVLDYIAGELSKKPHSVVFLENVDQADFLVQNSLFHAIKTGKFPYSHGREISINNAMFIVTSSVFKSSGSFNLEEDPKMFPEERILEAKRCQMQLSLGHASEGAKRSGCTNVKVAERKGKSKTTFLSKRKLIESGDLKDKAPCKTLKPVREASRSYLDLNMPLEEVEEGNNYNDDESESIVENSGAWLNDLCDQVDEKVVFKPFNFDSIAEQVIKSIDTQFQKMLGSEFILEIEYEVMTQILAAAWLSDKKKSLEDWVEHVLGRSFGEAHQKYHFAPEFVMKLVNCERFFLEEQSPGVCLPARINLN

SEQ ID NO: 156861 - protein, 44 aa, Glycine max
  Coding DNA Sequence Number=SeqID_65176
MKKKFQAKEEKVQVADDLLSEADPLIECHPLSEAYNSFSGLGNP

SEQ ID NO: 156862 - protein, 90 aa, Glycine max
  Coding DNA Sequence Number=SeqID_65177
MDEPFIMAKQARQVFYVQDPYDSRFSVVLQGRPTGINHVVDDSTLDICEAPAFSNRMPSLNESHNVDDVMGTPPRSPLRLCLGKVDNPPG

SEQ ID NO: 156863 - protein, 219 aa, Glycine max
  Coding DNA Sequence Number=SeqID_65178
MLQLGEDRAPKKRSSIAIWGIVVREKIPIVHSNWKDVLESLKDLVLDDILVKFDIPKASNAKKKIHKLGRNLMQPAKPLIGRESGKRHRKLKNTMTAPPPHFLCRGGYDLREKKLLDEKIKKRQQKVIMTENTPEIHDPHLPLKDISWRSCSCSEVWCETINQYYGKASHGSSSSSTSITQQQLAEIIGSLKEEWRNEIKEEIRNEIGEENKWNLEKLK

SEQ ID NO: 156864 - protein, 365 aa, Glycine max
  Coding DNA Sequence Number=SeqID_65179
  Homolog annotation: Hit_ID=Q2HSY3; Match level="QueryCoverage=42%, HitCoverage=70%, E-value=7e-10, Identity=28%"; Hit description =Nucleic acid-binding, OB-fold, subgroup
  Pfam annotation: Domain name=DUF223; Domain location=78-179; Score= -14.4; E_value=0.066; Accession=PF02721.5; Description=Domain of unknown function DUF223
MEFCSLIIRCTKVVELWLFNKLTSIGSFYKCQINNLTLLSLFCRLKSIAEIDDQKETCKIIVRVINMWTIPRSPKSIVELILVDKKGDKILAQMRNVDVQLDNVIFDVGHTYVIKNFEVEKNSGHYKATRHGFKINFVKTTKVTPHKILEIPKTMYNFTMFDDISLALEFKDCFDRHVSGPVMLLLNLAKIKEARGCCFIECMCVTVATLSKLLVANGWIYDGCPKCNKKDDGEGSSLFCVECGNKSASTVAKFCVDVRVGQPNEYAIFTLWDRECYALIKETADEIKQKMINEDEASPCVSMMHDINDVGDTTTESDPTLLESITPAKRILPLLQSQLDGIPFEDLSSIQLSSARLDKKHIKTE

SEQ ID NO: 156865 - protein, 48 aa, Glycine max
  Coding DNA Sequence Number=SeqID_65180
MAEQKYRNSYDSSYKAPNEVIPKRGTRLKMKWWKKRITLSSEGNTQRM

SEQ ID NO: 156866 - protein, 160 aa, Glycine max
  Coding DNA Sequence Number=SeqID_65181
MAFLGETSSQTIVNSRLAFIFPNGTVIHNECGVYFQSSSPVPMRVPNLCDFSTLKSRIHISLLLNNNQVVDEFHYRRPVEDTADAILNLLERPNIPTHDVVLYYNGRWNMPRQNNFVGYAFTGTNPKKFDIPKGCSIDQLKDLPLPVPTARRRPRVLTMI

SEQ ID NO: 156867 - protein, 333 aa, Glycine max
  Coding DNA Sequence Number=SeqID_65182
  Homolog annotation: Hit_ID=Q2HVW1; Match level="QueryCoverage=39%, HitCoverage=55%, E-value=8e-08, Identity=27%"; Hit description =Putative uncharacterized protein
MNVNIPKFERPQVAFSKDEGGTSYRAKEREPTTLYEMEGDTGKANHEHKERQLITQSFVEVMKGQINTKMKTWKPRCGKQALEEEKKWWEMELNIQRNVYVNENAGKIKFNYLGDDMVLISGCTKEWFSENTKQEGLLSIFHSIQKWEASITFGNRLTWVRCTGVPLDVWGEECFAAIAGQFGTLVKLDPLTMDMVNLSYAKMLAKLSSPLHVTFSENIKINGTAHLVRVVEEVLSLATTCKNIISSDSESETESIGGVSDEANEEMYGDHGTRGVSHRGGRREDRSTMMSKNSKCPEGVATHGINVLHTSTFKDDMLYKEVECHEGMSNMLA

SEQ ID NO: 156868 - protein, 238 aa, Glycine max
  Coding DNA Sequence Number=SeqID_65183
  Homolog annotation: Hit_ID=A7P771; Match level="QueryCoverage=86%, HitCoverage=27%, E-value=1e-55, Identity=59%"; Hit description =Chromosome chr9 scaffold_7, whole genome shotgun sequence
MVGPNFMDEIDCGSFFDHIDDLLDFPVKDVDGGAATLPSVAANIVKELSDFILKRLDHKSPIVKHKTLRLIKYAVGKCGVEFRREMQRHSVAIRQLLHYKGQSDPVKGDAFNKAMRDTAQEAISAIFSADDTNKQPLPAPAAAAGLNRRIEGFGNTNFQAPSQDNKKSFLGEVVDIGNATTKQGLSAFTQGHSSLIKNEAGTGTYKGPNNLPASFMTATESGDRDYRSETLENRIKNT

SEQ ID NO: 156869 - protein, 417 aa, Glycine max
  Coding DNA Sequence Number=SeqID_65184
  Homolog annotation: Hit_ID=A7NYF6; Match level="QueryCoverage=76%, HitCoverage=54%, E-value=5e-24, Identity=31%"; Hit description =Chromosome chr6 scaffold_3, whole genome shotgun sequence
MKNPRKKKRPKPQKKLEKNKGVVAAAAVVAENENENEEEKRKRSILEALVEAFSLSSVREASMAYNIAGGDPDRASEILRKGFSDRSEDSFSCFSYGSSSSSSSSSGLELGSKGGWRQQQQQKKMVASTGTVSTVLGKEYVRRNNNNIRNKGLSSNGVFEMEEAEQFLCSMLGDDSDINLAVVSVEMILKGYDDNLRLYFSYLSMIFQASDILLDLAASTNEKPNTARHPNYGVDNIDDERFFADPNDSIFEVFLTSSSVSILYSTNCQILSQLIDRRLECTSLSWEGYLSNNPWSVGSFGRKYAEVLNNSKANSAVSPGCTKSEIPQKVLESLFNIPKSTEHDKNTMNWRNVVKKIQSLGPGFYVSPHVAESQQRTCGGLGLATLGNLSQSEEDSSCIFGKITSAILVEFTRKGWI

SEQ ID NO: 156870 - protein, 219 aa, Glycine max
  Coding DNA Sequence Number=SeqID_65185
  Subcellular localization annotation: CTP_CleavageSite=36; ConfidenceScore=5.13e-01
MDDMVLSNNEFMKSIVDNVKRDVCHSTKTTSKHVVTNSTKTTSNHLVKNLKATPSPLEQDFSQQNSEGIETIFIYSENEDNTSKRVLGLKGKYVHLKTCTNVGGSSSKRKKVVEDVVQTVDVKLIAEEAQACAYLLNDSLDLRDNEIADAIEGFPVHDICLHYDKDYLNSFDNLNLICIPILENKEHWYLMFITTEERKVYHLDSYLTNNVNEERERLI

SEQ ID NO: 156871 - protein, 168 aa, Glycine max
  Coding DNA Sequence Number=SeqID_65186
  Gene Ontology: Cellular component=intracellular
  Homolog annotation: Hit_ID=A7QII4; Match level="QueryCoverage=77%, HitCoverage=96%, E-value=1e-61, Identity=83%"; Hit description =Chromosome chr12 scaffold_103, whole genome shotgun sequence
  Pfam annotation: Domain name=CS; Domain location=19-93; Score=94.0; E_ value=4.6e-25; Accession=PF04969.7; Description=CS domain
MAEKLAPEKRHSFVHNGQKVFEWDQTLDEVNIYIALPPNVHSKQFYCKIQSKHLELGIKGNPPYLNHDLTSPVKTDSSFWTLEDDIMHITLQKRDKGQTWASPISGQGQLDPYATDLEQKRLMLQRFQEEVSFAFIRILFRLLGFGMHLQPHDMSNMCLSASLVVMFY

SEQ ID NO: 156872 - protein, 90 aa, Glycine max
  Coding DNA Sequence Number=SeqID_65187
  Gene Ontology: Mol. function=nucleoside-triphosphatase activity; Cellular component=integral to membrane; Biological process=transport
  Homolog annotation: Hit_ID=A7NYG1; Match level="QueryCoverage=94%, HitCoverage=13%, E-value=2e-14, Identity=48%"; Hit description =Chromosome chr6 scaffold_3, whole genome shotgun sequence
MAITGFSFDMASERELFARASNAEWVEQDEEELQMVALLRLSMQKHVNTTLIDVRKLNRFHRERVVKDALATNEQDNYKLLSAIKEHFDK

SEQ ID NO: 156873 - protein, 388 aa, Glycine max
  Coding DNA Sequence Number=SeqID_65188
  Homolog annotation: Hit_ID=A7NYC2; Match level="QueryCoverage=99%, HitCoverage=90%, E-value=1e-100, Identity=51%"; Hit description =Chromosome chr6 scaffold_3, whole genome shotgun sequence
MSLENDSEITHLKKNLKVQMERNVSLEKENKDLRQEVARLKSQIMSLKAHNIERKSMLWKKIQKSMDGNNSDTLQHKAAVKVIMLEKSPPNERVHTNSDLQETPIVKDRSVKVPPPAPSSNPLLPSQKTEKGMKVQPLALPRTAPPPPPTPPKSLVGLKSVRRVPEVIELYRSLTRKDANNDNKISTNGTPAAAFTRNMIEEIENRSTFLSAVESAAYADISEVEAFVKWLDGELSSLVDERSVLKHFPHWPEQKTDALREASCNYRNLKSLESEVSSFENNPKEPLAQALKKMQALQDRRACAKLECSRSVNSAEKTRESASKRYRSFHIPWEWMLDTGLIGQMKLSSLKLAREFMKRVTKELESNEVSKEDNLLVQGVRFAFRVHQ

SEQ ID NO: 156874 - protein, 445 aa, Glycine max
  Coding DNA Sequence Number=SeqID_65189
  Gene Ontology: Mol. function=fructose-2,6-bisphosphate 2-phosphatase activity; Cellular component=6-phosphofructo-2-kinase/fructose-2,6 -biphosphatase 1 complex; Biological process=fructose 2,6 -bisphosphate metabolic process
  Homolog annotation: Hit_ID=A9PEZ0; Match level="QueryCoverage=97%, HitCoverage=48%, E-value=1e-143, Identity=64%"; Hit description =Putative uncharacterized protein
  Pfam annotation: Domain name=6PF2K; Domain location=1-195; Score =150.5; E_value=4.7e-42; Accession=PF01591.9; Description=6 -phosphofructo-2-kinase
  Pfam annotation: Domain name=PGAM; Domain location=249-404; Score =63.2; E_value=8.5e-16; Accession=PF00300.13; Description =Phosphoglycerate mutase family
  Pfam module annotation: Pfam domain module=6PF2K::PGAM; Domain location=1-195::249-404
MVEKNRHWHKIASKQSADFFRADNPEGVEARNEFNCESVTIDRVKSIACTLGHKVAALAFEDMISWMQEGGQVGIFDATNSSKERRNMLMKLAEGRCKIIFLETICNDRNIIERNIRLKIQQSPDYAEEPDFETGLQDFKNRLENYEKASLQRVYETVNEGSYIKMIDMVSGHGGQIQVNNISGYLPGRIVFFLPLCICKGKAAYNIPPPYLRIAKSLWAMGYEVFFFNRVGLGFLDQIKVNTHLTPRPILLTRHGESQDNVRGRRIGGDTAISIMAQLVSEGRQSEAGELYSKKLAKFVGKRIKSERAASIWTSTLQRTILTATPIVGFPKLNATNMADKKKHNVKLLLVLGSCKKDKLRYRYPRGESYLDVIQRLEPVIIELKRQRAPVVVISHQVAVLRALYAYFADRPLNEIPHIAVPLHTIIEIQMGVTGVQEKRYKLMD

SEQ ID NO: 156875 - protein, 211 aa, Glycine max
  Coding DNA Sequence Number=SeqID_65190
MGANTMVEKSVIVANHDLKGLNGCGGKSGKCVTQAWESTTKGSGKLIEESVAEGDNDSSDLSYAINKSRHLTENLGNAGNGGELVVVNNARGADGEGIENRLVVKLVFLDVTIKRSLSSTPWESKNCVILKIHPSGSLPSNRGTPNFISGRGGREGVSNGGEEHLRVGGVMGVLSLGKSKDNFLKVFCGCLPGVVLRHTDNVEVLVGKVKS

SEQ ID NO: 156876 - protein, 93 aa, Glycine max
  Coding DNA Sequence Number=SeqID_65191
  Subcellular localization annotation: CTP_CleavageSite=44; ConfidenceScore=5.46e-01
MATQMNPAQSQNSDKLPSQAVQNPKNVSAITLRSGNQIQVPPPVAAPAPEPVKLHSTHEKEPPIPLPFPPKAIPNRKNGRSRKGDLGDFQESR

SEQ ID NO: 156877 - protein, 177 aa, Glycine max
  Coding DNA Sequence Number=SeqID_65192
MGEIEELQERIKADMEAMKEQMATMMEAMMSMKKIMEVNAAAVVATSTVAKVDLVPPSRLNQINHPTSNMNKHAFLPYGLPPKYTPPNVAHTPDENVNNSTPILIESQQPQSDHAYEVPHHNLADFEPYLEYATEGQVVGGVPLPNTLKGPLISPTTITLAFCSGESPSCYGGKGKI

SEQ ID NO: 156878 - protein, 114 aa, Glycine max
  Coding DNA Sequence Number=SeqID_65193
MTGRSRSTLVYSNPSSGASRTWYMQYTAPLAPELVVCIKFLEPGHIYVPIHLPGQGFMPILPLKFLAKLIVLRDVKNNIPLWKNVPGVNVLIISLLGAHRYESGSVIGLPGSGG

SEQ ID NO: 156879 - protein, 71 aa, Glycine max
  Coding DNA Sequence Number=SeqID_65194
MIPLENSRGQRENTLLYHPPEPAVDALDFLEGDEDPLLEVDSPEEVMSASEADSTEDGGPGEMAISGGSSS

SEQ ID NO: 156880 - protein, 101 aa, Glycine max
  Coding DNA Sequence Number=SeqID_65195
DAGSRQARQGASAGVAGCRGWLNYAASEQIVLRVHHMRAIGAGLFAITPAGERGMCCKAIKLGNARVFPVTTFCWAKLSSWAKRIITTKRSFNALSAKENL

SEQ ID NO: 156881 - protein, 75 aa, Glycine max
  Coding DNA Sequence Number=SeqID_65196
MSVKNLVGRLGVHDKTNHSLASQVTLDNIIGRPVRVTMFCENPPTIWDQHRPKGALKSGDPHGLHSEESVGASPS

SEQ ID NO: 156882 - protein, 61 aa, Glycine max
  Coding DNA Sequence Number=SeqID_65197
MDSGRFQVSVPGDSYPSKTFLEEIWFLGQVVPLYLSKSGTLNLGGVTILGTRNNSSRLAKA

SEQ ID NO: 156883 - protein, 186 aa, Glycine max
  Coding DNA Sequence Number=SeqID_65198
MASHKRKAIASMSQASYDRSRFISQKTWDHYSDNVLARNILLERNGSIDVAIEKEFYANLYMPEDKSPKQVRVQGHLIKFDVDSLNTFLESPVVVEQGGFVLNAEGLPWKLLWKDLTTLAQTWSVLSYSNLAPTSHTSDLNLDRAKLVYELVMKMNMNLGSLISGQISLIAQSNSSLLGFPALITA

SEQ ID NO: 156884 - protein, 182 aa, Glycine max
  Coding DNA Sequence Number=SeqID_65199
MAPRKLASKRSRKDKAAEGTSSAPEYDSHRFRSVVHPAALRSHQGMEEIGRRRWAPLVTPMAKFDPEIVLEFYANAWPTEEGVRDMRSWVRGQWIPFDADAISQLLGYPMVLEEGQECEYGQRRNRSDGFDEEAIAQLLMYTGAGFCPDRCREASANHAHQYDHPDPDMDDVAPQQHPAHRS

SEQ ID NO: 156885 - protein, 38 aa, Glycine max
  Coding DNA Sequence Number=SeqID_65200
NLPQEVMQSYPARALVRRLQVDWARDPRKGPRVLMSLR

SEQ ID NO: 156886 - protein, 140 aa, Glycine max
  Coding DNA Sequence Number=SeqID_65201
MLEDEQAKVSALRVEREAREGVIELLHKEAMKWMERFALTLNESQELPRLLARAKAVADTHRRRQNVIIVIKKKECALRHPYRTRSKARIMSEMEEVQEQMKADMEAMKDQMTTMMEAMMSMRKMIKVKMDAIVATSTAT

SEQ ID NO: 156887 - protein, 28 aa, Glycine max
  Coding DNA Sequence Number=SeqID_65202
MAGRNDHAIADALQALAHAIGNPNRGEA

SEQ ID NO: 156888 - protein, 151 aa, Glycine max
  Coding DNA Sequence Number=SeqID_65203
  Subcellular localization annotation: CTP_CleavageSite=47; ConfidenceScore=5.48e-01
FIDPTTLQPTPYSTGSVRTSNAWVNLNSKNPGPNHSQPGVMLTNSTSQGMGKLTNKILLKGVVGVDEIYSFHNLKLQKSHSLLMSTVSSVASPNSTLTINSNSSTVMSDSVSSSLSIANLWHARYTWIYPIKSKAETMLVFQTFESMVDYN

SEQ ID NO: 156889 - protein, 229 aa, Glycine max
  Coding DNA Sequence Number=SeqID_65204
MPTDIREIEAALCILGRRFVLNAEGHPGKILKKDLTTHAQVWSVLSYSNLALTSHTSDLTLDRARLIFGLVSQLDMNEGALISGQITSMAQSNSSRLRFLALITALCRSRGVASDSLVLEHLSTVINLAYIRKNCWNPADLKTFNILKPCFKAYIRAWPGTQPPLHKEDEGLTAQVPQQRENESSETSTPEPLIRRKRVVETQEVAAILEKSLEATSEPSEPVADTASF

SEQ ID NO: 156890 - protein, 304 aa, Glycine max
  Coding DNA Sequence Number=SeqID_65205
  Homolog annotation: Hit_ID=A3XJ28; Match level="QueryCoverage=60%, HitCoverage=65%, E-value=2e-25, Identity=36%"; Hit description =Putative uncharacterized protein
  Pfam annotation: Domain name=Porph_ging; Domain location=126-178; Score=66.3; E_value=1e-16; Accession=PF09697.1; Description=Protein of unknown function (Porph_ging
MDKFSAAKLVILTTRYIYETAVNPDSINLVGLKTERTFLDIKGSQSLFISEHKLVRDSLVSNFKRDERINNKKEGKDFSKLGIGKSGEQSFFDYYILKDIPDQKVYYYDRVGGKQIYYQEDRPIQWHVTNDVEKQNGYSSQKATASFAGRTWTAWFTKDINVSDGPYKFSGLPGLIVKLEDDKGDYKFDLIKKVVVKNSFEEPMDADARKSSRVNFHGDKAALELELSKNKRSINGGNNGGMQGFEAGRHQGGMNGGGRDGMRGGGMRRGGTGMNGGNSDLPAQSFGSGNTSFNTGSQNPIELQ

SEQ ID NO: 156891 - protein, 77 aa, Glycine max
  Coding DNA Sequence Number=SeqID_65206
MPHLLAKKVRNQPYMGTELEFVIMVIAVSFGKPVVPAALMNRPTRGERRSLKGGNTVIHRIRDTQKEHVSKRPAKAR

SEQ ID NO: 156892 - protein, 76 aa, Glycine max
  Coding DNA Sequence Number=SeqID_65207
LSRVQVIEVSSSEEYLEEDPEELPPEPAMDTLDLPEDDEDPLPDVDSPEDIVSAFEADSTEESGLGGTTNSDDSSS

SEQ ID NO: 156893 - protein, 94 aa, Glycine max
  Coding DNA Sequence Number=SeqID_65208
MGLGQNSDGVASLVEFKENRRRFRLGYRPMHTDVRRSTLERKGRSVGQRQGLQVKETPPCHISESFVSAGWRCEGRVIEVVPESNKHENAVTRK

SEQ ID NO: 156894 - protein, 549 aa, Glycine max
  Coding DNA Sequence Number=SeqID_65209
  Gene Ontology: Mol. function=endopeptidase inhibitor activity; Cellular component=plasma membrane; Biological process=metabolic process
  Homolog annotation: Hit_ID=A8GHX1; Match level="QueryCoverage=93%, HitCoverage=45%, E-value=1e-146, Identity=61%"; Hit description =Alpha-2-macroglobulin domain protein
  Pfam annotation: Domain name=A2M_N; Domain location=2-297; Score =96.5; E_value=8.3e-26; Accession=PF01835.10; Description=Alpha-2 -macroglobulin family N-terminal region
LLTALSLSGCDNSGEPQAVSAADKGAADSAKKPDSAQLATLKEKSQGKALTLLDASEVQLDGAATLVLTFSIPLKPDQDFSHSVHLVDKKSGKVDGAWELAPNLKELRLRHLEPKRELIVTVDPTLIALNDATLGSSFEKTIATRDIAPSRFRPVRWIWPGKVVAGLPPVKAEVVQPNGEVAQTFVWQPENGVYQQRFALPASAMTGKWTLRINSGDNQPRSWPFNVEDFLPERMALSLKSNAQPLSPDANVTFDVEGRYLYGAPAAGNELQGQLFLRPAREAVAALPGYQFGDITEELKRSLDDVDEKLDDSGRLQLRVESSWAESHSPLNLILQASLLETGGRPVTRRATQAIWPAAALPGIRPLFNSESVYDYRTDRYNDEPTVPENSLAEFDVVYANAQGEKLAAQDLDVRLIHERRDYFWSFSDSEGWQSRYDEKDLQEEQQRISIAAGGSQKVSFPVEWGTYRLEVHAGDNIVSSVRFQAGYWWQDNTNGTGALRPDQVKLKIDKAAYQPGDTARVTVESPAAGKGYLLVESSSGTLWWQPLD

SEQ ID NO: 156895 - protein, 116 aa, Glycine max
  Coding DNA Sequence Number=SeqID_65210
MKNITNTGNKGIPDHICFCAMTISLELQGPTHMSTVYRGPRPEPHVQVSLHVARNLPFIQMLGQGKSQESIGWLPAPSRPASCSRGGGVLGRTTHCPPSSPLLSVELYSVPSTSRG

SEQ ID NO: 156896 - protein, 233 aa, Glycine max
  Coding DNA Sequence Number=SeqID_65211
MRQLGYPMRGAPLEESLTPIIARGFNSTNAGVFQKVRKAWEMVQKKDKELKGSSNGPIGGYHRWLKAYAQGLDWLPNLRTTKRVEVETLEEDEEIQVLKTELEKAQTVKEKFKSAAVRIRKENAELRDINIATAKALEQETKRAHREEHGRNKFRGALWGSNSELKLRRKEKDQSRVDSLILKDEFRVCLRSKRSLSQRLCETETNMLAIISKYQEELNLAMAHEHNVADEYA

SEQ ID NO: 156897 - protein, 302 aa, Glycine max
  Coding DNA Sequence Number=SeqID_65212
MAPKKLFTKRSRRDTTGEGSRATSEFDSHRFRSAEHQQHFEAIRGWSFHRERHVQLREDEYSDFQEEIAHRHWTPLVTPMAKFDPEIWIPFDANALSQFLGDPLILEEGQRCEFSQRRSQADDFNEEAIAQLLCIPGQDFTRTAAGRRVWIMRTGMTTLTQIWMTLLLSNVLPSDHNSDLPLPKFQLVYVILTRMSVHVAQVIADAIYLFAGMVPTRHPLDPEKSNRALGFSALITGLCQSYGVPDIPSKAAGTPPPPRQVDSAGPLGVERYLQHLVHQQPQSAGAEFHPFCMPYPRAVWAE

SEQ ID NO: 156898 - protein, 68 aa, Glycine max
  Coding DNA Sequence Number=SeqID_65213
MDFMGETFVVEWAFSVGWASDWEENTSNVSTIIVIISLSIIGGATWAAKSLHLYAYSLKGSCSFLHMF

SEQ ID NO: 156899 - protein, 162 aa, Glycine max
  Coding DNA Sequence Number=SeqID_65214
  Gene Ontology: Mol. function=aspartic-type endopeptidase activity; Biological process=RNA-dependent DNA replication
  Homolog annotation: Hit_ID=Q6WAY3; Match level="QueryCoverage=67%, HitCoverage=6%, E-value=9e-10, Identity=30%"; Hit description =Gag/pol polyprotein
MVHVPSENANHSILILLESQQPQLGHAPFAQPMAEARKEPRDHTLGDFETYPTYVTEGPTLPLAMEEREKFNLIEERLRAIERINDYPFADMVELCLVPNVIIPPKFKVSDFDNLAGATITWYTNLEAFWKDMMAAFIRQYQYNTDMAPDRTQLQNMSKKEH

SEQ ID NO: 156900 - protein, 62 aa, Glycine max
  Coding DNA Sequence Number=SeqID_65215
  Subcellular localization annotation: CTP_CleavageSite=35; ConfidenceScore=5.10e-01
FVKSILQDSGNLKRVAWGLGVGTGVGLSAYPSLSVASALSTAGAFSQAKLETGAKPESTYPR

SEQ ID NO: 156901 - protein, 157 aa, Glycine max
  Coding DNA Sequence Number=SeqID_65216
LCQSFGVPVTPSKVIRPPITRAFIEKYCTQRQVQGNAPQAVDAPPPHQAGPAGLFDTEQYLRHLVRQQAANHRAHVQTHDCLYQMSLSLQSQSFTSFPCPTPDQFRAEVAWPGDWPEAQAGEAPAGAPAEAPDEAEEAREDEEMTDLLDFLGGSGAA

SEQ ID NO: 156902 - protein, 331 aa, Glycine max
  Coding DNA Sequence Number=SeqID_65217
  Homolog annotation: Hit_ID=A3VEC6; Match level="QueryCoverage=92%, HitCoverage=71%, E-value=2e-10, Identity=23%"; Hit description =Possible phage integrase family protein
MTKTKLAKAERPKYLFLRGATYYYVRNIPPRHRHKFPEIKGTQIWRSLETRNYSDAVSRLEMVSRNDDAVMSGREAAPNKHTFEDLLEHAETHRFSYKRSDEIRLQEIADSVRDMALRLASTQFLSHPTMLEVAALAGAEEFPEVTIDEAVNRYLDITPEYTHDLSDFDADQKKKRLRRSINDFIKRCGNINILSIDDRVVSDYHLSIKADVVKKVFGSEHGIHMIADVRKVLKSVLKTDYQRSFSAMDGLKIKIKDSGKRSAFLEVEVRKILEELPSFRMNDEAKAIIQLALITGCGPKELCWLTAEDIHPFANTPYIKIGPNSLRAFVK

SEQ ID NO: 156903 - protein, 451 aa, Glycine max
  Coding DNA Sequence Number=SeqID_65218
  Gene Ontology: Mol. function=transporter activity; Cellular component= integral to membrane; Biological process=transport
  Homolog annotation: Hit_ID=A8GER8; Match level="QueryCoverage=98%, HitCoverage=99%, E-value=1e-142, Identity=62%"; Hit description =Benzoate transport
  Pfam annotation: Domain name=MFS_1; Domain location=29-398; Score =183.8; E_value=4.4e-52; Accession=PF07690.7; Description=Major Facilitator Superfamily
  Pfam annotation: Domain name=PUCC; Domain location=60-439; Score= -230.7; E_value=0.072; Accession=PF03209.6; Description=PUCC protein
  Pfam annotation: Domain name=Sugar_tr; Domain location=24-434; Score=- 6.8; E_value=1e-08; Accession=PF00083.15; Description=Sugar (and other) transporter
  Pfam module annotation: Pfam domain module=MFS_1::PUCC::Sugar_tr; Domain location=29-398::60-439::24-434
MPHDNNVEIRGFIDDQPFSRYQWLILVLCFLAVALDGFDTAIIGFIATSLVQEWGIEKTSLGPVMSAALVGLAVGALAAGPLADRIGRKKVLVISLLLFGGFSLLTAFAGSLSTLTLLRFLTGLGLGAAMPNAATLMSEYAPQRCRALMVNLMFCGFPLGSSLGGFSSAWLIPHFGWQSVMVLGGVMPLLLALVLIAALPESARFMVARGYAAERIAKVLKRIAPLPKTPHFMLQEEGQIKAASPLGMIFSRRYLLGTLMLCLTYFMGLMIFYLLTSWLPLLIRETGASVTQASLITALFPLGGGLGVLIIGWLMDRMNPHKVVAVGYLLTGLFVGIIGFVYSYPPLMAITVFIAGTCMNGAQSSMPALAAGFYPTQSRATGVAWMLGLGRFGGILGAMSGGALMQMQLSFSTIFTLLAIPALIAALALIAKHLSGYPALPAPLNKNAVRE

SEQ ID NO: 156904 - protein, 114 aa, Glycine max
  Coding DNA Sequence Number=SeqID_65219
KVIRPPITRAFIEKYFTPRQAQSDEHQAAGAQPPPRQAGSAGPLSMDLSQHGQGFAPFVCPTPEQFGAEVAWPGDWPDAQTGEEPAESPDETDEPHMDKDMTDLLGFLGGSGAT

SEQ ID NO: 156905 - protein, 1605 aa, Glycine max
  Coding DNA Sequence Number=SeqID_65220
  Gene Ontology: Mol. function=voltage-gated potassium channel activity; Cellular component=integral to membrane; Biological process=potassium ion transport
  Homolog annotation: Hit_ID=Q9FY05; Match level="QueryCoverage=43%, HitCoverage=91%, E-value=0.0, Identity=57%"; Hit description=Outward rectifying potassium channel
  Pfam annotation: Domain name=Ank; Domain location=1316-1348; Score =11.3; E_value=0.77; Accession=PF00023.21; Description=Ankyrin repeat
  Pfam annotation: Domain name=Ank; Domain location=1349-1381; Score =38.6; E_value=2.3e-08; Accession=PF00023.21; Description=Ankyrin repeat
  Pfam annotation: Domain name=Ank; Domain location=1382-1414; Score =22.4; E_value=0.0017; Accession=PF00023.21; Description=Ankyrin repeat
  Pfam annotation: Domain name=Ank; Domain location=1446-1478; Score =33.8; E_value=6.1e-07; Accession=PF00023.21; Description=Ankyrin repeat
  Pfam annotation: Domain name=Ank; Domain location=1479-1511; Score =9.8; E_value=1.3; Accession=PF00023.21; Description=Ankyrin repeat
  Pfam annotation: Domain name=Ion_trans; Domain location=948-1156; Score=82.2; E_value=1.7e-21; Accession=PF00520.22; Description=Ion transport protein
  Pfam annotation: Domain name=Ion_trans_2; Domain location=1084-1162; Score=20.4; E_value=0.006; Accession=PF07885.7; Description=Ion channel
  Pfam annotation: Domain name=PDT; Domain location=15-152; Score=81.2; E_value=3.4e-21; Accession=PF00800.9; Description=Prephenate dehydratase
  Pfam annotation: Domain name=zf-NF-X1; Domain location=227-245; Score= 6.5; E_value=1.4; Accession=PF01422.8; Description=NF-X1 type zinc finger
  Pfam annotation: Domain name=zf-NF-X1; Domain location=325-349; Score= 16.5; E_value=0.099; Accession=PF01422.8; Description=NF-X1 type zinc finger
  Pfam annotation: Domain name=zf-NF-X1; Domain location=354-375; Score= 6.0; E_value=1.6; Accession=PF01422.8; Description=NF-X1 type zinc finger
  Pfam module annotation: Pfam domain module=Ank::Ank::Ank::Ank::Ank::Io n_trans::Ion_trans_2::PDT::zf-NF-X1::zf-NF-X1::zf-NF-X1; Domain location=1316-1348::1349-1381::1382-1414::1446-1478::1479-1511::948 -1156::1084-1162::...
  Pfam module annotation: Domain location=15-152::227-245::325-349::354- 375
MGKEFPSSDGSKLRVAYKGLPGAYTEDAALKAYPKCETVPCEDFETSFKAVESWLVDKAVLPIESSVGGSIHPNYDLLLGHKLHIVGEVQLLINHCLLGLPGVRKEDLRAVMSHPQSAVDVSVFCSVHGPIEIAGDVAGCSKRFRTVVKSEQMVEYSLVERNLIVLIISVSRLVGKLDWRRNATFPRSVDVALLPALWSVARQKWKIRNLLSNPNNILNADWDPHLCQLPCESLCHSGHCPPCLQTIFTDLTCSCGTPPPSCQLPCSVPQPCSHPASHSCLFRDCPPCSVPVAKECIGGHVVLRNIPCGSKDIRCNKLCVKTRQCGLHACGRTCHLPPCDNLSVVTCGAPRRDCRHTCIAPCHPSTPSPDTRCEFPVTITCSCGRITENVPCDAGANYNADVVHEASIIQKLPVLLQPVAANGKKAPLRQRKLMCNDDCAKLERKRVLADAYEITAPNLDSLHFGENSIASELLADMLRSDSKWVLSVEERCKFLVLGKSRGNDAHGPKVQVFCPMLKDKGDAVRVIAERWKLVVNAAGREPKHFIVVHVTPKSRAPARVLGVKGTTTVNVPLPLAFDPLVDMDPRVVVSFLDLPRDADISALVLRFGGKCELVWLNDKNALAVFNDPARAATAMRRFDHGTVYKGAVMVVVPPNGNPWKKDVIQELGWREDAWGDEEWATGSANVQLPIKKKEALISASANPWSVLNQESSSSSSVAAIKIDGSRKHYESSVVTKLEPRDGGSNLGGQPAGNFDALEGADVVDDWEKACSGKNGMMVYGVIEGKINLALIHVVSFKHHITHPRAGACPVNYTEAYRNNDADDLCADASADLPNDAWAGVLRVLNQTAAYEATEVLGSSVRQGGETVEDSEMTWKAGRVHSTNGEGSEGAIQNGERMHASCRKFVIHPHNRWYLAWKHFILIWAVYSSFLTPMEFGFFRGLPQKIFLLDMAGQLFFLLDILLRFLVGYHEVQSNSLSLVLDPHKIALRYLKSCFLPDFLSCLPWDYFYKLSSNNELVRYLLLIRLCRAFRVTQFFDTLEKNTRVSYLFSRILKLFVVELYCTHTAACLFYYLATTVPPSQHSYTWIGSLKMGDYTYSDFTHIDLWKRYVTSLYFAIVTMATLGYGDIHAVNVREMIFVMIYVSFDMILGAYLLGNITALIVKGSKTERFRDQMSHIVNYINKNNLDKQICHHIKDHLRLKYHPSYTGSSVLQDIPTTIRTKEEFFLPGELVMEQGDVVDQLYFVYHGELPQTSMVEAHEFCKVLRLDKKSFTEILKIYFLDGRIVLNNLLEVKDLSLQRKLLESDFNLTIGNMETELAIRMNFAAHDGHLDLVKRLIGFGADPNKTDYDGRTPLHISASKGYVDISSYLVEQGVNINCADKFGTTPLLEAIKNGHEEVASILVNAGAIFTIDDVGNFLCMTVAKKELDLLKRVLGCGVNPNAKNYDQRTPLHIAASEGLFTMAEVLLEAGASVLSKDRWGNTPLHEAHTGGDRNMIKMLEVAKASQLVELSNNIHETQATPTDEIPKKRCIVFPFHPWDDQKADRKEGVVLTVPQSIEELIKEATKHLEIPNASCILSEQCGKIVYVGTINNDEKLFLVSEAQNE

SEQ ID NO: 156906 - protein, 194 aa, Glycine max
  Coding DNA Sequence Number=SeqID_65221
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=81%, HitCoverage=22%, E-value=4e-63, Identity=78%"; Hit description =Homeodomain protein HOX3
  Subcellular localization annotation: CTP_CleavageSite=66; ConfidenceScore=5.09e-01
SSIHSASAQYANRLSRALADSLNAAGTTGFPTGKRAWDVLSNGNAVQEVANIANGLHPGNCISVLRAFNNSQNMLILQESCIDSYGSLVVYCPVDLPSINTAVSGEDPSYIPLLPNGFTILPDGQPDQEGDGASTSSNTNRNIARSGGSLVTIAFQILVSSLPSAKVNMESVTTVNNLIGSTVQQIKSSLSCPT

SEQ ID NO: 156907 - protein, 74 aa, Glycine max
  Coding DNA Sequence Number=SeqID_65222
MACLLMLPKRGAVFLVINSKDEYSLIAVIQVMSGILDIFVGLSDLVWTALGTLHLVCLGKRLGHYLMCQGPNVN

SEQ ID NO: 156908 - protein, 224 aa, Glycine max
  Coding DNA Sequence Number=SeqID_65223
  Gene Ontology: Mol. function=drug transporter activity; Cellular component=membrane; Biological process=multidrug transport
  Homolog annotation: Hit_ID=A5ARU6; Match level="QueryCoverage=93%, HitCoverage=49%, E-value=5e-54, Identity=50%"; Hit description =Putative uncharacterized protein
  Pfam annotation: Domain name=MatE; Domain location=20-157; Score= -24.5; E_value=0.039; Accession=PF01554.9; Description=MatE
MRIVREEVVEEVKRLWLAVPLFSVGILLHILQAISIMFVGHLGTLPLSGASMASSFASVTGFNLLPFYLFASSKLVIGVSYCTGHILWSIKWSRTVPYAWHTHAEIHACCFNDMIPSLFAYGILRCILKFLQTQKIVFPMVLTSGIAAVLHVLFCWLLVFKSGLANRGAALANSISYWVNAILISLYVRFSSACKHSWTGFSKMALHNLLDFLKLGAPSAAMHW

SEQ ID NO: 156909 - protein, 254 aa, Glycine max
  Coding DNA Sequence Number=SeqID_65224
  Gene Ontology: Cellular component=integral to peroxisomal membrane; Biological process=peroxisome organization and biogenesis
  Homolog annotation: Hit_ID=A7PH34; Match level="QueryCoverage=65%, HitCoverage=45%, E-value=2e-42, Identity=53%"; Hit description =Chromosome chr17 scaffold_16, whole genome shotgun sequence
MESFEKGIMDIEKRFSLLEMLRRISSIESFETPPRIFWAQRGVKVCTKPGLCAKRGCAESGDVVDREDQKKFLDSVDFLSQHGMPALISDMEAATKEVLKGKQLSTFFNSTTLHETIMQILNTFMSMGTPNSWIKYMIPEDVRPYSTTSGSDDPVPFDVTEFEQLMIEARAVLSSAEFGSIVEISLKAVVDTLVELMRTKFSGGSVAEGMPLARVLPQVAQILPFKCSNSASVCSCRFYIMMRYARVVQWCPIF

SEQ ID NO: 156910 - protein, 224 aa, Glycine max
  Coding DNA Sequence Number=SeqID_65225
  Subcellular localization annotation: CTP_CleavageSite=32; ConfidenceScore=5.23e-01
MVASLVLSRAPPLIALLGFFSPSGTGLGNPVMASDATRCTLEDLPETPPSSTQRLLNDPSSIVDYGGGSPTNHNYEVIEVCNGDLYLINRETVSYFGTPLLGDTYKVVEDCNSLETEVRIHRLGHNCWRIVVRWSGFPKLRNVHGAVYASVSPRKSLFLCLANEGVLDYIAEYRDILLLSSNEVFEVITYNRRDNRLEYTDISSNKVWLHSSDYVESLVLPYCN

SEQ ID NO: 156911 - protein, 1413 aa, Glycine max
  Coding DNA Sequence Number=SeqID_65226
  Gene Ontology: Mol. function=ATP-dependent helicase activity; Cellular component=intracellular; Biological process=dosage compensation complex assembly during dosage compensation by hyperactivation of X chromosome
  Homolog annotation: Hit_ID=Q9C734; Match level="QueryCoverage=81%, HitCoverage=97%, E-value=0.0, Identity=65%"; Hit description =Putative uncharacterized protein F11I4_16
  Pfam annotation: Domain name=DEAD; Domain location=553-696; Score= -2.6; E_value=6.7e-05; Accession=PF00270.20; Description=DEADDEAH box helicase
  Pfam annotation: Domain name=DUF1605; Domain location=1110-1216; Score=57.9; E_value=3.5e-14; Accession=PF07717.7; Description=Domain of unknown function (DUF1605)
  Pfam annotation: Domain name=HA2; Domain location=982-1073; Score =115.8; E_value=1.3e-31; Accession=PF04408.14; Description=Helicase associated domain (HA2)
  Pfam annotation: Domain name=Helicase_C; Domain location=826-920; Score=51.6; E_value=2.8e-12; Accession=PF00271.22; Description =Helicase conserved C-terminal domain
  Pfam annotation: Domain name=dsrm; Domain location=1316-1378; Score =47.8; E_value=3.7e-11; Accession=PF00035.16; Description=Double -stranded RNA binding motif
  Pfam module annotation: Pfam domain module=DEAD::DUF1605::HA2::Helicas e_C::dsrm; Domain location=553-696::1110-1216::982-1073::826 -920::1316-1378
MADLLVKDETFHELGVVDGAAELLHDLHIAEVDHVGLGGIDDGKNGVDGEGSQERGVLADDLAVEGCASGLHEGVAVRELDGDGHGGENVDGLHGSLVEGVGDDGGVDAVGEEEEALLEEGASNDDDGSGAVAGGGVLGLGELDEHLGGGLEDLHLVEDGGAVIGDDDLVGGGGDHLVHALGAQTGANRVGDGACGHDVGVADVILALVVNVGLRLRGSVLGSCSAVISMPMTYSGIFQGFIRFKATSRLRSAPLRHSLPSISSAPFHRTAIRLRHHSCSAALQVVKNTRQRTFKFPFWHQRSSTYGRFAYQDVSSDESDVEFASSPSHNQQLGDSTHENIDDWRWKLTMLMRNKDEQEAVSREKKDRRDFEQLSTLATRMGLYSRQYARVVVFSKAPLPNYRPDLDDKRPQREVVLPLGVHKEVDAHLLAHLSQKARNKWDFMEDSLHNSSDSRSIPANERMYEQPEPVTHNSVVKEKILQRKSLQLHHQQQDWQESPEGQKMLEFRRSLPAFKEKDAFLRVISQSQGEPLCNDKVAIFCNLEVTSSNLGSSPCETGCGKTTQLPQYILESEIEAARGAVCNIICTQPRRISAMSVSERVAAERGEKLGESVGYKVRLEGMKGRDTRLLFCTTGVLLRRLLVDRNLKGVTHVIVDEIHERGMNEDFLLIVLKELLHHRPDLRLILMSATLNAELFSSYFNGAPTMHIPDILERTGYRLTPYNQIDDYGQEKTWKMQKQAQAFRKRKSHIASAVEDALEVAEFKGYSLRTQDSLSCWYPDSIGFNLIEHVLCHIVKNERSGAVLVFMTGWDDITSLKDQLQAHPLLGDQSRVLLLACHGSMASSEQRLIFENPEGGVRKIVLATNMAETSITINDVVFVVDIGKAKETSYDALNNTPCLLPSWISKAAARQRRGRAGRVQPGECYHLYPRCVYDAFADYQLPELLRTPLQSLCLQIKTLQLGSISEFLSRALQPPEPLSVQNAIEYLKIIGALDENENLTVLGHKLAMLPVEPKLGKMLILGAIFKCLDPIMTIVAGLSVRDPFVMPSDKKDLAESAKAQFAARDYSDHLALIRAYDGWRDAEAQQAGYEYCWRNFLSSQTLRAIDSLRKQFFYLLKDICLVNNNSETYNTWSHEEHLLRAVICAGLFPGISSVVNKDKSIALKTMEDGQSSVNGCVPRIPFPWLVFNEKVKVNSVFLRDSTGISDSVLLLFGGNVSRGGLDGHLKMLGGYLEFFMKPELAKTYLSLKMGLEELIQKKLLDPMLETQSHSELLSAVRLLVSEDHCDGRFVFGRQVLPQSKKETNSKTGGVAEEKNYKNHLQAFLNRAGHDSPTYKTKELKNNQFRSTVIFNGLNFVGQPCSSKKLAEKSAAAEALLWLKGDSHSSDDIDHASVLLKKSNKKSRKNSFSSAKWS

SEQ ID NO: 156912 - protein, 152 aa, Glycine max
  Coding DNA Sequence Number=SeqID_65227
  Gene Ontology: Mol. function=protein dimerization activity; Cellular component=nucleus; Biological process=regulation of transcription, DNA-dependent
  Homolog annotation: Hit_ID=Q94KA7; Match level="QueryCoverage=25%, HitCoverage=9%, E-value=2e-15, Identity=87%"; Hit description=BZIP transcription factor 3
  Pfam annotation: Domain name=MFMR; Domain location=44-146; Score= -14.5; E_value=3.5e-06; Accession=PF07777.2; Description=G-box binding protein MFMR
MCFNELIFAGSQICEYEKAASISSSHDPPIVLAKVDANEEKNRSSEMDKTPKEKESKTPPPPPTSQEQSSTTSSGTINPEWPGFQAYSPIAPHGFLASSPQAHPYMWGVQKLLDFAELKDNSISFFDIEKHETAIFRWSRATTRAAKELNRA

SEQ ID NO: 156913 - protein, 456 aa, Glycine max
  Coding DNA Sequence Number=SeqID_65228
  Gene Ontology: Mol. function=microtubule motor activity; Cellular component=nuclear chromosome, telomeric region; Biological process =microtubule-based movement
  Homolog annotation: Hit_ID=A7PH82; Match level="QueryCoverage=89%, HitCoverage=93%, E-value=4e-92, Identity=43%"; Hit description =Chromosome chr17 scaffold_16, whole genome shotgun sequence
  Pfam annotation: Domain name=Telo_bind; Domain location=45-151; Score= 39.4; E_value=1.3e-08; Accession=PF02765.8; Description=Telomere -binding protein alpha subunit, ce
MSSRKRTGMREGYEFMPIRDVGRSVGQKAKLIGVILDFGFPKKSKGTDFCCCLRIIDETHHQISMAINMFEENVERLPRLAAVGDVVVLCCVEVKSFKGEVNVTFNKRFSSFGLYKGKDGDDLDPYHVSSYFHHVREDESLIVKLRKWLMNFQPHEDSSNFPMLREIKEETSVNLACKILHFCETAKDEWIIFSWDGTNTPSNVICSKLEEEINCPLPLQLEPLPLSREVLCTLPVAGSILRIMFDKVVVKNHLHLLNVDKWVKFMNIHLKVVDGLWLGVFSPQSRLRYTPNEDSLIVERQRLSDEQLFPKPLFITEEVNQDHATPVTLMTVLTHSKVVTAKFKCVVRVVAAMPYLAKNLLSSIGKYRMQLTLEDSTARVHAFVTGKDGETLFDGYPSIDELTRKLNRLLGVTGIKDAPRDPPWVSVCLKSYYVSKTDVWGSRNFKIFGIKIVGDT

SEQ ID NO: 156914 - protein, 667 aa, Glycine max
  Coding DNA Sequence Number=SeqID_65229
  Gene Ontology: Mol. function=binding; Cellular component=endoplasmic reticulum; Biological process=Notch signaling pathway
  Homolog annotation: Hit_ID=Q4R1J3; Match level="QueryCoverage=95%, HitCoverage=95%, E-value=0.0, Identity=97%"; Hit description=SEL-1
  Pfam annotation: Domain name=Sel1; Domain location=121-156; Score =15.1; E_value=0.21; Accession=PF08238.3; Description=Sel1 repeat
  Pfam annotation: Domain name=Sel1; Domain location=239-275; Score =37.4; E_value=5e-08; Accession=PF08238.3; Description=Sel1 repeat
  Pfam annotation: Domain name=Sel1; Domain location=276-311; Score =33.9; E_value=5.8e-07; Accession=PF08238.3; Description=Sel1 repeat
  Pfam annotation: Domain name=Sel1; Domain location=312-348; Score =31.4; E_value=3.3e-06; Accession=PF08238.3; Description=Sel1 repeat
  Pfam annotation: Domain name=Sel1; Domain location=349-384; Score =35.5; E_value=2e-07; Accession=PF08238.3; Description=Sel1 repeat
  Pfam annotation: Domain name=Sel1; Domain location=385-420; Score =23.3; E_value=0.00091; Accession=PF08238.3; Description=Sel1 repeat
  Pfam annotation: Domain name=Sel1; Domain location=421-452; Score =2.9; E_value=7.8; Accession=PF08238.3; Description=Sel1 repeat
  Pfam annotation: Domain name=Sel1; Domain location=501-536; Score =18.2; E_value=0.031; Accession=PF08238.3; Description=Sel1 repeat
  Pfam annotation: Domain name=Sel1; Domain location=537-572; Score =32.4; E_value=1.6e-06; Accession=PF08238.3; Description=Sel1 repeat
  Pfam module annotation: Pfam domain module=Sel1::Sel1::Sel1::Sel1::Sel 1::Sel1::Sel1::Sel1::Sel1; Domain location=121-156::239-275::276 -311::312-348::349-384::385-420::421-452::501-536::537-572
MAGPKPKLLFLIVILSLSASVGARPFVLILSQEDYKDDPPADPDSPAEWDEFAHGDAHKSEEDLDPGSWRPIFEPPAGDPQPLPESDAAYYSAVHKLMSGEPALIQDAGEEIAGLAVSGHPAAQSVLGFLWEMGLFRERSKGKAFLYHHFAAEGGNMQSKMALAYSYTRQDMLEKGVKLYGELAEVAVNSFLISKESPVIEAVRLHNGAEENKEALGKSKGEEDEDFQILEYQAQKGNAAAMYKVGLFYYFGLRGLRRDHSKALWWFLKAVEKGEPRSMELLGEIYARGAGVERNYTKALEWLTLASRHHLYSAYNGMGYLYVKGYGVDQKNYTKAKEYFEKAADNDEVGGHYNLGVMYLKGIGVKRDVKLACKFFVLAANHGQPKAFYQLAKIFHTGLGFKKNIPLATALYKLVAERGPWSSLSRWALESYLKGDIGKAFMLYSRMAEMGYEVAQSNAAWILDKYGERSMCMGESGFCTDAERHQRAHSLWWQASEQGNEHAALLIGDAYYYGRGTARDYERAAEAYMHAKSQSNAQAMFNLGYMHEHGQGLPFDLHLAKRYYDEALDHDPAAKLPVTLALSSLWVRKNYADSFVVIDSLPELYPKLEAWVENVLLEEGNATILTLFVCLLTVLYLRERQRRQAAVAAGEGNNTCIAVEISAFVDR

SEQ ID NO: 156915 - protein, 158 aa, Glycine max
  Coding DNA Sequence Number=SeqID_65230
MASRKRKSMASRPIAQYDTKRFQSLGSWNRYTDNILSRNIILKRNVKIYHTEFDEFKVDLERRNFHKHLTNLQAGSIDVVVVKEFYANLYNPKEPAPKQARVRGHLIKIDADSLNEFLHTSMVLEEGESLPTYSRFVMNAEGQPWKLLRKDLTTLAQT

SEQ ID NO: 156916 - protein, 102 aa, Glycine max
  Coding DNA Sequence Number=SeqID_65231
MTSLASLSSKNTYFKCAGKVICLTLTKTSSITPYGLMVERSTNYKVILVGIISSYPILQHIESDIKFMLAPKSIRALPTETAPIEQGIVTLPRSLCLGGRMR

SEQ ID NO: 156917 - protein, 150 aa, Glycine max
  Coding DNA Sequence Number=SeqID_65232
  Homolog annotation: Hit_ID=O52175; Match level="QueryCoverage=54%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGTSFGDCAPPSQLPRFKELVAQRTFENRPASGFSFQSRDYAQTKRSQKIIYIR

SEQ ID NO: 156918 - protein, 113 aa, Glycine max
  Coding DNA Sequence Number=SeqID_65233
MDMNLGYIISTQISLTAQHDSSRLEFPALITALCKARGVISNSLTLESLGPTINVAYMLHFMLQSLHRGQSIIMQSLQGLGLPSIMSMDEFDAQVAWPGAQPSPSRGGGASVA

SEQ ID NO: 156919 - protein, 133 aa, Glycine max
  Coding DNA Sequence Number=SeqID_65234
  Gene Ontology: Mol. function=aspartic-type endopeptidase activity; Biological process=DNA integration
  Homolog annotation: Hit_ID=A5AUE6; Match level="QueryCoverage=88%, HitCoverage=6%, E-value=5e-22, Identity=43%"; Hit description =Putative uncharacterized protein
MFYCPNHSTRFVETGNARFIENGEISGSAVRREVEIKDVKVCCYKINEEEQHNNEPMMLNEPIMEELQEVALRRSQRERRPAISNDYMVYLHETETNLSINDNDPILFSQAVSCDNSKEVVKCHERRDKFHGT

SEQ ID NO: 156920 - protein, 382 aa, Glycine max
  Coding DNA Sequence Number=SeqID_65235
IDADSLNAFLETPVILAEAETLPVYSRYCRLPTDFREIEAALCIPGRGFILNFKGHPGNILRKDLTTLAPVWSVLSYSNLAPTSHTSDLTVDRARLIFGLVSHLDKNIGVLISVQMTSIAQYNTSRLWFPALITVLCRVRGVVSDSLTFKRLSPVINLAYIRKNCWNPEHLTVSNRGARRARARPVELPSTSAAPIPASTSAAPSILAQTNSHRFEAMLQSIHQGQIILLQSFHMIAPPDSIPSVQQFNEMVAWPGTQPSLQKEDKGPTAQVPQHMEDESSEATIPEPFDIGEEAEETQLRQVAATTPEQSLEATSEPSAPVVNPPSPQPASHPSTPLLQILEYPTTPVLAVDTSPPTTPVLQLTDEEDGQTQKTQDQSQEF

SEQ ID NO: 156921 - protein, 397 aa, Glycine max
  Coding DNA Sequence Number=SeqID_65236
  Homolog annotation: Hit_ID=Q6WAY6; Match level="QueryCoverage=37%, HitCoverage=31%, E-value=3e-20, Identity=35%"; Hit description =Putative uncharacterized protein
RIATVVKDSARGLDRIKQTRNGIAGLPQRYLEDKARGMANQGDWVPFMDVLALLIFGVVLFPNVDGLVDLAAIDAFLAYHHSKESPVVAVLADLLDTFDRRLGPALGRIGGRTISWFPRWKEGKEGVLFSCGGYPNIPLVGTRGCINYNPALAIRQLGYPMRGAPTEESMSPFLLRGIRNGIIGGYHEWLKVHIRGLDWLAKLKVVSEESFEAPEEDEEVQALKSELGKAKLAKEKFKLAATHVRKECAGLREENAITARALEQETKRARKEEYDRNKFAELYGVAIVNSSCEGKKGTSRELHSMTNMLAIIAKYEEELGLATAHEHRIADEYAQVYAEKEARGRVIDSLHQEATMWMDRFALTLNGSQELPRLLAKAKAMADTYSTPEEIHGLLGY

SEQ ID NO: 156922 - protein, 148 aa, Glycine max
  Coding DNA Sequence Number=SeqID_65237
  Subcellular localization annotation: CTP_CleavageSite=9; ConfidenceScore=5.09e-01
APRKARGKRSEAPSTSTSEEATPSSSTLPPSSTTELPVIPPAPTQIPLPAPLSVGQTEFIFTPQMLHSMLQSIHKGQSIIMQSLQGLGFPSIMSMEEFDTHMVWPGDQPSSSGGGGASTAQETVSEEPLAPAPSPAATEEETTPAQTP

SEQ ID NO: 156923 - protein, 376 aa, Glycine max
  Coding DNA Sequence Number=SeqID_65238
  Gene Ontology: Mol. function=motor activity; Cellular component=cell projection
  Homolog annotation: Hit_ID=UPI00016621D1; Match level="QueryCoverage =63%, HitCoverage=43%, E-value=5e-23, Identity=34%"; Hit description =UPI00016621D1 related cluster
VNPWVLVPIAFRGLHALTYKGLHVLTFRGLHVLAFKGLHTLAFRGHHVLTFRGLHALAFVGLHVLTFRGLNAFAFVGLHVLTFRGLHAFAFVGLHVLTVRGLHVLAFRELHVLTVRGLHVLTFRGLHVLTFRGLHALTFRGATNLTFKGLHALAFRGLHILAFRGLHVLTFRGLHVLTIRGLHVLLFRGLHVLALVRLGILHFRELHAFAFRRLRVLTFSGLRIHTLREFKRPQYRSPPTEVSIGLCHPDIEKPNKALGFPAQVTGLCQSYRVPVPPARSCHRDIGIAPIRHPVDSKKSNRVLAFPALIMGLCQFYGVPVAVNKAQGETPQQPGDSRQRAINAPPPPLEFTSAHLQKVRALPTTRGGPIGDQVQSQ

SEQ ID NO: 156924 - protein, 112 aa, Glycine max
  Coding DNA Sequence Number=SeqID_65239
DRAHKTPNGPGEVQQVIGFPALITGLCQSYRVPVPPTRSCRHDIGIAPARQIVDPEKSNRVLRFPALITSLCQFYKVLVAPNKVIKPLLTGLSSRSTAPPGRRRARHHGSGQ

SEQ ID NO: 156925 - protein, 87 aa, Glycine max
  Coding DNA Sequence Number=SeqID_65240
MVILRLLSSRGGEPNDMRRNHMVPHLFHCPETIKPDCTRRQIMIIRTLLLSGQQVEWWAEIPYGHPCLSSTERNEFSSIRMMLVIRC

SEQ ID NO: 156926 - protein, 107 aa, Glycine max
  Coding DNA Sequence Number=SeqID_65241
MERNKKRISKKGGKGVYLVNRGVQIAIRPTWAFQDVPIGAFWWKQPSSPGRAELAWASWATTTSLFSPINRGRRAEQIRSTLLEYEIHLKLVIKIDSVKKIQAEALP

SEQ ID NO: 156927 - protein, 81 aa, Glycine max
  Coding DNA Sequence Number=SeqID_65242
MAESSKQQKGSSSTTAAAGHRCHGPYHLHNHQLYFLQMINVYVFQNSGLVEFMSLKLPYYPELVKVFYSNLKIEDGIISSE

SEQ ID NO: 156928 - protein, 104 aa, Glycine max
  Coding DNA Sequence Number=SeqID_65243
MITKDDDKGDDKKLKGQSKNNSRVQDRIKKNSRLKKKVKSQESRFKVQDLKNQDQDSRLKIQESRKGLIKITHDFSQNMFTKEFLLSGNRLPDCCNRLPVGKLF

SEQ ID NO: 156929 - protein, 517 aa, Glycine max
  Coding DNA Sequence Number=SeqID_65244
  Gene Ontology: Mol. function=nucleoside-triphosphatase activity; Cellular component=flagellum; Biological process=transport
  Homolog annotation: Hit_ID=P0A9W4; Match level="QueryCoverage=100%, HitCoverage=96%, E-value=0.0, Identity=67%"; Hit description =Uncharacterized ABC transporter ATP-binding protein yjjK
  Pfam annotation: Domain name=ABC_tran; Domain location=25-228; Score =213.0; E_value=7.3e-61; Accession=PF00005.18; Description=ABC transporter
  Pfam annotation: Domain name=ABC_tran; Domain location=342-511; Score= 193.4; E_value=5.7e-55; Accession=PF00005.18; Description=ABC transporter
  Pfam annotation: Domain name=MMR_HSR1; Domain location=343-418; Score= -20.5; E_value=0.081; Accession=PF01926.14; Description=GTPase of unknown function
  Pfam module annotation: Pfam domain module=ABC_tran::ABC_tran::MMR _HSR1; Domain location=25-228::342-511::343-418
MHRVGKVVPPKRHILKNISLSFFPGAKIGVLGLNGAGKSTLLRIMAGIDKDIEGEARPQPGIKVGYLPQEPQLNPEHTVRESVEEAVAEVVGALKRLDEVYALYADPDADFDKLAAEQGRLEEVIQAHDGHNLETQLNRAADAMRLPEWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGAKGRQSKGKARLARFEELNNTDYQKRNETNELFIPPGARLGDKVLEVKNLSKAYGDRVLIDDLSFSLPKGAIVGIIGPNGAGKSTLFRMMSGQEQPDSGSIELGETVKLASVDQFRDAMDNSKTVWEEVSGGQDIMRIGNTEMPSRAYVGRFNFKGTDQGKRVGELSGGERGRLHLAKLLQVGGNLLLLDEPTNDLDIETLRALENALLEFPGCAMVISHDRWFLDRIATHIIDYQDEGKVEFFE

SEQ ID NO: 156930 - protein, 665 aa, Glycine max
  Coding DNA Sequence Number=SeqID_65245
  Gene Ontology: Mol. function=transcription regulator activity; Cellular component=membrane; Biological process=pyridine nucleotide biosynthetic process
  Homolog annotation: Hit_ID=P24518; Match level="QueryCoverage=53%, HitCoverage=87%, E-value=0.0, Identity=87%"; Hit description =Transcriptional regulator nadR
  Pfam annotation: Domain name=HTH_3; Domain location=299-355; Score =35.7; E_value=1.6e-07; Accession=PF01381.13; Description=Helix-turn -helix
MLSETSIEQICLIAEQEQPKLMVIDSIQVMHMAEIQSSPGSVAQVRETAAYLTRFAKTRGVAIIMVGHVTKDGSLAGPKVLEHCIDCSVLLDGDADSRFRTLRSHKNRFGAVNELGVFAMTEQGMREVSNPSAIFLSRGDEITSGSAGGPFDDGQSAPCGGWAGAEPSGDSAGGAAPPRRPADGRSGRVCERGRRRQSHRDQCRPGAAAGDVGLAGEIRPVPSGQERISEAAKHGFKRAIVPAGNAPKKAIDGMKGVWLVLHLFPHPNPLPLAGEGTVRRGGKDGTDLLLTALFRIFPLSRGRERAGGHTLQQVADASGMTKGYLSQLLNAKIKSPSAQKLEALHRFLGLEFPRRDKTVGVVFGKFYPLHTGHIYLIQRACSQVDELHIIMGHDDPRDRQLFENSAMSQQPTISDRLRWLLQTFKYQKNIRIHSFNEEGIEPYPHGWDVWSAGVKTFLAEQGIDPDCVYTSEEPDAPMYQQHLGIPAVVIDPHRSFMNISGSQIRQDPFRYWEYIPTEVKPFFVRTVAVLGGESSGKSTLVNKLANIFNTTSAWEYGRDYVFSHLGGDEMALQYSDYDKIALGQAQYIDFAVKYANKVAFIDTDFITTQAFCLKYEGREHPFVQALIDEYRFDLVILLENNVPWVADGLRSLGSSMDRREFQSML

SEQ ID NO: 156931 - protein, 70 aa, Glycine max
  Coding DNA Sequence Number=SeqID_65246
  Subcellular localization annotation: CTP_CleavageSite=45; ConfidenceScore=5.32e-01
MNSLPSAVYVSSTNESGAPRIDCLALFANSPFSNLIRRPMNSLPSAVHVSSVIKRRASEKEEGEMRVVID

SEQ ID NO: 156932 - protein, 114 aa, Glycine max
  Coding DNA Sequence Number=SeqID_65247
MEGVVEFFGEFWLWRDWREPSLKRKLSCKALDEILSDCEVSRGGGDIPATSSLLWRAKSSIGSSYGVLDYFISVCFCLDHVDVCLVRVIQHWEMFWSSLVQQEGSEDDAWLGLG

SEQ ID NO: 156933 - protein, 109 aa, Glycine max
  Coding DNA Sequence Number=SeqID_65248
MGIMKHVPYTLRLVESIAQVSEDDFVGCLCLTIGLMMSDKDYKYVHSSHGEGPRGAQAMKIVRKSAWNICKFLASSAPLGEVKGVCPERWLIVAGTHHFGRKGVSPSMK

SEQ ID NO: 156934 - protein, 63 aa, Glycine max
  Coding DNA Sequence Number=SeqID_65249
MAVVGTTGSYGGHDGEFSKTGDEVLNQYGNTSIYSTKFTTVYKQHRLCILLFLRRCLQKHRLR

SEQ ID NO: 156935 - protein, 95 aa, Glycine max
  Coding DNA Sequence Number=SeqID_65250
MVENHHVKDLIEAQRSSLHRSSTSKLPSLSLSLHSSSPTFKLLSMASYGEAKDSIDEEDAWPGSFTWSYVMWYQEHLRLGDVLLLPLSFCSVNSL

SEQ ID NO: 156936 - protein, 146 aa, Glycine max
  Coding DNA Sequence Number=SeqID_65251
MSTTFSTASTEMKNGIMRRPLIMQFIAAFNNDKNAIQLPAFYHTQWAPNYPEFVHLRYNGAIYEIRVRQRREKVYLAYGLQNFRKDLKIYESTSINFFACGHHSVFDIHFTPPLERQTCGRQRHSSRKHIWTLQLTQEMLDHPEPL

SEQ ID NO: 156937 - protein, 144 aa, Glycine max
  Coding DNA Sequence Number=SeqID_65252
MDPDYDEMSPCACWWISTKASSKSLLASTFRKCLHGLTIVDVYWMPYASGPAKHPPVTQDDTYVEPYIPEVPVAAATPTHAPSDAEQPRHAVANYVACQAIAERLERLLNLRIVTEGTEVHDIMEDCLRIARGVTEEGNVYVRS

SEQ ID NO: 156938 - protein, 73 aa, Glycine max
  Coding DNA Sequence Number=SeqID_65253
MMTKVMNKKLKRSKNNSSESRTSQEFKNQEEFKTQEESLQSRIKIQDTRSQESRSRFKTQDSRMKKRLNQDKY

SEQ ID NO: 156939 - protein, 30 aa, Glycine max
  Coding DNA Sequence Number=SeqID_65254
MDSQHNDDKGDKGDDWDGEFRMKMKKKQGK

SEQ ID NO: 156940 - protein, 230 aa, Glycine max
  Coding DNA Sequence Number=SeqID_65255
MERSMIDAVSGGALGDMTPAEARNLIEKMASNSQQFSARSDVIVIRGVHEVATNSSSSGETKKLEGKLDALVNLVTQLAMNQKSASVARLCGLCSSADHHTDLCPSMQQSEAIEQPEAYVANIYNIPPQPQQQNQPQQNNYDLSNNRPYVPPPIQQQQPQKQQTVKAPLQPSLEELVRQMTMQNMQFQQETKASIQSLTNQMGQLATQLNQQQSQNSDRLPSQSVQNPKN

SEQ ID NO: 156941 - protein, 295 aa, Glycine max
  Coding DNA Sequence Number=SeqID_65256
STLEDPPRARLERTTRPHHQRAARPYLQRTTCPRLERATRPHLGGLHALTLRGLHVLTIRGLHALTSRGLHVLALRGLHALTLGTSYPHRQRTTRPRLERTTRPHHQRAARPYLQRTTCPRLERATRLHLGGLHALTLRGLHVLTIRGLHALTSRGLSPRLERATRPHLGGLHVLAFKGSCTFNFRGLHVLAVKGSCAFTFGHVLTFRGLHVLAFRRLHALAFRGLRVLTFGASSFLLTVPGPPPDIGGGPTVRAQPEREAITQLLCIPGQDFIRAAVKRRVRIMRTNMTTLTQI

SEQ ID NO: 156942 - protein, 367 aa, Glycine max
  Coding DNA Sequence Number=SeqID_65257
  Gene Ontology: Mol. function=methyltransferase activity; Cellular component=cytoplasm; Biological process=biological_process
  Homolog annotation: Hit_ID=Q9LEU9; Match level="QueryCoverage=85%, HitCoverage=82%, E-value=1e-87, Identity=53%"; Hit description =Putative uncharacterized protein T30N20_180
  Pfam annotation: Domain name=Methyltransf_5; Domain location=82-367; Score=210.3; E_value=4.7e-60; Accession=PF01795.10; Description=MraW methylase family
  Subcellular localization annotation: CTP_CleavageSite=47; ConfidenceScore=5.43e-01
MTMLSKISSSLLLSLSSKPKPKPICNPFLLSRSAATKHQKNKKENAKAALAKEKRRTRSDKQFNRDAIIERCRINDIDTDTKFSHVPVMLGEVLDVFSNSTLTSFVDCTLGAAGHSTAVIRGHPELKYLVGMDVDSLAHDIAQPRLDAVLNAGVKAITVLRNFRDVKSVLREIAELHLLGVDAILMDLGMSSMQVDDPARGFSVLGDGPLDMRMDPQNEINRYGAKATVDGGRQGWIKTATRVFQALRIAVNDELKTLEDSLYSCFDCLAPGGRLAVISFHSLEDRIVKQTFLNIIKGREDVEERESLNSVLRNTSDEIKEKEAWIKQVIYGSNGTILTKRPITPSGEEEKLNRRSRSAKLRVIQKH

SEQ ID NO: 156943 - protein, 126 aa, Glycine max
  Coding DNA Sequence Number=SeqID_65258
MGNFSNFSLAVVMVGVPEKEKTGPKEAISAQGLTTKLSGPDRSAFDDEVTARGIHWERDYQGWVALFEANLTLVSPKKMVGDDDGWRAMANADDKCEDDKLCATADDEREYEEKGRAWWPVAMKIS

SEQ ID NO: 156944 - protein, 60 aa, Glycine max
  Coding DNA Sequence Number=SeqID_65259
MDAQFAGMDTHITKLEEDGEIVEAMSFKIILMVPKNQESSKFHRIKIKIQVLRIKIKIQE

SEQ ID NO: 156945 - protein, 26 aa, Glycine max
  Coding DNA Sequence Number=SeqID_65260
MAKVDLSKNGKNYVCENRHFNLSPTN

SEQ ID NO: 156946 - protein, 136 aa, Glycine max
  Coding DNA Sequence Number=SeqID_65261
  Gene Ontology: Cellular component=anchored to membrane
  Homolog annotation: Hit_ID=Q9LXQ2; Match level="QueryCoverage=75%, HitCoverage=64%, E-value=1e-17, Identity=49%"; Hit description =Putative uncharacterized protein F26G5_50
  Pfam annotation: Domain name=E1_DerP2_DerF2; Domain location=27-132; Score=47.1; E_value=6e-11; Accession=PF02221.6; Description=ML domain
MEFQFLPRFYLLVSLSILFLAPFHAQAKIKVTYCDKKADYAVKVSGVEISPNPVVSGQAATFKISATSGKAIYGGEVVIGVSYVGVPVHTERIDLCEEVTCPVANGNFLISHTQTLPAITPPLPLTSFKGPLSLDT

SEQ ID NO: 156947 - protein, 89 aa, Glycine max
  Coding DNA Sequence Number=SeqID_65262
MWHVNKHNGRLAINMVLMDHTEVNRSEIPDNIHVINEFANIISSIASRDTLVDVVNVVAEVIERKTVNPVYKVTVKLRDNNDAEIIMTV

SEQ ID NO: 156948 - protein, 285 aa, Glycine max
  Coding DNA Sequence Number=SeqID_65263
  Homolog annotation: Hit_ID=A7QTR6; Match level="QueryCoverage=55%, HitCoverage=37%, E-value=6e-21, Identity=38%"; Hit description =Chromosome undetermined scaffold_171, whole genome shotgun sequence
MVLPHFKHSRFKDDQHCSHRIAEVLDLDGKISPAQISNMLKRLGLVVAPRRKMCDADAKGPLSTSPNLLDGDKITGATNHKSVNLEGSLLVQHLFKDYRRCSYMIANALDKDGKFTTAQVSRKLKQLGLSLPLKSSGGKMHPKGADLMDRSNERMDESDDETLVSLGCFSLTNTTIGIDVPARTMQTRRECHYVNAEYLLSELEEIGSSPENLKKESANWNKTQGDEEIGSSPAKVWTQDIKNKLDDVIKGIAPTSGSNSDKDDHKKKLVLDGDLERQIKDLHEK

SEQ ID NO: 156949 - protein, 47 aa, Glycine max
  Coding DNA Sequence Number=SeqID_65264
MEARGLHAPKNARVEGRSPEFQEPLDLRSNLFQGGGNDAILPSKDIG

SEQ ID NO: 156950 - protein, 123 aa, Glycine max
  Coding DNA Sequence Number=SeqID_65265
MSGNFTDYVIIPSLAFEMFWNFTDCATMLPFDFRHVTKLHRLPNDGCQVPRSGQTRVASQQTDGPRMKLGYDRWHKVQLAICWRSRQRFGVVMVIKVLALMGSIFNSQGVLGIFKAKDLLYGA

SEQ ID NO: 156951 - protein, 214 aa, Glycine max
  Coding DNA Sequence Number=SeqID_65266
MCPRWKWRRKSFQPGGPAKTPLERVLVQPHRQMWTLIDTLKAEEGVRDKRSWVRGQWIPFDEDAINQFLGHPPILKEGQHCEFSQRRSQASSFDEDVVSHLMCVPGQDFSWSIAGRQVRIMHTNVGSGTPTAKGGPATADCRCATAASRGGTISEQSQDPGPFPWPTPEHFGAILAWPRDKTDFETRAGPAGALGDGGGAKEDDDMADVLDFFT

SEQ ID NO: 156952 - protein, 477 aa, Glycine max
  Coding DNA Sequence Number=SeqID_65267
  Homolog annotation: Hit_ID=Q6WAY6; Match level="QueryCoverage=68%, HitCoverage=69%, E-value=1e-20, Identity=25%"; Hit description =Putative uncharacterized protein
MARMAKVVKISEHELDRLKQNRNEVVGIPRKRLEEKAKALANQREWTSFIDILALLVFGTILFPNVDDLVDLAAINAYLAYHHSKESPVIVVLEDTYDTLDLRSVYPLQGHRMCPKNRKANWEELLAGFPKIPLMGTRGCINYNPMLAIRQLGYPMRGALSEEIIAPFVAQAWNIVERKDKELRGSSNGAINSYHKWLKSRTQEINWLPKLKGLSGKEAEVPEESKEVQALKVELEKTRVVKEKLKTEVTRVKKECDVLRDVNMTTVKALDNELKLRKAERDKSREESMVLEDKLKAYQRLKRSLTKQLRRTKENMLTIIDQYKEKVNQLLVIGKSWRKNMRRYRLCKWKREARERVIESLHGEAMRWMDKFALTLNKSEELPRLLAKAKAMANTYSAPDEVHGLFDYCQHMEVPEQMNADMEAMKDQMATMMEAMLTMKKIMESNAAAVATTNAAAKVDLTHPFGINQMSHPVPDV

SEQ ID NO: 156953 - protein, 258 aa, Glycine max
  Coding DNA Sequence Number=SeqID_65268
  Homolog annotation: Hit_ID=Q949K7; Match level="QueryCoverage=13%, HitCoverage=40%, E-value=9e-08, Identity=72%"; Hit description =Putative gag polyprotein
MGEIEEVQEWMKADMEAMKEKMATMMEAMMCMKKIIEVNTAAVAATSIIAEVDPTPPSGLNQINHPTSDMVGQGGKELGSTGGPHFVQVQNKHVFLPYDLPPNYTPPNVAHTPNENVNNSTPILIESQRPQFDHAHIPQPMGETHKIPHHNLVDFEPHLGYATEGQVVGGVPLPNTLEGPQFRPQPQPLHFAVGRIPPAMVEKGKIGGGRDHAFANMAELYLVPDVVIPSKLKVLDFDKYKGTTCRKNHLKLYNRKMG

SEQ ID NO: 156954 - protein, 84 aa, Glycine max
  Coding DNA Sequence Number=SeqID_65269
MGKGRIKRILRLCFIEFFEKGEGRHKRIQAVSPLFFWKREKRDTKRIQAKTLKGFWQRKKKKKFKEIQKSIRKVIEKQVKLLHL

SEQ ID NO: 156955 - protein, 288 aa, Glycine max
  Coding DNA Sequence Number=SeqID_65270
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=64%, HitCoverage=57%, E-value=3e-25, Identity=38%"; Hit description =Similarity to MADS-box DNA-binding protein
  Pfam annotation: Domain name=SRF-TF; Domain location=198-239; Score =2.1; E_value=0.26; Accession=PF00319.9; Description=SRF-type transcription factor (DNA-binding and dimerisation domain)
  Pfam annotation: Domain name=SRF-TF; Domain location=9-60; Score =38.9; E_value=1.8e-08; Accession=PF00319.9; Description=SRF-type transcription factor (DNA-binding and dimerisation domain)
  Pfam module annotation: Pfam domain module=SRF-TF::SRF-TF; Domain location=198-239::9-60
MARKKLRHTYINNPLKRKTTFKKRKNGFLKKVDEITTLSDIRACAIIYTLDEPEPKVWPSNQGLESVISRFRGVSELAQSKRMLCQENLLKRNIMKAQGKLMNEIKKKEIGLFMCQYFASWNNLDNANIIDQNDITLLANKKLEITKKNEILQVQEVTPAIENGGETMTEGEQTLVANVDAMPNLNWSNDNIDDGDGDGIDVKIGRCLLKKVGEITTLCDIQACAIIYTPDEPKAEVTPAIENGGETMTEREQALVDNMDVMPNLNWSNDNINVVGEYWVYLNIGRCY

SEQ ID NO: 156956 - protein, 128 aa, Glycine max
  Coding DNA Sequence Number=SeqID_65271
MRSFNCDFPPWRCSGRQRRRGERRRHPLGNKPWKKELHHQDEPWIRSSEGCFNGGKERGRERERGEHEIEGMKEGEKWNFEIGCISCGSVQVKGTSTWLFKENKGGYIPCGSLACKGFYKIERNLKNR

SEQ ID NO: 156957 - protein, 111 aa, Glycine max
  Coding DNA Sequence Number=SeqID_65272
  Homolog annotation: Hit_ID=Q2HW87; Match level="QueryCoverage=80%, HitCoverage=9%, E-value=3e-07, Identity=34%"; Hit description=RNA -directed DNA polymerase (Reverse transcriptase); Zinc finger, CCHC -type; Peptidase ...
  Homolog annotation: Hit description=aspartic, active site; Retrotransposon gag protein
YWPQYQDARNEEDLCAQFENGLRLEIQQAVSYMQITDFNQLVTKCRIFEDKMKERQARGVGGPQRNHPFRGNSNKRMKPYASNKGKQPMATSNMSKSTLWTPLLWMTLCIL

SEQ ID NO: 156958 - protein, 781 aa, Glycine max
  Coding DNA Sequence Number=SeqID_65273
  Gene Ontology: Mol. function=phosphoprotein phosphatase activity; Cellular component=nucleus; Biological process=termination of RNA polymerase II transcription, poly(A)-independent
  Homolog annotation: Hit_ID=A7QVR2; Match level="QueryCoverage=91%, HitCoverage=68%, E-value=0.0, Identity=78%"; Hit description =Serine/threonine protein phosphatase
  Pfam annotation: Domain name=Kelch_1; Domain location=221-269; Score =2.8; E_value=1.4; Accession=PF01344.16; Description=Kelch motif
  Pfam annotation: Domain name=Kelch_1; Domain location=274-322; Score =13.9; E_value=0.066; Accession=PF01344.16; Description=Kelch motif
  Pfam annotation: Domain name=Kelch_1; Domain location=328-377; Score =0.9; E_value=2.4; Accession=PF01344.16; Description=Kelch motif
  Pfam annotation: Domain name=Kelch_1; Domain location=380-429; Score =10.0; E_value=0.2; Accession=PF01344.16; Description=Kelch motif
  Pfam annotation: Domain name=Kelch_1; Domain location=452-498; Score =8.4; E_value=0.3; Accession=PF01344.16; Description=Kelch motif
  Pfam annotation: Domain name=Kelch_2; Domain location=164-216; Score =1.7; E_value=29; Accession=PF07646.6; Description=Kelch motif
  Pfam annotation: Domain name=Kelch_2; Domain location=221-269; Score =8.0; E_value=4.8; Accession=PF07646.6; Description=Kelch motif
  Pfam annotation: Domain name=Kelch_2; Domain location=274-322; Score =8.2; E_value=4.6; Accession=PF07646.6; Description=Kelch motif
  Pfam annotation: Domain name=Kelch_2; Domain location=328-375; Score =15.2; E_value=0.24; Accession=PF07646.6; Description=Kelch motif
  Pfam annotation: Domain name=Kelch_2; Domain location=380-429; Score =40.7; E_value=5.2e-09; Accession=PF07646.6; Description=Kelch motif
  Pfam annotation: Domain name=Kelch_2; Domain location=452-497; Score =7.2; E_value=6; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch _2::Kelch_2; Domain location=221-269::274-322::328-377::380-429::452 -498::164-216::221-269:...
  Pfam module annotation: Domain location=:274-322::328-375::380 -429::452-497
MDVDSSMVPEPDHDPPVQNHAERDQLGDSPSPSLSEGGGSLAQSPPQQQQQQQQQPPPATAAQVHQPNSLVGPRLAPTYSVVNAILEKKEDGPGPRCGHTLTAVAAVGEEGTSGYIGPRLILFGGATALEGNSAASGTPSSAGNAGIQFYFHYHLCLTHRLGWANEPHSFALDYGILCLSEALKLRYFKKGLAGATADVHCYDVISNKWSRITPIGEPPTPRAAHVATAVGTMVVIQGGIGPAGLSAEDLHVLDLTQQRPRWHRVGVPGPGPGPRYGHVMALVGQRYLMAIGGNDGKRPLADVWALDTAAKPYEWRKLEPEGEGPPPCMYATASARSDGLLLLCGGRDANSVPLSSAYGLAKHRDGRWEWAIAPGVSPSPRYQHAAVFVNARLHVSGGALGGGRMVEDSSSVAVLDTAAGVWCDTKSVVTSPRTGRYSADAAGGDAAVELTRRCRHAAAAIGDLIFIYGGLRGGVLLDDLLVAEDLAAAETTTAASHAAAAAAASNVQAGRLPGRYGFIDDRTRQTMPEAASDGSVVLGNPVAPPVNGDMYTDISTENALLPGTRRTSKGVEYLVEASAAEAEAISATLAAAKARQVNGEVELPDRDRGAEATPSGKQISSLIKPDSAGSNSIPPGGVRLHHRAVVVAAETGGALGGMVRQLSIDQFENEGRRVSYGTPESATAARKLLDRQMSINSVPKKVVAHLLKPRGWKPPVRRQFFLDCNEIADLCDSAERIFSSEPSVLQLRAPIKIFGDLHGQFGDLMRLFEEYGAPSTAGDIA

SEQ ID NO: 156959 - protein, 120 aa, Glycine max
  Coding DNA Sequence Number=SeqID_65274
MLGKLGRIDGDLVLRETRIWATWEYVSSVGGGQQGMVEWYLEICCEGQETLGTSGGVLLPKTKLDQSRPNPSIVSHQQIKGTKTTKQGGLWWLASCESCVIYGLWPLLIDYQGWVIDYKA

SEQ ID NO: 156960 - protein, 224 aa, Glycine max
  Coding DNA Sequence Number=SeqID_65275
MHEHPLILLVKKNLQDDSLIIEETEVNSKFEKVLEAFNEMHEETQRLAISNYKLRSDLKWHITKLASTQSELVKLKHESEKLVSSYKAIGCVCVSNSLNMDDYKSLPNEFEKFKKDYYEELIKLQTEFSYLKYLFRKMNKEKNDLSHFLSVQKHTTSKTGLGYNKQTKFFKKTKFASSKKVNPNRVSKKKNIMYPKLDAKTYHCCMKRGHTSCKCYVRRFDVLR

SEQ ID NO: 156961 - protein, 51 aa, Glycine max
  Coding DNA Sequence Number=SeqID_65276
MPPSDVALSPLATDNANDGKKNSQEHWGFRLFSLSVVMRMLFTFAPVDVPH

SEQ ID NO: 156962 - protein, 120 aa, Glycine max
  Coding DNA Sequence Number=SeqID_65277
  Homolog annotation: Hit_ID=Q2HPL4; Match level="QueryCoverage=68%, HitCoverage=32%, E-value=1e-28, Identity=74%"; Hit description=Expp1 protein precursor
MALKRALWLMLLLLSVAAAATNTNNVYQPCADARIQRSDGFTFGIAFSSRDSFFYNQNQSLQLSPCDRRLSLSFSNSQLALFRPRVDEISLLTINTSSFFPNMGIMGLWFLFIGCTICAG

SEQ ID NO: 156963 - protein, 114 aa, Glycine max
  Coding DNA Sequence Number=SeqID_65278
MKAAMKVAMSNDGSNEGCDRSPNLSHKNDDLGLIHRWIVVKFKQHVCNPFPSILTVGNFDIMSDLREIPLMEKQESHKDSPNGGFNHFSVPLTFGNSIGAFGGKTRGILGNHWR

SEQ ID NO: 156964 - protein, 115 aa, Glycine max
  Coding DNA Sequence Number=SeqID_65279
MISHPVNETLRIDGRDINSGCSENRGGNDGVNDNGGAMVVVVTMTTTMLVALVVVVVGGDGGDRGSGGCDSNVGDGDEVTGSIGGGGSSGGNDDSSVSGGSNVSGDDNCGIDGGN

SEQ ID NO: 156965 - protein, 182 aa, Glycine max
  Coding DNA Sequence Number=SeqID_65280
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
  Subcellular localization annotation: CTP_CleavageSite=31; ConfidenceScore=5.11e-01
AQYANRLSPRVGRFINAAGTTGFPTGKRAVSATQLMNLTEDKVTRILAPHAANTGLMNLDLSNYTNAVSQQPKVTLETSPVSTSDHLQEAEHHWSMVKKLGMTCDMNHDSIIESFRALENRDRKEAENLGMQAWHWPSFYNVVTGKTLALPNLIALQHIPLSPAGVIAKRPAPIALPNSCAA

SEQ ID NO: 156966 - protein, 194 aa, Glycine max
  Coding DNA Sequence Number=SeqID_65281
  Gene Ontology: Mol. function=transporter activity; Cellular component= integral to membrane; Biological process=transport
  Homolog annotation: Hit_ID=A1TK72; Match level="QueryCoverage=70%, HitCoverage=24%, E-value=3e-49, Identity=69%"; Hit description =Putative uncharacterized protein
MEKPKAEILTTCAKIFAKPCRQKSLYKLADFFRYLLTGELRIVLSSHTDRNSLMNQPNPQTARSGAFSPFAYGLFAVIWTASVLGNTGSFIRDVASAWLITGLSDNPTAVALMQTAATLPVFLLALPAGVLSDIVDRRRLLIVVQLLMASVSGTLLLLSHNHWLTVEWLIGLTFVGGVGAALFGPAWQAIVPEL

SEQ ID NO: 156967 - protein, 466 aa, Glycine max
  Coding DNA Sequence Number=SeqID_65282
  Gene Ontology: Mol. function=carboxymethylenebutenolidase activity; Cellular component=integral to membrane
  Homolog annotation: Hit_ID=A4WED9; Match level="QueryCoverage=59%, HitCoverage=99%, E-value=1e-108, Identity=65%"; Hit description =Carboxymethylenebutenolidase
  Pfam annotation: Domain name=DLH; Domain location=271-464; Score =147.2; E_value=4.6e-41; Accession=PF01738.9; Description =Dienelactone hydrolase family
MPRARRANKEGTGEEGRHRHMEQAVRERRVEDNLKPVLRHHDAILNDVALRGMHPAVGREDPEGRDDGTERNHAGGKEVQARPNAVPAKQHHAEEARFKEEGGEHFIRQQRTGNTAGKLREAAPVGTKLVRHHQSGHHAHAEVNGKDFGPEMVEIAIGLVTGFQPHAFEHRQETGETDVRLISEGEVMTRLTAQDFPQELLELYDYYAHGRISKREFLSLAAKFTIAGMTGATLLSAMSPNYALAEQVSFTDPDINAEYIHYPSPQGHGEVRAYRVRPTHASGKLGAVVVVHENRGLNPYIEDVARRVAKAGYVALAPDGLSQSRPGQTDERFLRGGRFPDAASRGERQVGITGFCYGGGVANAAAVAFPELACAVPFYGRQPKAEDVARIQAPLLLHYAALDKGINEGWPAYEAALQASHKTYEAYIYPGVNHGFHNDSTPRYDKAAADLAWGRTLGWFEKYLHA

SEQ ID NO: 156968 - protein, 614 aa, Glycine max
  Coding DNA Sequence Number=SeqID_65283
  Gene Ontology: Mol. function=transcription factor activity; Cellular component=cytoplasm; Biological process=regulation of transcription, DNA-dependent
  Homolog annotation: Hit_ID=A7MIL0; Match level="QueryCoverage=43%, HitCoverage=88%, E-value=1e-122, Identity=80%"; Hit description =Putative uncharacterized protein
  Pfam annotation: Domain name=HTH_1; Domain location=351-410; Score =78.0; E_value=3.2e-20; Accession=PF00126.18; Description=Bacterial regulatory helix-turn-helix protein, lysR family
  Pfam annotation: Domain name=LysR_substrate; Domain location=433-614; Score=-10.5; E_value=0.019; Accession=PF03466.11; Description=LysR substrate binding domain
  Pfam annotation: Domain name=Na_H_Exchanger; Domain location=2-352; Score=-89.7; E_value=0.026; Accession=PF00999.12; Description =Sodiumhydrogen exchanger family
  Pfam annotation: Domain name=Na_H_antiport_1; Domain location=1-354; Score=655.0; E_value=6e-194; Accession=PF06965.3; Description=Na+H+ antiporter 1
  Pfam module annotation: Pfam domain module=HTH_1::LysR_substrate::Na _H_Exchanger::Na_H_antiport_1; Domain location=351-410::433-614::2 -352::1-354
MVLANNAATAQGYQNLLAEPVQIRFGALDISKNLLLWINDALMALFFLLIGLEVKRELISGELASRDRAIFPVIAALGGMIAPALIFLLFNHDNEVARNGWAIPTATDIAFALGVLALLGSRVPAALKVFLMALAIIDDLGAIVIIALFYTSDLSVLSLSVAAGAIVLLAILNRCGVRNIAVYMLVGVVLWTAVLKSGVHATLAGVVVGFFVPLEEKEGHSPAEHLAHGLMPWVNWLILPLFAFANAGISLSGITFGDVLSPEPLGIILGLLIGKPLGITLFCWLAVKLRLAALPGSTTIRDIMAIGVLCGIGFTMSIFISSLAFDAAHEQLVTFSKLGILSGSLLSALNFNHLYYFWQVCKTGSVVRAAEVLCLTPQTVTGQIKALEEQLNGVLFRRQGRGLVPTELGQLVFRYADRMFMLSQEMLDIVNYRKESHLLFDVGVADALSKQLVSKVLETVVMAGEKIQLRCFESTHEMLLEQLSQHKLDMILSDCPIDSTQQAGLFSVKLGECPVSFWCNAPRPELPFPACLEQRRLLLPGRHSMLGRKLLNWIHTQGLQVEILGEFDDAALMKAFGAQNNAIFVAPTLYGDDVYRDDSVREIGRLETVMEEYH

SEQ ID NO: 156969 - protein, 90 aa, Glycine max
  Coding DNA Sequence Number=SeqID_65284
MYAVIQEKEKLSAERQPSLITSLVKVLRIQVCVFLTVCDREALVDDPSLISVIPTNLSQLCFLIIMFMSSKNCMSCEKLLMEALIAIHVM

SEQ ID NO: 156970 - protein, 156 aa, Glycine max
  Coding DNA Sequence Number=SeqID_65285
  Pfam annotation: Domain name=G-patch; Domain location=46-90; Score =8.4; E_value=0.018; Accession=PF01585.14; Description=G-patch domain
MLVTCPSSAPYVEVEEESLETTFQSFEVVSCASVETSLLLPCLSNAALMVARVRLRHGNEPGMGLGKDSHGNADVVDIRGNPYKYGLGYEPGKPGRRNAPSRLQADRAWPGLVSQCFTSARIMFEVKVAVIGEELHKIRQVSWDRAIPIPKWGTGA

SEQ ID NO: 156971 - protein, 155 aa, Glycine max
  Coding DNA Sequence Number=SeqID_65286
MERSMINATSGGALGDMTPAEARNLIEKMASNSQQFSARNYVIVLRGVHEQSGVNEQPKAYDANIYNRPPQQQNQQQQNNYDISSNRYNPGWRNHPNLRWASPPQQHQSVPPFQNVVGPSKPYVPPPMQQQQQQSQQRQQATEAPPQPSLEELVR

SEQ ID NO: 156972 - protein, 240 aa, Glycine max
  Coding DNA Sequence Number=SeqID_65287
MENGELANTVRQSIDGAPDSMAINSRGSILDGGGCMNSARQSIHGSPNKIENGELANGARKSIRDARDTMAINSWGSRLDGGGHMNSARQSIHGSPNKIENGELGNRARQSIRGAPDSMRYAINSRGSRLDGGGHINSARQSIHRSLHKIENGELANSAKQLDGGGRMNSARQSIHGSLNKIENGELGNRARQSIRGAPDSIVEDASTAPGNQCMGLRIRLEIGDLANSARQSIRGSPDS

SEQ ID NO: 156973 - protein, 64 aa, Glycine max
  Coding DNA Sequence Number=SeqID_65288
  Homolog annotation: Hit_ID=A7Q538; Match level="QueryCoverage=89%, HitCoverage=14%, E-value=8e-08, Identity=45%"; Hit description =Chromosome undetermined scaffold_51, whole genome shotgun sequence
YDLKAKNIITSALGIDEYFRVSSCTNAKDMWDTLQLTHEGTTDAKRSRINTLTHEYESPYDEPK

SEQ ID NO: 156974 - protein, 152 aa, Glycine max
  Coding DNA Sequence Number=SeqID_65289
MSKSCGFGMTGPLDESISCFLIRVDPWVLVPITLRGLHVLAIRGLHALTSRGLPVLALRGLHVLTIRGLHALTSRGLHVLALRGLHALTLGTSYPHRQRTTRPRLERTTRPHHQRAARPYLQRTTCPRLERATRPHLGYYLPSPSEDYTSSP

SEQ ID NO: 156975 - protein, 89 aa, Glycine max
  Coding DNA Sequence Number=SeqID_65290
MGSGRFQVSIPGGSCPSKTFLEEILRLLAFNEYGRRVIDILTGSVCHIGWCIVERQVIWWEGMLVFALKGAPPVLPNSLPSRPTISEVG

SEQ ID NO: 156976 - protein, 88 aa, Glycine max
  Coding DNA Sequence Number=SeqID_65291
MSPVESPTVATCPFAGERTRGSRVCFPKEERCTESPPTFICGKRRKNRRKPVEMEILSSGVVFMFEEGRQKRGSCSYVPFIEEEIRPT

SEQ ID NO: 156977 - protein, 86 aa, Glycine max
  Coding DNA Sequence Number=SeqID_65292
REGEFGRASASRPRAKHEINVLSVGGVFSQAQHVCTLFQSAYFGKRALEAERGATCALKSGFCNLIEISSLESECEMLRRGGGILL

SEQ ID NO: 156978 - protein, 43 aa, Glycine max
  Coding DNA Sequence Number=SeqID_65293
MGDRHRLKGALKPVIEFVRFPQWIPSQCSSLINSLPLKGLTVV

SEQ ID NO: 156979 - protein, 291 aa, Glycine max
  Coding DNA Sequence Number=SeqID_65294
MRSWVRGQWISFNPDALSQFLGDPLVLEEGQECEFSQRRNRADEFDEEAFAQLLCISGQDFSRTAAGRWVRIMCTSTTTSTQMWMTLLLSNVLPSDHNSDLPLPKCQLVYAILTRMSVHVAQLIADAIYLFAGMPPTRHPLDPDMSNRALGFPALITSLCQSFGVPVTPSKVIRPPITLAFIEKYCTPRQAQGDAPQATDAPPPPHQADPAGSFGMERGQVQIDECLYQLSLSQQSHGFAPFAFPTPDQFRAEVAWLGDWPEAQAGEAPAEAPSDAEEARMDEEMTDLLGF

SEQ ID NO: 156980 - protein, 52 aa, Glycine max
  Coding DNA Sequence Number=SeqID_65295
MKVFRRSSPFFIHSSFVLRSSTVLEELRRSDFLTTIEEYVGARETPLSTTKR

SEQ ID NO: 156981 - protein, 59 aa, Glycine max
  Coding DNA Sequence Number=SeqID_65296
TYQGNSCGVYPDLSSFTGSGVYPDLSSLFGSGIIQISVACIKRSAPSQVHIIWYQSFGS

SEQ ID NO: 156982 - protein, 232 aa, Glycine max
  Coding DNA Sequence Number=SeqID_65297
  Gene Ontology: Mol. function=aspartic-type endopeptidase activity; Cellular component=integral to membrane; Biological process =cytochrome complex assembly
  Homolog annotation: Hit_ID=Q945B8; Match level="QueryCoverage=100%, HitCoverage=32%, E-value=3e-60, Identity=53%"; Hit description =Growth-on protein GRO10
  Pfam annotation: Domain name=Peptidase_A22B; Domain location=59-230; Score=-144.5; E_value=0.015; Accession=PF04258.4; Description=Signal peptide peptidase
LYSPLRPAVDVAEVFLWMMAVLTILCASYWSAWTTREAAIEHDKLLKDASDELPNTKYASVSGVVNMNVKATVLFVVFASCFLFMLYKLMSSWFIDVLVVLFCIGGIEGLQTCLVALLSRASPGAAVKLCLGDLLVMGSNPETASLHMQGASPGAAVKLCLSDLLVMGSNPETASLHMQGWFKHAGESYIKVPFLGAISYLTLAVSPFCITFSILWAVYRNESFAWIGQDIL

SEQ ID NO: 156983 - protein, 80 aa, Glycine max
  Coding DNA Sequence Number=SeqID_65298
VKDVNSYLSQRALRGRARARLTGALSKGGKMRGVATNEGISTSYVDKSGAFAPTYPPLERKSDLRSSSLYVNQVIPFYLK

SEQ ID NO: 156984 - protein, 285 aa, Glycine max
  Coding DNA Sequence Number=SeqID_65299
  Pfam annotation: Domain name=Transposase_23; Domain location=143-212; Score=-10.8; E_value=0.018; Accession=PF03017.5; Description =TNP1ENSPM transposase
MARTKKTGQMTSEAAKEIAEKILSHFQLRILTMFDSLEEQASQGSFIPHGRQDVLIAAIVRPDHPGHVHAVGAVTIKQYFGLAPRISRSSSFLLPEDLQQLTQQIKDQLEESITEKVTQQLMASFSQITKESYVDPSGNDPETGDSDKCRLYIEANPPRPVALGRVYEGSTVHNIPLLSSQVKVGVEEVRDAQALVPVSTDEVTLVGQALNTFLAWLTHLVKPLSEQAAVSLAKPPQRLDPEVNWDATVFGVFNPDFPLYIKHEDLSEITHGGQCLSISVLQLWI

SEQ ID NO: 156985 - protein, 58 aa, Glycine max
  Coding DNA Sequence Number=SeqID_65300
MGVQIAIRPTWAFQGLPTERRCLLVEATQLAWASWAATTTLFSPIIGEEGKTKSSTLL

SEQ ID NO: 156986 - protein, 107 aa, Glycine max
  Coding DNA Sequence Number=SeqID_65301
MFHLSYPNFVWGLSFVDLLILASRLTVLNASYSTKQGTIWCFAQEYKRYQERRAKGSFPCFFLGPSLPRPAFGSSGPPNNFNAKGLAHLGKLQLPQGGLLPKNRHPK

SEQ ID NO: 156987 - protein, 115 aa, Glycine max
  Coding DNA Sequence Number=SeqID_65302
MSILARKDDRSLRSKEEASPDDADRTFPNRHHQIVIQGLNRINNGRCQSLYDEDMTKSKGKDPLEGLGGPMTRARARKAKEALQQVLSILFEYKPKFQGEKSKVVSCIMAQMEED

SEQ ID NO: 156988 - protein, 196 aa, Glycine max
  Coding DNA Sequence Number=SeqID_65303
MADQGEWASFIDVLALLVFGVVLFPNVDGLVDLVAIDAFLAYHHNKESLIVVVLVDAYDTFGRRCEKSGARIVYCTPALYLWLVSHIFHHESRPTCFLQGHRMCAEKGKANWEQLLAGMVGASINWFLSQRALRGRARARLTGALSKGGKMRGVATKVDKSGAFAPTYPPSKRKSDLRSSFLCVNQVILLLEGRSF

SEQ ID NO: 156989 - protein, 113 aa, Glycine max
  Coding DNA Sequence Number=SeqID_65304
  Homolog annotation: Hit_ID=A0PAV3; Match level="QueryCoverage=24%, HitCoverage=14%, E-value=6e-07, Identity=89%"; Hit description =Restriction endonuclease
MEAITNGMMNLNRQRHQHLVALRIIFCPWVKTGAKKLSILATFKSKPETAGNRRGIHSRAMKTFQFAHGKRCNKVGTSYVPINVSFSPKVGPGLPGINRDTRIYLFCEVIFRH

SEQ ID NO: 156990 - protein, 79 aa, Glycine max
  Coding DNA Sequence Number=SeqID_65305
MYIVGLFAQVNYAPDLISKVMIKKTTIDTIEPYTGAIRGTMHEPQADLGADQKFSPGRLKTRKGGLGKIRVMKNKKKKE

SEQ ID NO: 156991 - protein, 95 aa, Glycine max
  Coding DNA Sequence Number=SeqID_65306
  Subcellular localization annotation: CTP_CleavageSite=53; ConfidenceScore=5.08e-01
MAFYRKLLLTRTHSGKISNIYFKDTTRFGASRGLSEKAQARLTGVLSKGGKMRGVATNEGISTSHVDKSGAFAPTYPPLERKSDLRSSFLRVNQV

SEQ ID NO: 156992 - protein, 57 aa, Glycine max
  Coding DNA Sequence Number=SeqID_65307
MMFYLSTWRTKISFSLDLVPVQASCKVHFPLSDSNDPPYYEPVHNCGHYRMFKLHQC

SEQ ID NO: 156993 - protein, 555 aa, Glycine max
  Coding DNA Sequence Number=SeqID_65308
  Gene Ontology: Mol. function=nucleoside-triphosphatase activity; Cellular component=DNA replication factor C complex; Biological process=defense response
  Homolog annotation: Hit_ID=Q9C587; Match level="QueryCoverage=95%, HitCoverage=55%, E-value=1e-145, Identity=53%"; Hit description =Replication factor C large subunit-like protein
  Pfam annotation: Domain name=AAA; Domain location=378-547; Score= -17.6; E_value=0.00067; Accession=PF00004.20; Description=ATPase family associated with various cellular activities (AAA)
  Pfam annotation: Domain name=BRCT; Domain location=186-263; Score =81.5; E_value=2.7e-21; Accession=PF00533.17; Description=BRCA1 C Terminus (BRCT) domain
  Pfam module annotation: Pfam domain module=AAA::BRCT; Domain location= 378-547::186-263
MSDIRKWFMKTHDKGNNAASSKPSSDKPQSEKTVAGGQESSGRRITSKYFNSNKQKGKDEKEKQELPAKRKNAKDSEEIHEDDGDDSVLPTNKKKLADTTPTKKLKSGSGRGIPKKSAVLEESDEDDDKDAVSAAKSAGRGGGGGGRGAPGRSTGGRGRGGGRGGFMNFGERKDPPHKGEKEVPEGAPDCLAGLTFVISGTLDSLEREEAEDLIKRHGGRVTGSVSKKTNYLLCDEDIGGRKSEKAKELGTSFLTEDGLFDMIRASKPAKASSQEDKKLVNKAVAVASQSKVSPKSQVKVPLSSRSPSKQAKPKTATTVQSSSMWTEKYRPKDPKDIIGNQSLVLQLRNWLKAWNEHFLDTGNKKQGKKQNDSGLKKAVLLSGTPGIGKTTSAKLVCQELGFQAIEVEIFLVKFICLEKVNASDSRGKADSKIEKGISGSKTNSVKELVTNEAIGVNMERSKHYKSVLIMDEVDGMSAGDRGGVADLIASIKISKIPIICICNDRYSQKLKSLVNYCLLLSFRKPTKQQVIPFYSPSPLTDGVYNLNNKFFRSRK

SEQ ID NO: 156994 - protein, 476 aa, Glycine max
  Coding DNA Sequence Number=SeqID_65309
  Gene Ontology: Mol. function=binding; Biological process=protein folding
  Homolog annotation: Hit_ID=A7PG97; Match level="QueryCoverage=99%, HitCoverage=78%, E-value=1e-145, Identity=57%"; Hit description =Chromosome chr6 scaffold_15, whole genome shotgun sequence
  Pfam annotation: Domain name=TPR_1; Domain location=52-85; Score =33.1; E_value=1e-06; Accession=PF00515.19; Description =Tetratricopeptide repeat
  Pfam annotation: Domain name=TPR_2; Domain location=52-85; Score =23.2; E_value=0.00095; Accession=PF07719.8; Description =Tetratricopeptide repeat
  Pfam module annotation: Pfam domain module=TPR_1::TPR_2; Domain location=52-85::52-85
AKENIKEVPSFQSRKLLLACSLNLMSCYLKTRQYNECVKEGSEVLAYDAKNLKALYRRGQAYKELGLLKDAVSDLSMALEVSPDDDTIAELLRDAKEKLAMDGGEHAPGRLVIEEITEDVPSGSSSLEQTVVQPKKSGDSSKSYSTANNGNPKTNADSLDALKKDPEAVRSFQNFISNTDPDMLASLNAGQFKDVSPDMIKTTSDMVSKMSPEELQRMLDMASSFQGDNPFFRGGSPDSSFNPGSMPPNVTPDMFKAASDMISKMPADELKRMFEMASSLKGKESTPLAAAVDENERNVSRSNLPSSSTNGTTAFGESSSHNVFSNMRNASQSNFPSSSTDLQEQMRNQMKDPAMRKMSLPLSKIDFSYSHCIFFWQVVQMFSSMVKNMSPEMMANMGEQFGVKLSPGEAAKAHQAMSSLSPESLDKMMLWADRIQRGVESARKTKNWLLGKPGMIFAIFMLILAVILHRLGFIGG

SEQ ID NO: 156995 - protein, 498 aa, Glycine max
  Coding DNA Sequence Number=SeqID_65310
  Gene Ontology: Cellular component=nucleus; Biological process=mitotic cell cycle
  Homolog annotation: Hit_ID=Q2HT10; Match level="QueryCoverage=95%, HitCoverage=66%, E-value=1e-137, Identity=54%"; Hit description =Barren
  Pfam annotation: Domain name=Barren; Domain location=2-498; Score= -49.5; E_value=3.5e-08; Accession=PF05786.5; Description=Barren protein
MMPDTTLDGVNIESRQEESRKETSKKLSPLSTLESSFEALNVKKFDGDLKSYSVSVTCLMRRGVEVVLKIAAFVVDPLYRQTTAKFDEGGAKGLLMNNLGVYGGCRVLFDSQEVPAKCMASQNQSDISDTIDLSFLKDCIDQMVLDMRVKDEISPSLRTIVNQFDESNRRPTDIQLQGPSSAEDLDNADNNENGFDREEYENCTAWSDDHDDQTVVADLDYNDADPSFSSYPQDNAEQFPSPETDMDDRFENVEGYLFLSLGFSSKQNAWAGPDHWKYRKSKGGVWMPDKDFNTYIFFSIQYEVHPTSEDGSTLKSRQPKSKRQTEVDLNFTDSLEKKVLDTFSPPKNPKLLLLPESRLPCNTKLPEDCHYQPEDLVKLFLLSNVKCLGRKANRFSDGSREQSNEYESFPSWDNGSVCGDDAGDYGGDLHSDMEDSNTLITQPRQVNKIEVQYDKTSKQVDVHALKITLWDHVQESVKLPLEMGTVSLLSNKSKKALK

SEQ ID NO: 156996 - protein, 123 aa, Glycine max
  Coding DNA Sequence Number=SeqID_65311
  Gene Ontology: Mol. function=cellulose synthase (UDP-forming) activity; Cellular component=membrane; Biological process=cellulose biosynthetic process
  Homolog annotation: Hit_ID=Q2HT17; Match level="QueryCoverage=69%, HitCoverage=10%, E-value=1e-19, Identity=56%"; Hit description =Cellulose synthase
MSRITPMNAGFCAFLSVLLKLFRISETVFDITKKDLPSAKDVGDDKDAGRYTFDESVVFLPGTTILLVQLTAMVIKLLGFQPPVATQSGKHGCGLGYNHIAILRRKQASLLQALEELLCFSFC

SEQ ID NO: 156997 - protein, 56 aa, Glycine max
  Coding DNA Sequence Number=SeqID_65312
MALASALYSASDELLDTVACLLDFHELNESPIRKENPCSWGSLDIPKNSNSNLLMS

SEQ ID NO: 156998 - protein, 291 aa, Glycine max
  Coding DNA Sequence Number=SeqID_65313
  Gene Ontology: Cellular component=integral to membrane
  Homolog annotation: Hit_ID=A7PX45; Match level="QueryCoverage=91%, HitCoverage=69%, E-value=1e-89, Identity=62%"; Hit description =Chromosome chr12 scaffold_36, whole genome shotgun sequence
  Pfam annotation: Domain name=C4dic_mal_tran; Domain location=46-290; Score=157.7; E_value=3.1e-44; Accession=PF03595.8; Description=C4 -dicarboxylate transportermalic acid transport protein
MGDNEKQHLQPHVELPIDVSVSKTQSNCKPQIQIQSLSSILTQFHAGYFRISLSLASQAVLLKILIEPIQDAHALRRLFSSIPSSVHTLLWFLALFTVATLSFLYILKCLLHFDMIKDEFLSHVGVNYLFIPWISWLLLLESSPFLSPTKLYYKVLWWVFVSPLVMLDVKIYGQWFTKGKRFLSIGANPTSQLSVIGNLVGAQAAAQMGWKESALCMFSLGITHYLVLFVTLYQRLAGNNSVPSMLRPVFFLFFAAHSMASLAWNSICGKFDTTCKMLFFLSFFLFMSLVI

SEQ ID NO: 156999 - protein, 71 aa, Glycine max
  Coding DNA Sequence Number=SeqID_65314
MVESALTRASFCTVTADQWEKLARLHSQQLQLLLHVSNKKNKTKTSYTLKEEISRASDIYKGRNETGQSYV

SEQ ID NO: 157000 - protein, 383 aa, Glycine max
  Coding DNA Sequence Number=SeqID_65315
  Homolog annotation: Hit_ID=A7PXJ1; Match level="QueryCoverage=80%, HitCoverage=80%, E-value=7e-57, Identity=42%"; Hit description =Chromosome chr12 scaffold_36, whole genome shotgun sequence
MELILFLLADTSGYGRRDYLDNDLRDKLDRRHVSPRRERYAHAALPNDFAPAVFLMFHELKIAEYSPTRSLEKKSDRRYRRKQDITGQSDVSGNLKVSDRVQDRVKEGKLLSSGSRNNLEEKLKKVDSDISTLQNRKFQLEKCIFLKVFLDENVQEVDSLNSRIRELEGQLSKEDEECKRSQVRLQRFGDQLFSDISRIGANEEDLSIDILSNGENTGLHPIAKHNVEQNDASFHRRRLHIECDALEELKQDRSKDGHLVETARTRKRSRWNLSDQLNEDSLGTPDNGTEVTRSLDLEGKHKKGLKQPRIEAPSTSMAAHVVDEDVDIERYDGNDIYETANTENYNGAAYKVKGAPLMLPPALIPRSNYSQYEGNDENVDVDG

SEQ ID NO: 157001 - protein, 129 aa, Glycine max
  Coding DNA Sequence Number=SeqID_65316
MIESFQQQQQMSILELYAEKDVAGGSMFHAANSVTSCGRNVSHHESELPRNICNLHDDEDDDDDYLASNPNIEESFDEDDSVDGISDTNDEVTNIVEPVSIVHPTEARFLPLTMTTPSMSPTFSPLTMA

SEQ ID NO: 157002 - protein, 232 aa, Glycine max
  Coding DNA Sequence Number=SeqID_65317
  Gene Ontology: Mol. function=succinate dehydrogenase activity; Cellular component=membrane; Biological process=tricarboxylic acid cycle
  Homolog annotation: Hit_ID=Q94FP3; Match level="QueryCoverage=54%, HitCoverage=80%, E-value=9e-51, Identity=81%"; Hit description =Succinate dehydrogenase subunit 3
  Subcellular localization annotation: CTP_CleavageSite=69; ConfidenceScore=5.59e-01
MSWLLRSTKSKFLSSSSSSSLSRTFPSLPRPQIGAISPLPDLFHRNTATMPFAKENASGGNLTGLPKVPANKLGSDSDATNSSRYKASGLNTNVLAGARYVSRVWAAQGQMPLGVNTVMARSFERSMEAGTLGMIGHKRFMSDIPSKTSETNPSGFRPLSPHLPLYQPQLSSTLSIFNRIAGAFLAAVPEFLFWNGYSRIAILKHLFGNDYSKIEPLCMTEMERKLLEFQGG

SEQ ID NO: 157003 - protein, 202 aa, Glycine max
  Coding DNA Sequence Number=SeqID_65318
  Gene Ontology: Mol. function=aspartic-type endopeptidase activity; Cellular component=membrane; Biological process=RNA-dependent DNA replication
  Homolog annotation: Hit_ID=Q8LPI3; Match level="QueryCoverage=91%, HitCoverage=36%, E-value=2e-69, Identity=69%"; Hit description =Integral membrane protein, putative
  Pfam annotation: Domain name=MatE; Domain location=1-143; Score=85.3; E_value=2e-22; Accession=PF01554.9; Description=MatE
  Subcellular localization annotation: CTP_CleavageSite=36; ConfidenceScore=5.57e-01
MWFMYPYVSHSNYCSTTFSGWVFMISVGFNAAASVRVSNELGARNPKSASFSVMVVTLISFIISVIVALVVLAIRDIISYAFTDGEEVAAAVSDLCPLLALSIVLNGIQPVLSGVAVGCGWQTFVAYVNVGCYYGIGIPLGSVLGFYFKLSAKGIWLGMLGGTVLQTIILVWVTFRTDWNNEVEEAAKRLNKWENKTEPLVN

SEQ ID NO: 157004 - protein, 394 aa, Glycine max
  Coding DNA Sequence Number=SeqID_65319
  Homolog annotation: Hit_ID=A7P5Q0; Match level="QueryCoverage=81%, HitCoverage=93%, E-value=2e-49, Identity=33%"; Hit description =Chromosome chr4 scaffold_6, whole genome shotgun sequence
  Pfam annotation: Domain name=DUF247; Domain location=22-336; Score =283.3; E_value=4.8e-82; Accession=PF03140.6; Description=Plant protein of unknown function
MAYKGDVVRINIEEMLEGAKAPVTTECCIYKVPLSIRRHNEEAYTPEVVSIGPFHHGHPHLQDMEKHKLFYSKAFLKRTQTTLYSFIGQIEEMEPEFRRCYSHTLEFSKEQLVKIIFVDCAFILELFYRFDSGERKEDIIRHFTDLIRTFHLQDPLPSRIDGKIIKHLPSATELSEAGLRFKVLESESCLLKLDFSGRVLEIPQLVVEDPTETLFRNMVALEQCHYPFQSYITDYVCFLDFLVNTNRDVDILVQERVFINWLGDTDSVATMINGLMKDIATSNDTSSQYLDVCEKLNAFHKNPWRKLKSTLRRDYCRGPWQTAASTAAIILLILSFVQTVLSILQVLKQINLLVPPKITIAISGREEQKFQHNRIPIYSLIKREVKLGKLYHFL

SEQ ID NO: 157005 - protein, 82 aa, Glycine max
  Coding DNA Sequence Number=SeqID_65320
  Gene Ontology: Mol. function=nucleotide binding; Cellular component =intracellular; Biological process=small GTPase mediated signal transduction
  Homolog annotation: Hit_ID=A7PXH0; Match level="QueryCoverage=64%, HitCoverage=20%, E-value=5e-20, Identity=83%"; Hit description =Chromosome chr12 scaffold_36, whole genome shotgun sequence
MFDLTSRRTLNSVVGWYKEARKWNQTAIPVLIGTKFDDFIQLPIDLQWTIANENLQKSLSMKAQSTKIILTSCSLLNSRMCE

SEQ ID NO: 157006 - protein, 480 aa, Glycine max
  Coding DNA Sequence Number=SeqID_65321
  Homolog annotation: Hit_ID=A7P7S0; Match level="QueryCoverage=80%, HitCoverage=56%, E-value=9e-65, Identity=35%"; Hit description =Chromosome chr9 scaffold_7, whole genome shotgun sequence
  Pfam annotation: Domain name=DUF247; Domain location=22-404; Score =376.6; E_value=4.1e-110; Accession=PF03140.6; Description=Plant protein of unknown function
MAYSGDVVRINVAEMLEGAREPVTTECCIYKVPFSIRRHNEEAYTPKVVSIGPFHHRHPRLQDMQKHKLFYSMAFLQRTQTTSDSFIGKIEEMEPEFRRCYSHTLEFSKEQLVKIIFVDCAFILELFYRFGSGEWKEDMYLSKPLTRRSMRYDLLLLENQVPFFVLERLFNLSFSSQGDDFPSFLEFTFHFFGWFNRSSLNFNNINRIRHFTDLIRTFLLQDPLPSRIDGKMIKHLPSVTELSEAGLRFKVLESESCLLKFDFSGRVLEIPQLVVEDGTETLFRNMVALEQCHCPEESYITDYVGFLDFLVNTNRDVDILVQERVFLNWLGDTDSVATMINGLMKDIATPNNTSSQYFDVSEKLNAFHKNPWRKLKSTLRRDYCRGPWQTAASSAAIILLVLSFVQTVCSILQHAVRGIGGLASGEEEDTVEDAEEAPLEQGNAVVEPSPEGGGTAEFPIKSFNDFCANQQHYFNATVDR

SEQ ID NO: 157007 - protein, 209 aa, Glycine max
  Coding DNA Sequence Number=SeqID_65322
  Homolog annotation: Hit_ID=A7P7S0; Match level="QueryCoverage=65%, HitCoverage=19%, E-value=1e-24, Identity=40%"; Hit description =Chromosome chr9 scaffold_7, whole genome shotgun sequence
  Pfam annotation: Domain name=DUF247; Domain location=25-208; Score= -113.2; E_value=4.7e-05; Accession=PF03140.6; Description=Plant protein of unknown function
MAYDGDVVEINIEEMLKGAWAPVITECCIYKVPFSIRRHNEEAYTPKVISIGPFHHGHPRLRDMEEHKIYYSKAFLERSQTTLDSFIGWIDEMEPKFRRCYSHTLEFSKEQLVKIIFVDCAFILELFCRDHDQGLNQDVMCLSIPPLRDSIQYDLLLLENQHAVRGIGGLASGAEEDTVEDAEEEPPEQGNAVVEPSPEGGGTAEFRIK

SEQ ID NO: 157008 - protein, 182 aa, Glycine max
  Coding DNA Sequence Number=SeqID_65323
MKNFSNWILSVGDGSIGERNDEGGHRGVPAEGTRGTHLEPLIDALSVEAVAALRNAPYGLLGKILAQANRARALVAGPGQAFALSDHDLGPVAGLDGGLLHAQDHNARPIRGVTKTTIVIIIIIVVDAVVVTVASDDDDVGFDSDAGVGGEHDGGDEDQDAHGDGNAVAESLGGGDGGGWIA

SEQ ID NO: 157009 - protein, 158 aa, Glycine max
  Coding DNA Sequence Number=SeqID_65324
  Gene Ontology: Mol. function=methyltransferase activity
  Homolog annotation: Hit_ID=A0G0E0; Match level="QueryCoverage=94%, HitCoverage=64%, E-value=3e-43, Identity=60%"; Hit description =Dimethylmenaquinone methyltransferase
  Pfam annotation: Domain name=Methyltransf_6; Domain location=25-158; Score=56.2; E_value=1.1e-13; Accession=PF03737.6; Description =Demethylmenaquinone methyltransferase
MSVSANNLINRNIERVSALSVSQAAAFQAAILADVAGRRGTLHGRVKPLSPQMKVAGPAITVEVRPGDNLAIHAALAIAQPGDVLVVDGKGDISCALLGEIMATQAEASGIAGIIIDGAVRDADALAQGSYPVFAAGLNPSGPTKSIPGRVNHPVSVA

SEQ ID NO: 157010 - protein, 81 aa, Glycine max
  Coding DNA Sequence Number=SeqID_65325
MDNEEGVQEQMKADLSTLKDHMASITEAMLKLQKTIEDNATATASNTAREAESMLQPAINLGRDRNTTVFGRRLHSSYRSR

SEQ ID NO: 157011 - protein, 155 aa, Glycine max
  Coding DNA Sequence Number=SeqID_65326
  Gene Ontology: Mol. function=endonuclease activity
  Homolog annotation: Hit_ID=Q9AY32; Match level="QueryCoverage=40%, HitCoverage=95%, E-value=7e-27, Identity=96%"; Hit description=RRNA intron-encoded homing endonuclease
  Subcellular localization annotation: CTP_CleavageSite=62; ConfidenceScore=5.16e-01
MGGGAWPFLVGGAICLVSWTLGWVDRSASGVHRSARPFCRRCAPVLNWPGRASGAVTLKKLECSKQAYALRTTAKAFAKDVFINQERKLGARRRSDTVLVSTINDADQGSADVAFRTPLAPYEKSKSLGSGGSMVARLKLKGIDGRAPPGVEPAA

SEQ ID NO: 157012 - protein, 85 aa, Glycine max
  Coding DNA Sequence Number=SeqID_65327
  Subcellular localization annotation: CTP_CleavageSite=40; ConfidenceScore=5.45e-01
MQGYFMVTRTFHQPGSNEPVDTRRLTSSYAPFVVLTREVRANEPVDARRLTSSSAPFVVLTREVKTGGSSRSTCSHSSTRGKRDH

SEQ ID NO: 157013 - protein, 77 aa, Glycine max
  Coding DNA Sequence Number=SeqID_65328
SKKNVYTDNHSGISARQRDSNVSMTDLVSAEDDVNLRVSTGLLAAIDEGRMVSGFSSYRQQKVLKVRTTTWVSPHVM

SEQ ID NO: 157014 - protein, 70 aa, Glycine max
  Coding DNA Sequence Number=SeqID_65329
MVRWRTYNFKVDGEQREQESLDGEEDREKDKTTRRRRNIPRYGGEGEETMLECDEHDAQMQTGTISLDGD

SEQ ID NO: 157015 - protein, 224 aa, Glycine max
  Coding DNA Sequence Number=SeqID_65330
  Gene Ontology: Mol. function=enoyl-CoA hydratase activity; Cellular component=mitochondrial matrix; Biological process=fatty acid metabolic process
  Homolog annotation: Hit_ID=P76082; Match level="QueryCoverage=69%, HitCoverage=61%, E-value=2e-58, Identity=75%"; Hit description =Probable enoyl-CoA hydratase paaF
  Pfam annotation: Domain name=ECH; Domain location=23-189; Score =226.7; E_value=5.5e-65; Accession=PF00378.11; Description=Enoyl-CoA hydrataseisomerase family
MQSAAREGGHGDQLQPGAGRAGRRLTLNRPAARNALNNALLTQLAEQLETAAADTGVAVCVIYGNERCFAAGADLSEMAEKDLPATLNDIRPQLWARINAFPKPLIAAVNGFALGAGCELALLCDVVIAGDNARFGLPEITLGIMPGAGGTQRLIRCVGKSLASKMVLTGESISAEQALSAGLVSDVFPAALTLEYALKQASLMARHSPLALQAAKQALRQSQE

SEQ ID NO: 157016 - protein, 56 aa, Glycine max
  Coding DNA Sequence Number=SeqID_65331
MCGLAATLELDVWLVPMWVEGYVIKELCELLDVGLVRYQLMIPSLPFASQLVIYQG

SEQ ID NO: 157017 - protein, 117 aa, Glycine max
  Coding DNA Sequence Number=SeqID_65332
MRILICGKGKLSFGLARDISGFILLSFCFIGDTRDLELLKINIRVLGITTFTGLIVATYPSAEGRRVTRGMRVPRKEYARSRHQRLFEENVGKTGKDTIYELLSERFGSCIYARGRY

SEQ ID NO: 157018 - protein, 83 aa, Glycine max
  Coding DNA Sequence Number=SeqID_65333
MVSRGIIPFEEHTAAVGTTSNMESPTVATCPFAGGRRVTRGMRVPRKEYARSRHQRLFEENVGKTEGKPVQKENSKFGSCIYT

SEQ ID NO: 157019 - protein, 68 aa, Glycine max
  Coding DNA Sequence Number=SeqID_65334
  Subcellular localization annotation: CTP_CleavageSite=32; ConfidenceScore=5.50e-01
MGESDQTISTRVNHPNTLTVLQSPRPAAPTPSATRHGNSPRNSGIPAGTAPFGALRSWKNSSRGREWG

SEQ ID NO: 157020 - protein, 121 aa, Glycine max
  Coding DNA Sequence Number=SeqID_65335
MEAALLCIVMLFRYYDLLGSITLMMLASTLPKMLIVTPHIMSSQASNHSIREHLQLGKYVRRIDVFASIQVKSFAEVVDDTIVCRVIIDLTNISIMDKTGDTSNVVVVDEVEPHILDPASK

SEQ ID NO: 157021 - protein, 79 aa, Glycine max
  Coding DNA Sequence Number=SeqID_65336
IANETFSQSRPKDADISENGAGHLRVPKDSQVTIAKGGAIEKSEAFAPTYPQFVMRNSDLRDPIVPSSEDKDGNSHPGS

SEQ ID NO: 157022 - protein, 190 aa, Glycine max
  Coding DNA Sequence Number=SeqID_65337
DSGLISLGRLYEGSTTVHNIPLFHGQVKVGVKEVKDAEAPIPVPIDETIVSPAKPPESLDHEVDDPLYLMTLTIPQLFLKPFQVMWDAIVFGVFNQNFLLYIKHEDLSEIAHGGQCFSIFVIQLWILGHWQMVVILPKENLVVWFCSLHNRPDNYLKGIINSALKGLDDTPQPKSKAAARWIVVKAKRKH

SEQ ID NO: 157023 - protein, 60 aa, Glycine max
  Coding DNA Sequence Number=SeqID_65338
  Homolog annotation: Hit_ID=A7QR85; Match level="QueryCoverage=75%, HitCoverage=30%, E-value=1e-11, Identity=62%"; Hit description =Chromosome chr13 scaffold_149, whole genome shotgun sequence
MKTNKKCVCLILKDRDDPDLGLKINMTIAVGLPSLCKTPDNLSQCSDSLCYQFFRLFGGE

SEQ ID NO: 157024 - protein, 54 aa, Glycine max
  Coding DNA Sequence Number=SeqID_65339
  Gene Ontology: Mol. function=nucleic acid binding
  Homolog annotation: Hit_ID=Q6RZV4; Match level="QueryCoverage=92%, HitCoverage=23%, E-value=1e-09, Identity=62%"; Hit description =Retrotransposon-like protein
MVYSKRNVCLNARDSLWYLDSGDSRHMTTDKSKLSDFVSKDGGYVTFGDNNKGK

SEQ ID NO: 157025 - protein, 58 aa, Glycine max
  Coding DNA Sequence Number=SeqID_65340
  Subcellular localization annotation: CTP_CleavageSite=49; ConfidenceScore=5.41e-01
MTTPPRSPPPPPSTDAASHSPPTLKWTRKATRLRSLDTRPVGAERPLVYVDPVTGKAD

SEQ ID NO: 157026 - protein, 640 aa, Glycine max
  Coding DNA Sequence Number=SeqID_65341
  Gene Ontology: Mol. function=transporter activity; Cellular component= integral to membrane; Biological process=transport
  Homolog annotation: Hit_ID=Q5PFX2; Match level="QueryCoverage=57%, HitCoverage=88%, E-value=1e-179, Identity=82%"; Hit description =Putative metabolite transport protein
  Pfam annotation: Domain name=MFS_1; Domain location=7-323; Score =127.7; E_value=3.3e-35; Accession=PF07690.7; Description=Major Facilitator Superfamily
  Pfam annotation: Domain name=MFS_Mycoplasma; Domain location=102-334; Score=-148.2; E_value=0.028; Accession=PF07672.4; Description =Mycoplasma MFS transporter
  Pfam annotation: Domain name=Sugar_tr; Domain location=1-372; Score =9.1; E_value=2.4e-09; Accession=PF00083.15; Description=Sugar (and other) transporter
  Pfam module annotation: Pfam domain module=MFS_1::MFS_Mycoplasma::Suga r_tr; Domain location=7-323::102-334::1-372
VDSRGSPDLARYFNTSVSDVSIAIMLTLAVRPVGALIFGRLAEKYGRRPILMLNIVLFSLFELLSAWSPNFAAFLTFRVIYGVAMGGIWGVASSLAMETIPDRSRGLMSGIFQAGYPCGYLLASIVFGLFFEQVGWRGMFLIGALPILLLPFIYFKVPESPVWLAARERKENHALLPIIRQHWKICIYMVLLMACFNFFSHGTQDLYPTFLKVQHQFDAHTVSIIAIGYNIAAMLGGITFGSLSERIGRKKAIMLASFLALPVLPLWAFSSGSWAIGIGAFLMQFMVQGAWGVVPTYLTELVPANARAVLPGFVYQLGNLIASVNATLQSRIAEAHGGNYGLGMAIVAGTVAVLICVFVAFGRETRGIEISGAPERAHAADRMAGPVHHFIHAQHARFCPERCLQLAVIQPGVAAVLAICPGATPCTRAASSTVAVLSGISMMSISGACSAKKCRTDSRLIFFSVTAAFDVRNAIALAAAAALHRAVTRDHGAIQRIITAVGQGFAEKQRLFQLMPGGRRQLLLQFAKEPAVLNQAFDTLLRIEIARILILLHINPEGARMAVFVELNVDTLRRARFGFLRNIGMVAIEIVAVTLRQAAIVKRRGPFGQRQRACGGRLAQLHVFPHVAALVAHQIFQRAG

SEQ ID NO: 157027 - protein, 224 aa, Glycine max
  Coding DNA Sequence Number=SeqID_65342
  Homolog annotation: Hit_ID=A7MQ07; Match level="QueryCoverage=87%, HitCoverage=57%, E-value=1e-75, Identity=71%"; Hit description =Putative uncharacterized protein
  Pfam annotation: Domain name=ImpA-rel_N; Domain location=54-114; Score=62.9; E_value=1.1e-15; Accession=PF06812.3; Description=ImpA -related N-terminal
MTMNIDALLAPVSSDNPCGDNLEYHADYQAMEQASTGKAEQQFGETIIPAESADWNKVEKLAIDLLSRSKDLRVMLALTHAWTELKGLPGYAQGLKLIEQALLLYWEPLWPRLEEYGEQDPFYRINAVALLGDKSALSSAVRQSWLLRYASDGITLRDAAALCDGSKTEVADYPGGLPRLTDELARGEQPGIEAVLQITGGSGGAGAVAAAQADRHDRRTLSGH

SEQ ID NO: 157028 - protein, 25 aa, Glycine max
  Coding DNA Sequence Number=SeqID_65343
MDKSLKVRENEWKGEGQKEHKASNK

SEQ ID NO: 157029 - protein, 122 aa, Glycine max
  Coding DNA Sequence Number=SeqID_65344
VPSCSATDGVVRNGKKHPPDISAGKCSGPAARRVPFAIQAAQLLGRAIGAGLFAITPAGERGMCCKAIKLGIRCPLKGRACSPLKARMCSPLKAGTCSPLMARVRACSPLMVRTGSPLKART

SEQ ID NO: 157030 - protein, 236 aa, Glycine max
  Coding DNA Sequence Number=SeqID_65345
  Homolog annotation: Hit_ID=Q6WAY3; Match level="QueryCoverage=23%, HitCoverage=2%, E-value=3e-08, Identity=46%"; Hit description =Gag/pol polyprotein
  Subcellular localization annotation: CTP_CleavageSite=32; ConfidenceScore=5.20e-01
AKVLIDNGSSLSVMPKATLDKMPFNASHPRPSSMVVRAFDDSCRDVDLGFIQLGHSRKLPFFYALCGSHGGVLGNVLSGIGSGKKCSRGVSTSTTMLIWGHIDGSSEFTGNHRRFGLGYEPTRTDMRRISLERRGRSMGQTQGLQVKEVPLYHIDKSFVKFELGNWRIVKQPVVSEDSDVDFEQLVSQAEEGEDEDWGLPLELKRMVEQEDREVKPHQEETKIINLGVGEERKEVK

SEQ ID NO: 157031 - protein, 34 aa, Glycine max
  Coding DNA Sequence Number=SeqID_65346
MTSGLAPGMLAQPGGSSGSSTRLAICWIKWPRNN

SEQ ID NO: 157032 - protein, 75 aa, Glycine max
  Coding DNA Sequence Number=SeqID_65347
MVRRTHGLFCHAWQCAVGFWRSGWRRRRDWVQAMHDNVGKDCVGVSKGSAHVRGWWRVSVRRLDVTWYPIFIPSK

SEQ ID NO: 157033 - protein, 118 aa, Glycine max
  Coding DNA Sequence Number=SeqID_65348
MYFSKLVTGNRLPLRCNRLHINRWCVICGGAHDSGCCLPNEEPTAHEVNYMGNQPINNFNAGGFPGFQHGQQYNQQQGHWRNHPGNQFNRDQGGPSTRPQQQRPSLYECTTKLEETLA

SEQ ID NO: 157034 - protein, 31 aa, Glycine max
  Coding DNA Sequence Number=SeqID_65349
YFNDVRPLEAERLKALRIQWAQFYLKVTNQS

SEQ ID NO: 157035 - protein, 113 aa, Glycine max
  Coding DNA Sequence Number=SeqID_65350
  Pfam annotation: Domain name=DUF1723; Domain location=42-89; Score =13.0; E_value=0.015; Accession=PF08330.1; Description=Protein of unknown function (DUF1723)
MKLAFHNLTFMLCYSTQERPELKLVSHGRKVDKFGSPVPGIEGLVAGIGLSPLIGETSTFHLLVGELMITLDDVACLIHLPITGALHRFETLGVDEAVLLLTELLEVSGEEAR

SEQ ID NO: 157036 - protein, 147 aa, Glycine max
  Coding DNA Sequence Number=SeqID_65351
YILCGKSRGYIYLGLTENKRGYISCGSVLVEGTSTRFKENKGGYPYVTGSSVVAIKYKDGILMASNMGVAIKYKDGILMAVDMRDMGGCCSCHVSFVGKVHDVESECNHNNDDGACEHGRARVMLKGSSTFVSMYNQKVQKELIKMH

SEQ ID NO: 157037 - protein, 75 aa, Glycine max
  Coding DNA Sequence Number=SeqID_65352
MLEVGSGSYWKLEVGNESYWKLKVKNGDWKLEVGRGKLLKVVVIIKKGENVNHAGFDDIKKNLLDKGGECESCKL

SEQ ID NO: 157038 - protein, 106 aa, Glycine max
  Coding DNA Sequence Number=SeqID_65353
DVLDIVSDIVDPAQSVKDITDLCVQYFRAGCPGHCIRHRGLRSTYLKLLYSDYHLMQAPLELVGLGSSSSMDSFASWKMNGSGMEKEERDETPLQGEDESRRSSPP

SEQ ID NO: 157039 - protein, 99 aa, Glycine max
  Coding DNA Sequence Number=SeqID_65354
MREVIAMLIDAREYVSKSPTSPTSESPLDEDDDISSKDEFVNLIDCFADEVIIEACFGVCINWGVVELVEGWGLILPSITATKVSTLCRSMIEYSYRFI

SEQ ID NO: 157040 - protein, 23 aa, Glycine max
  Coding DNA Sequence Number=SeqID_65355
MGLETRSSLYGNQVWLIAGHLID

SEQ ID NO: 157041 - protein, 229 aa, Glycine max
  Coding DNA Sequence Number=SeqID_65356
  Pfam annotation: Domain name=Transposase_23; Domain location=57-127; Score=-0.5; E_value=0.0014; Accession=PF03017.5; Description =TNP1ENSPM transposase
MAPKELEQLTQQIRDQLEESITKKGLAMPPEPEVGPSAARVSTKGSCVDPSATNPDTSDSDKCGLYIEKNPSRLVALGRVYEGSTVVHNIPLLHGQVKVGVKEVKDAEAPVPVPTNEVNLVGQTLNTFLAWPTHLMKRLSQQLTMLDKHAVVSPAKPQDRSDHEVDDPLYLMTLTIPQLFLKPLQVMWDATVFKVFNEHFPLYIKHEDLFEIAHGGQCLIISVIQLWIL

SEQ ID NO: 157042 - protein, 92 aa, Glycine max
  Coding DNA Sequence Number=SeqID_65357
MEEFDAQVAWPGARPSPFGGGGASVAQESASKEPAAEEEDELTPLEPFYFDAYAHMAQKEGTSIDQIPEPSSAPAPEETQPSTPVTELEQPI

SEQ ID NO: 157043 - protein, 355 aa, Glycine max
  Coding DNA Sequence Number=SeqID_65358
MSLRIVFLLPHQALIPEISGIRSNGQIGSKNAISRAHRNGLQTQIYCLSSKTGPDGCREMRGTGTREAACKLRQDFSIQKGPVFFSSFMAEYVVKSKEKVKKCEILRVRKPNLGKTWSEQMRKVSDKCERKEPFIGTCRIQFEWNWMYVSLISKICKIMQQSCQIVQQILPIMQKKNGCAVLVSAVTGKVPMCKGYGNSFLGTGNRLLTLIAMAAQLIHDRVVMECLEGVWETLEGNERCRFRGTIRLTATSLVHPEQPEPTLQQPMEWILPTPTPYRLIELVQVIEVSSFEEDLEKDPEELPPEPALDSPDFPQDDEDPLPDVDSPEDILSASKADSTEESGLGGTTNSDDSSS

SEQ ID NO: 157044 - protein, 391 aa, Glycine max
  Coding DNA Sequence Number=SeqID_65359
  Gene Ontology: Mol. function=transferase activity; Cellular component= Golgi apparatus; Biological process=metabolic process
  Homolog annotation: Hit_ID=A7PXF1; Match level="QueryCoverage=74%, HitCoverage=89%, E-value=1e-121, Identity=71%"; Hit description =Chromosome chr12 scaffold_36, whole genome shotgun sequence
  Pfam annotation: Domain name=FTCD_N; Domain location=100-287; Score =194.3; E_value=3.1e-55; Accession=PF07837.3; Description =Formiminotransferase domain, N-termina
MGSSGYGRYASGLSGFGGCAMELSRFGGCTTELSEVWCICDEVVEVANDGMPPCRSMLNLIVRDKEKEREVVSFDDWGGGRGKFDDGIASVCDRGEEFFVSESRNNATLNAIERAARSNPETVIVNMFHDRAYNRARYDLVSYVLHDCTGNPIYSPLHQTVIAMAEATFNAVNLEFHEGAHPRLGAVDDIVFHPLGHASLDEAAWLAKAVAADIGNRFSVPVFLYAAAHPTGKELDAIRRELGYYRPNSRGSQWAGWAMPETLPLSPDEGPNVVSRAKGITMIGARPWVTLYNVPILCTDVSVARRIARKVSARGGGLPTMQTIALVHEDSTEIACMLLDSKQVGADRVQNRVEMLAAQEGLDIEQGYFTDISPEMIVEKYMKLINSANKS

SEQ ID NO: 157045 - protein, 164 aa, Glycine max
  Coding DNA Sequence Number=SeqID_65360
  Pfam annotation: Domain name=zf-CCHC; Domain location=77-94; Score =21.5; E_value=0.00084; Accession=PF00098.14; Description=Zinc knuckle
MMKEGIGHILDLTPIGEKRKESLKRLTLNLPYFHGKDHKDQGQGILGVTPSKPKDDKGNTIEKQPLKASMQEKTSSMKCFKCLGRGHITSQCPTKKTMIMRGQDIYSSQDEVTTSPSSSESEEAKGEESSEEIYPQEEGQPLMVKDECKEVSVSSKRFAKKESD

SEQ ID NO: 157046 - protein, 94 aa, Glycine max
  Coding DNA Sequence Number=SeqID_65361
MKNKKVVVAGVLLSKACALSENHLLSEALSPLSELGESGGESVKHQRTQRVISSLSESFVFSRTKRAQLALWKSTNSRLAQKWSYVSLRGQKAL

SEQ ID NO: 157047 - protein, 72 aa, Glycine max
  Coding DNA Sequence Number=SeqID_65362
MRVGKTLWNLNESCAKILPPLCFSLCKLGGVDGDPVLRGTRRRLQWYLEICRGGQETLGTSGGVLLPKTKLG

SEQ ID NO: 157048 - protein, 164 aa, Glycine max
  Coding DNA Sequence Number=SeqID_65363
  Homolog annotation: Hit_ID=Q2HV50; Match level="QueryCoverage=37%, HitCoverage=30%, E-value=2e-08, Identity=46%"; Hit description=H+ -transporting two-sector ATPase, alpha/beta subunit, central region, related
MAMGSFSQARGALGKIARFQVWWLEGFGGGLCNKKRNWLDSGGRRQVQILGGLVVRYCHAFKAEIPKLSSKFSLIGKINGYGSMTTVDITLQKAAKSAIFAWRLIKDRLPTKMNLIRRQVVVNDRLCPFCGLKDEEAEHLFFNCTYTLPLWWESISWANLTTAN

SEQ ID NO: 157049 - protein, 75 aa, Glycine max
  Coding DNA Sequence Number=SeqID_65364
MKMLLIPHDVSSIGASEWRRKRERRHHFKEKMSLEEAHHHRRPWIRAWRKKEMNEGRGREEHEILCSKRALKSEA

SEQ ID NO: 157050 - protein, 98 aa, Glycine max
  Coding DNA Sequence Number=SeqID_65365
MLPFDFRCVTETYGLCINIFWFFGMSRNFTNCLMMDAKHLTRTKERSHVIKQRSPDKIRGFGVGKWLSHDRVDLDTQRFEIRSPFSSLLVQCGSEGLE

SEQ ID NO: 157051 - protein, 124 aa, Glycine max
  Coding DNA Sequence Number=SeqID_65366
MSNDFQDYFDDAKESRVKQVPKNQESKSFKNQVSKNQDSRIINFQESRFKNNQDEDSRLKIQESREDSIKISVETMPSKVILMMPKNSRIKRKIQEKFQVSSFQESRIKNNQEQDSRLKIQESR

SEQ ID NO: 157052 - protein, 104 aa, Glycine max
  Coding DNA Sequence Number=SeqID_65367
  Subcellular localization annotation: CTP_CleavageSite=47; ConfidenceScore=5.65e-01
MDEVLRMPCSPPASTPPPPPPPPPSPPPPPPTLDASTSPSAVKWTRKASRLRSLSTRPPGAERPVVHVDPAIGKADGPHRKKLRTYLGIVTRDKVDITYENWKE

SEQ ID NO: 157053 - protein, 370 aa, Glycine max
  Coding DNA Sequence Number=SeqID_65368
  Homolog annotation: Hit_ID=Q5NRP4; Match level="QueryCoverage=27%, HitCoverage=6%, E-value=6e-07, Identity=31%"; Hit description =Putative gag-pol polyprotein, identical
  Pfam annotation: Domain name=zf-CCHC; Domain location=152-169; Score =18.4; E_value=0.0025; Accession=PF00098.14; Description=Zinc knuckle
MNQDEREQIREEKRRKILKELRKEKHASYSSHNSCKSLSEELRDYYEGRYRSHLRPHSHRREKERKPQEANINLPYFHGKDDVEAYLDGEIIVEQQFKRKSTSKSYGSHSYPKKDQGKGILGVTPSKPKDDKGKTIEKQPLKASMQEKTSSIICFKCFGKGHITSQCPTKKTMIMRGQDIYISQDEATTSPSSNESEEAKGGESSEEIYPQEEGQSLMVKEECKDVSVSSKRLAKKKSHYEIKTNIKETSPLRQPLNLLLCKKTLVNTITPLWLDIIPQVKEFLDEGLVHKSLNPCALLVPKIGVIRHQIPKISDMMNVLSGATLFCKITHAPNIFKICVDRDLLGVEQRTPEFQEPLDLRSNPFSRGRE

SEQ ID NO: 157054 - protein, 47 aa, Glycine max
  Coding DNA Sequence Number=SeqID_65369
MVNGKLVVARGWFWGVDLVNISAKWEAGGGTMVVLVSGSNEGRSVRV

SEQ ID NO: 157055 - protein, 113 aa, Glycine max
  Coding DNA Sequence Number=SeqID_65370
  Homolog annotation: Hit_ID=UPI00016621D1; Match level="QueryCoverage =81%, HitCoverage=35%, E-value=5e-07, Identity=38%"; Hit description =UPI00016621D1 related cluster
MIGPLDESISCFLIRVDPWVHALAFKGQHVLTFRGLHVLTFRGLHVLTFRGLHVLTFRGLHVLTFSGLHALAFRGLHVLHFRGLQVLAFRGLRALAFSGLHIRILREFKVLYS

SEQ ID NO: 157056 - protein, 90 aa, Glycine max
  Coding DNA Sequence Number=SeqID_65371
MVVRWWFRQVDLVKGRLVVGGIGVSVVVWTNKYGEWEVGGGPGVVLESRSGEEEASGAAVVVNISAKWEVGGGTMVVLVSGSNEGRIVRV

SEQ ID NO: 157057 - protein, 276 aa, Glycine max
  Coding DNA Sequence Number=SeqID_65372
MLAPPLTQSPPSPFQHSNSILLISHHLNQKKIELSPLHSLKLVNNLKGSLLQNLMALTLLQRKTKGQDIYSSQDDATTSPSSSESEEAKGGESSEEIYPQEEGQPLMVKEECKDVSVSSKRLAKKESHYEIKTNIKETSPLRQPLNLLLCKKTLVNTTTPLWLDIIPQVKELDEGLVHKSLNPCALLVPKIGVIRHQIPKISDMMNVLSGATLFCKITHAPNIFKICVDRDLLAPLIELVRNHVPSREDAQEMDFQTLPYSNVLSKEPQSFKNLWI

SEQ ID NO: 157058 - protein, 208 aa, Glycine max
  Coding DNA Sequence Number=SeqID_65373
MIMRGQDIYSSQDEATTSPSSSESEEAKEGESSEEIYPQEEGQPLMVKEECKDVSVSSKRLAKKESHYEIKTNIKETSPLRKHLNLLLCKKTLVNTATPLWLDIIPQVKELLDEGLFHKSLNPCALLVPKIGVIRHQIPKISDMMNVLSGATLFCKITHAPNIFKICVDRDLLGVEQRTPEFQEPLDLRSNPFQGGGNDGILSPKGIQ

SEQ ID NO: 157059 - protein, 69 aa, Glycine max
  Coding DNA Sequence Number=SeqID_65374
MRGVATNAYSRKTSEKPKRRGLRTLSVKDLGVVFTQGEGEGGCRPARPGLLHPEAIQLRKTVWKAQIKI

SEQ ID NO: 157060 - protein, 91 aa, Glycine max
  Coding DNA Sequence Number=SeqID_65375
MIMKGQDIYSSQDEATTSASSRESEEAKGGESSEEIYPQEEGKPLMVKEECKDISVSSKRLAKKESHYEIKTNIKETSPLRQPLNLLLCKK

SEQ ID NO: 157061 - protein, 61 aa, Glycine max
  Coding DNA Sequence Number=SeqID_65376
MVANLGQMATPVKIIEISFSKFTSLIFLTTHVKHTYRGPPFARDGSPQYVPGPPYVRNDSP

SEQ ID NO: 157062 - protein, 87 aa, Glycine max
  Coding DNA Sequence Number=SeqID_65377
MCFDFLRIQSFTLVFKYNSKVVVWTKKYGEWEVGGGLGVVLESRSGEEEASGVAVVVWVNISAKWEVGGGTMVVLVSGSNEGRSVRV

SEQ ID NO: 157063 - protein, 110 aa, Glycine max
  Coding DNA Sequence Number=SeqID_65378
MGINYNRMQQTKICSDGQCIIKVKGFGEREDNGGAMVGGIGVSVVVWTNKYGEWEVGGGPGVVLESRFGEEEASGAAVVVWVNISAKWEVGGGTMVVLVSGSNEGKSVRV

SEQ ID NO: 157064 - protein, 377 aa, Glycine max
  Coding DNA Sequence Number=SeqID_65379
  Homolog annotation: Hit_ID=A5BY33; Match level="QueryCoverage=64%, HitCoverage=14%, E-value=1e-08, Identity=22%"; Hit description =Putative uncharacterized protein
MEEDHKKTLKFLDVTNAINLAYIAWDNNDSSDGSEKEINLLTKDYESDENISQEVNDILRHRKCRFPPLFPVPHYFHPKNSKYAFENSNLITFMSLKLPVYSDLVKAFYSNLEIQEGTLISEVYGIKMVIDQSLFYELTQLSTEGVPFEGTLVDDWKYEFFVHDARRLVCTNQADMTGRLLPGSLDFESRILHYLIVRILLPRSSKFAQVYEEDLIVMWAFHKGRQIDWAHLVQYRMNKALRLNAPFPYPHLVTLFLQHFNIPLDSEPYVSIKRSFLIGASVIASFGYQKEHDGSWVKKGAQHVDEEGHGEEDSSLLQKILDRFDGLQTFVGERFATLELQVDMRFNEMESRIAKVEEDVSYIRSSFDLPPPPPPSS

SEQ ID NO: 157065 - protein, 296 aa, Glycine max
  Coding DNA Sequence Number=SeqID_65380
MPIRQMKVEVVNISRNWSFLFNGKKLIQDPNMFDAKTFWNQIVLNDTLKASFPAMMERDNVEHHDFVQVLRPVKTYHFDDACVYFTKDTNTYAFITRLKNLPIIFHETTYYLTKIDERDFRDHAKVAGKAVDENIVNEVIIDLTNTGVMDENSKASKEAQADEVISRQQEPMFKKSETSHEVMSKEKDVPEVVIVYSASSSPIPIKYAPPNDVTRDQVQDMISQAMDTFAERQRQENYCCGTPVVANFITTLVERPTPSIQQPPALDQPPTSVPFVAAKHTLSAPKHPFPSPQVQQ

SEQ ID NO: 157066 - protein, 317 aa, Glycine max
  Coding DNA Sequence Number=SeqID_65381
MEIIFITKHAPPKQALNQRHHRHIKPRPREAQARPNVHHLAPREDRGTQPVHNAPGRVVIQFFPQELLGGGHFSLGGGLELERHGLVGGELAAEVGGVEGVEDEDGVGPDREEGAGDGVGAVGRDGEWHDGEEGVGGEGEDGSVVRAREEGERAMMRREGLRGSLLCGKMRKGVGRGGDGGVKMFRSSSRNLDGGAASVITSSISFLEGRKEGWCCSSGTELWFPDLRKRGRFVVVVVAFAWLVVFIVVLWGGFVMVFGDEFRGGSRRFRVGEQRCSVFESGGGFAALAGFGVTTATTTVTKVASARVGCSGVETEN

SEQ ID NO: 157067 - protein, 263 aa, Glycine max
  Coding DNA Sequence Number=SeqID_65382
  Homolog annotation: Hit_ID=A5CAR0; Match level="QueryCoverage=61%, HitCoverage=34%, E-value=2e-13, Identity=25%"; Hit description =Putative uncharacterized protein
MNKMRLLQEHNRTFISWFRETILADDSASKTLRLLVRSEQWGQCDGHSDHFCSASDNNPIQASMPYYGVIEDILELNYYLEKVAYNNDPFIMAAQARQVFYVQDPCDSRWSVVLQGRTTCIGYVQEDQTIDPAEKVDYPRFGSAATNAREKIPILHSTWNDVPKSLKNLVSDDILGKFDIPEGDNAKKKVVSTVATRQNMFMLTKTVIRKMILLLSMVLMQQHGQNLQKATKPLTGREYGKRLRKFKNTTAAPIYCLVGVMSY

SEQ ID NO: 157068 - protein, 124 aa, Glycine max
  Coding DNA Sequence Number=SeqID_65383
MGRDEHDVDVPRHRRPTASARRQQEVPQVTEDIPDVIEDVPHVDDDIPTADVDAADVAADGVEGSPANHGEGFLGWPCDTSSTTQVDVPSTCTTKDVPSNALRQSSQAVKPLKPCEWGYKRFSG

SEQ ID NO: 157069 - protein, 66 aa, Glycine max
  Coding DNA Sequence Number=SeqID_65384
MKKQQWKRRCSGRQRRRGERRHHPLGNKPWKKELHHQDEPWIRSLERVLQWRKRKRERKREGRARN

SEQ ID NO: 157070 - protein, 124 aa, Glycine max
  Coding DNA Sequence Number=SeqID_65385
  Subcellular localization annotation: CTP_CleavageSite=51; ConfidenceScore=5.31e-01
MPTTPSSPLQSDGNTEAPPKKTRQTTRLKRLTLRTLDKHRPMVTVDPATGRASGPEKQKFHRYLGVVAREKIPIVHSNWKDVLETLKDIVWGDIFLNLISQKPQRPRKRSCPRWPLDGGNLSLH

SEQ ID NO: 157071 - protein, 84 aa, Glycine max
  Coding DNA Sequence Number=SeqID_65386
MIVIIRDVILDESKWWNWDEGNPKATKRPQRNRQQPQRLNDFKMLLDILVTQEGDLVHLALFIKAKPMIFEEAIQDEKWSNAMK

SEQ ID NO: 157072 - protein, 65 aa, Glycine max
  Coding DNA Sequence Number=SeqID_65387
MSVKNIIERLGGDQSGSQCFTRMLQPCGITTGLKEHSNQVTPKAYTLKSPSGPLPLDSGPTQKTF

SEQ ID NO: 157073 - protein, 109 aa, Glycine max
  Coding DNA Sequence Number=SeqID_65388
MDGLSLCGSEISITLKLLKPLVQHKVFCFDVSSIGACRPRIFFINGFLCFLEDQWQRNGERKREMRRHFKEKMSLEEAHHHRRPWIRAWRKKEMNKGRGREEHEILCSK

SEQ ID NO: 157074 - protein, 28 aa, Glycine max
  Coding DNA Sequence Number=SeqID_65389
MDGSNSHKGINEALGLNLELGLDLKRAD

SEQ ID NO: 157075 - protein, 187 aa, Glycine max
  Coding DNA Sequence Number=SeqID_65390
  Homolog annotation: Hit_ID=A5AKA7; Match level="QueryCoverage=67%, HitCoverage=25%, E-value=5e-07, Identity=29%"; Hit description =Putative uncharacterized protein
MHYLIVHILLPRSSNLAQVSEEDLIIMWVFLTGRQIDWAHLVRYRMHKALQSNAPLPYPHLITLFLQHFNVPLDSEPFVKLKRSFSIGANIVSSFGYRKERDGSWVKKGAQPNDDEGHLPVEGDSSLLQSFLDRFDGLQTYVGERFDSLERQVDTRFKEINSRIAKVEQDVTIIRDCLDLPPPPPSS

SEQ ID NO: 157076 - protein, 198 aa, Glycine max
  Coding DNA Sequence Number=SeqID_65391
  Gene Ontology: Mol. function=RNA-directed DNA polymerase activity; Biological process=RNA-dependent DNA replication
  Homolog annotation: Hit_ID=A5BSW9; Match level="QueryCoverage=43%, HitCoverage=6%, E-value=2e-09, Identity=43%"; Hit description =Putative uncharacterized protein
MARAGDNGGVYHQLDESQRLFLDAWTTQMQRLLNRNKEKPYRRIAKSSSFTLKPLSPRECSTIISPSVQPLLQPSRGIEHQVDLLPGASLPNRPTYKSNPQETQRKDAHAKVEYVKRLYDQVKVQIAKKNESYVKQAHKKRKEVVLEPGDDPEHLRTNVFQEGGNDENHETGQIQAKGPSGEGRRPKWRRTKTPSGEG

SEQ ID NO: 157077 - protein, 96 aa, Glycine max
  Coding DNA Sequence Number=SeqID_65392
  Subcellular localization annotation: CTP_CleavageSite=63; ConfidenceScore=5.87e-01
CPTSSAASSSSPLTSPSVPPFPSSRKLLPAFWSCIYVVGLAQTSSVEVLNRFNTYGRTSFLCVGEGLGGRGVFMLGLGLSVGRLGVALGFGVGLRV

SEQ ID NO: 157078 - protein, 50 aa, Glycine max
  Coding DNA Sequence Number=SeqID_65393
MPISPCRWIAPTRRPVDPKEVQQGPEVSNSGYRPLSVLQGARPPTRSCPY

SEQ ID NO: 157079 - protein, 138 aa, Glycine max
  Coding DNA Sequence Number=SeqID_65394
  Gene Ontology: Cellular component=integral to membrane; Biological process=lipopolysaccharide biosynthetic process
  Homolog annotation: Hit_ID=A4WC76; Match level="QueryCoverage=98%, HitCoverage=42%, E-value=1e-35, Identity=53%"; Hit description =Lipopolysaccharide biosynthesis protein
  Pfam annotation: Domain name=Wzz; Domain location=16-138; Score=51.0; E_value=4e-12; Accession=PF02706.6; Description=Chain length determinant protein
MTQNNNSLVTRSTDPEQIDLLDLVLQLWRGKWVIGAFIAVFIVFAGVYITVAKEKWTSSAIIAQPDAAQIATYANALNILYGSAAPSMLDIQNRAINRFNSSFSALAQALENQDIPEKLTIDTTVKGQPLPLSVSYQG

SEQ ID NO: 157080 - protein, 306 aa, Glycine max
  Coding DNA Sequence Number=SeqID_65395
  Gene Ontology: Mol. function=transferase activity; Biological process= biosynthetic process
  Homolog annotation: Hit_ID=A9HNQ7; Match level="QueryCoverage=38%, HitCoverage=29%, E-value=3e-24, Identity=49%"; Hit description =Putative colanic acid biosynthesis glycosyl transferase
  Pfam annotation: Domain name=Glycos_transf_1; Domain location=1-168; Score=64.0; E_value=5.1e-16; Accession=PF00534.11; Description =Glycosyl transferases group 1
  Pfam annotation: Domain name=Glycos_transf_2; Domain location=70-223; Score=14.5; E_value=0.0045; Accession=PF00535.17; Description =Glycosyl transferase
  Pfam module annotation: Pfam domain module=Glycos_transf_1::Glycos _transf_2; Domain location=1-168::70-223
RLVEKKGAHVLLDAFSKIKDKFPDHIITFIGDGPLKPQLYDQAHTLGVNAKFLGACSKEKIIEELHNTAVFCLPSIRAKNGDSEGFGLVILEAAACGVPVVTSALGGATEGIVHGETEFHRKKSNGGACQSRNQGASLSEAEFIAFLDDDDMWEPEHIEKLINCFKDDKVALAYSGKKITNFAKDSVRKSLNVIPNKEQYKALLKCNYPGSTSSILVRKKYFLETSGFDEKLPAIQDYDFYLRLVKKVIEKRNHIGGNIYCKEIEGINVHAYGAHIFHTNDKKIWDYVNALTEFNRFTNSPVAYQK

SEQ ID NO: 157081 - protein, 131 aa, Glycine max
  Coding DNA Sequence Number=SeqID_65396
  Subcellular localization annotation: CTP_CleavageSite=35; ConfidenceScore=5.28e-01
MVESLKKRKGSSSTTAAVGHRHGTSGDTPAPIPPSLSSPQSSTLFSSDDQRQRYYSQFCNRVIQDPKYLDLEFFDGETFDCYQVHNIPIIVDQSLFYSLTKLPSQGVPCTLVDDWKFDYSSHDARRMVYND

SEQ ID NO: 157082 - protein, 93 aa, Glycine max
  Coding DNA Sequence Number=SeqID_65397
MVGYAPSSFADLVFAGERIEAGLKKGKFNHPAWTNEKTGANEEGENEGETHDVIAVPTWKLPTSQTMSLLSQYQPFSLPTTQSSTKAIPKSTT

SEQ ID NO: 157083 - protein, 163 aa, Glycine max
  Coding DNA Sequence Number=SeqID_65398
MLLPERNVVIYHTEFDEFKEELDRRRWDEELTSFKEGNIDVAIVKEFYANLYDPEDKSPKQVRVRCHLIKFDEEALNTFLKTPMIIKEGETLSAYSRFALLRPDPQELAAKLCIPGRGFELNADGQPLNILRKNMTTLAQTWSVLSYSNLVPNSHTSDITLDR

SEQ ID NO: 157084 - protein, 326 aa, Glycine max
  Coding DNA Sequence Number=SeqID_65399
  Homolog annotation: Hit_ID=UPI00006A2939; Match level="QueryCoverage =81%, HitCoverage=100%, E-value=2e-13, Identity=27%"; Hit description= UPI00006A2939 related cluster
TTRLHQQRAAHPHLERTTRPPQQTAARPHLGEGYTSSSIEDYTGLRALTFVGLNALTIRGLHVLTFRGLRALAFVGLHALTIRGLHLLTFRGLHALAIRGPHVHTFGYTPSPLEDYTSSPTEGCTPSPLEDYTSSPTEGCTPSPWRGLQVLANRGLQILTLRGLHVLALRGLHVLTIRGLHALTSSSEDYIELRALAFLGLHALTIRGLHVLTFRGLHALAIRGPHVLTFVRLHALTFRGPHVLTFRGLHALAIRGLHVLTSVGLHALTFRGLHVLANRGLHALTLRGLHVLTNRGLHTLTLRGLHVLGNRRLHALTLERDTRPRQ

SEQ ID NO: 157085 - protein, 145 aa, Glycine max
  Coding DNA Sequence Number=SeqID_65400
  Gene Ontology: Cellular component=cytoplasm; Biological process=rRNA processing
  Homolog annotation: Hit_ID=A8G908; Match level="QueryCoverage=89%, HitCoverage=95%, E-value=8e-63, Identity=96%"; Hit description =Ribosome-binding factor A
  Pfam annotation: Domain name=RBFA; Domain location=7-116; Score =189.8; E_value=6.8e-54; Accession=PF02033.9; Description=Ribosome -binding factor A
MAKEFSRGQRVAQEMQKEIAIILQREVKDPRVGMATVSGVEVSRDLAYAKVYVTFLNVLTENHDPDLVTNGIKALQDASGYIRTLLGKAMRLRVVPELTFAYDNSLVEGMRMSNLVTNVVKNDAERRSASVMTRRINESPSSPRP

SEQ ID NO: 157086 - protein, 96 aa, Glycine max
  Coding DNA Sequence Number=SeqID_65401
  Homolog annotation: Hit_ID=Q6VPE8; Match level="QueryCoverage=67%, HitCoverage=8%, E-value=7e-08, Identity=42%"; Hit description =Putative gag-pol polyprotein
  Subcellular localization annotation: CTP_CleavageSite=30; ConfidenceScore=5.03e-01
MVNMLSSASASRPSSFSTWDLLKCLENQLNQNTGRPYGGNRVGNVGPRQHRMEGQNRIEGVKLNVPPFKGKSDLEAYLDWEMEIEHVFSCNDYTKE

SEQ ID NO: 157087 - protein, 166 aa, Glycine max
  Coding DNA Sequence Number=SeqID_65402
MGEVEEVQKQMKADMEAMKEQMATMMEAMMSMKKIMKANAVAVATSSAVAKVNPMPPSGLNQMNHPTSAMVGKDLGSTRSPYYVQIQNKHAFLPYGLPPNYTPPNVAYTPSEDVNNFAPILIESRQPQTDHAHVSQPMGETHEMPHHNLADFEPCLGYATEGQVVG

SEQ ID NO: 157088 - protein, 381 aa, Glycine max
  Coding DNA Sequence Number=SeqID_65403
  Gene Ontology: Mol. function=transferase activity, transferring groups other than amino-acyl groups; Cellular component=integral to membrane; Biological process=glucan biosynthetic process
  Homolog annotation: Hit_ID=A7MG24; Match level="QueryCoverage=96%, HitCoverage=96%, E-value=1e-129, Identity=60%"; Hit description =Putative uncharacterized protein
  Pfam annotation: Domain name=Acyl_transf_3; Domain location=9-364; Score=75.9; E_value=1.3e-19; Accession=PF01757.13; Description =Acyltransferase family
MSSAKPEREYFLDSIRAYLMLLGVPFHVSLIYSTQRWSVNSQDASLWLTVLNDFIHAFRMQVFFVISGYFSYMLYLRYQPNRWLKVRLERVGIPLLTAVPLITLPQFFMLKNLTSKVGDWANFSLYDKYNALMWDLISHLWFLLVLVILTAFGMLSFRWLRDQQRRIDYQQVGWGKLTLALLAYALVWCAFRRLIFHFAPALLMDGLFSIAVMQSLFFLPFFMLGALSWKHQALKALFVRFNPVMCFGAIAVFIAYSLNQRYSSGEGWLYELDAIISTLMGLCMLNVCFSFGHKLLNSHSPRIMYLVNASLFIYLVHHPLTILYGIYVTPHISSNTLGFFVGLLMVFGVAFALYEIHLRIPLLRFLFSGKPQRKPETSAQT

SEQ ID NO: 157089 - protein, 706 aa, Glycine max
  Coding DNA Sequence Number=SeqID_65404
  Gene Ontology: Mol. function=siderophore-iron transmembrane transporter activity; Cellular component=cell outer membrane; Biological process=siderophore transport
  Homolog annotation: Hit_ID=A6T5W5; Match level="QueryCoverage=98%, HitCoverage=98%, E-value=0.0, Identity=59%"; Hit description =Putative TonB-dependent receptor
  Pfam annotation: Domain name=Plug; Domain location=85-185; Score =71.9; E_value=2.1e-18; Accession=PF07715.6; Description=TonB -dependent Receptor Plug Domain
  Pfam annotation: Domain name=TonB_dep_Rec; Domain location=470-706; Score=74.9; E_value=2.7e-19; Accession=PF00593.15; Description=TonB dependent receptor
  Pfam module annotation: Pfam domain module=Plug::TonB_dep_Rec; Domain location=85-185::470-706
  Subcellular localization annotation: CTP_CleavageSite=27; ConfidenceScore=5.18e-01
MRRTPFNPGMKPTLLAMLVSAGCLPVMAATTNTSNAPQGANEQPTLTVTATPQSEFKPGGNDLVPAFLDGQIAHGGRLGMLGEQNAMDVPFNVIGYTAKMIQDQQAQTIADVVRNDAGVQNVKGYGNFAETYRIRGFTLDGDDMTFGGLPGVVPRQVMDASLIDRVEIFKGANSLVNGAASSGVGGGGTLDVGRRFGDNNQFGVRVNAVHREGETGVDGEKKRTTAASVGLDYRGDRLRTSLDVGYQKKTFHDGLQGVKFASAGVIPPVPSNSHNYSQKWVYSDMESEFGIAKAEYDITDSWTAYAGLGAQHAHETGNYGAPTITNSNGDGTISSFYSNRIQDNMSGMVGLRGEFHTGFVSHKVNVGYSALTTNAKNAYDMSLVGTPFNIYHSGDVAEPAATFAGGKFSDPLTTSRTRTQGYLLSDTLGLLDDTLLVTVGARHQKVVVRSYNYNTGAESVDSRFTNDRWMPTYGVVYKPWKEVALYANHTEALQPGEVAPKDAVNYGTVTGVAHSKQNEIGVKTDFGRIGGSLGLFEIQKPSGLINSDNVYVMDGEQRHRGVEANVFGEPVLGLRLNASATWIDPVMKKTAGGTYDGKQAIGVPRYTYVLGAEYDIKPVEGLTATALLNHSGAQYANSANTLKLDSYTTLDLGMRYRMKVNQNDLVWRVAVENVTNEKYWSNVDDTGTYLAQGDPRTLKISMSYDF

SEQ ID NO: 157090 - protein, 304 aa, Glycine max
  Coding DNA Sequence Number=SeqID_65405
  Gene Ontology: Mol. function=catalytic activity; Biological process =metabolic process
  Homolog annotation: Hit_ID=Q6CYK6; Match level="QueryCoverage=58%, HitCoverage=39%, E-value=2e-49, Identity=56%"; Hit description =Putative AMP-binding enzyme
CLRGRRAAGRGCATRAATLDCAVDEIYGSTETGVIAWRRASDDAALWQCFPHVSLREIAPQRWQVFSDLLESRAGCALDDRIVQQPSGQFQLAGRQDRVVKIEDKRVSLSEVERRLLALPGVEDAAALAIQRHGRHAIAVVLALPQLPDAATLHQRKQQWKRALQPWLEPVAMPRYWRVVTTIPVTAQSKRAWPQIEELFDVTAAGAAGCAAGAAVAVAAGKVAAKFSLRAAARFACAECLFCALRADSLLQPRCHAGVGAGAAGPVQPAGDRGRRRQRCPDPTAYRCAGCAAAPGADAAAQPR

SEQ ID NO: 157091 - protein, 131 aa, Glycine max
  Coding DNA Sequence Number=SeqID_65406
MASRKRKSIGTRPIAQYDRRRFHSFEAWTRYIDNVLGRHILHERKVEIYDIELDEFKDELERHNFHKQLTNLVDNNIDLALVKEFYANLYSSEGPSPKQVPGAKKDVLYLTVLMRSYVVSWTARPRFLMIA

SEQ ID NO: 157092 - protein, 112 aa, Glycine max
  Coding DNA Sequence Number=SeqID_65407
MGGTGVVEEDGARVSGAAEVVGTSNLLPLAFLGPLNVTVGSSRFQQFFLIYAKLMAGLKFSRDLESDWTPLALHRAVIKARNPSLDVSCYAIREIWWKMKYPKFISIFIMIP

SEQ ID NO: 157093 - protein, 192 aa, Glycine max
  Coding DNA Sequence Number=SeqID_65408
MNGGTPGHLVEQCMALKHKVQSLIEAGWLTFQEDGPNMKTNPLTNDRGSTVNAIEVCSLQTPKHLKDVTTSRRFSFEALQEAGVVPLSEHKGDPCLMHLGAPHDMETCSAVEELQGKSQEAQAFGDAFHQRCGSPKSLRPFDVVRKYAPQKPNERKKKVTDIDSFSTKVTNITGLSGMTCNGYIFVAPDLPI

SEQ ID NO: 157094 - protein, 189 aa, Glycine max
  Coding DNA Sequence Number=SeqID_65409
  Subcellular localization annotation: CTP_CleavageSite=38; ConfidenceScore=5.58e-01
MAEPSKKRKGVSTSSAVTGTRSHGASKAQTTRIPPSISSPMLFSSEEKCIRYNSFFSSHSIIDPKFVDLTFFDDEVFDCFQAFQNSGLIQFISIKLPFYPELVKAFYSNLEIQEDSLISEISSDGVPFKGTLDDDWKFDFSVSDARRLVCTKQADMTGRLLAGSLAFECRIMHYLIVHILFPRSSNLAQ

SEQ ID NO: 157095 - protein, 68 aa, Glycine max
  Coding DNA Sequence Number=SeqID_65410
  Subcellular localization annotation: CTP_CleavageSite=26; ConfidenceScore=5.08e-01
MVSAEGGFARIGLFHQIEQNQTAPPSSSNSSSTVGAELRTRLMVWSVGQDGGKVINGWNREEYLARRF

SEQ ID NO: 157096 - protein, 25 aa, Glycine max
  Coding DNA Sequence Number=SeqID_65411
MAGWNDRAMADALQALAQELMKHWA

SEQ ID NO: 157097 - protein, 426 aa, Glycine max
  Coding DNA Sequence Number=SeqID_65412
  Gene Ontology: Mol. function=protein disulfide oxidoreductase activity; Cellular component=integral to membrane; Biological process=cell redox homeostasis
  Homolog annotation: Hit_ID=A4W977; Match level="QueryCoverage=50%, HitCoverage=99%, E-value=8e-88, Identity=73%"; Hit description =Glutaredoxin, GrxB family
  Pfam annotation: Domain name=Glutaredoxin2_C; Domain location=295 -426; Score=254.3; E_value=2.6e-73; Accession=PF04399.4; Description =Glutaredoxin 2, C terminal domain
MAHLYGAYRHARGNAARVARPPFPPVMLMLPVMVNQVAGAPAAVKWMYAIEALLSLSLLYPLARWSEKRFRLETRLMAGLFLMTFSLLPVGMTDSLPSLFLLIAVFYLGSIIAEPARETLSASLASARARGSYMGFSRLGLAIGGLIGYSGGGWMFDMGQQLALPELPSSRARWHRRSSAASLPVQAFSSILPARPEKGDLRHPENHRRNGMKLYIYDHCPFCVKARMIFGLKNLPVELIVMLNDDEATPKKLIGQKMAPILQKADGSAMPESMDIVRFVDNQDRQPLLTGKQNPAIADWLRRVNGYINKLLLPRIAEAAFAEFATPEARDYFREKKQASLGDFAELRKHAPGFIKNISDDLRQLDKLIVKPNAVNGELSEDDIHLFPLLRSLTLVSGIEWPSRVADYRDNMAKQTQVNLLSSIAA

SEQ ID NO: 157098 - protein, 129 aa, Glycine max
  Coding DNA Sequence Number=SeqID_65413
  Subcellular localization annotation: CTP_CleavageSite=44; ConfidenceScore=5.60e-01
MALSQPRAPTPPQGGALRTPTSTRPHPANNAYFGANTTRNFSPRQTQIFALIPMTYGELLPSLIANQLAVVVPGKFFQSPFPKWYNPSATCAYHGGDPRALDRTMLDHEKQGPKLDRGRVVDFSEDRPN

SEQ ID NO: 157099 - protein, 209 aa, Glycine max
  Coding DNA Sequence Number=SeqID_65414
MHPYRTRSKSRMMGDLDEVQEQMKADMSALKEQMDSMMDAMLGMKQLMESNAATTTVVSSAAEADPTLPTVAHHPIPNMVGGEGSTPGHINNPYPRYHRAIHEDMGHVPPLILKGEPPLHPDGVHENHREHAQGDVDSYSPLPAEGPAPNALPQPKITEEPLSHPTQPMFLSVRGPPPAAEGKGKLDLIEERLRAIEGFSDYPFVDMTD

SEQ ID NO: 157100 - protein, 71 aa, Glycine max
  Coding DNA Sequence Number=SeqID_65415
MVFACQSDLGSPNDMVRITVSKGCVRVTIGCHRMPPESWVTVAKGRVVDKSRAFAHMYPQFVMRNSDLRSC

SEQ ID NO: 157101 - protein, 145 aa, Glycine max
  Coding DNA Sequence Number=SeqID_65416
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MSDLGASHIETLEIEQRKLSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 157102 - protein, 48 aa, Glycine max
  Coding DNA Sequence Number=SeqID_65417
MTAFAFFHTWRVGLSNSAWAMYHMVLHQSVEFWVILMGRTKKNVQMTN

SEQ ID NO: 157103 - protein, 504 aa, Glycine max
  Coding DNA Sequence Number=SeqID_65418
  Gene Ontology: Mol. function=ligase activity; Cellular component =nucleus; Biological process=embryonic development ending in seed dormancy
  Homolog annotation: Hit_ID=Q2HRN6; Match level="QueryCoverage=100%, HitCoverage=100%, E-value=1e-159, Identity=56%"; Hit description =Pentatricopeptide repeat
  Pfam annotation: Domain name=PPR; Domain location=184-217; Score =16.8; E_value=0.08; Accession=PF01535.11; Description=PPR repeat
  Pfam annotation: Domain name=PPR; Domain location=220-254; Score =19.3; E_value=0.014; Accession=PF01535.11; Description=PPR repeat
  Pfam annotation: Domain name=PPR; Domain location=255-289; Score =28.2; E_value=2.9e-05; Accession=PF01535.11; Description=PPR repeat
  Pfam annotation: Domain name=PPR; Domain location=290-324; Score=5.6; E_value=1.7; Accession=PF01535.11; Description=PPR repeat
  Pfam annotation: Domain name=PPR; Domain location=465-499; Score=8.1; E_value=0.85; Accession=PF01535.11; Description=PPR repeat
  Pfam module annotation: Pfam domain module=PPR::PPR::PPR::PPR::PPR; Domain location=184-217::220-254::255-289::290-324::465-499
  Subcellular localization annotation: CTP_CleavageSite=66; ConfidenceScore=5.15e-01
MRRVWRFSSDATRRAQLLLLLQSHYFHGFSNPKTTPSLATALSHHRNLNSVPNACSDLIPLFTAKSCSSAKEDLINKASILKNELIRESSDSARVLSILDDNSDTLIQRHPDGSVLLRLMNQLNSNPSLALQVFSWRRKRSNVENPMDAYEYSKGIKAAGRSGNVDLAVKLFKEAAVKGIKTTSTYNALMGACMSNGLADNCQSLFCDLKRDPTCDPSIATYNILLSVFGRLMLVDHMEATFREIQKLTFTMNICTYNHMIAGYITAWMWDDMENVFQMLKRSPVEPNMKTYMLMLRGYANSGNLEKMEEIYSFITDRVDIKEISLIRCMICAYSRSSDADRLKKIELLLKFIPGKEYRPWLNVLLIKLYAKEDWLEKMENAINEAFEHGTSITTKGILRCIVATYYRYNAVEKLENFVRRAEISGWSICRSAYHCKLVMYGSQLPLMHNVLEEMEMVNLECTKKTLWIMYKAYMRNGQSSMVLKTLGQMFKHGYEVPLSAFPS

SEQ ID NO: 157104 - protein, 74 aa, Glycine max
  Coding DNA Sequence Number=SeqID_65419
MEMPVFLRKISNCKNVKPITIVKYLLQDDGLSSVKQNRNGPNFLGLESLFFSNPHHLPASLVRSACMNDGSNEE

SEQ ID NO: 157105 - protein, 279 aa, Glycine max
  Coding DNA Sequence Number=SeqID_65420
  Gene Ontology: Mol. function=sugar:hydrogen symporter activity; Cellular component=integral to membrane; Biological process =carbohydrate transport
  Homolog annotation: Hit_ID=A7PU29; Match level="QueryCoverage=86%, HitCoverage=53%, E-value=7e-97, Identity=70%"; Hit description =Chromosome chr7 scaffold_31, whole genome shotgun sequence
  Pfam annotation: Domain name=Sugar_tr; Domain location=34-276; Score=- 91.0; E_value=2e-05; Accession=PF00083.15; Description=Sugar (and other) transporter
MAIKEDVEEGMQKGVREPLVVRASKGHPWMVYFTTFVAVCGSYEFGACAGYSSPTQDAIRKDFSLSLAEYSLFGSILTFGAMVGAITSGPIADFIGRKGAMRVSSAFCVAGWLVIYFAEGPVYLDIGRLSTGYGMGVFSYVVPVFVAEIAPKELRGTLTTLNQFMITAAVSVSFTIGNVFSWRVLAIIGLIPTAVLLLGLFFIPESPRWLAKRGREKDFVAALQILRGNDADISEEAEEIQIMPLKYHRLSLRASLVQDLGVGSCQDPVVETDRALKML

SEQ ID NO: 157106 - protein, 95 aa, Glycine max
  Coding DNA Sequence Number=SeqID_65421
MCEKKIEEVRDESIGGGGINDIINDGDKGDIGGDNNSHNGVNDDDNDNGVGGNSCGDGNGGDIGISGGDNDGLVVEVKVVTSTMVKFKKYVFFKS

SEQ ID NO: 157107 - protein, 943 aa, Glycine max
  Coding DNA Sequence Number=SeqID_65422
  Homolog annotation: Hit_ID=A7PU75; Match level="QueryCoverage=86%, HitCoverage=77%, E-value=2e-96, Identity=32%"; Hit description =Chromosome chr7 scaffold_31, whole genome shotgun sequence
MDCGSDGGLGFKKKEGQLHQSLCKGSDKLHDKAFCNPADVEVFTEEKKQSLAKRPGRGGEFARAVKEIIECYEKLRTENQDGDTGSKEQMDESYSPDPSANTGAKEQMDAPFTINSQMKSSNCVIDRPEDAVALKDESYNIEASLEEATDNAIMTATVKSLFSTTQRNAPVQRSRSTLQVQNFVLPYSDGGNNGSNSNDNISADAIEDTSIRRRKHIRKSPDLLGCDDTDSPAFAPNVSMEDNGSEIITIISDAFTLNEGSTIDSNLKLEQSEPIECPEGEDDLNKGLDLEIKAVINKKKRKPNRKKETNDSGAQNASQSLQNMGGNSKERCPDQDGDEHLPLVKRARVRMGKSSAEAELNSIAQVQVKCGEEDITDSPHQIITSSNCENGSLAEGGTSVLNSALVSVSPSNLIALCSENGSQICKIKKDQMFGCSVDDEAALPPSKRIHRALEAMSANAAEEGEACMESSSIMTSSGRCCISTIKRCPCMTVNNQGGNDLELQRLDSCGIDSSHVSMYSFSTRSNTIISTENESSTEVDKHLAKFQCETGKDVIPGDRQQGGEDLSDSVVCHPAKIDSQIQSHGKISPDLDVKCCQVGNSKDSPCPSLLPNGDYNVRPSNHSDASDTLEHGGISLDPVAGDGESDKLVPQNSINVPQNVVVACEDMGKQAVGGSSKINDTHEVVKEVKFKGQEEDMNSVSISNDYSGEKGNLVILSSPSLTDGRVFLPLGSPPNTSVCNISTSDSSNILQNGSCSPDVHQKNTLSGPTDGWKDGIVENGRSRSVGKSTEAGDAALLYFEATLRTLKRTKESIGRATRIAIDCAKFGIATKVMRWKLLPLKNQTISMYPILNMAQSHLMGWTSVIDSRVLAVQGSLGIIGISGSLAWDLEFRHLIESDSKRAIEFSANDYPIPHPQCSLLVLKDAMGSATLRSIRILKFLVGL

SEQ ID NO: 157108 - protein, 171 aa, Glycine max
  Coding DNA Sequence Number=SeqID_65423
MEVRPKDGDNMPQKSVELTLIELHLDGHLQGQMASRENAGAMQLVNELVDVTDDVLCEKLLNLLLNLVLVMALSRKEGKLKQALGACLGPQKCKDDHEDGAPIKLRVPALELDSGDLGLDLDPLSPSPIEEPQEWVGLIVPKSQSVVNVGHPKGSYQRRESEGGCQLMAPR

SEQ ID NO: 157109 - protein, 524 aa, Glycine max
  Coding DNA Sequence Number=SeqID_65424
  Gene Ontology: Mol. function=transcription regulator activity; Cellular component=nucleus; Biological process=regulation of transcription
  Homolog annotation: Hit_ID=A7PU94; Match level="QueryCoverage=85%, HitCoverage=81%, E-value=9e-85, Identity=40%"; Hit description =Chromosome chr7 scaffold_31, whole genome shotgun sequence
  Pfam annotation: Domain name=HLH; Domain location=361-410; Score =51.9; E_value=2.2e-12; Accession=PF00010.17; Description=Helix-loop -helix DNA-binding domain
MLLCGDILGFELFCNSVPRSSSLNSNPHHTCMIVTAQHDHTVQGTTTRPFHGFPICFDEIPRLPGTAYARRQHLWLSGANEVDSKTFSRAILAKTVVCIPVLEGVVELGTTDKIEEDLNFIQHIKSFFIDQQPPPPTAKPALSEHSTSNLTSSYPLVIVPVTAAATANNVLIQNDMNIVDKGEAIILNNNNNNTEAELLADPNSNSFIPSELMELDHQLEEFGVGSPGDGSNHLDSFPKEESMALCAAGLELLQLQRPPAPAHPPTENLAQGDTDTHYSQTVSSILKKNSSRWWPDSPSVNHPTDSFQSAFNKWKSDTDNHHHYFHETVADGTSQGLLKYILFNVPYLHANRLKGTGASSYETNHVMAERRRREKLNERFLILRSMVPFMMRMDKESILEDTIHYIKQLREKIESLEARERLRGKRRVREVEVSIIESEALLEVECVHRERLLLDVMTMLRELGVEVMMVQSWVKDDGVFVAEMRAKVKENGNGKKASVVEVKNALNQIIPHHEPYTLCSNDHF

SEQ ID NO: 157110 - protein, 124 aa, Glycine max
  Coding DNA Sequence Number=SeqID_65425
MDNRSKEQLCACKVVHRARQKSYKHRLVCMGVLICDRLVISCLLNICSIVLMKIHIKIKMVIVEEDKVVATLDVKNALDSNDFQPSNDQANSEYQSDHNVENYESWPVKYLSSSKAGVLPTSET

SEQ ID NO: 157111 - protein, 313 aa, Glycine max
  Coding DNA Sequence Number=SeqID_65426
  Gene Ontology: Mol. function=calcium ion binding; Cellular component =intracellular; Biological process=small GTPase mediated signal transduction
  Homolog annotation: Hit_ID=A7PU62; Match level="QueryCoverage=98%, HitCoverage=46%, E-value=7e-99, Identity=59%"; Hit description =Chromosome chr7 scaffold_31, whole genome shotgun sequence
  Pfam annotation: Domain name=EF_assoc_1; Domain location=7-77; Score =130.2; E_value=5.9e-36; Accession=PF08355.3; Description=EF hand associated
  Pfam annotation: Domain name=MMR_HSR1; Domain location=82-214; Score=- 11.3; E_value=0.012; Accession=PF01926.14; Description=GTPase of unknown function
  Pfam annotation: Domain name=Miro; Domain location=83-214; Score =19.4; E_value=0.00015; Accession=PF08477.4; Description=Miro-like protein
  Pfam module annotation: Pfam domain module=EF_assoc_1::MMR _HSR1::Miro; Domain location=7-77::82-214::83-214
MVVNCSPWDDALYKDAAERTNMGYISLNGFLAQWVLMTLLDPPCSLANLIYIGYSGNPAAALRVTRRRAVDRKKQATEKNVFQCYVFGSKNAGKSALLDSLLGRPFSNNYTPTTVERFAANSIELIGGTRKTLVLREIPESEVSNVLSNKGYLAACDVAVFVYDSHSDEYAWRESRSSDEHSWKKSRDLLEKVGRQGDLTGYRVPCLLIAAKDDLTPYPRAVQDSVKVTEELGIEAPIHVSMKLGDSSNVYHKIVNAAEHPHLSIPETEIGRKRKQYHRLLQHSLVFASVGTAMAFVGLAACRAYAVKKNSSG

SEQ ID NO: 157112 - protein, 102 aa, Glycine max
  Coding DNA Sequence Number=SeqID_65427
MGFFWFYFRHGVVSYVNSVPCRTQTAIVNGEFGVTEQVANGSGDTCLNRHYRWRFVQSIGNRQSNWRVPLVAGGDGSFKGELQLPLASCLEVATPIGDLGHK

SEQ ID NO: 157113 - protein, 257 aa, Glycine max
  Coding DNA Sequence Number=SeqID_65428
  Homolog annotation: Hit_ID=A5C0G0; Match level="QueryCoverage=35%, HitCoverage=13%, E-value=3e-15, Identity=45%"; Hit description =Putative uncharacterized protein
MELENFERVAITDDDDNLVILIANQADDTPDQSLCLVGRFLTDRTIQILIMRCSKKIRKPGGEVTEVTFKYEKLSTFCYICVLLGYNDDHCDKIFEMADDGGVRLWGLEIKVQSRTYGGNNGGSRWLKEEGSHGSNVSRTVGGNQEANPINCGAIIAEDKKWDEMVIRDANINFLATRTLVHTGALSIAEAEALALLAAINWTMDKGYNNIVFETNCKHVHDLILSTKRNISDLGLILATCKNKLINSSKPSRSLPC

SEQ ID NO: 157114 - protein, 378 aa, Glycine max
  Coding DNA Sequence Number=SeqID_65429
  Gene Ontology: Mol. function=GTP binding; Cellular component =intracellular; Biological process=small GTPase mediated signal transduction
  Homolog annotation: Hit_ID=A9PEM5; Match level="QueryCoverage=100%, HitCoverage=100%, E-value=1e-128, Identity=62%"; Hit description =Putative uncharacterized protein
  Pfam annotation: Domain name=MMR_HSR1; Domain location=220-330; Score= 76.0; E_value=1.3e-19; Accession=PF01926.14; Description=GTPase of unknown function
  Subcellular localization annotation: CTP_CleavageSite=55; ConfidenceScore=5.87e-01
MSVQLSSLWVPNSPPIPQHFVPNRGRFSASALSSQSPTIQATLFPFSLKFLSFFQCTLTSRDYCSGIIGVGGPSWRENGYGNPNNNNLFDGCQGESDHWSELDTDLYHWTKALRPVQWFPGHIAKAEKELKEQLKLMDVVIEMDLWLGNRKRILVLNREDMISTADRNAWADYFTRNGTKVVFSNGQLGMGTMKLGRLAKELAADVNVKRRSKGLLPRAVRAGIVGYPNVGKSSLINRLLKRRMCPAAPRPGVTRELRWVRFGKDLELLDSPGILPMRISDQSAAIKLAICDDIGERSYDVADVAAILVQMLSKLPTVGRDALCKRYKIDVDCRDGRIFIEKLAVRVFNGDVHQAAFRVLADFRKGKFGWTALERPPK

SEQ ID NO: 157115 - protein, 58 aa, Glycine max
  Coding DNA Sequence Number=SeqID_65430
MAQGFILCAGSMSGTSSGNEPPNGSGSGSVELKVVKLMWDQSFHFHLKNDEEGNERAH

SEQ ID NO: 157116 - protein, 122 aa, Glycine max
  Coding DNA Sequence Number=SeqID_65431
  Homolog annotation: Hit_ID=A7PHV0; Match level="QueryCoverage=98%, HitCoverage=46%, E-value=2e-10, Identity=29%"; Hit description =Chromosome chr13 scaffold_17, whole genome shotgun sequence
FTRAWILRFIGGVLFVDKSSSKVSLSATDYKIKSIGGMCILIQMWAWERCTTLAPKRTPPIMENKPLGHRWLRRGNQHIGNDDLIVFRRKLDIMKRHEFLWEPYTATVMSMLPLICLVGSMA

SEQ ID NO: 157117 - protein, 87 aa, Glycine max
  Coding DNA Sequence Number=SeqID_65432
MEKINKLQHQCQVPRAEEKFVLQFMDSMDNYLSLFDAVSSTLRQMKKMSSDLGAWEQLMVMKANARMETCMEAMEKAIEENRDVMEA

SEQ ID NO: 157118 - protein, 105 aa, Glycine max
  Coding DNA Sequence Number=SeqID_65433
MVAWPGTQPSLHREDEGPIAQPLVRRKKADQTQEVAATSEKSLEATSEPSELVADTTSLQQVAYPCTLEDQTMPVLSLNTSPTTTHVLHLTDEEDVQTEDTQDRS

SEQ ID NO: 157119 - protein, 115 aa, Glycine max
  Coding DNA Sequence Number=SeqID_65434
MQEEEKEEESDDEEDFSLFVKKFHKFVKNRRMEKSHNFNNRKRSQEFSPTLKCYKRMRRKAIKKEDPRRRILLGTIMTHSMVWRRRSTFYLRNMKVMRTSLKKFKQENQKSDFHL

SEQ ID NO: 157120 - protein, 192 aa, Glycine max
  Coding DNA Sequence Number=SeqID_65435
  Gene Ontology: Mol. function=unspecific monooxygenase activity
  Homolog annotation: Hit_ID=Q9AVH2; Match level="QueryCoverage=100%, HitCoverage=79%, E-value=5e-61, Identity=57%"; Hit description =Putative senescence-associated protein
GKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLAPTYPTPLKSFHKVGLESSSTGSSFPADSAKPVPLAVVSLDSRQGQWESR

SEQ ID NO: 157121 - protein, 101 aa, Glycine max
  Coding DNA Sequence Number=SeqID_65436
SRSLDTHIVVGQTHKTPYTVGKPTLSSLEPTEPPTLPENPYCHRSNPTEPTLSWLEENPTYTVATRVLKHSSVLKGQSFLREAPLTCVLLGSLDQVISNGA

SEQ ID NO: 157122 - protein, 192 aa, Glycine max
  Coding DNA Sequence Number=SeqID_65437
MHLSLYPQLVTLFLRHFQIPLDDEPFVQVKCSFAIGVGVVTSFGYRKDRNGQWLKKDALPPQVERTPSPPPQRDDSTLMTEVLSELRGLRTYVGDRFDSLDNRFAGMDIRLTQLEEDVGYIRQSFDLPCRAKHELTEFGDGNIDVANVKEFYANLYGPEDKSPKQVRVRGHLIKFDEDMLNIFLKTPVVVEE

SEQ ID NO: 157123 - protein, 78 aa, Glycine max
  Coding DNA Sequence Number=SeqID_65438
DCIKFHDSLIAKKDFVVGQKVLLYNYKLGLMSVEIKSESIDKSFKVNGHRLKPFLTNPSLVDVVVEETFLLHPTSLLP

SEQ ID NO: 157124 - protein, 96 aa, Glycine max
  Coding DNA Sequence Number=SeqID_65439
MMKDYENGEEQKRYIDNNFSKHMAYIKVYSTNKGHLINMPNNYVEKPENYPVIGTKWVFRNKLDEHGIVRNKIVLLYPLLKRNISLPAVVVHRFYG

SEQ ID NO: 157125 - protein, 87 aa, Glycine max
  Coding DNA Sequence Number=SeqID_65440
MNLEERSRIFAKIGEKLAAQLAQASSAHPGEQGYFLQKQQPSGGIFWRAQVGLLSKKLRKLTDCAKTPLFDFRHITEFHGSRKPASF

SEQ ID NO: 157126 - protein, 266 aa, Glycine max
  Coding DNA Sequence Number=SeqID_65441
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDGKSPLKDLIEAQRSSLHRNPTSKLPSGVKSSRSADRLLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAKPFS

SEQ ID NO: 157127 - protein, 127 aa, Glycine max
  Coding DNA Sequence Number=SeqID_65442
MVLFGNLVQPPIVDANSKTVLHPSRNQLLLLIFYHGEASFLRDYLDGTQPLAVGDKINDSSLQKLGYLLLHYIKNHQVESSLVHPISFDAILPPRALDRRLQEDWVKDAREGPRVLMSLRVDFGPMG

SEQ ID NO: 157128 - protein, 213 aa, Glycine max
  Coding DNA Sequence Number=SeqID_65443
  Pfam annotation: Domain name=Transposase_23; Domain location=140-210; Score=-2.3; E_value=0.0021; Accession=PF03017.5; Description =TNP1ENSPM transposase
MDSFEEQATQGSSVPHGRQDVLTAAIGRPEHPGRVRAAGAGVTIKQYFGSAPRTSRNFPSLPPEELQQLTQQIRDQLEESITEKVSRQLMASFGQMQTQFQSQMQSQGLALPLEPLVGPSSPRVSIKGSCVDPSGNDLETGDLDRCGLYIKANPSRLVALGRVYEGSAVVHNTHLLPGQVKMGVEEVKDPDAPVPVPTDEVSLVGQAIHTFLA

SEQ ID NO: 157129 - protein, 83 aa, Glycine max
  Coding DNA Sequence Number=SeqID_65444
MTKARQKGVWKENRGDACHLGELGCFLQKQSPSGGIFWKAQVGLNFTDCALTLFNFRHVAELHGLCYNAFFRLLARHRTLRIA

SEQ ID NO: 157130 - protein, 166 aa, Glycine max
  Coding DNA Sequence Number=SeqID_65445
MPAGRLLEDPRMVCIDQADMTGRLLSGCPIDWAHLIRYRMHKALRSSEPLPYPQLVTLFLQHFEIPLNSEPFVQVKRSFAIGVGAVTSFDYHKDMDGQWLKKDVQPPQDERTPSPLPQRDDSSALMHEVFSELRGPHTYVGERFDSLDGCIDVIDARFAGMDTHIT

SEQ ID NO: 157131 - protein, 218 aa, Glycine max
  Coding DNA Sequence Number=SeqID_65446
MASRKRKSIGSRPTTQYDTRRFSSIDAWNRYTYNVLGRNILPKRKVELYHTELDDFKIELERRNFHKCLTNLVDGSIDLALVKEFYANLYNFEGPSPKQSRVRGHLVKIDADNLNTFLETPMVLAEGETLPIYSRYCRLPTDYKEIEAALCIPGRGFILNTEGHLGKILMKDLTTLAQVWSVLSYSNLAPTSHTSDLIVDKARLIFGLVSRMDMKGIL

SEQ ID NO: 157132 - protein, 43 aa, Glycine max
  Coding DNA Sequence Number=SeqID_65447
MAYEHDQRTTLEDYSSSSERPRGGSTHSKVTVLKPGKKFWKSS

SEQ ID NO: 157133 - protein, 189 aa, Glycine max
  Coding DNA Sequence Number=SeqID_65448
MGVVTDFGRMVAAISGVAPIHSAIAVPDTMARQRQRHHGGLQQLIKQRAAGEIARVGQVRQQQQWNNDRHGYQQRIDDREVDSGCQTACQQIRHYGDDNRAKLCAEDIGVAHHANADRHKQQRHVADQQLTAGFHPRYRDNLQRQQGKQQQHAKDAAGNGKWQQGSKAVAGIQRGIDDGKGAQIAPAGR

SEQ ID NO: 157134 - protein, 101 aa, Glycine max
  Coding DNA Sequence Number=SeqID_65449
MNYEPHWVLLVKILNEVHGTSSCTLLLDRRRARWKTLVLRHQAIHRRQGVMQAPLELVGLGSSSSMDSFASWKINGSGMEKEEREETPLQGEDESRRSSPP

SEQ ID NO: 157135 - protein, 197 aa, Glycine max
  Coding DNA Sequence Number=SeqID_65450
  Gene Ontology: Mol. function=sequence-specific DNA binding; Cellular component=intracellular; Biological process=regulation of transcription, DNA-dependent
  Homolog annotation: Hit_ID=Q13XK1; Match level="QueryCoverage=43%, HitCoverage=28%, E-value=1e-09, Identity=37%"; Hit description =Transcriptional regulator, AraC family
MVWDNNVPGAISGGFPVEAQTALVFAPHQGIKCYCVVEGSCWVAVDGIQQPLLLETGDCVFLTSGKSFSLATHPAAKRQPFVPPDSETGALTQRTGRYPAAGSARDHSRQAGHGNQHYAQCDGMPERGDTNFAARRRFTLAATGADYAGAGAQGISSAGRVGDDADAIPVEMANAAGRRAPEKLARTYFADFIFCRI

SEQ ID NO: 157136 - protein, 87 aa, Glycine max
  Coding DNA Sequence Number=SeqID_65451
  Gene Ontology: Mol. function=transcription regulator activity; Cellular component=nucleus; Biological process=regulation of transcription
  Homolog annotation: Hit_ID=A7QWE9; Match level="QueryCoverage=65%, HitCoverage=10%, E-value=1e-19, Identity=77%"; Hit description =Chromosome undetermined scaffold_203, whole genome shotgun sequence
MVVEVLGQGLFNYLVVNLVLNENLLMVFGSGENLQNKLSNLEELPNASNFSWNYVIFKQFLQSKYGDWVLGWGDGCCREPRKGEEVG

SEQ ID NO: 157137 - protein, 63 aa, Glycine max
  Coding DNA Sequence Number=SeqID_65452
MAPKTWLNSASASDRTSSIKWLIRQVCEVLILICSLSQFVGLASHPLSAPLLRLSARKNLEEG

SEQ ID NO: 157138 - protein, 255 aa, Glycine max
  Coding DNA Sequence Number=SeqID_65453
  Homolog annotation: Hit_ID=A2FDT0; Match level="QueryCoverage=50%, HitCoverage=18%, E-value=1e-10, Identity=32%"; Hit description =Putative uncharacterized protein
HILPFRGLHAPTFRGLYAFAFRGLHVLPFRGLHIIPFRGLHVLHFKGVHVLPFRGLHILAIKGLHVLPIRGLPVLKFRGLHFLPFEGLHALAFRGLQILGFSGLHALTFVGVHALAFIGLHICAFRELKVSIHVAQLISDVIHYLHGSRPQDTQWTQRSPTGPWGFQLWLWASASPTGCPSPQQGITPARHPVDPEESNRVLGFPALITSLYQFYGVPVAPSMVIRPPTNQAFIKKYCAPRQAQCVTPQQPGDGW

SEQ ID NO: 157139 - protein, 440 aa, Glycine max
  Coding DNA Sequence Number=SeqID_65454
  Gene Ontology: Mol. function=hydrolase activity, hydrolyzing O -glycosyl compounds; Cellular component=cell surface; Biological process=carbohydrate metabolic process
  Homolog annotation: Hit_ID=Q9M2X0; Match level="QueryCoverage=97%, HitCoverage=97%, E-value=1e-166, Identity=62%"; Hit description =Putative uncharacterized protein T16K5.230
  Pfam annotation: Domain name=Glyco_hydro_43; Domain location=161-417; Score=-89.5; E_value=3.4e-05; Accession=PF04616.5; Description =Glycosyl hydrolases family 43
MRMRNKYRKPTTLRCNAGSRCSTSVVVLSLLGCLYLLHFYTLIHHRDRNGEESLLRISNHPQFRELQEVEEEDVQIPPPRGKRSPRAAKRRPKRTTTLIDEFLDENSQLRHVFFPGKKIAIDPMQTAVNESYYYYPGRIWLDTDGNPIQAHGGGIIYDKRSRTYYWYGEYKDGPTYQIHKKGAARVDIIGVGCYSSKDLWTWKHKGIVLAAEETDETHDLHMSNVLERPKVIYNERTGKYVMWMHIDDANYTKAAVGVAVSDTPDGPFDYLGSQRPHGYESRDMTVFKDDDGVAYLIYSSEDNSELHMGPLTEDYLNVTSVMRRILVGQHREAPALFKYQGTYYMITSACTGWVPNEALAHAAESILGPWETVGNPCIGGNKMFRLTTFFAQSTFVLPLPGFPGPVDQPLEYSFEFPLWSRVSIYWHRKWRLPHGWNGFK

SEQ ID NO: 157140 - protein, 60 aa, Glycine max
  Coding DNA Sequence Number=SeqID_65455
MVMMNQAVLLILLLLKEKMRLRGIIMTSGRLRMRTLIQMYCYLANMKNNTSSCGQYVSNL

SEQ ID NO: 157141 - protein, 77 aa, Glycine max
  Coding DNA Sequence Number=SeqID_65456
MNNCLLTKSMNTLEVSSLQKSLQVWAHIRDLAPFGRRFTSSLQCITDSLIRGRSTSGVQGKTTLSGYSNYSLLHLAV

SEQ ID NO: 157142 - protein, 383 aa, Glycine max
  Coding DNA Sequence Number=SeqID_65457
  Gene Ontology: Mol. function=transcription regulator activity; Cellular component=nucleus; Biological process=regulation of transcription
  Homolog annotation: Hit_ID=A7R3U8; Match level="QueryCoverage=85%, HitCoverage=99%, E-value=6e-66, Identity=43%"; Hit description =Chromosome chr7 scaffold_572, whole genome shotgun sequence
  Pfam annotation: Domain name=HLH; Domain location=168-217; Score =49.5; E_value=1.2e-11; Accession=PF00010.17; Description=Helix-loop -helix DNA-binding domain
IMEIAYNYYLPELEIEDPTFFDQYQMDSFACPLDDFDFESFSGSPESNSSYHFNSESTPNCFPAESHDQSFTPARPTKRLKNTCASDFISHKVSAFSSSQLISFGHFNAPSPSHASQQFQNLDFDEKASSENMDFAAFVSQGSYEDKSFLSSDNRTNQVGITTRNPIQAQEHIIAERKRRENISKRFIALSAILPGLKKMDKASVLGDAVKYVKQLQERVQTLEEQAAKRTLGSGVLVKRSIIFADDETSDSHCEHSLPEVEVRVSGKDVLIRTQCDKHSGHAAMILSELEKLYFIVQSSSFLPFGNSKTDVTIIAQMNKENCMTAKDLLGRLRQALGHIVMMLGSCASNVWVHRVDSDIGWMIAIEVTAVVIKRTQAPDPNA

SEQ ID NO: 157143 - protein, 305 aa, Glycine max
  Coding DNA Sequence Number=SeqID_65458
  Gene Ontology: Mol. function=protein dimerization activity; Cellular component=cytoplasm; Biological process=proteolysis
  Homolog annotation: Hit_ID=A7PC95; Match level="QueryCoverage=70%, HitCoverage=50%, E-value=1e-102, Identity=80%"; Hit description =Chromosome chr2 scaffold_11, whole genome shotgun sequence
  Pfam annotation: Domain name=Peptidase_M20; Domain location=90-223; Score=8.2; E_value=0.00048; Accession=PF01546.19; Description =Peptidase family M20M25M40
MAANLLATLGDLERDSFVPLLSKLIGESKHPPELIPQEDRVVKHVLDILLPFSTTSSGGPLLVNHVTYHAGRGNLIIEYPGTVPGKILSFVGCHMDVVTVNPNDWDFDPLSLTVDGDKLRGRGTTDCLGHVALVTELVRKLGETKSNLKSTIVAVFIANEENSAITGVGVDALVKDGLLNKLKDGPLYWIDTADKQPGVGTGGMIPWKLHVTGRLFHSGLAHKGHKCARASHGCSKGNSVVILSRLPTSSSGTGLWVCNPFNHETNPMELSRRWNQSNSRGMYYFRRCQINSILQVSYILQYSQK

SEQ ID NO: 157144 - protein, 344 aa, Glycine max
  Coding DNA Sequence Number=SeqID_65459
  Gene Ontology: Mol. function=DNA binding; Cellular component=nucleus; Biological process=regulation of transcription, DNA-dependent
  Homolog annotation: Hit_ID=A7PCC2; Match level="QueryCoverage=94%, HitCoverage=98%, E-value=6e-59, Identity=41%"; Hit description =Chromosome chr2 scaffold_11, whole genome shotgun sequence
  Pfam annotation: Domain name=AT_hook; Domain location=132-144; Score =8.5; E_value=0.82; Accession=PF02178.10; Description=AT hook motif
  Pfam annotation: Domain name=AT_hook; Domain location=98-110; Score =18.9; E_value=0.013; Accession=PF02178.10; Description=AT hook motif
  Pfam annotation: Domain name=DUF296; Domain location=156-269; Score =117.1; E_value=5.3e-32; Accession=PF03479.6; Description=Domain of unknown function (DUF296)
  Pfam module annotation: Pfam domain module=AT_hook::AT_hook::DUF296; Domain location=132-144::98-110::156-269
  Subcellular localization annotation: CTP_CleavageSite=16; ConfidenceScore=5.49e-01
VCIPTLSSYSNASTPRSAMDSREQPQPQPPNMMVGPTVYPSMLAPATARFPYSNNNNNNSNPPPPSSEPLNSDANTNHNNSTFEALKPCALAASESSKKKRGRPRKYSPDGNIALGLGPTHAPASSADPPAKKHRGRPPGSGKKQMDALGIPGTGFTPHVITAEVGEDIASKLVAFCEQGRRTVCTLSASGAIRNVTIRAPDMPAGILAYEGQFEIISLKAATLQSDNNRMAALSVSIAGPDGRLLGGEVVGALTAATAVQSSSSNLKSGRSSTPSSQMLAFGASPTPTTPTSLGPSTDSSEDNENSHFSKGPGGSGLYNNNASQPIHTMPMYQHQLWAGHTQQ

SEQ ID NO: 157145 - protein, 183 aa, Glycine max
  Coding DNA Sequence Number=SeqID_65460
  Gene Ontology: Mol. function=nucleotide binding; Cellular component =cytoplasm; Biological process=small GTPase mediated signal transduction
  Homolog annotation: Hit_ID=Q8VY57; Match level="QueryCoverage=50%, HitCoverage=50%, E-value=1e-38, Identity=84%"; Hit description=ADP -RIBOSYLATION FACTOR-like protein
  Pfam annotation: Domain name=Arf; Domain location=46-179; Score= -25.9; E_value=1.6e-07; Accession=PF00025.12; Description=ADP -ribosylation factor family
MTVKTSDTCSSRRRSQLVGKRMPGADKPVRARQRMRKEKIPHQAPFAIQAAQLLGRAIGAGLFAITPAGERGMCCKAIKLGNARVFPVTTFYVVDAADPDNISISRSELHDLLSKPSLSGIPLLVLGNKIDKAEALSKQALTDQMDLKSITDREVCCFMISCKNSTNIDSVIDWLVKHSKSKS

SEQ ID NO: 157146 - protein, 63 aa, Glycine max
  Coding DNA Sequence Number=SeqID_65461
  Subcellular localization annotation: CTP_CleavageSite=41; ConfidenceScore=5.40e-01
MCCSSYRVTDVIKDPSPNQASSSNPSCWRSLSKVVLAQRLCTAHPSSKIVHPLSQKMSGLASS

SEQ ID NO: 157147 - protein, 143 aa, Glycine max
  Coding DNA Sequence Number=SeqID_65462
MASRKRKSMASRPAAQYDTRHSQSLEAWNRYTDNILGQNIIPERNVKIYHTEFDEFKVELERRNLHKCLTNLQDGSIDVAIVKEFYVNLYRQEEPAPKQARVRGHLIKIDADSLNDFLQTPLVLEEGESLPTYSRFCRLRTKH

SEQ ID NO: 157148 - protein, 49 aa, Glycine max
  Coding DNA Sequence Number=SeqID_65463
MEDWKIFSTESLRRILRILLQLKCSSSCGGSMESNSGSRVWVAFWRRGE

SEQ ID NO: 157149 - protein, 190 aa, Glycine max
  Coding DNA Sequence Number=SeqID_65464
  Subcellular localization annotation: CTP_CleavageSite=51; ConfidenceScore=5.51e-01
MASGPAAPAVHHPASVTRIPLSRREPRPATAAVAPAAAPTAIHSSRPANAAATAVSKRCANGCPAAIVDTPAARYCVRCRNRCAIHYQPAPRWRTSARRDRLNDYASAAGAAHPDARRRRKAGRSFAAHASANPVTPLPFQTPRSAHAEYLRHNNRQRNHGCHGRLAGAPADSAPDAVVQAPPATPECHQ

SEQ ID NO: 157150 - protein, 223 aa, Glycine max
  Coding DNA Sequence Number=SeqID_65465
  Gene Ontology: Cellular component=integral to membrane; Biological process=transport
  Homolog annotation: Hit_ID=A6TEQ7; Match level="QueryCoverage=86%, HitCoverage=29%, E-value=5e-85, Identity=82%"; Hit description =Putative membrane protein, transport
MGTYTIAPRHLRFAIKLACAVVLALFVGFHFQLETPRWAVLTAAIVTAGPAFAAGGEPYSGAIRYRGMLRIAGTFIGCIAALAIIILMIRAPLLMMLVCCLWAGFCTWISSLVKVENSYAWGLAGYTALIIIITIHTDPMLAPQFAVERCSEIVIGIVSAIVADLLFSPRSIKKEIDLELDNLLLDQYRLMQLVSPMAIARWWTKPGERWCAVLPRWKECAAI

SEQ ID NO: 157151 - protein, 131 aa, Glycine max
  Coding DNA Sequence Number=SeqID_65466
  Subcellular localization annotation: CTP_CleavageSite=51; ConfidenceScore=5.16e-01
MKNSSRSLQTSGKSVPGYEKKMQLPQEPLNKKPRVLARKSMAETNSMELCGAATVQKNLVSVFMRDKDQHASHHQEELNLATAHGHKVADEYAQVYAKKEARGRVIDALHQEATMWMDRFALTLNGSQELH

SEQ ID NO: 157152 - protein, 88 aa, Glycine max
  Coding DNA Sequence Number=SeqID_65467
  Homolog annotation: Hit_ID=A5BTC5; Match level="QueryCoverage=98%, HitCoverage=18%, E-value=2e-18, Identity=51%"; Hit description =Putative uncharacterized protein
MEIWKMLEVTHEGTADVRKARNHTLVSEYEAFRMKNGETILELQTRFTYIVNHLLRLGKVFKDDELNIKILICLTRTWEPKITAIKES

SEQ ID NO: 157153 - protein, 145 aa, Glycine max
  Coding DNA Sequence Number=SeqID_65468
VKVVSFRVSQLRSPLGAMWLKRVKTPVAKRALCAKPECHFGEAELSTLCCPKLRLSSAKRESAAMASKKRKAPSTPSQVRYDQSRFTSQEAWERYTDIIVPRKLLPERNVVVYYTEFDEFKEELKRRHWDEELTDFADCSIDVAI

SEQ ID NO: 157154 - protein, 98 aa, Glycine max
  Coding DNA Sequence Number=SeqID_65469
MHLSVDFASTQTSSIPEGKTSELVPLDLQIEATFRRNNSERIRKLLHDKTIASILEEAHFSESSSSNSPISRESQTAEIEAEVMAEEQPRRVTLEDDS

SEQ ID NO: 157155 - protein, 496 aa, Glycine max
  Coding DNA Sequence Number=SeqID_65470
  Gene Ontology: Mol. function=transcription factor activity; Cellular component=intracellular; Biological process=regulation of transcription, DNA-dependent
  Homolog annotation: Hit_ID=A7MLK3; Match level="QueryCoverage=62%, HitCoverage=80%, E-value=1e-100, Identity=55%"; Hit description =Putative uncharacterized protein
  Pfam annotation: Domain name=DUF405; Domain location=1-94; Score =36.6; E_value=1.7e-09; Accession=PF04171.3; Description=Protein of unknown function (DUF405)
  Pfam annotation: Domain name=DUF418; Domain location=163-323; Score =164.3; E_value=3.2e-46; Accession=PF04235.3; Description=Protein of unknown function (DUF418)
  Pfam annotation: Domain name=LacI; Domain location=356-381; Score =50.9; E_value=4.5e-12; Accession=PF00356.12; Description=Bacterial regulatory proteins, lacI fa
  Pfam module annotation: Pfam domain module=DUF405::DUF418::LacI; Domain location=1-94::163-323::356-381
MDGLAQLKFLTLFALLFGAGLALQVPLGSRWISSRLTLLVFIGFIHAVFLWEGDILLDYGLIGLIVWRMLRDVPSERALLHTGVLLYLVGCAVLLVFGVISSPQPTRSWLPGAADLEYESYWKLVGGWEAVQNRLEHLSSGLMALASQYGWQLAGLMLIGAALMRSGWLSGQFSLQHYRRAAALLLTIGWLIAIPGVLAQWLLQWEFRWSGFFLQVPRDLASPFISLGYAALCLGYWPAIAATRISYAIQCVGRMALSNYLLQTLICTTLFYRFDLFLKFDRLQLLAFVPAIWLVNILFSVLWLRVFPQGPMEWLWRRLTQLAAGKADNACFRCPDRIAPLRASRAFSPLWNNCMITIRDVARQAGVSVATVSRVLNNSSAVTSDTREAVLQAVESLGYRPNANAQALATQVSDTIGVVVMDVSDPFFGALVKAVDTVAQRMHKHVLISNSWHQEEKERHAIEVLIRQRCNALVVHAKTLTDAELARFMDQFPVWY

SEQ ID NO: 157156 - protein, 206 aa, Glycine max
  Coding DNA Sequence Number=SeqID_65471
  Gene Ontology: Cellular component=integral to membrane
  Homolog annotation: Hit_ID=P0AFY4; Match level="QueryCoverage=94%, HitCoverage=88%, E-value=8e-92, Identity=78%"; Hit description =Protein sanA
  Pfam annotation: Domain name=DUF218; Domain location=28-153; Score =97.9; E_value=3.2e-26; Accession=PF02698.8; Description =Uncharacterized ACR, COG1434
MATALGLDRWISWRTAPFIYEDVASLPHRQVGVVLGTAKYYRTGVINQYYLYRIQGALNAYNSGKVNYLLLSGDNALQSYNEPMTMRRDLIKAGVDPSDIVLDYAGFRTLDSIRFHCERALYIAQHLGIQAQCYAVPSPKNMLSVRFREVGARLGALADLYLMKREPRFLGPLVPIPAVHEVPEDAQSYPAVTPEQLLELEEKLRK

SEQ ID NO: 157157 - protein, 389 aa, Glycine max
  Coding DNA Sequence Number=SeqID_65472
  Gene Ontology: Mol. function=methionine-tRNA ligase activity; Cellular component=cytoplasm; Biological process=tRNA aminoacylation for protein translation
  Homolog annotation: Hit_ID=Q8FFX8; Match level="QueryCoverage=100%, HitCoverage=57%, E-value=0.0, Identity=93%"; Hit description =Methionyl-tRNA synthetase
  Pfam annotation: Domain name=tRNA-synt_1; Domain location=6-373; Score=-408.1; E_value=0.011; Accession=PF00133.13; Description=tRNA synthetases class I (I, L, M and V)
  Pfam annotation: Domain name=tRNA-synt_1g; Domain location=8-389; Score=721.3; E_value=6.9e-214; Accession=PF09334.2; Description=tRNA synthetases class I (M)
  Pfam module annotation: Pfam domain module=tRNA-synt_1::tRNA-synt_1g; Domain location=6-373::8-389
MTQVAKKLLVTCALPYANGSIHLGHMLEHIQADVWVRYQRMRGNQVFFICADDAHGTPIMLKAQQLGIAPEQMIAEMKQEHETDFAGFNISYDNYHSTHGDENRQLSELIYTRLKENGFIKNRTISQLYDPEKGMFLPDRFVKGTCPKCKSPDQYGDNCEVCGATYSPTELIEPKSVVSGATPVMRDSEHFFFDLPSFSAMLQAWTRSGALQEQVANKMQEWFEAGLQQWDISRDAPYFGFEIPGAPGKYFYVWLDAPIGYMGSFKNLCDKRGDIDFDEFWKKDSSTELYHFIGKDIVYFHSLFWPAMLEGSNFRKPTNLFVHGYVTVNGAKMSKSRGTFIKASTWLQHLDADSLRYYYAAKLSSRIDDIDLNLEDFVQRVNADIVNKV

SEQ ID NO: 157158 - protein, 383 aa, Glycine max
  Coding DNA Sequence Number=SeqID_65473
  Gene Ontology: Mol. function=catalytic activity; Cellular component =cytoplasm; Biological process=metabolic process
  Homolog annotation: Hit_ID=P0A992; Match level="QueryCoverage=91%, HitCoverage=100%, E-value=1e-180, Identity=89%"; Hit description =Fructose-bisphosphate aldolase class 1
  Pfam annotation: Domain name=DeoC; Domain location=101-359; Score =287.6; E_value=2.6e-83; Accession=PF01791.10; Description =Deoxyribose-phosphate aldolase
MESAICQPGAFRSRLWGRIGRCRFFSSHLSGANMTDIVQLLGKEADTLLQHRCMTIPADSLYLPGADYVDRVMIDNNRSPAVLRNMQTLYNTGRLAGTGYLSILPVDQGVEHSAGASFAANPAYFDPKNIVELAIEAGCNCVASTYGVLASVSRRYAHRIPFMVKLNHNETLSYPTQYDQTLYASVEQAFNMGAVAVGATIYFGSEQSRRQIEEIAAAFERAHELGMVTVLWAYLRNNDFKKDGVDYHASADLTGQANHLAATIGADIVKQKMAENNGGYNAVKFGHTDERVYSKLTSENPIDLVRYQLANCYMGRAGLINSGGASAGATDVAESVRTAVINKRAGGMGLILGRKAFKKSLKEGVALINAVQDVYLAKDVTIA

SEQ ID NO: 157159 - protein, 142 aa, Glycine max
  Coding DNA Sequence Number=SeqID_65474
  Gene Ontology: Mol. function=chorismate mutase activity; Cellular component=periplasmic space; Biological process=aromatic amino acid family biosynthetic process
  Homolog annotation: Hit_ID=UPI00005F8022; Match level="QueryCoverage =98%, HitCoverage=77%, E-value=1e-36, Identity=52%"; Hit description =COG1605: Chorismate mutase
  Pfam annotation: Domain name=CM_2; Domain location=1-60; Score=14.9; E_value=0.00064; Accession=PF01817.12; Description=Chorismate mutase type II
MKDVAGYKAQHHQPIEDLGQERKVRDKALAEARELGLDDATVQPFIQAQMDVAKAVQYRYRADWLATPEPHWQPRPLDEVRKSIGHYSDAILTQLAAQLKQGATLQAPQKAEFMRDIQQRNVSPQDKELLWRTLSAVTLRQP

SEQ ID NO: 157160 - protein, 183 aa, Glycine max
  Coding DNA Sequence Number=SeqID_65475
  Homolog annotation: Hit_ID=A5B939; Match level="QueryCoverage=21%, HitCoverage=24%, E-value=6e-07, Identity=69%"; Hit description =Putative uncharacterized protein
TGKPSDSALCAYSERNRVKFLNRDVAADGNVRESGDPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 157161 - protein, 24 aa, Glycine max
  Coding DNA Sequence Number=SeqID_65476
MGEEVAAQLAKTSWWISLEETFSP

SEQ ID NO: 157162 - protein, 197 aa, Glycine max
  Coding DNA Sequence Number=SeqID_65477
MGDPIGRLSFPENNETFSSLTSYPELRRSEFLIRGYVGARASLLSTIPPFVAMTQELVARGDTLRLSAPRHSVTPSVIHEQRPIWSSAPFPEMSAFSDGDFSSLTSYPELRHVTCTLVSSRGGGPDDTRRYLTVIRTLLSSRGGGPDDKQRPKTKFGHSAPLYHPEAAGPMIRGDTLAVIRTLLSSRGGRPDDKQRP

SEQ ID NO: 157163 - protein, 81 aa, Glycine max
  Coding DNA Sequence Number=SeqID_65478
MGHLSDQGVPMNPKRIKVIPEWTTPPSVEGRSPEFEEPLDLRSNPFQGGRNDAILPPPQGHWIEDSKKIKTEMQEKTLGFS

SEQ ID NO: 157164 - protein, 132 aa, Glycine max
  Coding DNA Sequence Number=SeqID_65479
MSKPYSTGSSIGIELTSTSSNEFNTEQQAHTPLVLHTIVPLYNRPLVLVPLRTPAHSPFLICQSTRPHDQRRSSCIAHIASCNRASTITECTTRQMGVVGLVLAMVAAGSLARGTMRCTSEVGSYAVGSFAG

SEQ ID NO: 157165 - protein, 331 aa, Glycine max
  Coding DNA Sequence Number=SeqID_65480
  Gene Ontology: Biological process=transposition, DNA-mediated
  Homolog annotation: Hit_ID=Q6UUU1; Match level="QueryCoverage=31%, HitCoverage=93%, E-value=1e-20, Identity=47%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDSKWKLCVWHKNQNKYQTGDKKDETGYLVYGKWIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPGGSLVRSLFLPFGLPVSFRCMAAFVSSTPDTQFR

SEQ ID NO: 157166 - protein, 173 aa, Glycine max
  Coding DNA Sequence Number=SeqID_65481
  Homolog annotation: Hit_ID=A5B939; Match level="QueryCoverage=50%, HitCoverage=55%, E-value=9e-28, Identity=68%"; Hit description =Putative uncharacterized protein
MSRRARRSLQNPGREPGRSGRRCRSWCLPTLETAQPEVGSSGWKSTARRVVSGAPPAALENPEDRVPPTPGRTHNRIRSPRQGKSAKWIRNLGKGLALRAGHGGPSPEPVGCRWTARAASARERSSRAVGDDWNGPFGLSRASTVNSELKFNQARVNGGSNYDSLKVAKCLVI

SEQ ID NO: 157167 - protein, 62 aa, Glycine max
  Coding DNA Sequence Number=SeqID_65482
MEMAPRKLASKRSRKDKAAEGTSSAPEYDSHRFRVLYTSSASRPSRDGHFLRSDASSSGRRV

SEQ ID NO: 157168 - protein, 68 aa, Glycine max
  Coding DNA Sequence Number=SeqID_65483
  Homolog annotation: Hit_ID=P03845; Match level="QueryCoverage=61%, HitCoverage=100%, E-value=9e-12, Identity=76%"; Hit description =Putative uncharacterized protein 1
MDTLAPVSPWANIYARRQGADAAGDSVVLLHVFPGWTQDDSYRIRRSGRTERGVRAYSPAWSELPTRN

SEQ ID NO: 157169 - protein, 144 aa, Glycine max
  Coding DNA Sequence Number=SeqID_65484
MVVSFFLTHLLLEVASPIIFLPSPFCYHDLLEAKDSIDEEDPSPTSSTWSYIKGLGLLGFLSLNCMHTSHSSFFVLQISICPLLIIPYSSSSAIRHVSTSCDSHGCCHSLISSGDNHLQAFGFLPVQLSFSTPIVTHSIKLVNI

SEQ ID NO: 157170 - protein, 83 aa, Glycine max
  Coding DNA Sequence Number=SeqID_65485
MRDTQVALMDTIYEKVRSSFFSATICWSVVFAGLQVINKIRPITWLRALSLLRQTPSGHNGKTLMWGSKDRLATDSTDRFPVE

SEQ ID NO: 157171 - protein, 220 aa, Glycine max
  Coding DNA Sequence Number=SeqID_65486
  Homolog annotation: Hit_ID=Q6WAY6; Match level="QueryCoverage=42%, HitCoverage=16%, E-value=6e-11, Identity=39%"; Hit description =Putative uncharacterized protein
  Subcellular localization annotation: CTP_CleavageSite=19; ConfidenceScore=5.07e-01
SHTSFIMKVDPSVPYKVTACMPRRGRKIGSDSWLGFSNVPLMGTRGCINYNPVLAIRQLGYPMRGALSEESIVPFIAWGFSNPNARILQGVHKAWSTVQRKDKELRGSNNGIIGSYHKWLKAWTQELDWLLKLKVSSEEEAETPEESEEVKALKAKLERAQAVKEKFKTTTIMVRKECDGLRDVNVATVRERPVKSRRHDIGRQVEGMSEVKEEFVRAIE

SEQ ID NO: 157172 - protein, 202 aa, Glycine max
  Coding DNA Sequence Number=SeqID_65487
  Gene Ontology: Mol. function=kinase activity
  Homolog annotation: Hit_ID=A4W5J3; Match level="QueryCoverage=99%, HitCoverage=60%, E-value=2e-69, Identity=67%"; Hit description=PfkB domain protein
MKIFHLGYLCFSTAWIMPDDEFGTRSARLLAQMRDQGYETSLDLVSRKGDPRYQPLVHPALRHLDYLVINELEAGEFSGLTMRDENDAPHIAHIAEAAAQLLAAGVRQRVVIHCPEGAWGEAPGEKGRWIPSWMLEQGEIIGSVGAGDAFCAGFLYGCHESLPLTESIYLAHACARASLLAANAIDGAKTLAELQLFIKEHR

SEQ ID NO: 157173 - protein, 118 aa, Glycine max
  Coding DNA Sequence Number=SeqID_65488
  Gene Ontology: Mol. function=4 iron, 4 sulfur cluster binding; Cellular component=formate dehydrogenase complex; Biological process= formate metabolic process
  Homolog annotation: Hit_ID=P07658; Match level="QueryCoverage=95%, HitCoverage=15%, E-value=9e-57, Identity=93%"; Hit description =Formate dehydrogenase H
  Pfam annotation: Domain name=Molybdop_Fe4S4; Domain location=1-54; Score=78.0; E_value=3.2e-20; Accession=PF04879.7; Description =Molybdopterin oxidoreductase Fe4S4 domain
MKKVVTVCPYCASGCKIHLVVDNGKIVRAEAAQGKTNQGTLCLKGYYGWDFINDTQILTPRLKTPMIRRERGGKLEAVSWNEALDYVATRLSAIKAKYGPDAIQTTGSSRGTGMKLTM

SEQ ID NO: 157174 - protein, 67 aa, Glycine max
  Coding DNA Sequence Number=SeqID_65489
MVGYAHSSFADLVFAGERIEAGLKRGKFDHLALMNEKIGANKEDEKEGETHAVCGVPKIMTGLIVMI

SEQ ID NO: 157175 - protein, 102 aa, Glycine max
  Coding DNA Sequence Number=SeqID_65490
MAYERGGDFLEDARKILNREAFPPGGSLVRSPVPAFRFTGVIPLLWPRLSHSTPDTQFRVGSSLQAGLYARTPVQSDRCALSGNYRLESNPEDMQKHTAAAT

SEQ ID NO: 157176 - protein, 125 aa, Glycine max
  Coding DNA Sequence Number=SeqID_65491
  Gene Ontology: Mol. function=protein binding; Biological process =auxin mediated signaling pathway
  Homolog annotation: Hit_ID=Q9SJK4; Match level="QueryCoverage=85%, HitCoverage=88%, E-value=2e-18, Identity=43%"; Hit description =Putative auxin-induced protein
  Pfam annotation: Domain name=Auxin_inducible; Domain location=24-112; Score=90.3; E_value=6.2e-24; Accession=PF02519.5; Description=Auxin responsive protein
MEMKVRLLKCWLREFSKFIRKVRVIFPILVRYYCSPHENSHSYVPKDVPKGYLVVYVGEDCKRFVIKVGILNHPLFQALLDHAENVFGFTNYSKLHIPCNENIFLLILQNIAGDLVQDQRLFNCF

SEQ ID NO: 157177 - protein, 213 aa, Glycine max
  Coding DNA Sequence Number=SeqID_65492
  Gene Ontology: Mol. function=dolichyl-diphosphooligosaccharide -protein glycotransferase activity; Cellular component=cellulose and pectin-containing cell wall; Biological process=protein amino acid glycosylation
  Homolog annotation: Hit_ID=A7PI36; Match level="QueryCoverage=60%, HitCoverage=28%, E-value=3e-58, Identity=83%"; Hit description =Chromosome chr13 scaffold_17, whole genome shotgun sequence
  Pfam annotation: Domain name=Ribophorin_I; Domain location=2-167; Score=-144.4; E_value=4.2e-06; Accession=PF04597.5; Description =Ribophorin I
MVMFYWSTVRIPTLSKLNVSELEIEPRYPLFGGWKSTFVIGYGLPLQDFLFESPDGRRYLNFTFGCPLVETVVDKLIVVLPEGSKDPTVEIPFEVKQHLEIKYSYLDVVGRTVVVLEKRNAVPEHNTPFQVYYRFNPIFMLAEPLMLAVTEQIQGFLILEGHIALWQFCVELRGLIAVIDILVCTIFPRQFDLVPFIQTNFEPFLLFKKHRIC

SEQ ID NO: 157178 - protein, 502 aa, Glycine max
  Coding DNA Sequence Number=SeqID_65493
  Gene Ontology: Mol. function=intramolecular transferase activity, phosphotransferases; Biological process=carbohydrate metabolic process
  Homolog annotation: Hit_ID=A7PI40; Match level="QueryCoverage=88%, HitCoverage=77%, E-value=1e-175, Identity=73%"; Hit description =Chromosome chr13 scaffold_17, whole genome shotgun sequence
  Pfam annotation: Domain name=PGM_PMM_I; Domain location=1-88; Score= -41.0; E_value=0.039; Accession=PF02878.7; Description=Phosphoglucomut asephosphomannomutase, alphabetaalpha domain I
  Pfam annotation: Domain name=PGM_PMM_II; Domain location=126-259; Score=22.6; E_value=1.3e-06; Accession=PF02879.7; Description =Phosphoglucomutasephosphomannomutase, alphabetaalpha domain II
  Pfam annotation: Domain name=PGM_PMM_III; Domain location=261-385; Score=2.1; E_value=0.0091; Accession=PF02880.7; Description =Phosphoglucomutasephosphomannomutase, alphabetaalpha domain III
  Pfam annotation: Domain name=PGM_PMM_IV; Domain location=415-486; Score=3.1; E_value=0.028; Accession=PF00408.11; Description =Phosphoglucomutasephosphomannomutase
  Pfam module annotation: Pfam domain module=PGM_PMM_I::PGM_PMM_II::PGM_ PMM_III::PGM_PMM_IV; Domain location=1-88::126-259::261-385::415-486
MSAITWPTICLYCFTLMLFFQASTPAMFNSTLTKNEAFLCPADGSIMITASHLPFNRNGFKFFTNAGGLGKADIKDILERAADIYNRFTEESLTNSERKASLSIKKVDYMIVYTSDLVKAVRKAAGNIGMTLLKYFYNKKPLGGFHIVVDAGNGAGGFFAAKVLEPLGAITSGSQFLEPDGNYYAWRNDFNWVWQMDFNSLSNKWLFYSGLFPNHIPNPEDKTAMKAITQAVLDNKVDLGIIFDTDVDRSAAVDFTGREFNRNRLIALMAAIVLEEHPGTTIVTDSVTSDGLTTFIEKKLGGRHHRFKRGYKNVIDEAIRLNSIGEESHLAIETSGHGALKENHWLDDGAYLMVKILNKLASARASGKGGGSKVLTDLIDGLQEPDFAVELRLKINQNHPDLKGGAFRSFREYGEAVLKHLENSIGSDPSLHKAPVNYEGVRVSGYGGWFLLRLSLHDPVLPLNIEAPSNDDAVKLGLAVLAAVKDFAGLDTSALNKFVGAS

SEQ ID NO: 157179 - protein, 176 aa, Glycine max
  Coding DNA Sequence Number=SeqID_65494
  Gene Ontology: Mol. function=anthranilate synthase activity; Biological process=folic acid and derivative biosynthetic process
  Homolog annotation: Hit_ID=A7PI60; Match level="QueryCoverage=88%, HitCoverage=33%, E-value=2e-36, Identity=53%"; Hit description =Chromosome chr13 scaffold_17, whole genome shotgun sequence
  Subcellular localization annotation: CTP_CleavageSite=30; ConfidenceScore=5.15e-01
MNSPLRLFSSELTCPASESMQYTNSSLRVSCFIKKGGGVRVSNRNGRNAKAVVCCQLMHSHKEEESNERKRKLQEPVLVPVQKADFVRTLLIDNYDSYTYNVYQELSIINGVPPVVIQNDDWTWEELCHYLYEENAFDNIVISPGPGSPACPEDIGEDLRMPLWIDNFTTFASCFK

SEQ ID NO: 157180 - protein, 559 aa, Glycine max
  Coding DNA Sequence Number=SeqID_65495
  Gene Ontology: Mol. function=calmodulin binding; Cellular component =integral to membrane; Biological process=cell death
  Homolog annotation: Hit_ID=Q56BA4; Match level="QueryCoverage=97%, HitCoverage=98%, E-value=0.0, Identity=67%"; Hit description=MLO1
  Pfam annotation: Domain name=Mlo; Domain location=8-476; Score=951.0; E_value=4.9e-283; Accession=PF03094.6; Description=Mlo family
MSDKEANLQAKLEATSTWAVAVVCFVMLAISILIEHILEELGKWLKKKHQKALHEALEKVKGELMLLGFISLLLVVFQDRISTICIPKSIASTWHPCDPDYKSKKPEGYYDKCAEKGKDLVAFMSEYSIHQLHIFVFVLAIFHILQCIMTLTLGRTKMSKWRKWEDETKSVEHQFYHDPERFRFARDTTFGRRHLSSWSRSPISLWIVSFFRQFYRSLNKVDYMALRHGFIVAHLTPASEAKFDFQNYIKRTLDEDFAVVVGITPTIWFFAVLILLTNTHGWHSYLWIPFIPVIIILLVGTKLQMIITEMALRIQDRGEVVKGAPVVEPGDGLFWFNRPRFILFLIHLVLFQNAFQLAFFAWSTFDNGFKINSCFHRTTADIVIRLTMGVLTQVLCSYVTLPLYALVTQMGSTMKPTIFNENVATALMNWHHSARNHIKHNKGSTSNTPFSSRPGTPTHGMSPVHLLHKHPRHSDSPIVSPMAYNYENEQWGVEGIHSPNHHARDHDHDHGETMQMQQPTAPTADLPPSGLNPIRTQHEINIALSEFSFGRGHHTGSNN

SEQ ID NO: 157181 - protein, 47 aa, Glycine max
  Coding DNA Sequence Number=SeqID_65496
MEKKAENNERTNGSTTKGSKSKHRNTNPNTKLTEAVGYAHGSTKIPF

SEQ ID NO: 157182 - protein, 531 aa, Glycine max
  Coding DNA Sequence Number=SeqID_65497
  Gene Ontology: Mol. function=transporter activity; Cellular component= mitochondrial inner membrane; Biological process=transport
  Homolog annotation: Hit_ID=A7PI87; Match level="QueryCoverage=83%, HitCoverage=54%, E-value=0.0, Identity=74%"; Hit description =Chromosome chr13 scaffold_17, whole genome shotgun sequence
  Pfam annotation: Domain name=Mito_carr; Domain location=242-326; Score=51.3; E_value=3.4e-12; Accession=PF00153.18; Description =Mitochondrial carrier protein
  Pfam annotation: Domain name=Mito_carr; Domain location=351-430; Score=22.5; E_value=2.5e-05; Accession=PF00153.18; Description =Mitochondrial carrier protein
  Pfam annotation: Domain name=Mito_carr; Domain location=435-523; Score=97.3; E_value=4.9e-26; Accession=PF00153.18; Description =Mitochondrial carrier protein
  Pfam annotation: Domain name=efhand; Domain location=80-108; Score =26.5; E_value=0.0001; Accession=PF00036.23; Description=EF hand
  Pfam module annotation: Pfam domain module=Mito_carr::Mito_carr::Mito_ carr::efhand; Domain location=242-326::351-430::435-523::80-108
MRPDPKRASSNSKPSYPLHLEEPFPIIWQQAFRTSGTFHLPTNLNLCDYFFGPDIPTGMGFSQLPNLSSRGSQPLQLLRKGRRFFEELDRDGDGQVTLEDLEVAMRKRKLPRRYAKEFMSRARSHLFSRSFGWKQFLSLMEQKEPTILRAYTSLCLSKSGTLKKSEILESLKNAGLPANEDNAVAMMRFLKADTEESISYGHFRNFMLLLPSDRLQEDPRSIWFEAATVVAVPPAVEIPAGSVLRSALAGGLSCALSCALLHPVDTIKTRVQASTMSFPEIISKLPEIGRRGLYRGSIPAILGQFSSHGLRTGIFEASKLVLINIAPTLPELQVFRFCALYNLVLVKAVRKVVENIAKLCAVRIPCEVLKQRLQAGLFDNVGEAFVATWEQDGLRGFFRGTGATLCREVPFYVAGMGLYAESKKVAERLLERELGPLETIAVGALSGGLAAVVTTPFDVMKTRMMTAQGRSVSMTLIAFSILKHEGPLGLFKGAVPRFFWIAPLGAMNFAGYELAKKAMNKNEEGKAGRSE

SEQ ID NO: 157183 - protein, 102 aa, Glycine max
  Coding DNA Sequence Number=SeqID_65498
MVHTKRRNHWHQKKMNDLVYVMYNLKLKSESGSGSNIDLVGGSLSDPTLDAFDIDNLILKDNVEDHFSTEEELEDDGDDDDGGGGGGGGDIGDDLIRGLMDI

SEQ ID NO: 157184 - protein, 308 aa, Glycine max
  Coding DNA Sequence Number=SeqID_65499
  Gene Ontology: Mol. function=high molecular weight B cell growth factor receptor binding; Cellular component=extracellular region; Biological process=cell proliferation
  Homolog annotation: Hit_ID=A7PI80; Match level="QueryCoverage=59%, HitCoverage=57%, E-value=6e-73, Identity=80%"; Hit description =Chromosome chr13 scaffold_17, whole genome shotgun sequence
MQNPDANQLPEVDSLPDGFVESTTEPLAPATPSPEQEKPLNSYKDDGPSDLIHSNERSNDLGEKEFQNNHDCSAESPSRSSMQQTEGAQITPPVANSVPESLLSSCCEEECKRVSTEGQNLRLDLSAKFQDAIKDVSNKLEERKDECLSQLKENDMLRNKLRQLVEQYELSEQQHAQKLKQKSLELQLADLKIKQHEEKLVQERSQIKVYAEQVSQLLATEKSLRLQLTTDGEKFQQFQEALSKSNEIFETFKQEIEKMAKSIKELKKENQFLKSKSEKSDVTLIELVDEAERKQNSSENKSNNSVQT

SEQ ID NO: 157185 - protein, 575 aa, Glycine max
  Coding DNA Sequence Number=SeqID_65500
  Gene Ontology: Mol. function=catalytic activity; Cellular component =membrane; Biological process=carbohydrate metabolic process
  Homolog annotation: Hit_ID=A7Q7F4; Match level="QueryCoverage=95%, HitCoverage=98%, E-value=0.0, Identity=89%"; Hit description =Chromosome chr18 scaffold_59, whole genome shotgun sequence
  Pfam annotation: Domain name=GDE_C; Domain location=187-521; Score= -242.2; E_value=0.031; Accession=PF06202.5; Description=Amylo-alpha-1, 6-glucosidase
  Pfam annotation: Domain name=Invertase_neut; Domain location=80-548; Score=1193.0; E_value=0; Accession=PF04853.3; Description=Plant neutral invertase
  Pfam module annotation: Pfam domain module=GDE_C::Invertase_neut; Domain location=187-521::80-548
MDGHMGMRKISSHCSIPDLDDSDILRLLEKPKLNIERQRSFDERSLSELSIGLARAGLDNYDTYSPGGRSGFNTPASSTRNSFEPHPMVADAWESLRKSLVYFRGQPVGTIAAVDHQSEEVLNYDQVFVRDFVPSALAFLMNGEPEIVRNFLLKTLHLQGWEKRVDRFKLGEGVMPASFKVLHDPIRKTDTLIADFGESAIGRVAPVDSGFWWIILLRAYTKSTGDLSLAESPDCQKGMKLILTLCLSEGFDTFPTLLCADGCCMVDRRMGIYGYPIEIQALFFMALRCALSMLKQDDAEGKECVERIVKRLHALSYHMRSYFWLDFQQLNDIYRYKTEEYSHTAVNKFNVIPDSIPEWVFDFMPMRGGYFIGNVSPARMDFRWFALGNCVAILSSLATPEQSMAIMDLIESRWDELVGEMPLKISYPAIESHEWRIVTGCDPKNTRWSYHNGGSWPVLLWLVTAACIKTGRPQIARRAIELAESRLLKDGWPEYYDGKLGRYIGKQARKYQTWSIAGYLVAKMMLEDPSHLGMISLEEDKQMKPKVRDIVVSIHGTILGDSLPRRLDWKFGLLV

SEQ ID NO: 157186 - protein, 456 aa, Glycine max
  Coding DNA Sequence Number=SeqID_65501
  Gene Ontology: Mol. function=L-isoleucine transmembrane transporter activity; Cellular component=integral to membrane; Biological process=amino acid transport
  Homolog annotation: Hit_ID=Q949Y8; Match level="QueryCoverage=84%, HitCoverage=70%, E-value=1e-136, Identity=62%"; Hit description =Putative uncharacterized protein At2g39130
  Pfam annotation: Domain name=Aa_trans; Domain location=153-448; Score= 16.0; E_value=1.1e-05; Accession=PF01490.9; Description=Transmembrane amino acid transporter protein
MNNSVSENSFIIESDEEDEEKDLNKGGVDGNDSDSSNYSNENPPQRKPSSYNISWPQSYRQSIDLYSSVPSPNIGYLGTPSLSRLSSSFLSTSLTRRHTPEALPSVAKPLIQDTEDEQHQRRSSHTLLPPLPSRRSSLIKKDSKVIHHEVPSGHCSFGQAVLNGINVLCGVGILSTPYAAKVGGWLGLSILVIFAIISFYTGLLLRSCLDSEPELETYPDIGQAAFGTTGRIAISVSHHADLYSYLKCPCPIRFSHGDNLSSLFPSAHLNLGGIELNSHTLFAVITTLAVLPTVWLRDLSILSYISAGGVVASILVVLCLLWVGIEDVGFHSKGTTLNLATLPVAVGLYGYCYSGHAVFPNIYTSMANPNQFPGVLLACFGICTLLYAGAAVLGYTMFGEAILSQFTLNMPKELVATKIAVWTTAALCITIITVGVVCSAFGSYSALAEIVKSLRG

SEQ ID NO: 157187 - protein, 782 aa, Glycine max
  Coding DNA Sequence Number=SeqID_65502
  Gene Ontology: Mol. function=RNA binding; Cellular component=voltage -gated potassium channel complex; Biological process=potassium ion transport
  Homolog annotation: Hit_ID=Q9SS47; Match level="QueryCoverage=94%, HitCoverage=72%, E-value=0.0, Identity=51%"; Hit description =Putative RNA binding protein
  Pfam annotation: Domain name=NABP; Domain location=72-414; Score =108.6; E_value=1.9e-29; Accession=PF07990.3; Description=Nucleic acid binding protein NABP
  Pfam annotation: Domain name=PUF; Domain location=415-449; Score =41.6; E_value=2.7e-09; Accession=PF00806.10; Description=Pumilio -family RNA binding repeat
  Pfam annotation: Domain name=PUF; Domain location=451-485; Score =39.2; E_value=1.4e-08; Accession=PF00806.10; Description=Pumilio -family RNA binding repeat
  Pfam annotation: Domain name=PUF; Domain location=487-521; Score =33.9; E_value=5.6e-07; Accession=PF00806.10; Description=Pumilio -family RNA binding repeat
  Pfam annotation: Domain name=PUF; Domain location=523-557; Score =33.9; E_value=6e-07; Accession=PF00806.10; Description=Pumilio -family RNA binding repeat
  Pfam annotation: Domain name=PUF; Domain location=559-593; Score =39.5; E_value=1.2e-08; Accession=PF00806.10; Description=Pumilio -family RNA binding repeat
  Pfam annotation: Domain name=PUF; Domain location=596-630; Score =30.1; E_value=8.1e-06; Accession=PF00806.10; Description=Pumilio -family RNA binding repeat
  Pfam annotation: Domain name=PUF; Domain location=632-666; Score =30.9; E_value=4.8e-06; Accession=PF00806.10; Description=Pumilio -family RNA binding repeat
  Pfam annotation: Domain name=PUF; Domain location=674-708; Score =26.3; E_value=0.00011; Accession=PF00806.10; Description=Pumilio -family RNA binding repeat
  Pfam module annotation: Pfam domain module=NABP::PUF::PUF::PUF::PUF::P UF::PUF::PUF::PUF; Domain location=72-414::415-449::451-485::487 -521::523-557::559-593::596-630::632-666::674-708
  Subcellular localization annotation: CTP_CleavageSite=74; ConfidenceScore=5.02e-01
MSRPASHNAFGDIMGSTGIVDRESFEGLRSSASTPGLVGLQNHSLNLSHSFAPAVGTSPSRVKTPEAQVIGRPVASAASQMGNKVFSVENIGMGLGTQHGHSSNMTDLTDVVSSLAGLNLSGARHAEQDSLLKSKLQMEVDNHADVLLSTQSNVNLPRRNDIATNLNTFSSNEHVNLLKKTASSANLRSKLHSTGNASSFPNADFTGHVPSAYLVNSKLNSVYNNNLETALRLRRDGQSLDAQGNHVGPELHSSTLNPHLIQCLQQSSDYSMQGMSSSGYPLQMRNFPDASHGDLEGLRKAYLETLLTQQKQQYELPLLSKSGLTNGFYGSQPYGLGMPYSGKQIANSTLPSLGSGNPLFENERISRLNSMMRSSVGGSGGSWHADIGNNIEGRFASSLLDEFKNKKTRPFELPDIIDHVVQFSTDQYGSRFIQQKLETASVEEKTKIFPEIIPHARALMTDVFGNYVIQKFFEHGTDSQRKELASQLTGHVLPLSLQMYGCRVIQKALEVVDADQQGQLVSELNGAIMKCVRDQNGNHVIQKCIECVPQDKIQFIVSSFYGQVVLLSTHPYGCRVIQRVLEHCDDLNTQQIIMDEIMQSVGTLAQDQYGNYVIQHIVEHGKPHERTAIISKLAGQIVKMSQQKFASNVIEKCLAFGSPEERQILVNEMLGTSDENEPLQAMMKDPFGNYVVQKVLETCDDRSLELILSRIKVHLNALKRYTYGKHIVSRVEKLITTGGEKCKDLGVFDFYFKNCLVFKIQLNKAVQTAGGKYCKEQNKVLN

SEQ ID NO: 157188 - protein, 135 aa, Glycine max
  Coding DNA Sequence Number=SeqID_65503
MDLVSQTLQVKTIARSCLEDVFKLDLAENFIEEVSLTLIDVATSSGFGLDFKAELQRWQWHKRSCKGGFAMTWWWLDCGRGGRNGEGEGGFEVKCRERGEGLGVRQRGRGRRVGGIGEGEKEKRKGGGFVDDAKA

SEQ ID NO: 157189 - protein, 64 aa, Glycine max
  Coding DNA Sequence Number=SeqID_65504
MLQDIYSSQEETTSCPSYSGTEADVRGEESSEEVYPHEEGDLLMVRRLLGGPIGHYITPNGACE

SEQ ID NO: 157190 - protein, 95 aa, Glycine max
  Coding DNA Sequence Number=SeqID_65505
MVAWPGTQPSLHKEDKGEEAGETQVRLVAAATPERSLKATSEPPAPVVDLPSPQHTTDPSTPILEIPEDPTTPVLAMDTSPPATLVLHLTDEDDV

SEQ ID NO: 157191 - protein, 79 aa, Glycine max
  Coding DNA Sequence Number=SeqID_65506
MMITKDDDKGDDKKLKDQSKSTQINQRSIKNNSRVQDKNQEEFKTQEESLETRIKIQGSRSQESDQDSRMKRRLNQDKY

SEQ ID NO: 157192 - protein, 230 aa, Glycine max
  Coding DNA Sequence Number=SeqID_65507
  Gene Ontology: Mol. function=chloramphenicol O-acetyltransferase activity; Biological process=response to antibiotic
  Homolog annotation: Hit_ID=P62577; Match level="QueryCoverage=74%, HitCoverage=78%, E-value=1e-94, Identity=95%"; Hit description =Chloramphenicol acetyltransferase
  Pfam annotation: Domain name=CAT; Domain location=6-177; Score=328.1; E_value=1.6e-95; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLTWPYGHFFAPVFTMANIIRRRQGADAAGDSVVLLHVFPGWTHDDSYRIRRSGRTERGVRAYSPAWSELPTRN

SEQ ID NO: 157193 - protein, 162 aa, Glycine max
  Coding DNA Sequence Number=SeqID_65508
  Homolog annotation: Hit_ID=UPI00016621D1; Match level="QueryCoverage =87%, HitCoverage=41%, E-value=3e-13, Identity=33%"; Hit description =UPI00016621D1 related cluster
MTDPLDKLISCFLIRVNPWVLVPITSRGLHAITFRGLHVLAIRGLHSLAIVGLHALTYQGLHVLTFRGLHALTFRGLYVLAFSGLDALAFRGLHVLTFSGLDTLAFRGIHALTFRGLHVLAFSGLDALAFRGLHVLTFSGLDTLAFRGLHALTFRGLHVLAF

SEQ ID NO: 157194 - protein, 58 aa, Glycine max
  Coding DNA Sequence Number=SeqID_65509
MSQEVDMDYENEQECGVNEPHVDCSDAFNTSQVFGTRDDILQWAPLVAHENGFVAVTP

SEQ ID NO: 157195 - protein, 70 aa, Glycine max
  Coding DNA Sequence Number=SeqID_65510
MSLSLQSQGFTSFSCPTPDQFRAEVAWPGDWPQAQAAEAPAGAPAEAPDEARKDEEMIDLLDFLGGSGAA

SEQ ID NO: 157196 - protein, 74 aa, Glycine max
  Coding DNA Sequence Number=SeqID_65511
MKDLGLLHHFLGVATYPSAGGRRETRGMRVPRKEYARSRHQRLFEENIGKTGKDAIYELLSERFGSCIYARGRY

SEQ ID NO: 157197 - protein, 39 aa, Glycine max
  Coding DNA Sequence Number=SeqID_65512
  Subcellular localization annotation: CTP_CleavageSite=23; ConfidenceScore=5.25e-01
MASPPASPPPPPSPPPPPHSTPSDASASPSAVKRTRKAS

SEQ ID NO: 157198 - protein, 101 aa, Glycine max
  Coding DNA Sequence Number=SeqID_65513
KDIELVDDEEPRISADCSSVTSNKSEIYNEEAGNATQKHKPKRVESVNVDAEAFGDHWKNKTGDSIVLKIRDSAKVVIKQDMKGGEHKYGFKNNKRKKPEK

SEQ ID NO: 157199 - protein, 87 aa, Glycine max
  Coding DNA Sequence Number=SeqID_65514
MDDRFIWRRFQNTKFSEIIFSFFTTVRCTIFIWRTRQSCSAAATDNEYTNIEQQHHHDVGEPVIQERRNPRRNQRPPPCGTGHRLGH

SEQ ID NO: 157200 - protein, 45 aa, Glycine max
  Coding DNA Sequence Number=SeqID_65515
MNTSEKCRQRIKLNVLMMPKDHMLLKALFKTKKLKIFKMDDQDSL

SEQ ID NO: 157201 - protein, 162 aa, Glycine max
  Coding DNA Sequence Number=SeqID_65516
DFQLVPTVKEFEEILGCPLGGRKPYLFSGVLSLHDKSCQGQRPWQNQGEWASFIDILALLVFGGVLFPNMEGLVDLAAIDAFLAFHHGKEIPVVAILAMHDTFNQRCSSIRYKVTARASKKRKTNWDQLLASIEGRLLIGSLARRKEESGFYLHAKDFQMFP

SEQ ID NO: 157202 - protein, 199 aa, Glycine max
  Coding DNA Sequence Number=SeqID_65517
MGETDKVQEWIKANLEAMKEQMAIMMEGMMSMKKIMKVNAAIVAATSAIAERGKELGSTRGPHFMQGQNKHSFPLYGLAPNHTLPNVAHTPNEDVDNSAPIPIESQQPQADHAHVFQPMGETHEIPHHNLTDFEPHLGYAIEEQAVGGRIPLAMVEKGKLDHIEERLGAVEGGGSYALADMAKLCLVPLHHHHSEVQGV

SEQ ID NO: 157203 - protein, 160 aa, Glycine max
  Coding DNA Sequence Number=SeqID_65518
  Homolog annotation: Hit_ID=Q2JIC4; Match level="QueryCoverage=88%, HitCoverage=23%, E-value=3e-09, Identity=38%"; Hit description =ISSoc9, transposase
DPWVLVPIAFRGLHVLTIRGLHVLAFRGMHALTFRGLHPFIFRGLHVLTLRGRHAPSFKGLHALAFKGLHALTFRGLHVLAFRGLHALAFRGLHALAFRGLHKLTFRPPPDPGGGPTMRAQPEREAIMQLLCVPGQDFTRAAAKRRVLIMCTNMTTLTQI

SEQ ID NO: 157204 - protein, 148 aa, Glycine max
  Coding DNA Sequence Number=SeqID_65519
  Subcellular localization annotation: CTP_CleavageSite=20; ConfidenceScore=5.01e-01
LASHARLATVLFQLSERAKRASLAKRLMASRKRKATTSRPQEPYDTTRRNWHKALTQHMDGHIDVALVKEFYPKLYDPEDKSPKQGSTSQLILDFAERALILRSLPPSFVFQAPEEGLDYLSSGVECAFILQPRPPPLTRLTLLWTGR

SEQ ID NO: 157205 - protein, 170 aa, Glycine max
  Coding DNA Sequence Number=SeqID_65520
MKADMEALKDQMTSMMEAILSMKQMIESNAGAIIATSAAPVADPTYTSAINQANQPIPDMVGQGGEVLGSTGGPHTGHNRNTYPYGLPPNYKLPTMHIPNENNNHVVPVTFEGQQPQPVRGAHEEPREHAQGDLDPYPTFTDEGPAFNAMSQPNAARAPQPRPLQPLHFL

SEQ ID NO: 157206 - protein, 59 aa, Glycine max
  Coding DNA Sequence Number=SeqID_65521
  Subcellular localization annotation: CTP_CleavageSite=36; ConfidenceScore=5.24e-01
MTTDSPPLPMFPWTRVKKRLSFKLQNVAVGLSTYPPLSAASARLAQRRIWQSISIKAAR

SEQ ID NO: 157207 - protein, 179 aa, Glycine max
  Coding DNA Sequence Number=SeqID_65522
MRCLTETCAPGYGGHGFLSTVLGLPPDIGGRPTVRAHPEREAITHLLCIPGQDFPRAAAKRRVRTMRTNMTTLMWMTLLFSNILCRHDIGKDRAHKDTQWTRKSPTGPWGFQLWLRASVVLQGARSPRQGHVIIGIAPAKHPVDPKKSNKVLELSSSNYRSLSILPSACHLQQGHQAPY

SEQ ID NO: 157208 - protein, 33 aa, Glycine max
  Coding DNA Sequence Number=SeqID_65523
MSEIGRFGGLGMEERRKEKGLRRSFWKMPSVLV

SEQ ID NO: 157209 - protein, 205 aa, Glycine max
  Coding DNA Sequence Number=SeqID_65524
MAPKKLPAKRSRKDATGEGSSAAPQADMDFDRHRFWSAGHQQRERQVQLRDKEYVEFQEEIARRQWTQLVSPMAKLDPNIVMEFYANAWPTEEGVRDMRSWVKGQWIPFDEHPINQFLGHPLVLEEGQHCEFSHRRSQAFSFDEEAISQLLCVPGQDFAWSIARRRVRIMRTSMTTITKIWMMLLLRNILPSDHTFRVRPVSTVE

SEQ ID NO: 157210 - protein, 168 aa, Glycine max
  Coding DNA Sequence Number=SeqID_65525
  Gene Ontology: Mol. function=catalytic activity; Cellular component =cytoplasm; Biological process=metabolic process
  Homolog annotation: Hit_ID=A3U7W0; Match level="QueryCoverage=98%, HitCoverage=28%, E-value=2e-58, Identity=62%"; Hit description =Probable long chain fatty-acid CoA ligase
MFVTKYQGEWKKTSTQEFINQGNKISRGLLKLGIKPGDKIALITTNTRTEWAVMDLGLSQIGVVSVPVYPSISHEDYEFIFNNAEIQYCFVSDKELLAKVMKVKHNIPSLQGVFTFDMISGAPNWREILDLGEDDSTQIEVEDLSNAINSEDLATIIYTSGTTGRPKG

SEQ ID NO: 157211 - protein, 192 aa, Glycine max
  Coding DNA Sequence Number=SeqID_65526
MDEIEEVQERMKADMEAMKEQMATMMEAMMSIKKILEVNAAAIVATSIIAEVDPTPPSGLNQINHPTSDMVGHGGKELGSTGGPHFVQVQNKHAFLPYGLPPNYTPLNVVHTPNENVNNSTPILIESQQPQSDYAHVSQPMGETHEIPHHNLVDFEPHFGYATEGQAVGGVPFPNTLEDPQLCPQPQLLHFA

SEQ ID NO: 157212 - protein, 77 aa, Glycine max
  Coding DNA Sequence Number=SeqID_65527
DPPQQKRSLIIEIEEELKNITKDDAPQRERSQKIQKNKELKNITQGDPSKQKRSQGNKKKTKDDNITQGVTQREQWR

SEQ ID NO: 157213 - protein, 66 aa, Glycine max
  Coding DNA Sequence Number=SeqID_65528
  Subcellular localization annotation: CTP_CleavageSite=15; ConfidenceScore=5.02e-01
MKNGGKPSQNRPRKRLGSVTEGKKGRWLPPSSPRRAGLLPPEGTAFCWNTLEGSSGPDFYLHTLVY

SEQ ID NO: 157214 - protein, 88 aa, Glycine max
  Coding DNA Sequence Number=SeqID_65529
MCLSGKENMPMKFSHNRNTGSNKDRRESLKVYQSHTGLTFSPWVKVYDKLGFCLKACRTAGHDICQGLASGSGIKGMSYIISMIHMQQ

SEQ ID NO: 157215 - protein, 181 aa, Glycine max
  Coding DNA Sequence Number=SeqID_65530
MSVETITQAIGCERYGTKFMNSWGDELEDHIWHSLWGPNWAKTLRRYGTLFNKAKIFQQIVNKAIIHKQGSKDFLSNTHKFILYHLMEGTPFDLPQILFNFFVSKVMMDKCIEKDIYHSVVLTKKAFIQEKNLNMRLVDDGSFQQTPQVDDSILFELHQKFGLNIRRDNQLDAVWEKSAKE

SEQ ID NO: 157216 - protein, 52 aa, Glycine max
  Coding DNA Sequence Number=SeqID_65531
  Subcellular localization annotation: CTP_CleavageSite=40; ConfidenceScore=5.22e-01
MSRLAPSSRLAPSSRLTFSHHAKRAVAALSGRCALSPEVRLSAIAPFSTLRL

SEQ ID NO: 157217 - protein, 61 aa, Glycine max
  Coding DNA Sequence Number=SeqID_65532
MQLIRQHICTFDRDSVEVFSCLWSFYGGWIFELQWGPLMVIFHHGDAAEDKGKEVRGGAIH

SEQ ID NO: 157218 - protein, 83 aa, Glycine max
  Coding DNA Sequence Number=SeqID_65533
MTNLGISISRDISKTGSTHTGPLKMTRGHYGETMIWCYFNVWIQAKLSRCYERCMKAHLALMPMGMPWPGHRQAILSMMFGAI

SEQ ID NO: 157219 - protein, 66 aa, Glycine max
  Coding DNA Sequence Number=SeqID_65534
MSDEQSNDIDQGNEQVLQEINHNDLIKLEADDSDDIIEVTIPMENILPHDKADNYIDDDESDADFF

SEQ ID NO: 157220 - protein, 224 aa, Glycine max
  Coding DNA Sequence Number=SeqID_65535
MYDYHEKERTPDLESILSDFMTYQASSKGYCYSMQQQGTQFEMDYSSADYQRESQWQTNYHNEAEGFLNLNDLLMQFRDTVESMQQAFRRIETQISKLVDNMTNAVAIKEEEHAEIEIHQESILQVTSIHHQLTNEEEKHEVSNTPEYHCLATVGYVGGKDKGDACFEEEEVEQEIALLASTMVLQSPLEREPGYGIDCLVYDEELDDPKDNCVDHVVLKNGKN

SEQ ID NO: 157221 - protein, 111 aa, Glycine max
  Coding DNA Sequence Number=SeqID_65536
  Homolog annotation: Hit_ID=A2XB60; Match level="QueryCoverage=37%, HitCoverage=8%, E-value=5e-09, Identity=64%"; Hit description =Putative uncharacterized protein
MGQCAPVVGSRVILFGGEDMSRKLFNDVHILDLESMTWEMIKTALILSSSMIFIYYTCKYLKLKTVTTYPLGGGRRETHRCVFQGRKAHGVATNVYSRKMSEKPERVVYEL

SEQ ID NO: 157222 - protein, 96 aa, Glycine max
  Coding DNA Sequence Number=SeqID_65537
MRNGLQIQKSEIAPCCRVKCLLNMLWLLMQEHYIMQEHYINHIVKEGALRCHTLISSGDHPLLGCDPHLTTSRYLAPIVRQFVKFRDMPEAKRKAS

SEQ ID NO: 157223 - protein, 195 aa, Glycine max
  Coding DNA Sequence Number=SeqID_65538
  Subcellular localization annotation: CTP_CleavageSite=67; ConfidenceScore=5.68e-01
MDPPPPKKLNKSAMSSSSWALSSTPGAPASPAPAQWPSRSGLPRWRRCVCCLRLGFSVLYLSGSTILLNEGPSDRRSDDLAGYNGHSVELAEARDQSRKPQGPVGLLRVQGGKVRVVVAREDVVEQQRHPHLGQGGHAGAHDPHPPPCGSPGKIMPWINEWSNNWLRVSASNGTHWPHTHERMSQIPSSVGQALA

SEQ ID NO: 157224 - protein, 207 aa, Glycine max
  Coding DNA Sequence Number=SeqID_65539
  Homolog annotation: Hit_ID=UPI00016621D1; Match level="QueryCoverage =51%, HitCoverage=38%, E-value=9e-09, Identity=38%"; Hit description =UPI00016621D1 related cluster
MIGPLDESISCFLIRVDPWVLVPIAFRGLHALAFRGLHVLDFRGLHVLAFRGLQVLTFRGLRALAFGGLHVLTFRGLHVLTFRGLHVLTFKGLHVLTFRGLHDLAFGGLHVLDLRGLHVLAFRGLHVLDFKGLHSHAFRGLHGYMPSPLEGCTSSPSKGYTPSPSEGYSSSPSHDYMPSPSEGYTPSPLEGSTLAPLENLSSSALNA

SEQ ID NO: 157225 - protein, 755 aa, Glycine max
  Coding DNA Sequence Number=SeqID_65540
  Gene Ontology: Mol. function=nucleoside-triphosphatase activity; Cellular component=protein complex; Biological process=cell division
  Homolog annotation: Hit_ID=A7QNG1; Match level="QueryCoverage=99%, HitCoverage=91%, E-value=0.0, Identity=73%"; Hit description =Chromosome chr2 scaffold_132, whole genome shotgun sequence
  Pfam annotation: Domain name=AAA; Domain location=481-665; Score =262.7; E_value=7.6e-76; Accession=PF00004.20; Description=ATPase family associated with various cellular activities (AAA)
  Pfam annotation: Domain name=AAA_3; Domain location=481-607; Score= -9.2; E_value=0.0034; Accession=PF07726.2; Description=ATPase family associated with various
  Pfam annotation: Domain name=AAA_5; Domain location=481-613; Score =7.5; E_value=0.00078; Accession=PF07728.5; Description=ATPase family associated with various
  Pfam annotation: Domain name=Sigma54_activat; Domain location=471 -668; Score=-182.8; E_value=0.041; Accession=PF00158.17; Description =Sigma-54 interaction domain
  Pfam module annotation: Pfam domain module=AAA::AAA_3::AAA_5::Sigma54_ activat; Domain location=481-665::481-607::481-613::471-668
MSFLLWKNERTQALLTSAAYVHLKSLHFSKHTRNLPPASRAILLSGPAEPYQQMLAKALAHYFESKLLLLDITDFSVKLQNKFGCSRKEPSFKRSISEVTLERMSGLFGSFSMISSTGETRGILRQQSSAFVSSNPPKLRRNASASSDISSTSSQCGPTFPAPLKRTSSLCFDEKLFVQSLYKLLVFITETSSIILYIRDVEKLVLQSPRLYNLLQKMIKKLSGSVLILGSQILDSEDDCKEVDERFSALFPYNIEIKAPEDETHLGSWKGQLEKDMKDIQFQDNRNHIAEVLAANDIDCDDLNSICHGDTILLSNYIEEIVVSALSYHLMNTKDPEYRNGKLVISANSLSHGLSLFQEGKSSGNLKTNESNKENAGEDITGAKNEVKCDNQAPENKSETEKSIPVTKKDGENPTPAKAEVPDNEFEKRIRPEVIPANEIGVTFADIGALDEIKESLQELVMLPLRRPDLFKGGLLKPCRGILLFGPPGTGKTMLAKAIANEAGASFINVSMSTITSKWFGEDEKNVRALFTLAAKVAPTIIFVDEVDSMLGQRTRVGEHEAMRKIKNEFMTHWDGLLTGPNEQILVLAATNRPFDLDEAIIRRFERRILVGLPSVENREMILKTLLAKEKHENLDFKELATMTEGYTGSDLKNLCITAAYRPVRELIQQERLKDMEKKKREAEGQSSEDASNNKDKEEQEITLRPLNMEDMRQAKSQVAASFASEGSVMNELKQWNDLYGEGGSRKKQQLTYFL

SEQ ID NO: 157226 - protein, 39 aa, Glycine max
  Coding DNA Sequence Number=SeqID_65541
MGGVTKALVHCFEVVHDMLPKENMLPKSYYQAKKILCPI

SEQ ID NO: 157227 - protein, 22 aa, Glycine max
  Coding DNA Sequence Number=SeqID_65542
MEGLYFVLKLFALWLFLKGMYA

SEQ ID NO: 157228 - protein, 597 aa, Glycine max
  Coding DNA Sequence Number=SeqID_65543
  Gene Ontology: Cellular component=integral to membrane
  Homolog annotation: Hit_ID=A7QGD4; Match level="QueryCoverage=73%, HitCoverage=90%, E-value=0.0, Identity=74%"; Hit description =Chromosome undetermined scaffold_91, whole genome shotgun sequence
  Pfam annotation: Domain name=C4dic_mal_tran; Domain location=224-489; Score=298.3; E_value=1.5e-86; Accession=PF03595.8; Description=C4 -dicarboxylate transportermalic acid transport protein
MENNINIEISEQGSPEVPSLIRYISSSEVAGFDTADSQLPSASAQGSEANSPTRQHDEPIVINHQRKYSISMPLSSEEVQLQPMDTKKDGIPISSSQSGTASSNHPQASKCYSQPMPKCHVPQEADNGVKINNHPGIKDFKDKRFDSFKTWSGRLERQLTILRGKSPRATAQDGNNNSKSTDRPLPVDRYFDALEGPELETLKASEETVLPQDKQWPFLLRFPISSFGICLGVSSQAILWKALATSPSTQFLHISLKVNLILWFISIALVITVFTIYLLKIILYFEAVHREYYHPIRVNFFFAPWIALLFLAIGVPPSVTKDLHHAPWYILMTPILCLELKIYGQWMSGGQRRLSKVANPTNHLSIVGNFVGALLGASMGLKEGPIFFFAIGLAHYIVMFVTLYQRLPTNETLPKELHPVFFLFVAAPSVASMAWANIQGSFDYGSRIAYFIALFLYFSLAVRINFFRGFIFSLAWWAYTFPMTGAAIATVRYSNQVTNPVTKTLCVILSLISTLIVIALLVSTILHAFVFKNLFPNDLAIAISYRKRRPQKKWLGLRYRSHDSKEIENYLKCVNSDKIDLEASTPLPDGTEDSPSI

SEQ ID NO: 157229 - protein, 82 aa, Glycine max
  Coding DNA Sequence Number=SeqID_65544
  Gene Ontology: Mol. function=protein dimerization activity
  Homolog annotation: Hit_ID=Q2HTW7; Match level="QueryCoverage=86%, HitCoverage=20%, E-value=4e-20, Identity=66%"; Hit description=HAT dimerisation, putative
MRNDGWEELISKVMEICNKHNIDVSDLDALYVQGKKSRRHATTSSVSDLHHYKHDYLFSVLDLQLHELNDRCAGSGGATSAS

SEQ ID NO: 157230 - protein, 653 aa, Glycine max
  Coding DNA Sequence Number=SeqID_65545
  Gene Ontology: Mol. function=aspartic-type endopeptidase activity; Cellular component=integral to membrane; Biological process =chromatin assembly or disassembly
  Homolog annotation: Hit_ID=A7QGD4; Match level="QueryCoverage=64%, HitCoverage=70%, E-value=1e-114, Identity=67%"; Hit description =Chromosome undetermined scaffold_91, whole genome shotgun sequence
  Pfam annotation: Domain name=C4dic_mal_tran; Domain location=399-643; Score=220.3; E_value=4.4e-63; Accession=PF03595.8; Description=C4 -dicarboxylate transportermalic acid transport protein
  Pfam annotation: Domain name=RVP_2; Domain location=6-105; Score= -60.7; E_value=0.055; Accession=PF08284.2; Description=Retroviral aspartyl protease
  Pfam module annotation: Pfam domain module=C4dic_mal_tran::RVP_2; Domain location=399-643::6-105
MLCFEGIIRAHPLVFLVDGGSTHNFVQQPLVSQLGLPCRSTPPLRVMVGNGHHLKCTTICEAIPISIQNIEFLVHLYVLPIVGANIVAFHQLEKPIITYTYYPNQNPALNAVMVQDQFPIPTIDELLDELGGGNYKTGEASANPFPDRLAWNCDPAEQFLSIKRMPLCSEEAQLQPLDTITDGIPISSSQSGTASSSHPQPSKCYSQPMLESHDHKHQEAENGDETNNHPEIKAFKDKRFDSFKTWSGSLNRKLLILRRKRQRETPQDGNNISRSTDRPLPIHRYYDALEGPELETLRVDGQKYRNGNNGSYRAPNEVIPKRGERVKMKGRKESLFPVRATHKGCKSPLTQPGPCHRSSKSFKWILALALGHVLINGCASEETVLPQDRQWPFILRFPISSFGICLGVGSQTILWKAIATSPSTKFLNISLKINLIFWFISIALIIAVFTTYLLKIILYFEATLREYYHPIRVNYFFAPWIALLFLAQGVPPSVIKDLPNALWYILMTPILCLELKIYGQWMSGGSRRLSKVANPTNYLSVVGNFVRALLGASMGLKEGPIFFFAIGLAHYVVVFITLYQRLPTNETLPKDLHPVFFMFVAPPIVASMAWATIQGSFDYGSRIAYFIGLFLYLSLLEIISAGSRSEVSGRLFV

SEQ ID NO: 157231 - protein, 115 aa, Glycine max
  Coding DNA Sequence Number=SeqID_65546
  Gene Ontology: Cellular component=integral to membrane
  Homolog annotation: Hit_ID=A7QGD4; Match level="QueryCoverage=89%, HitCoverage=20%, E-value=2e-25, Identity=59%"; Hit description =Chromosome undetermined scaffold_91, whole genome shotgun sequence
MASAASATVRYANEVTNTVTKTLCVILSLVSTLIVAVMLVSTILHAFVFKDLFPNDHAIAISHRKRRPEKKWLGLGNRSHDSVEIENYLKFVNSSDKIDLEASTTSLPNGTEDSP

SEQ ID NO: 157232 - protein, 156 aa, Glycine max
  Coding DNA Sequence Number=SeqID_65547
  Homolog annotation: Hit_ID=A5BS97; Match level="QueryCoverage=68%, HitCoverage=24%, E-value=4e-09, Identity=28%"; Hit description =Putative uncharacterized protein
MEESVGESWEDCFDKLWSVKLTETSCPFCRNSEEDSAHLFLHCDRIQPIWWKTISWLNLKGAVPFTPKQHFLQHIDVQADGVRMQRWQCWWLALTWSTWKLRNNIVFSNATFNANKLFEDAIFTLWTWLRHFEKDFTIHFNQWSSSIRHSFCISRG

SEQ ID NO: 157233 - protein, 114 aa, Glycine max
  Coding DNA Sequence Number=SeqID_65548
  Gene Ontology: Mol. function=pyruvate kinase activity; Cellular component=chloroplast stroma; Biological process=glycolysis
  Homolog annotation: Hit_ID=A5BTB0; Match level="QueryCoverage=51%, HitCoverage=10%, E-value=2e-23, Identity=88%"; Hit description =Pyruvate kinase
MEYARNMAKEGPLGVLRPDTDLTSLLIPEPPKLISRKYYTVKGSRAVLSSRAYNGPEVRSGDLPQPITLMPGQEFTFTIQRGVGTADCVSVNYDDFVNDVEVGDMLLVDGMVIN

SEQ ID NO: 157234 - protein, 194 aa, Glycine max
  Coding DNA Sequence Number=SeqID_65549
MATNRRWKIWWLAATKSIWKLRNDMVFHNQTFVISKLVDNAIFLTWSWLKGISMYLFNNGDASLLLLLCSTPEHRSKQKRKVPNVEIGDIKGELRVPIGFVNDPEGSVLLALAEAEAPEPGLNAGEAVGIERLRLLRELLQPLVFLRRRRGLIRLRALGGLAEKRGKEWWWGLNSQMRKREGFGEKGVEKWEFL

SEQ ID NO: 157235 - protein, 401 aa, Glycine max
  Coding DNA Sequence Number=SeqID_65550
MVQWVDADCKQLLVVVRLIRRFQNRNDWNARSFRGFRQRQFNYHDQVPHKIGGGKTAVTYDIMAPSPVVGSSFKLVYQQILDSQAQLLEGKEYHKIQNPTVETNDHPHAPADSNIYTQPEDVSSDSAARELRPPKVGYCKICEVHLPYCKTLEMHNQENSHQRILKLYEEIQRLKTSNGQRPNSQKNLVVLPKTVHISGKNGHPQKNMSSEASILKHKNYLKKGMGLTCEIPAKGPEVKPRDNSGAQGHGFKQNIRGPKIGKSSFKRQSQRILASQTPVSEHKEHAIHIGTESQLSKDTADCENQSCTDEKNNQLLPSIVVEFNSPSGSSTNTQTTDECSKAEQRIEILTHQSGTTQLSQVAVCLQCGNAGFPETLVFCNKCQQYFIIQMLPLLMCQRDIL

SEQ ID NO: 157236 - protein, 260 aa, Glycine max
  Coding DNA Sequence Number=SeqID_65551
GEVAETLQYMVSPQGRNTWTVDDLVPYVEKLAIISQEQERIIEPVTHGPASEEIVQAEYFSQQMDQRGHGMYYTPPTFSQYPSQMYQYPFEGHDTDMSASEHSFGGVAETHPHFSWPTMTPSQQHDDPMATPNAPLGPQWDVPGAIPDMGDLLGVDLHHEFSAEAEQQGRRQRKKKSGSSSPKCGVRSPYVVARGPQVYPLNLPNNWYQSQWVDQVPAQTSIQVPQVARMASGTACPVGGAGWPEWLVGRASTADGHGYT

SEQ ID NO: 157237 - protein, 205 aa, Glycine max
  Coding DNA Sequence Number=SeqID_65552
MTQSNSFRLGFPALITALCIARGVVPDSLTFESLSPAINLAFMRKNCWNPDDPPITFPGTRKARARGPLDASAPYSSAYSSSAPPTPASPTPPSTPAPPHEGFHGPGGLARNPAFPLGEGKAPTTQEQQPEVEATPEGTPKVSPAATPLVEIVEDEDGAEDTDYAVDMAVAQSTWDPWPTTTQDTPQPAQDAPSSPYDEPTLVQD

SEQ ID NO: 157238 - protein, 164 aa, Glycine max
  Coding DNA Sequence Number=SeqID_65553
  Gene Ontology: Mol. function=subtilase activity; Biological process =proteolysis
  Homolog annotation: Hit_ID=B0JCV8; Match level="QueryCoverage=82%, HitCoverage=17%, E-value=5e-11, Identity=29%"; Hit description =Misfit TNP1-like protein
MVNVNPTTRRGSGPQKEKFHSYLGVVAREKILIIHSNWNDVQESLKNLVWDDILGKFDIPEGNKGKKKVMSTIATRWMQFKSSLTTKYVYANNDDHQKDDPSVKYGIDATTWAEFAKTCETLTWQGIRKKAWEIQKYNDCPHLLSRGGLFRRIDDLGKLCSAWS

SEQ ID NO: 157239 - protein, 191 aa, Glycine max
  Coding DNA Sequence Number=SeqID_65554
  Subcellular localization annotation: CTP_CleavageSite=40; ConfidenceScore=5.53e-01
MSHLLSVATTSSRFQLLTLNNTFTTQPPFLGFKKRGANISCSMNMSAQQSDDHGKMKLDQLIDKVQKLWDSSPEPMKKFPHNKASDNFIQLILDLILVVVKYLVVPVFAVTDASSIGACRPRIFFINGFLCFLEDQWQRNGERERERRRHFKEKMSLEEAHHHRRPWIRAWRKKEMNEGKGREEHEILCSK

SEQ ID NO: 157240 - protein, 137 aa, Glycine max
  Coding DNA Sequence Number=SeqID_65555
LPGINRDTRIYLFCEVIFRHSGFCFYQLSPPVQLLTGVVRNGKKHRRTSALASVAVTAARRVPFAIQAAQLLGRAIGAGLFAITPAGERGMCCKAIKLGNARVFPVTTLANWSSTAVAAALELVDPPGCRNSISIPI

SEQ ID NO: 157241 - protein, 70 aa, Glycine max
  Coding DNA Sequence Number=SeqID_65556
MGWQWMGGDGVGVWGRWLNGKGGEMFKHGVHFLVHGRLCLGQGSVFVGEGGLSLRKLGDGILQAFEGGLA

SEQ ID NO: 157242 - protein, 115 aa, Glycine max
  Coding DNA Sequence Number=SeqID_65557
AAGAPPPPHWAGPAGSFDMEQYLRHLVRQQAANHWAHVQTHDCLYQLSLSMQSQGFTSFSCPTPDQFRAKVTWPGDWPEAQAGEAPPEVPDDGEEAHEDEEMANLLDFLGGSGAT

SEQ ID NO: 157243 - protein, 147 aa, Glycine max
  Coding DNA Sequence Number=SeqID_65558
  Homolog annotation: Hit_ID=Q6WAY6; Match level="QueryCoverage=88%, HitCoverage=23%, E-value=9e-14, Identity=31%"; Hit description =Putative uncharacterized protein
MVEFSVEAIASLTQYYDQPLRCFTFGDFQLVPTVEEFEEILVCLLGGRKPHLFSVFYPSMARVAKVIKISVQELDYVKQNRNGAVEITRKHLEEKAKALANQGEWASFIDVLALLIFGVILFPNVEGLVDLAVIDAFLAYHHSKESL

SEQ ID NO: 157244 - protein, 32 aa, Glycine max
  Coding DNA Sequence Number=SeqID_65559
MAGLCGVSKECPKVQDEKIQDLEMDLMELAMV

SEQ ID NO: 157245 - protein, 186 aa, Glycine max
  Coding DNA Sequence Number=SeqID_65560
MASKKHKSSDSRPQDQNDNRRFQSEEAWNVKLYHSEFDEFKVELERRNLHKRLANLQEGSIDVAVVKEFYANFYSPADQAPKCARIRGHLIRIVVDSLNEFLQTPASLCIPGKGFILNTEGQPWKLLKKDLTTLAQTWSFFSCSNLAPTSRTLDLNTNKARLVYGLITRMDMNIGGLISGQMTMMA

SEQ ID NO: 157246 - protein, 40 aa, Glycine max
  Coding DNA Sequence Number=SeqID_65561
MAQRSRGVSSSSPSVGAGAGGSLVIGSWAAEAPPPPEEEG

SEQ ID NO: 157247 - protein, 427 aa, Glycine max
  Coding DNA Sequence Number=SeqID_65562
  Gene Ontology: Mol. function=glycine hydroxymethyltransferase activity; Cellular component=cytoplasm; Biological process=serine family amino acid metabolic process
  Homolog annotation: Hit_ID=A7ZPZ4; Match level="QueryCoverage=92%, HitCoverage=94%, E-value=0.0, Identity=89%"; Hit description=Serine hydroxymethyltransferase
  Pfam annotation: Domain name=Aminotran_1_2; Domain location=30-388; Score=-61.6; E_value=0.00036; Accession=PF00155.12; Description =Aminotransferase class I and II
  Pfam annotation: Domain name=Aminotran_5; Domain location=43-384; Score=-195.8; E_value=0.056; Accession=PF00266.10; Description =Aminotransferase class-V
  Pfam annotation: Domain name=Beta_elim_lyase; Domain location=78-328; Score=-109.3; E_value=0.0029; Accession=PF01212.12; Description=Beta -eliminating lyase
  Pfam annotation: Domain name=OKR_DC_1; Domain location=56-393; Score=- 185.6; E_value=0.021; Accession=PF01276.11; Description=OrnLysArg decarboxylase, major domain
  Pfam annotation: Domain name=SHMT; Domain location=10-388; Score =951.2; E_value=4.2e-283; Accession=PF00464.10; Description=Serine hydroxymethyltransferase
  Pfam module annotation: Pfam domain module=Aminotran_1_2::Aminotran _5::Beta_elim_lyase::OKR_DC_1::SHMT; Domain location=30-388::43 -384::78-328::56-393::10-388
MRMLKRDMNIADYDAELWQAMEQEKVRQEEHIELIASENYTSPRVMQAQGSQLTNKYAEGYPGKRYYGGCEYVDIVEQLAIDRAKALFGADYANVQPHSGSQANFAVYTALLQPGDTILGMNLAHGGHLTHGSPVNLSGKLYNVIPYGIDETGKINYEELAELAQTHKPKMIVGGFSAYSGVCDWAKMREIADSIGAWLFVDMAHVAGLIAADVYPNPVPHAHIVTSTTHKTLAGPRGGLILAKNGDEELYKKLNSAVFPGGQGGPLMHVIAGKAVAFKEAMEPEFKAYQQQVAKNAKAMVEVLLERGYNIVSGGTYNHLFLIDLVSKGLTGKEADAALGRANITVNKNSVPNDPKSPFVTSGVRIGTPAVTRRGFKEAEVRELAGWIADVLDNIQRRSHYRAHQTESAGYLCPSAGLCLISAKPAV

SEQ ID NO: 157248 - protein, 232 aa, Glycine max
  Coding DNA Sequence Number=SeqID_65563
  Gene Ontology: Mol. function=chloramphenicol O-acetyltransferase activity; Biological process=response to antibiotic
  Homolog annotation: Hit_ID=P62577; Match level="QueryCoverage=93%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFFKQLLVPRIFI

SEQ ID NO: 157249 - protein, 65 aa, Glycine max
  Coding DNA Sequence Number=SeqID_65564
PFAPFMGSRIVLGNGQRSRQAQRQKPIKVLRDGRKERLGSRPIGRHRLLSPGQTKNVAAKQPRIL

SEQ ID NO: 157250 - protein, 124 aa, Glycine max
  Coding DNA Sequence Number=SeqID_65565
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGFKELVAQRTFEKPPCKA

SEQ ID NO: 157251 - protein, 93 aa, Glycine max
  Coding DNA Sequence Number=SeqID_65566
MDQLQHQAFCETYGKIWDLAMIEVSVEAIASLTQYYDQLLRCFTFGDFQLVPTVEEFEEILGCLLGGRKPYLFSGFYPSMARISKVVKILAQE

SEQ ID NO: 157252 - protein, 181 aa, Glycine max
  Coding DNA Sequence Number=SeqID_65567
MNMNVGYLFSHQISLIAQHDTSRLGFSPLITTLCIARGVQSDSRSLESLSVAIKLAYIKKNYWNLDDPTITFRGPRKARGKISEAPSTSASEAPTPSSSTVPLSSSTQILEFNAQVAWPGDQPSSSGGGGASAAQEPETEEPPAPAEEQTIPVQTPQPSPSSAPAPEQTQTSALDLNEDQP

SEQ ID NO: 157253 - protein, 147 aa, Glycine max
  Coding DNA Sequence Number=SeqID_65568
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIPLYGRVCLIPRLTLSS

SEQ ID NO: 157254 - protein, 57 aa, Glycine max
  Coding DNA Sequence Number=SeqID_65569
MPPIVVMTLARVLNNFLLAIILAKREKFHWLPLAFKGMPSIGGLPLLRNEGFMGILQ

SEQ ID NO: 157255 - protein, 148 aa, Glycine max
  Coding DNA Sequence Number=SeqID_65570
MGIGLRLFLSYVSTQKLVRNNASCKLIGIGSIQIKMHDGICRNLPFGGRATPGLTGASSKKGKRAESPPTFIRGKRRKNRKRRGLRTLSVKGSGVVFTHGEGVTKLCVDFRLLKNPRLTNKSEKDHFKALDLKNVFLGDNKSLIYELI

SEQ ID NO: 157256 - protein, 85 aa, Glycine max
  Coding DNA Sequence Number=SeqID_65571
  Gene Ontology: Mol. function=nucleoside-triphosphatase activity; Cellular component=chloroplast
  Homolog annotation: Hit_ID=Q2PMM5; Match level="QueryCoverage=72%, HitCoverage=2%, E-value=5e-28, Identity=100%"; Hit description =Protein ycf2
MKKLTILLYLLSCSAGSVAQDLWSLPGPDEKNGITSYGLVENNSDLVHGLLEVEGALVGSSRHFGTSGSFMMKRMSFRDDSEFLQ

SEQ ID NO: 157257 - protein, 193 aa, Glycine max
  Coding DNA Sequence Number=SeqID_65572
  Gene Ontology: Mol. function=transferase activity; Biological process= signal transduction
  Homolog annotation: Hit_ID=P54291; Match level="QueryCoverage=83%, HitCoverage=82%, E-value=5e-20, Identity=32%"; Hit description=Acyl -homoserine-lactone synthase
  Pfam annotation: Domain name=Autoind_synth; Domain location=1-165; Score=-86.2; E_value=0.014; Accession=PF00765.8; Description =Autoinducer synthetase
MPSSLLAELGTYRYSVFARGEGWSIPPRLSTPGQEYDRFDRSDVTWLIAWTARQGICGCARLLPWHEPEVPEGMVLPFDQQKVWEMSRYSARLEVDAELPLNILWHSVQLAELSGMEYLISSATPMLEKMFEQHQVVYEPLSPGLIQSEDNLFAIRIPVQQPALAEKYRGTRRFSPEEVLPSLGVSVNWQSHS

SEQ ID NO: 157258 - protein, 469 aa, Glycine max
  Coding DNA Sequence Number=SeqID_65573
  Gene Ontology: Mol. function=amino acid transmembrane transporter activity; Cellular component=integral to membrane; Biological process=amino acid transport
  Homolog annotation: Hit_ID=Q6D359; Match level="QueryCoverage=79%, HitCoverage=79%, E-value=1e-157, Identity=73%"; Hit description=D -serine/D-alanine/glycine transporter
  Pfam annotation: Domain name=AA_permease; Domain location=53-460; Score=381.0; E_value=1.9e-111; Accession=PF00324.12; Description =Amino acid permease
MPSCPVQQHVIQQPAELTQHQDRKDIFMVDQSKAAPIEAEQPEKLRRNLHNRHIQLIAIGGAIGTGLFMGSGKTISLAGPSIIFVYMIIGFMLFFVMRAMGELLLSNLEYKSFSDFAADLLGPWAGYFTGWTYWFCWVVTGIADVVAISAYFQLWFPDFSIWMSALLCVFVFLALNIATVKLFGEMEFWFAIIKIVAIVALIITGIVLVSLHYPSPNGSHAALSNIWDHGGMFPKGLSGFFAGFQIAVFAFVGIELVGTAAAETKDPHKVLPRAINAIPLRIIMFYVLALLVIMAVTPWNQVMPDRSPFVEMFVLIGLPAAASIVNFVVLTSAASSANSGIFSTSRMLYGLAEQGVAHKAFGRLSARAVPTTGLFFSCLCLLAGVALIYLIPDVMTVFTMLPGLPQTASAAACGVTLQNATWQADVLGVHGFLCLCAGAADTAGRYAPGTDGDATVVCGADHGLAATPA

SEQ ID NO: 157259 - protein, 320 aa, Glycine max
  Coding DNA Sequence Number=SeqID_65574
  Homolog annotation: Hit_ID=P56614; Match level="QueryCoverage=17%, HitCoverage=100%, E-value=5e-10, Identity=57%"; Hit description =Uncharacterized protein ymdF
MAQHRGGSGNFAEDRERAAEAGRKGGKNSGGNFRNDPQRAAEAGEKGGRSRAKKYKNVRQSSILVRYVCFHFPPQPAYYASGAGTYFYHYGLGWHLSGGASRHGALGAILFCRAAFRYRLSAAGLFLSPLFASHYLAGNQSGRADWRGDCRWLRIANLGYANHFQQPVGVSHGALRAGGAAVAVAVSAPAAGPDGVAGHFAGVHRSGAGGGAAGWQPDAECRRDRHAAQHPRHCRRDHSYQSLRRAGRCAPRDAGTAAGGFGLRLRANAAQRRIFTHAIGAAAVQRAGPRRGQRADSGHHELGAAQRLADARHSDLCRRA

SEQ ID NO: 157260 - protein, 179 aa, Glycine max
  Coding DNA Sequence Number=SeqID_65575
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=89%, HitCoverage=11%, E-value=2e-79, Identity=92%"; Hit description=DNA -directed RNA polymerase subunit beta''
  Pfam annotation: Domain name=RNA_pol_Rpb1_5; Domain location=1-179; Score=-143.1; E_value=0.027; Accession=PF04998.8; Description=RNA polymerase Rpb1, domain 5
TAVRTSDAGYLTRRLVEVVQHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQENHTGPVQSLFQSEKIKIK

SEQ ID NO: 157261 - protein, 129 aa, Glycine max
  Coding DNA Sequence Number=SeqID_65576
VVNYRNKSNEGIRKAFTKLPSSNCISHQIPNFVAYSVPQGLVAWKPSGIGSLKGEYLYLGHLTQFATPLKLKLITMGEVVCVRQGDLDTYCLVFLSESVVWTRLRYFLINGTTLHLRVDVKCMHHTQHD

SEQ ID NO: 157262 - protein, 42 aa, Glycine max
  Coding DNA Sequence Number=SeqID_65577
MRKWALAADKDGVDDTVCEKYDIRRRNGPSFVRPVETLRGRM

SEQ ID NO: 157263 - protein, 93 aa, Glycine max
  Coding DNA Sequence Number=SeqID_65578
MHENEWHRACLLFAPIREPIGQYLGVSNNYSPTIHNSHSCFLENQSPTVATCPSRASEGEAHGCAFQRRKDARSRHQRLFVENVGKTEGNRSK

SEQ ID NO: 157264 - protein, 144 aa, Glycine max
  Coding DNA Sequence Number=SeqID_65579
LEPLRADQRLIFAKKLAQGFPVSTGTPRIYLFCEVIFRHSCPLPVQLLTGVVRNGKSTARTSALASVAVPAARRVPFAIQAAQLLGRAIGAGLFAITPAGERGMCCKAIKLGNARVFPVTTLAKKSLAHGILVGNQREKTILGR

SEQ ID NO: 157265 - protein, 79 aa, Glycine max
  Coding DNA Sequence Number=SeqID_65580
MSSARLSARLALCLNPLSRAKHEGRAKVGRRFAQILEHTTVPISGIELWRQQEEQLLQRYLGFLSDFSIGKCTVALELD

SEQ ID NO: 157266 - protein, 114 aa, Glycine max
  Coding DNA Sequence Number=SeqID_65581
ASLPNRPGYKSNPQETQHKDAHAKVEYVKRLYDQVKVQFAKKNESYAKQANKIRKEEVLEPGDDPGHLRENVVQEGGNDENLKTAQIQGPMTRSKAKQSIDTLQQMVADILSKA

SEQ ID NO: 157267 - protein, 120 aa, Glycine max
  Coding DNA Sequence Number=SeqID_65582
MAMGRVGYGYCLPNPLSRLLISPYPYPILDGFEFIVPSLYPSDFKWRGGFEFGVGTSLVISYPYPYPTFGYRGKPEPVPIPGQLEYYPSKSGRIRTGVRIGIDTPYWFTVNQKTMVLCQP

SEQ ID NO: 157268 - protein, 101 aa, Glycine max
  Coding DNA Sequence Number=SeqID_65583
MEVIVSSPSLWSLETLTEQTEEKRKNKKVAVAGVSLREAYALSEQHPLSEASARLMSEENLEENLSRMHALSALSARPASHLSILAPSAPNSLSQKSLTHT

SEQ ID NO: 157269 - protein, 384 aa, Glycine max
  Coding DNA Sequence Number=SeqID_65584
  Gene Ontology: Mol. function=translation initiation factor activity; Cellular component=cytoplasm; Biological process=cellular metabolic process
  Homolog annotation: Hit_ID=A7Q5N7; Match level="QueryCoverage=100%, HitCoverage=100%, E-value=1e-145, Identity=66%"; Hit description =Chromosome undetermined scaffold_53, whole genome shotgun sequence
  Pfam annotation: Domain name=IF-2B; Domain location=80-358; Score =175.8; E_value=1.1e-49; Accession=PF01008.8; Description=Initiation factor 2 subunit family
MPDVQALVNDFVNLLKKRVSSHSKADSSVATLGDFTAAELAVGNIVRRVLHIIREEDLSLVTDAVAGFGMFAGSDDEDDVERDDYPALSAASVAAAARSTSRPPSLQTLLEDVTDSAVVPPTPSSGGDSEGISRTLEKGSSGRKLKHDVIEAVNELIQDITSCHEQIAEQAVEHIHQNEVILTLGSSKTVLEFLCAAKEKKRSFKVVVAEGAPRYQGQVLAKELAARGIQTTVIADSATFAMISQVNMVIVGAHAVMANGGVIAPIGLHMVALAAQRHAVPFVVLAGSHKLCPLYPHNPQVLLTELRSPSELLDFGEFSDLMDSATGSGSLHVVNPAFDYVPPNLVSLFITDTGGHNPSYMYRLIADYYSADDLVVKQRPTTGS

SEQ ID NO: 157270 - protein, 263 aa, Glycine max
  Coding DNA Sequence Number=SeqID_65585
  Homolog annotation: Hit_ID=Q5XM22; Match level="QueryCoverage=41%, HitCoverage=75%, E-value=5e-24, Identity=48%"; Hit description =Resistance-like protein HAAS-2
RRCQTGHWTAAARAYLLHLLGCTLFANKSATKVNVVYLEALRDLNMTERYAWGVAALVHMYDQLNDASMSHSRQLGGYITLLQCWIYERFPSVAESTADQDFDEASPHACSAWTHSGFRMYVGSRMGSIGRSRTFTSDHAIPTIHAPPVDSRVSYDDIHDRWMHYDDHIVLASEPRVIPQAPQTNIHRVPEPGASSTSAEEPRHAVEVCDDIAERLERHLSLGVVTPGSSTHEPDLRLDLRNLNPREYGLTWASPMGRHNDLK

SEQ ID NO: 157271 - protein, 323 aa, Glycine max
  Coding DNA Sequence Number=SeqID_65586
  Gene Ontology: Mol. function=molecular_function; Cellular component =cytoplasm; Biological process=red or far red light signaling pathway
  Homolog annotation: Hit_ID=A7PG23; Match level="QueryCoverage=79%, HitCoverage=96%, E-value=2e-89, Identity=63%"; Hit description =Chromosome chr6 scaffold_15, whole genome shotgun sequence
  Pfam annotation: Domain name=SRR1; Domain location=103-157; Score =79.8; E_value=8.8e-21; Accession=PF07985.3; Description=SRR1
MAASEKTLTNKCTTNEGWTVVLPRRSRQRRKATKSGVLEEKQEPWTPTDSQTDPSKEATLVQKMERCINRIERSEFYHTFRDQIQTSVVDYFNRVLGSEIKMQMVIYGIGSIKLYEPPRLQLSLAILMRRDFSWIGNIEVFDPILSATESRVLEALGCSVMSINEHGRREALKPTMFFMPHCEAELYNNLLQANWKLNLLKNMVLFGNSFETYEQHVSLCKNSPILNSMGHILAAQGFTNEFRIQTVSDDYYNAFHDSRMYIRINVAVHHVVIIIDLVMLVYPCTVARVVSVCDDPVSSVCGEQMNRRRSLVVGDFTDMRIWT

SEQ ID NO: 157272 - protein, 153 aa, Glycine max
  Coding DNA Sequence Number=SeqID_65587
MAEEHRCETPEGARRSVNEIHNRNCAIFFLLDETVVVHVTSAVSVDVLIESESAPPFAAEVEVAITIAVVSSSISISSASGADRVQVQVRSDVLQGSQAVMISREEGGDDDGIGRVVVVCWRHDLWFGGVGHCSMLVIVRGELGKEKEVGFLM

SEQ ID NO: 157273 - protein, 508 aa, Glycine max
  Coding DNA Sequence Number=SeqID_65588
  Gene Ontology: Mol. function=transferase activity; Cellular component= integrator complex; Biological process=snRNA processing
  Homolog annotation: Hit_ID=A7QRT5; Match level="QueryCoverage=62%, HitCoverage=59%, E-value=1e-101, Identity=60%"; Hit description =Chromosome chr13 scaffold_152, whole genome shotgun sequence
MDEFNTHLDSGILSADVKDFMLKIHTVNYAEEVCFNGTLVIKAFSSGIEIGSCNWILNSPKGDIAYLSGSSFISAHAMPFDYHSLQGTCVLIYSDFLSLGDTQDGENGDNYSVSTADKLLPISSQDLAGFNHNSVEYSEEKEKLVFICSHAMEHIKQGGSVLIPFDRLGTILLLLEEMTASLEASDTKVPVYIISSVAEELLALLNIIPEWLCKQRQEKLFDGEPLFAHLKLLKERKIHVVPAIHSHELLINWQEPCIVFCPHRNLRMGPVVHLLRRWCGDPKSLLILEDVLNPLSLLPYQPVAMKVLQCVFPVGIGLHEVQPLLKTLQPKTVLCPEELRLHINFSSEKKSFSVLYYTEAETLKVPYRKDSSELKIATDLASHFYWKTFKKEEINIAKLKGELLMENGRHHLLFDNDNKNSLSNNRSLVHWGLPDSEKLMAALSKMGISGNIQHGVSDAKSQTVCIVHIQDPYKASIEIGTTSTIITTADENVAAFIYKIVDNILDGV

SEQ ID NO: 157274 - protein, 288 aa, Glycine max
  Coding DNA Sequence Number=SeqID_65589
  Pfam annotation: Domain name=Transposase_28; Domain location=24-185; Score=-59.7; E_value=0.035; Accession=PF04195.3; Description =Putative gypsy type transposon
MARPSTAIRSLRSSGDGDIRVSPRMRHSLSAWLSSSTPTVVGYEWVRDDVLKYKSCLTSAASGGAWLSPFFFMYRCLFEVLGVILPLTTFQCALLEHLNVALSQLHPNSCTMVRAFEVLYPFSNIWPSVLVFLFFFQMKLSGKIGWVSLNSMSKKLFEFDSNIFRCFKDHFFKVLATDVVADSMPLMLNRDGEPYFLFYWQFDPTGFKSDPLASLDGIMGDFAWRPLVKQVRPANGTVPSSTAALSVGEGGQPASEVGLVVVTTDVTPNTFSSILAKRKRDNVVKQIE

SEQ ID NO: 157275 - protein, 20 aa, Glycine max
  Coding DNA Sequence Number=SeqID_65590
MTDCLRDEEEKACLFSRKSP

SEQ ID NO: 157276 - protein, 144 aa, Glycine max
  Coding DNA Sequence Number=SeqID_65591
MACRTKTHMHTWPHTLRFAIQPRLSDEVVEKFLKKYFTESKTAEGKAAISSFHQFLDTLEVAIQAVVGCFCWGKIKLKTLEEAMELIENVAASDHAILRDRTHIPTKRSPLELSSQDALLAQNKLLAKQLKTLIETLSKLPNQL

SEQ ID NO: 157277 - protein, 319 aa, Glycine max
  Coding DNA Sequence Number=SeqID_65592
  Gene Ontology: Mol. function=flavin-containing monooxygenase activity; Cellular component=intrinsic to endoplasmic reticulum membrane; Biological process=electron transport
  Homolog annotation: Hit_ID=A7QRT4; Match level="QueryCoverage=90%, HitCoverage=54%, E-value=6e-88, Identity=57%"; Hit description =Chromosome chr13 scaffold_152, whole genome shotgun sequence
  Pfam annotation: Domain name=DAO; Domain location=6-253; Score=-33.5; E_value=0.0017; Accession=PF01266.15; Description=FAD dependent oxidoreductase
  Pfam annotation: Domain name=FMO-like; Domain location=6-316; Score= -313.0; E_value=5.9e-11; Accession=PF00743.10; Description=Flavin -binding monooxygenase-like
  Pfam annotation: Domain name=Pyr_redox_2; Domain location=6-233; Score=-28.2; E_value=0.003; Accession=PF07992.5; Description =Pyridine nucleotide-disulphide oxidore
  Pfam module annotation: Pfam domain module=DAO::FMO-like::Pyr_redox _2; Domain location=6-253::6-316::6-233
MTHPLRVAVIGAGVAGLAAARSLRREGLDVVVFEKSNHLGGTWSYDPRTDSDPVGLDPNREVVHTSLYRSLRTNLPRQLMGFLDYPFPNRNNGDPRTFPGHEEVLWFLNRFSDEFGLRGLTRFGSEVVRVELVSEKSDSWVVESRRNRDSVLTREVFGAVVVCTGHFTQPRLPTIPGIEKWPGYQIHSHNYRVPEPFQGQIVVVIGFASSAFDISREIAKVAKEVHIATRSPDVKVMKLANHDNMWQHKMTSLSTCSGNAAFIYPLHLSRWEPSTYFVLPLIIEILITSVKCVSEDRLVAFDDGSSVYADVLFYCTGYA

SEQ ID NO: 157278 - protein, 213 aa, Glycine max
  Coding DNA Sequence Number=SeqID_65593
  Homolog annotation: Hit_ID=Q2HRR7; Match level="QueryCoverage=59%, HitCoverage=44%, E-value=1e-07, Identity=32%"; Hit description =Cecropin; Plant MuDR transposase, putative
  Subcellular localization annotation: CTP_CleavageSite=58; ConfidenceScore=5.66e-01
MLGAPSNSPSLSVFGPSRERLFVFPPFSSRGLPRSHHQSLPPPVVNVSRHLLVIATLRASLFTQVHVIMDVKITLILHHGGRFTPRASDGNVEYIGKKFDVWEDISADYMNTFILCDLVQACKKYSRIGDCFWLIDKDLDFNHGLMSCTTDGDILYLVKDALENENEINVYFHHEVDPIPEEVPLMLDLKCHPIPKASNEDDLDDVPVAGHEE

SEQ ID NO: 157279 - protein, 174 aa, Glycine max
  Coding DNA Sequence Number=SeqID_65594
  Homolog annotation: Hit_ID=A5BEV8; Match level="QueryCoverage=98%, HitCoverage=31%, E-value=1e-16, Identity=30%"; Hit description =Putative uncharacterized protein
MHVVGHVFKVTLYKKLFGMVSRYALNEIAAEFKRVAYAGKNPSRCGCVMRSTHGLPCAWLSETQATITEEMEIISKRFEKLDVCDGNYGYRAIAALLGMSEELWSLVRNHLHKELSNWSEEYMNLVGGIERFEELKRYLLVDELSKVTMNKWMNITDMGYVIASRYNVIVVSFS

SEQ ID NO: 157280 - protein, 495 aa, Glycine max
  Coding DNA Sequence Number=SeqID_65595
  Homolog annotation: Hit_ID=Q2HTA0; Match level="QueryCoverage=90%, HitCoverage=74%, E-value=2e-29, Identity=27%"; Hit description=IMP dehydrogenase/GMP reductase, related
  Pfam annotation: Domain name=DUF1723; Domain location=118-167; Score =27.3; E_value=5.7e-05; Accession=PF08330.1; Description=Protein of unknown function (DUF1723)
MVSTRGLGRALGHAIGKVLGRRDESDDDVPQWRRPIASACRQRQQQVVLVDPPMAEEELVDDQLEAHVEEGVADVECPELKLSSHGRKMTKFGRPAPEIEGHVVASGLSPLIAYSLDTCDHGLMSAFVEYWHKVTSSFHLSVRKVTITLDDIASLLHLPTVEVFHSFEQLHVDNVVEMLVELLEVSAIDARAETIQCHGSYVQLSWLCDLYELKIEACEWIVSGRAYLLHLFGCTLFANKSVTHMHVCWIYEHFSSIASTVPVEDYDKMRLHACRWTSGKALPVATYRRRLDRLTLDAVCWIPYGDHRSFREFEVISLFFDHLRWAPLTVIHRPKRVVRKFGYIQTILPHPVVSLLSIAEIDDRWMQFGEYIALVGQLCAVSGHCSPDYLDWFYMISHPFMSPAQPGDPPRAPPQHLMPAAAPNEADTEQHDLRHAVDDFVAIADRLEKLLNLRILTEGTEAYTVVEDCVAIARRFTGQPTVAHKSRRRRRMDGH

SEQ ID NO: 157281 - protein, 67 aa, Glycine max
  Coding DNA Sequence Number=SeqID_65596
MKVECPRQKKKKRYYGDKMKKSLIVTWDDLDNEKSNSSADEQANICLVADSNDKVETMKRIPYDVLL

SEQ ID NO: 157282 - protein, 110 aa, Glycine max
  Coding DNA Sequence Number=SeqID_65597
  Homolog annotation: Hit_ID=Q1RU93; Match level="QueryCoverage=63%, HitCoverage=5%, E-value=4e-08, Identity=38%"; Hit description=RNA -directed DNA polymerase (Reverse transcriptase); Ribonuclease H; Endonuclease/exonuclease/phosphatase
MEATSITGNHSNGIMFNNIMEFPRFRKLHIVGHTTCCPELTTCGGIFQNHMGDMLGCFAQSIPVSIAFHGELQAAMLAIEIAATKEWMNIWLECNFSLVVQAFKDSKMVP

SEQ ID NO: 157283 - protein, 284 aa, Glycine max
  Coding DNA Sequence Number=SeqID_65598
  Gene Ontology: Cellular component=membrane
  Homolog annotation: Hit_ID=A7QRT9; Match level="QueryCoverage=100%, HitCoverage=39%, E-value=8e-98, Identity=63%"; Hit description =Chromosome chr13 scaffold_152, whole genome shotgun sequence
  Pfam annotation: Domain name=DUF221; Domain location=1-281; Score =16.1; E_value=5.4e-09; Accession=PF02714.6; Description=Domain of unknown function DUF221
MAKIAGCIARSKEEIKACNMVFYFLVGNVFFWSVLSGSLLDLIGQFISHPKNVPSQLAGAVSAQADFFVTYILTDGLSGFSLELLQPGMLIWDILKSCVHGCQRETSPYLYSLPYFRIIPLVSLSVLIGIVYAVVAPLLLPFLILYFCLGYVVYVNQIRDVYETTYETCGQYWPYIHHYILLAIILMQITMVGLFGLKLKPAASISTIPLILFTWMFNEYCKMRFLPSFHHYTLQDAAENDELDEKCGLLELHYENAINAYCPPGLRPVNFMASESSSTPLVSS

SEQ ID NO: 157284 - protein, 103 aa, Glycine max
  Coding DNA Sequence Number=SeqID_65599
  Subcellular localization annotation: CTP_CleavageSite=28; ConfidenceScore=5.05e-01
MPLSLRQLRPPPPDCNFFTDDYDNDFFSGATTATSFPPPSWRQPPPPRHQPSRPPFRCSGGPRCWKQANTMPKRPRPSSSNSWYSSFFTATPLDRSRTFGECK

SEQ ID NO: 157285 - protein, 110 aa, Glycine max
  Coding DNA Sequence Number=SeqID_65600
MALREPSRTESDENPEILCSIIMAGAGDNGGVYHQLDEFQRLLLDAMTTQMQRLLNRNNKVLYMRIERLEPQMNPNAGRPYGGNQRVTDGLNRIEGPDRIEGVKLQCILF

SEQ ID NO: 157286 - protein, 327 aa, Glycine max
  Coding DNA Sequence Number=SeqID_65601
  Gene Ontology: Mol. function=nucleic acid binding; Cellular component= ribonucleoprotein complex; Biological process=ribosome biogenesis and assembly
  Homolog annotation: Hit_ID=A5B6W8; Match level="QueryCoverage=100%, HitCoverage=100%, E-value=1e-139, Identity=76%"; Hit description =Putative uncharacterized protein
  Pfam annotation: Domain name=Brix; Domain location=86-268; Score =248.4; E_value=1.5e-71; Accession=PF04427.9; Description=Brix domain
MLRRNIRLRREYLYRKSLEGKERLLYEKKRKIREALQEGKPIPTELRNEEAALRREIDLEDENTAVPRTHIDDEYAYAAEKDPKILLTTSRDPSAPLQQFVKELSFVFPNAQRMNRGGQVISEIIESCRAHDYTDVVLVHEHRGVPDGLIVCHLPFGPTAYFGLLNVASTSLTVTRHEIKDKKAIGTMPEAYPHLILDNFSTKLGDRTANILKHLFPVPKPDTKRIVTFSNQSDYISFRHHIYEKHGGPKSIELKEIGPRFELRLYQCFTLNSSILPKSIVVETGPIPHNTTLKQIKLGTVDQAEAQIEWVIRPYMNTTKKRKFLSN

SEQ ID NO: 157287 - protein, 131 aa, Glycine max
  Coding DNA Sequence Number=SeqID_65602
MDRGGKCLYHVNVDTLREVGKTLHNIALSLEYKFTLVRCVHDPIDKRVKVNCIIMDVSVLVDCIDELGPKRVLDELLGCPPSLLVPVESPIFYLGVGIPEHKGWVVPVCSDFVMDFTKIVEISSGLLEYWM

SEQ ID NO: 157288 - protein, 518 aa, Glycine max
  Coding DNA Sequence Number=SeqID_65603
  Gene Ontology: Mol. function=protein serine/threonine kinase activity; Cellular component=integral to membrane; Biological process=recognition or rejection of self pollen
  Homolog annotation: Hit_ID=Q70I28; Match level="QueryCoverage=94%, HitCoverage=63%, E-value=1e-157, Identity=55%"; Hit description=S -receptor kinase-like protein 3
  Pfam annotation: Domain name=B_lectin; Domain location=48-161; Score =129.5; E_value=9.8e-36; Accession=PF01453.15; Description=D-mannose binding lectin
  Pfam annotation: Domain name=PAN_2; Domain location=291-354; Score =109.2; E_value=1.3e-29; Accession=PF08276.2; Description=PAN-like domain
  Pfam annotation: Domain name=S_locus_glycop; Domain location=149-274; Score=92.1; E_value=1.8e-24; Accession=PF00954.11; Description=S -locus glycoprotein family
  Pfam module annotation: Pfam domain module=B_lectin::PAN_2::S_locus _glycop; Domain location=48-161::291-354::149-274
TLAIITPNESIQGNRTLVSSAGTFEAGFFNFGNSQGQYFGIWYKNISPKTIVWVANKDAPVKDSTAFLTLTHQGDPVILDGSRSTTVWFSNSSRIAEKPIMQLLDSGNLVVKDGNSKKENFLWESFDYPGNTFLAGMKLRTNLVSGPYRSLTSWKNAEDPGSGSWTGFVFSGVSWRRMLSLVTFSLAINDKEVTYQYETLKAGTVTMLVINPSGFVQRLLWSERTGNWEILSTRPMDQCEYYAFCDVNSLCNVTNSPKTCTCLEGFVPKFYEKWSALDWSGGCVRRINLSCEGDVFQKYAGMKLPDTSSSWYDKSLNLEKCEKLCLKNCSCTAYANVDVDGRGCLLWFDNIVDLTRHTDQGQDIYIRLAASELDHRGNDQSFDNKKLVGIVVGIVAFIMVLGSVTFTYMKRKKLAKREMLKIFHWKYKREKEDVELSTIFDFSTISNATDQFSPSKKLGEGGFGPVYKGLLKDGQEIAVKRLAKTSEQGAEQFKNEVIGYMPPEALLGSTQDNSVSFS

SEQ ID NO: 157289 - protein, 312 aa, Glycine max
  Coding DNA Sequence Number=SeqID_65604
HSLPEHSFGEECYSLHLEYDEFHRELERQNWHKALTRQMDGHIDMALVKEFYANLHDPEDKSPRQVRVWGKLIKFDVASLNAFLETPPVLELGAQYTPYTRGHTLEAPEEGFNYTDIDLERPDGHGHGLTHIRPDLIDGPEELLEPNPHDPIITFLGTRKARARGPSDVSALYSFAHSVLALSSSALAFTPAPPVPSDPSAQNSDTVVPMLQSLHQGLCLVMQSIHNVAQHWPIIGMEDFMAQATPKVSPAATPLVEVSEEEDDTTDMDYAADMAAAQSKWDPWPTTVQETSQPAQDALSSPQDDQIPAQDE

SEQ ID NO: 157290 - protein, 73 aa, Glycine max
  Coding DNA Sequence Number=SeqID_65605
  Homolog annotation: Hit_ID=A5ATC7; Match level="QueryCoverage=93%, HitCoverage=15%, E-value=1e-15, Identity=62%"; Hit description =Putative uncharacterized protein
  Subcellular localization annotation: CTP_CleavageSite=60; ConfidenceScore=5.04e-01
MSLLGNETSWTADFSKVLLFPNLVKHVVYSLSANGNTFPNHALRNVCHNRVVIETDEAVNANVFVTVDQGNAS

SEQ ID NO: 157291 - protein, 253 aa, Glycine max
  Coding DNA Sequence Number=SeqID_65606
  Gene Ontology: Mol. function=nucleotide binding; Cellular component =intrinsic to membrane; Biological process=defense response
  Homolog annotation: Hit_ID=A7PYP7; Match level="QueryCoverage=98%, HitCoverage=45%, E-value=2e-36, Identity=40%"; Hit description =Chromosome chr12 scaffold_38, whole genome shotgun sequence
  Pfam annotation: Domain name=NB-ARC; Domain location=1-142; Score= -104.0; E_value=0.0012; Accession=PF00931.13; Description=NB-ARC domain
MGKKFLLVLDDVWNENYSSWEALQIPFIYGFSGSRILITTRNEKVTSVMNSSQILHLKPLEKEDCWKLFATLAFHDKDACKYPNLVSVGSKIVDKCGGLPLAIRTLGNVLQAKFSQHEWVEFDKDQLIQLWMAEGLLNFWQINKSEEELGAEFFNDLVARKHSGFDVKELGNPNNLQGTLSIFKLENVTDPTNAMEANKKDKKHLEGLVLDWGDKFGRSNENEDKIVEGHVLESLHPNGNLKRLTVLRYDGTI

SEQ ID NO: 157292 - protein, 82 aa, Glycine max
  Coding DNA Sequence Number=SeqID_65607
MAIYRKQPLSVGKFTQASYLLRPEGIYSPRRVACLGLKLTLSPGELDPWELNPPSVGIHKLPISAKKEGVKVGTFSTQDNAL

SEQ ID NO: 157293 - protein, 143 aa, Glycine max
  Coding DNA Sequence Number=SeqID_65608
MSSTIVVQEGKREEHKKKKKKKKNSRGKKRRTEEEEEVKSEIKCRSKCLWCFDDDHDDLMQMGFSSLNSRQRFKNTSHNIKMITSILGREFLIDIAKDCVIDYTILVIDYQQLMNVLIQILKAVIDYTNSVIDYQTRFSEKYF

SEQ ID NO: 157294 - protein, 469 aa, Glycine max
  Coding DNA Sequence Number=SeqID_65609
  Gene Ontology: Mol. function=protein binding; Biological process =defense response
  Homolog annotation: Hit_ID=A5BH36; Match level="QueryCoverage=44%, HitCoverage=27%, E-value=1e-20, Identity=30%"; Hit description =Putative uncharacterized protein
  Subcellular localization annotation: CTP_CleavageSite=44; ConfidenceScore=5.55e-01
MTPVLVVAATRMSKTTTMSTRMRGVRNKGRGIPGRRGRGSKSMRSRETQQPLLNYVVGWGEEKTEGHCIMRYQFASNEQNSSKINSKTRDSSTIGREAMRSHIKSAKHGVVVPDRCFGNLNSLVVEGCEFLSKGVVLPSHLLCFLNNLKVLQVRKCNSVQAVLDHTTDLVSIPLRKLILDQLPNLKHVWNGGSQGSLNLPHLEEVLVDGCENIESLFPASMANDELRILEVENCVSLVEIVAKDEVATEEVNTERIIFQSLTLLRLWNLPKLRCIYPGMLILKWPKLQKLDVLHCEVLRFFATEFQNSPDSHLEDRNSFPTDQQESVSLRKRFDESDVFPFVFVSEKLEVLKDGFDKGHDLNSVIKEQSDDASSVMTDSNDFYNFARKRIWWRTRSLLSFPCLMQIFQQQQSRKPECGFSHLCAFIFPSCAKMHEYDRYDECNKQWMKYNSNNYCKPNALFQLECGVRE

SEQ ID NO: 157295 - protein, 203 aa, Glycine max
  Coding DNA Sequence Number=SeqID_65610
  Gene Ontology: Mol. function=transferase activity; Cellular component= chloroplast; Biological process=isoprenoid biosynthetic process
  Homolog annotation: Hit_ID=O64684; Match level="QueryCoverage=55%, HitCoverage=54%, E-value=8e-28, Identity=48%"; Hit description =Putative trans-prenyltransferase
PRVVPQAPQMDIPHVPEPRASLTSAEEPRHAVKVCDDIAERLERHLSLWVVTPSSSTHEAIEECLRIHVNDRMFLQVLFLMSTALNLSIHEAPPPIELGGALTVDVRSRQQRIAEITEMIHVASLLHDDVLDDADTRRGIGSLNFVMGNKAIAILAGQTTEVAMLAFEYGKNLGLASQFIDDVLDFIGHQLPLERVHCQTFVM

SEQ ID NO: 157296 - protein, 66 aa, Glycine max
  Coding DNA Sequence Number=SeqID_65611
MMTTKDDDKGDDKKLKGQSKDKFKMFKKESRTIQDSRGKVEEHFKIQEEAAIDYNVLVIDYQCLER

SEQ ID NO: 157297 - protein, 64 aa, Glycine max
  Coding DNA Sequence Number=SeqID_65612
MAKHDGWIPRWLWRAYIYSDAQVNNSSRWSEENEMELVIILPVIIEKAHKGKQDLGSGQTELGE

SEQ ID NO: 157298 - protein, 63 aa, Glycine max
  Coding DNA Sequence Number=SeqID_65613
MGEGKGKGIRKFKGKGKGQRGRGKGRKEGKEGKEDTHLVGSWLNVSMDPIVDDDQARDYAKEQ

SEQ ID NO: 157299 - protein, 81 aa, Glycine max
  Coding DNA Sequence Number=SeqID_65614
  Subcellular localization annotation: CTP_CleavageSite=49; ConfidenceScore=5.08e-01
MSCGTHCSLKVTYSLLSQRALRGRAKARLTGALFKGGKMRGVATNEGISTSHVDKSGALAPTYPPSKRKSYLRSSFLCVNQ

SEQ ID NO: 157300 - protein, 208 aa, Glycine max
  Coding DNA Sequence Number=SeqID_65615
  Homolog annotation: Hit_ID=A7P8V6; Match level="QueryCoverage=35%, HitCoverage=22%, E-value=7e-20, Identity=64%"; Hit description =Chromosome chr3 scaffold_8, whole genome shotgun sequence
  Subcellular localization annotation: CTP_CleavageSite=50; ConfidenceScore=5.57e-01
MRVAPAWACQPLTQEATAFSPFARALTRITSLSSMPTQRHSSNPTPTLFSAMKLDYARPPLSIIICFYFTFELTNILLVQGSCPRRFIRRGFRHETSYPIPNEVVQAYFSFFNPKPNDFPGAKTLLQTFLDGQERDLTAFVDLILAQTTVAFIVKIEDDDDEGLFALVTALNLYRYKLKNVEQKRKWSIDSDEAIIYIKIEDKIFTRH

SEQ ID NO: 157301 - protein, 88 aa, Glycine max
  Coding DNA Sequence Number=SeqID_65616
  Subcellular localization annotation: CTP_CleavageSite=6; ConfidenceScore=5.17e-01
MSSKVILMMPKNQELSKVSSKDSSFKFQVSRFKILDSRFKIQESRSKNQDSRFKKNQDSRKIKIKIHESREDSIKISTKKFFKTLSST

SEQ ID NO: 157302 - protein, 366 aa, Glycine max
  Coding DNA Sequence Number=SeqID_65617
  Gene Ontology: Biological process=intracellular signaling cascade
  Homolog annotation: Hit_ID=A7PJF0; Match level="QueryCoverage=91%, HitCoverage=92%, E-value=1e-119, Identity=58%"; Hit description =Chromosome chr12 scaffold_18, whole genome shotgun sequence
  Pfam annotation: Domain name=DUF231; Domain location=209-364; Score =237.4; E_value=3.1e-68; Accession=PF03005.6; Description=Arabidopsis proteins of unknown function
MRMHPWVFGVICLCQLLCVVNTGGGGHVKSNFKWQRSQEEQEHELSCNMYEGRWELDDSYPLYDSSTCPHIRKEFDCLKYGRPDQQYLKYRWQPNECDLPIFDGKDFLTKLKGKQIMFIGDSVSLNQWQSLICLLRSSVPQTEILEQGDVNVSNYTFQDYGVSVIIFHSTYLVDIEEEKIGRVLKLDSLQSGSIWKEMDILVFNTWLWWYRRGPKQPWDYVQIGDKILKDMDRMEAFKLGLTTWANWVNAEVDTNKTKVLFQGISPSHYNGMEWNEPGVRNCSKETQPISGSTYPSGLPAALFVLEDVLKNITKPVHLLNITTLSQLRKDAHPSSYNGFRGMDCTHWCVAGLPDTWNQLLYAAVTC

SEQ ID NO: 157303 - protein, 233 aa, Glycine max
  Coding DNA Sequence Number=SeqID_65618
  Homolog annotation: Hit_ID=A5C7K2; Match level="QueryCoverage=56%, HitCoverage=86%, E-value=5e-31, Identity=46%"; Hit description =Putative uncharacterized protein
  Pfam annotation: Domain name=Dirigent; Domain location=19-160; Score =110.7; E_value=4.4e-30; Accession=PF03018.5; Description=Dirigent -like protein
MASLPCLLFSIHFIVIMSSSLPTNSDEVFAKQSPMSPSTKPVEKITQLHFYFHNNVTEKNPTAMRIVGPPKGFITQFGTVVMMDDPLTEGPSPSSKLGIYNGSTLSILGRNPTLLKAREVAIVGGTGIFKYARGSAVLTTYMFDYKAGVAIVEYNVTVLHAENAIATGGKAQPAIASGGKAGERGLPPEGLAGLAVQWDSPRVLARQPCHVNQLFRLAGLVSALHCLGMQHSV

SEQ ID NO: 157304 - protein, 97 aa, Glycine max
  Coding DNA Sequence Number=SeqID_65619
MEPNMEDDNNASDFKHEWWVVWIWVWAVACPVHHLMMRMTRVIKEERWQIYVERVGGIVTGSGDIGGERTVSPMGMATPKLGLADRDGEIGQGQSRR

SEQ ID NO: 157305 - protein, 39 aa, Glycine max
  Coding DNA Sequence Number=SeqID_65620
MDEALKLSCAKDTKERITGVDCYIELANGGLVPVSEALK

SEQ ID NO: 157306 - protein, 67 aa, Glycine max
  Coding DNA Sequence Number=SeqID_65621
MVLMVEAEVVEAIHLVEEVEAEAHKCALIITDQQTSQASSSHTTNKLVSSRKNGNSGQLLLEDDWNS

SEQ ID NO: 157307 - protein, 164 aa, Glycine max
  Coding DNA Sequence Number=SeqID_65622
  Homolog annotation: Hit_ID=A9PD67; Match level="QueryCoverage=37%, HitCoverage=29%, E-value=2e-10, Identity=50%"; Hit description =Putative uncharacterized protein
MGEHPTAMKIVEPPNESIAGFGTGFGTIYMMDDPLTEGPSPSSKLVGRSRGIYAKASQHDLGNGEEAERHPENGARSSPAVSLLQEDPVSILSLRSAFMRPPGSVPDETTTPEEARKQQKQEEALHASNLRVPRHPLWTPNMSADELNASEMQAFLAWRRSLAR

SEQ ID NO: 157308 - protein, 461 aa, Glycine max
  Coding DNA Sequence Number=SeqID_65623
  Gene Ontology: Mol. function=transcription factor activity; Cellular component=nucleus; Biological process=regulation of transcription
  Homolog annotation: Hit_ID=A7Q1V5; Match level="QueryCoverage=93%, HitCoverage=91%, E-value=1e-140, Identity=59%"; Hit description =Chromosome chr13 scaffold_45, whole genome shotgun sequence
  Pfam annotation: Domain name=GRAS; Domain location=12-368; Score =239.5; E_value=7.6e-69; Accession=PF03514.5; Description=GRAS family transcription factor
MARLDMLVFDNDNPFWPALKSSTLQRDNFGELRWESQGLNPMILLLDCAKCVASGSIKNADIGLEYISQISSPDGSAVQRMVTYFSEALSYRIIKRLPGVYKSLNPPKTSLSSEDILVQKYFYDLCPFLKFSYLITNQAIVEAMEFEKVVHIIDLHCCEPAQWIDLLLTFKNRQGGPPHLKITGIHEKKEVLDQMNFHLTTEAGKLDFPLQFYPVISKLEDVDFEKLPVKIGDALAISSVLQLHSLLATDDDMAGRISPAAAATMNLQRAVHMGQRTFAEWLERDMINAYILSPDSALSPLSLGASPKMGIFLNAMQKLQPKLVVITEQESNLNGSNLMERVDRALYFYSALFDCLESTVLRTSVERQKLESMLLGEQIKNIIACEGVDRKERHEKLEKWIRRLEMAGFVKVPLSYNGRIEAKNLLQRYSNKYKFREENDCLLVCWSDTPMFSVSAWSFSR

SEQ ID NO: 157309 - protein, 265 aa, Glycine max
  Coding DNA Sequence Number=SeqID_65624
  Gene Ontology: Mol. function=sequence-specific DNA binding; Cellular component=intracellular; Biological process=DNA metabolic process
  Homolog annotation: Hit_ID=A7Q1W0; Match level="QueryCoverage=100%, HitCoverage=84%, E-value=8e-87, Identity=60%"; Hit description =Chromosome chr13 scaffold_45, whole genome shotgun sequence
MENRTTQVRCPENQELATYVWNKWKEMAQQPKGISDNIDMTLSKAHFNLCNSKTPIRTIKDFSQVKGVGKMILKLMQGFFGTGSEPEDLTKKGKRTKGTKRYMPQRNSVAYALLITLYRGTSSGNEFMHKQELIDASEASGLSRVPIAPEKGKGKPGHFGSSSRDWYSGWSCMKTLIAKGLIVKSSCPAKYMLTQEGKEAARDCLARSGMAESIEMSSSVEIPSCMDNQNLLDVELNGHDLESEVLSPLTQQKKPIDVPLDCLER

SEQ ID NO: 157310 - protein, 66 aa, Glycine max
  Coding DNA Sequence Number=SeqID_65625
MARCMCQKLSRTKKKKKIVYYDLGDPKANKAKVVTMVLMGGGWVQWSWRYRGEATAWKGKDKNEIL

SEQ ID NO: 157311 - protein, 211 aa, Glycine max
  Coding DNA Sequence Number=SeqID_65626
  Homolog annotation: Hit_ID=A9PJP9; Match level="QueryCoverage=74%, HitCoverage=92%, E-value=1e-36, Identity=50%"; Hit description =Putative uncharacterized protein
  Pfam annotation: Domain name=PAM2; Domain location=6-23; Score=17.7; E_value=0.016; Accession=PF07145.6; Description=Ataxin-2 C-terminal region
MALVSGRSSALNPNAPMFIPAALRQVEDFSPQWWDLVKSSTWFRDYWLSQHKEEEFEEVANDSTNDDMENMLSETFDLGMEEDFNVLENEFEQLVMFSEALDHSVQDDPNTGKGSPQSLNKDVKAFLINLTPKSPRERGPKSPSGLAKHLEKPAQHVNVKNMYGAELAKEKTLLMLCWLHARTFGFAGLEQGKEHLEREIAKWNLLIDRPM

SEQ ID NO: 157312 - protein, 76 aa, Glycine max
  Coding DNA Sequence Number=SeqID_65627
  Homolog annotation: Hit_ID=Q6WAY3; Match level="QueryCoverage=92%, HitCoverage=3%, E-value=1e-07, Identity=41%"; Hit description =Gag/pol polyprotein
MPYVDLLPYLLDNAMAVISPTKISQPLFPRGYNPNMTCAYHEGVLGHSNEHCMTLKHKVQSLIDAGWLRFKEENRS

SEQ ID NO: 157313 - protein, 109 aa, Glycine max
  Coding DNA Sequence Number=SeqID_65628
  Homolog annotation: Hit_ID=A7Q1X6; Match level="QueryCoverage=92%, HitCoverage=78%, E-value=6e-10, Identity=42%"; Hit description =Chromosome chr13 scaffold_45, whole genome shotgun sequence
  Subcellular localization annotation: CTP_CleavageSite=42; ConfidenceScore=5.63e-01
MTTLFCVSNPISHLSAFASLRAPPFFFNSPALRIHAGGRERRGSAVATRAGPSTSSILFAIALPSSLLGVTILAALRMGDKLDRDWLEECQSLWISQSPREQKSPMYGD

SEQ ID NO: 157314 - protein, 198 aa, Glycine max
  Coding DNA Sequence Number=SeqID_65629
  Gene Ontology: Mol. function=N-acetyltransferase activity; Cellular component=plasma membrane; Biological process=cellulose and pectin -containing cell wall modification during multidimensional cell growth
  Homolog annotation: Hit_ID=A7Q1X5; Match level="QueryCoverage=98%, HitCoverage=47%, E-value=5e-72, Identity=62%"; Hit description =Chromosome chr13 scaffold_45, whole genome shotgun sequence
MFKKNYDHLPKDTYFGMYKDSVRGNPNYFLTYGNGKSAARIQDHLRPNVLLNYASEIKLEEAAVLHYTYAKFSDLTSRRDRCGCKPTKEDVKRCFMLEFDRSVIIQSLRESGVFSSVIASAPSLSKENFLLSIDSSNSSRAVASVTTLPSTSRKVGRTKESQAATRKALSIESVAFHQVAVPPLSPPGLDNNGLISHN

SEQ ID NO: 157315 - protein, 86 aa, Glycine max
  Coding DNA Sequence Number=SeqID_65630
MARNEALMELETYDDDDNDDNDDVSSEEDMKNLVGRLGVYDKANHALDRYRLKGALKPGVFTPKAYTPKSPSGSLSPDSGPMHKTF

SEQ ID NO: 157316 - protein, 191 aa, Glycine max
  Coding DNA Sequence Number=SeqID_65631
  Homolog annotation: Hit_ID=A7Q1X7; Match level="QueryCoverage=99%, HitCoverage=68%, E-value=7e-41, Identity=43%"; Hit description =Chromosome chr13 scaffold_45, whole genome shotgun sequence
  Pfam annotation: Domain name=PPR; Domain location=53-87; Score=35.6; E_value=1.8e-07; Accession=PF01535.11; Description=PPR repeat
  Pfam annotation: Domain name=PPR; Domain location=88-122; Score=19.8; E_value=0.0099; Accession=PF01535.11; Description=PPR repeat
  Pfam module annotation: Pfam domain module=PPR::PPR; Domain location =53-87::88-122
MDEFFKLLEQMQKLDFPVIADLPKFFSVLVEKKPIIALETFVQLKEKGHVSVKIYNILMDSLHKIGEVKKVLSLFDEMKGLSLKPDSFAYSIVILCLVELGEIKEACACHTKIIEMSCIPSVAAYSSLTKGLCKRCWFMIACAMLVMDQSSLSLVLPLFMHKNTADLVLSSLKFFGLESKLKAKGCKLLPS

SEQ ID NO: 157317 - protein, 375 aa, Glycine max
  Coding DNA Sequence Number=SeqID_65632
  Homolog annotation: Hit_ID=A7UQU7; Match level="QueryCoverage=36%, HitCoverage=23%, E-value=5e-17, Identity=39%"; Hit description=IMP dehydrogenase/GMP reductase, putative
  Pfam annotation: Domain name=DUF1723; Domain location=101-150; Score =48.8; E_value=1.9e-11; Accession=PF08330.1; Description=Protein of unknown function (DUF1723)
EVVVVAEDASHMDDVAEEVFQHVEEVGVDAQGFPGGSHDTSMLVAYVDHVAVIIWNGEERPELKLSSHGRKVQKFGRPTIEIEGLVAITGISLLIACSLDTGDRRLISTFVERWHKETSSFHLPIGELTITLDDMASLLQLPIICAFHSFNTFHGDKAVLIQSVSYAWRDAVLVHMYDNLKDACKNGGRQLVGYITLLQTSTKALPALTYWKCLDRLMIVDVVGCLTVTTMQFESLTSFHTIPPHSPGSRLSFQDIDNRWMHFSEYLASPEDPPKHLPGMQDETYVEADMPEFLMMTISIEEAHAHAPSDVEQPRHTMTCQAIAERLEWLLNLRIMTEGIEAHDIMQDCLRIARGVTVDHNVYVRSRLRWCTDHA

SEQ ID NO: 157318 - protein, 128 aa, Glycine max
  Coding DNA Sequence Number=SeqID_65633
MVVEILAIKISISANIGSNQAQSFEKRILSSQGQSMEVTNLQKLGQKIGTNEGRYGGHEGKNDNNDGSNDESMRKMMEDNTATGVAASTTTEMDPIHPAGFDKVNRPVLDVVGQGGKAGKNACGPHHV

SEQ ID NO: 157319 - protein, 376 aa, Glycine max
  Coding DNA Sequence Number=SeqID_65634
MASRKRRASTSRPQEPYDTTRFVFEELEKRRWHRALTRQPDNHIDVALVKEFYANLFDPEDKSLRQVRVRGKLIKFDAATLNEFLESPVVLEPEERYSTYSRFCHTHPVPQELAARLCIPGRGFVLNVEGAPWKLLRKDLTILPQTWSVLSYSNLAPTSHMSDLNMDRARLVYGLVMKMDMDVGSIISGQISQMAQSNSFRLGFPALITTLCIARGVVPDPLTSESLSPAINLAYIRKNCWNLDDPTITFPESREARARGPSDASTSAPAPTPTLVPPLAPLGLSGPSPSSAGEGETSTAQEPQPEPEETLKGTPTATPMEVTDEGYGTVDTDYIADITAAQGTWDPWPTTAQDTPMPTQDAPTSPHDDLAPAQDD

SEQ ID NO: 157320 - protein, 716 aa, Glycine max
  Coding DNA Sequence Number=SeqID_65635
  Gene Ontology: Mol. function=helicase activity; Cellular component =ribosome; Biological process=viral genome replication
  Homolog annotation: Hit_ID=Q2R1R7; Match level="QueryCoverage=30%, HitCoverage=13%, E-value=2e-47, Identity=47%"; Hit description=AT hook motif-containing protein, putative
MAHIADKIKTIDGSKETLKLVVRITELWFVGTPGRSKQAEMIIVDSDPLIRYFYDSQGDQIHVVCKQDKLKTWKMNLKEGCTYVMHNFRVSMNDEQYRVCDHPYKLTFIGVTVVRQCEFDGLPFKNYRFANFSDVVASLLWSSQPSGSAQLSSRETFISKSEAKTISEINNIYELAFSAIRKQMSIHNRLCAHVASIMIKLCLAFNAIIYVSRYRVEVMVNYKDESTKFLLWDHECTELIGQSVDEVNSLKVEDGDLDLNASPKALDKLLGHLLAFKVKIKPQYKNYVVLKCSIDLTLINDVLDMLLDAKTCPKIKVTTPSDSNDPVHDESQSISITADHDPLIGLPLIPTKRQTFHEFNVSDPSENENSGSTEESQTISSVGYPNCESSHHDPSMDTGAYFDLGDQLMQCRHCNAKMWYNERILKRSNTSSPRFSLCCGNGKVELPLLQNPLKFLQQVLFEQNTAHAKNYQQNIRTYNMMFAFTSAGIKFDKTISHLRGPPTIRIQGQPCHGIGSLLPMPGKEPKFAQLYIYEIENEVQNRINTMSHYNEIETHIVSNLREMLDENNAHAKSFRMARDRLTGTEVHNVRLKLIVGWEKDCRTYNVPSVAEVVALIAGICQGILHSISSILTYYGPQMDIPIKSYTCFKFKKIHKKAFGLYEWWDPPRGQCLAISTGEFHQLLPRVQLANSIGEFPPKIDPLWKKFRNSPLLGISF

SEQ ID NO: 157321 - protein, 83 aa, Glycine max
  Coding DNA Sequence Number=SeqID_65636
MKNTTRTSQESQIQNPQSQITTQITNSSHRSEWQMEVEHLLGELVDVGDDENEIVNKGQSLLALVEGDRASQTHACSGVVSQE

SEQ ID NO: 157322 - protein, 79 aa, Glycine max
  Coding DNA Sequence Number=SeqID_65637
MTLQLTNFSADPSSPHLNFQSSAWHHNSRRPAWRSDEINGEGEEFDKIEIMKQKCGTRNCSALSSNFFEFDVYNTSTCS

SEQ ID NO: 157323 - protein, 96 aa, Glycine max
  Coding DNA Sequence Number=SeqID_65638
MYYHPSQWWKDIQHISNYCSARYDWFEDLVTRKVRGGLQQESHIHGARPQMKEMVSLWLQYTNIFWKDTSLTSTGRILLCSPLSFGTTKHHHPMHV

SEQ ID NO: 157324 - protein, 35 aa, Glycine max
  Coding DNA Sequence Number=SeqID_65639
  Homolog annotation: Hit_ID=Q9ST51; Match level="QueryCoverage=82%, HitCoverage=5%, E-value=4e-07, Identity=89%"; Hit description=Fuct c3 protein
MRLQALESLEKSNIKIDSYGGCHRNYDGDVFLWEL

SEQ ID NO: 157325 - protein, 80 aa, Glycine max
  Coding DNA Sequence Number=SeqID_65640
MSVGGAEGAGAGAAAVEGVAGAVGAAAGDWAKVVVEWEKKSSVVGISACLYINKRWCVIEMHYCDSQWDFAWEGRKYSEI

SEQ ID NO: 157326 - protein, 47 aa, Glycine max
  Coding DNA Sequence Number=SeqID_65641
MEWFYMISRPFMSPTQPGNPPRHPPMLMVTTTMAEPRAAAPTDVDQP

SEQ ID NO: 157327 - protein, 838 aa, Glycine max
  Coding DNA Sequence Number=SeqID_65642
  Gene Ontology: Mol. function=hydrolase activity, acting on glycosyl bonds; Cellular component=beta-galactosidase complex; Biological process=carbohydrate metabolic process
  Homolog annotation: Hit_ID=A7NZH6; Match level="QueryCoverage=99%, HitCoverage=99%, E-value=0.0, Identity=76%"; Hit description=Beta -galactosidase
  Pfam annotation: Domain name=Gal_Lectin; Domain location=760-837; Score=121.6; E_value=2.3e-33; Accession=PF02140.9; Description =Galactose binding lectin domain
  Pfam annotation: Domain name=Glyco_hydro_2_N; Domain location=430 -573; Score=-52.4; E_value=0.026; Accession=PF02837.9; Description =Glycosyl hydrolases family 2, sugar binding domain
  Pfam annotation: Domain name=Glyco_hydro_35; Domain location=33-339; Score=650.6; E_value=1.3e-192; Accession=PF01301.10; Description =Glycosyl hydrolases family 35
  Pfam annotation: Domain name=Glyco_hydro_42; Domain location=55-370; Score=-224.0; E_value=0.0021; Accession=PF02449.6; Description=Beta -galactosidase
  Pfam module annotation: Pfam domain module=Gal_Lectin::Glyco_hydro_2 _N::Glyco_hydro_35::Glyco_hydro_42; Domain location=760-837::430 -573::33-339::55-370
MRGTQILFVGLLWFFCVYAPSSFCANVTYDHRALVIDGKRRVLVSGSIHYPRSTPEMWPDLIQKSKDGGLDVIETYVFWNLHEPVQGQYNFEGRADLVKFVKAVAAAGLYVHLRIGPYACAEWNYGGFPLWLHFIPGIQFRTDNKPFEAEMKRFTVKIVDMMKQESLYASQGGPIILSQVENEYGNIDAAYGPAAKSYIKWAASMATSLDTGVPWVMCQQADAPDPIINTCNGFYCDQFTPNSNAKPKMWTENWSGWFLSFGGAVPYRPVEDLAFAVARFYQRGGTFQNYYMYHGGTNFGRTTGGPFISTSYDYDAPIDQYGIIRQPKWGHLKDVHKAIKLCEEALIATDPTITSPGPNIEAAVYKTGSICAAFLANIATSDATVTFNGNSYHLPAWSVSILPDCKNVVLNTAKINSASMISSFTTESFKEEVGSLDDSGSGWSWISEPIGISKSDSFSKFGLLEQINTTADKSDYLWYSISIDVEGDSGSQTVLHIESLGHALHAFINGKIAGSGTGNSGKAKVNVDIPVTLVAGKNSIDLLSLTVGLQNYGAFFDTWGAGITGPVILKGLKNGSTVDLSSQQWTYQVGLKYEDLGPSNGSSGQWNSQSTLPTNQSLIWYKTNFVAPSGSNPVAIDFTGMGKGEAWVNGQSIGRYWPTYVSPNGGCTDSCNYRGAYSSSKCLKNCGKPSQTLYHIPRSWLQPDSNTLVLFEESGGDPTQISFATKQIGSMCSHVSESHPPPVDLWNSDKGRKVGPVLSLECPYPNQLISSIKFASFGTPYGTCGNFKHGRCRSNKALSIVQKACIGSSSCRIGISINTFGDPCKGVTKSLAVEASCA

SEQ ID NO: 157328 - protein, 411 aa, Glycine max
  Coding DNA Sequence Number=SeqID_65643
  Pfam annotation: Domain name=F-box; Domain location=25-72; Score =18.6; E_value=0.023; Accession=PF00646.24; Description=F-box domain
MTQGMIIAVQGSRNMNARNRFENRDIISTMPDDILGNILSRLTMKEAVRSSVLGTKWRHNWTFFSGVLEFEQSRRNFHLRREHVGILTKCNVFVSEWERFMTHMSKVMKSLKSSSMQGLRICMDLGDPWRAAEWVKYAAEKDVQTLDLDFSYHFSVPIYKMSELTIHNVFPSRGYEMKSLCNLRLSSVDKVQGEALRLKHLELVDCHIMDLYISAQNLQTLRYLGEFGKFKFQNIPSLVEASFGGIFCSFLQSDIGRVDFYEGFIEGMPVFDNVKQLEIRIPHRSGASLDHHVYLLSSFPSVRVLKIKFQRNDLREVKEKWKANMEHEYLNLRELEVSGYRRDPSQMELLINIFEKAPNLNRVVVDPLSSMHVDRSPDVRAEYREMRRETTKWLADSLKPHLSPLTQLIVL

SEQ ID NO: 157329 - protein, 63 aa, Glycine max
  Coding DNA Sequence Number=SeqID_65644
  Subcellular localization annotation: CTP_CleavageSite=34; ConfidenceScore=5.54e-01
MAKLSVQHNSFSSYAVLRLRLPPPLPLLVLVACSCSSIGACSSSSVTIGACSSSSSAVHLFVY

SEQ ID NO: 157330 - protein, 60 aa, Glycine max
  Coding DNA Sequence Number=SeqID_65645
MERQRGKKQCAKNQPRIGEEGRTVPMESWKEGEVRKPLRVVEEEEVSSSSMTHNHILDED

SEQ ID NO: 157331 - protein, 63 aa, Glycine max
  Coding DNA Sequence Number=SeqID_65646
MAKRERESEKEENEAEYELRIRELTGEEEEIEASFQNMREKKARNIEEAENPNLEIEKVRARR

SEQ ID NO: 157332 - protein, 87 aa, Glycine max
  Coding DNA Sequence Number=SeqID_65647
MDIELRSGIDNEKRVGEDSLWSVGPILSDQRNRDKDVNAPKIIKKTSLPCFSIFVLFSFFSLYSLSHPSSFNSNMFMLLRVSSSLPS

SEQ ID NO: 157333 - protein, 847 aa, Glycine max
  Coding DNA Sequence Number=SeqID_65648
  Gene Ontology: Mol. function=protein phosphatase binding; Cellular component=cytoplasm; Biological process=regulation of phosphoprotein phosphatase activity
  Homolog annotation: Hit_ID=A7NZK1; Match level="QueryCoverage=100%, HitCoverage=94%, E-value=0.0, Identity=63%"; Hit description =Chromosome chr6 scaffold_3, whole genome shotgun sequence
  Pfam annotation: Domain name=SAPS; Domain location=81-464; Score =458.1; E_value=1.2e-134; Accession=PF04499.6; Description=SIT4 phosphatase-associated protein
LRDRAQVEQLLRYIIEEPLEDDENKRVFKFPFISCEIFTCEIDVILKTLVDEEELMNLLFSFLEPDRSHSTLLAGYFSKVVICLMIRKTVPLMNYVQAHQHVFRQLVDLIGITSIMEVLVRLVGADDHVYPNFIDVMQWLAESNLLEMIVDKLSPSMIHGIFFDLPHIAILHLPGVKSPPEVHANVAETLCTITRVASSTLAIKLSSPSFVAKILGYALEDSQSMSSLVNSLSVCISLLDPKKSAISSPLFHSFRSQNMYEPPIPVNPDTIGAMLPKLGEFLVLLDVSSDNKVLPTTYGELRPPLGKHRLKIVEFIAVLLKTGNEVAEKELANSGTIRRVIDLFFEYPYNNSLHHHVESIISSCLESKSNAIIDHLLRDCDLVGRFLQADKHCILSVESSQHTVPAAGKRGTRVGNIGHITRIFNKLVHLARNQSHILACLQENSEWNEWQATVLQQRNVVENVHRWACGRPTSLQDRMRDSDDEDLHDRDYDVAALANNLSQAFRYKIYGNDDNEEEHGGLDRDDEETRYFMTEIREKPLLQRSESQDVYFDDDSAEVVISSLRLGDDQGSNLFTNSNWFAFQDNRIGDAPGGTSSSEMMDEIKLNAAANGGSNSSDDEVVVGEDEELVDSKNTVNGTSSSSTDFFSGLTGSDSLNGGTLNIESEKTSPSHDMGFFRFEAPDNEDLFGDRPLPDWVGWGEPSEMQDAGSSMNPFLDNDESGSNLPIKPQEGSPNLSSPSNGESIPSNGSPTTSDSINGSSDSSPTSVAVPSLFEEDVEFVGVELEGTEKAMDQALKEGVVGEAGPLKRNVVSKVPEKENSEEGSPGVKEFNDANYWRVDNEVAVLE

SEQ ID NO: 157334 - protein, 500 aa, Glycine max
  Coding DNA Sequence Number=SeqID_65649
  Gene Ontology: Mol. function=catalytic activity; Biological process =fructose 2,6-bisphosphate metabolic process
  Homolog annotation: Hit_ID=A7NZK5; Match level="QueryCoverage=90%, HitCoverage=83%, E-value=1e-163, Identity=63%"; Hit description =Chromosome chr6 scaffold_3, whole genome shotgun sequence
  Pfam annotation: Domain name=Brevenin; Domain location=3-48; Score =4.4; E_value=0.087; Accession=PF03032.6; Description=Breveninesculent ingaegurinrugosin family
MDPALKLCVLLLILLGLVNGSFAENDYGRCESVVKSWARSSLDEEMTKDDKHTLRDLLFFLHVPRTGGRTYFHCFLKKLYPSYLECPRSYDKLRFDPSKPKCRLLVTHDDYSITSKLPRERTSVVTILRDPVDRVFSTYEFSIEVAARFLVHPNLTSATKMALRLSSKTKGVSTLDIWPWKYLVPWMREDLFARREARYSRGLNIIESNDSYDMEDFAMPLQEYINDPVAVDVVHNGATFQVAGLTNNSYIAEAHEVRHCVQKYKTLGKYVLQVAKHVLQCLYILQKRLDEMLYVGLTEEHRKSATMFANVVGAQVISQLNAPNTSLETTDKTERSSFTDNDPDSSEHQNSTLDRGESAVTSSEGGEATEFNMTVGELMDAYEVCISNLRKAQSRRRISSLKRISPVNFTKEARLQVPEEILHKIRSLNDLDLQLYEYAKAIFNKQHKTSLLITEESWDNISGSAYGLWRVVTLAITCVFFIFLFLLIVNVRRRTSKVKK

SEQ ID NO: 157335 - protein, 306 aa, Glycine max
  Coding DNA Sequence Number=SeqID_65650
  Gene Ontology: Mol. function=3'-5'-exoribonuclease activity; Cellular component=exosome (RNase complex); Biological process=RNA processing
  Homolog annotation: Hit_ID=A9PH32; Match level="QueryCoverage=67%, HitCoverage=80%, E-value=2e-96, Identity=84%"; Hit description =Putative uncharacterized protein
  Pfam annotation: Domain name=RNase_PH; Domain location=93-217; Score =66.7; E_value=7.5e-17; Accession=PF01138.12; Description=3' exoribonuclease family, domain 1
MGPNWKRPSPPAPGVLPSPMPGRVRDSKGLRIDGALRIGDAPFSVRNIEQTFELIQLMMEVVLVQRVLGPFGTRITSGVPGIGIEIPDVVDCAGRTVFRTGAVNAASGSAYAEFGNTKVIVSVFGPRESKKAMMYSDIGRLNCNVSFTTFATPIRGQGSDHKEYCAMLHKALEGAIILETFPKTTVDVFALVLESSGSDLPVVISCASLALADAGIMMYDIVASVSVSCFNKNLVIDPILEEEIGQDGSLMITCMPSRYEITQLTVTGEWSTTKINEGMQLCLDACAKLAKIMRSCLKEVASDSQE

SEQ ID NO: 157336 - protein, 61 aa, Glycine max
  Coding DNA Sequence Number=SeqID_65651
MLRGNKSLKEWGGVWSVMMKKKGLMKSQEKRLNDEALLEGSKSYREASAKVANLAYFLKHV

SEQ ID NO: 157337 - protein, 134 aa, Glycine max
  Coding DNA Sequence Number=SeqID_65652
MTVWEEYALQLDDAIEKNHIDRKPLVIMLTLAKIKDPKGHYHESGDEVKVFPPCVDELLGKTWALRFKYRVQIRQSSVLDVTEDKDIIQTITSTIGLQVLADYDLGLSAFVTSAKRMSDQQASSEFHSDEYTPY

SEQ ID NO: 157338 - protein, 259 aa, Glycine max
  Coding DNA Sequence Number=SeqID_65653
MAEKTKKKLEEAAQSGSTEGVIDPPSPIRRHVKSKMAHTKKIGQMTSEAAKETTEKIASQGLFVPHGLQDLLTAVIGRPEHSGRVRATGSSVTIKQYFGLAPRSSRNSSSMAPEELEQLTKQIRDQLEESIMERPEVGPSAARVSIKGSCVDPSSTDPDTGDSDKCRLYIKENPSHLVKDAEALIPVPTDDVILVGQAINTFLAWPTHLVKRLSEQLCLQQNLQIGWIMRSRIPYICDIDHPIAFFEASLGYVGCYRVH

SEQ ID NO: 157339 - protein, 331 aa, Glycine max
  Coding DNA Sequence Number=SeqID_65654
  Gene Ontology: Mol. function=ATPase activity, coupled to transmembrane movement of substances; Cellular component=integral to membrane; Biological process=auxin mediated signaling pathway
  Homolog annotation: Hit_ID=A7QQI4; Match level="QueryCoverage=59%, HitCoverage=72%, E-value=6e-56, Identity=48%"; Hit description =Chromosome undetermined scaffold_143, whole genome shotgun sequence
  Pfam annotation: Domain name=ABC_tran; Domain location=166-300; Score= -33.1; E_value=0.00039; Accession=PF00005.18; Description=ABC transporter
MDMNAGLGSFAAVIRSSNLWVMNVVPTICVNNILLLSSSFSDANYLTNGHLDSAIELQQPTLQLNVRILGPEVVIGQKQAITQYNQYLVKAYRVGVQEGVAGGFGFGLVCLFIYCTYGLAVWFGGKMVLDKDDISGDIELKKVYFSYTSRPDEQIFNGFSISIPSTTTTALVGKSGSEKSIIIRLIERFYDPQAGEILIDGINLKEFQLKWIRQKIGLVSQEPVLFACSIKQNIAYGKDGPTDEEIKDAGKLAIAAKFIDKFLHGLHTMVGEHIRTSTNLRGAMGYIAPEWLRNAPITGKVDKYSFGAKECTLLPVYVCDNTTLPLGEFRS

SEQ ID NO: 157340 - protein, 113 aa, Glycine max
  Coding DNA Sequence Number=SeqID_65655
MMIQIVNSEETIKKIKVKVRGVNSLPRELRIIVNFDDQGQAIGEAQALFAGFLGTLAADCKLFPMDYDRWSGPSGVPKAYFDDCFETILKPNDASSVPNTPLDARGSSGASNP

SEQ ID NO: 157341 - protein, 83 aa, Glycine max
  Coding DNA Sequence Number=SeqID_65656
  Subcellular localization annotation: CTP_CleavageSite=42; ConfidenceScore=5.44e-01
MATPSSSPPPPPPTDATSYSPSTLKRTRKATRLRSLATIPIGAERAQVHVDPATGKVDGPHKKKIRTYLGIVTCDKVDVTYEN

SEQ ID NO: 157342 - protein, 224 aa, Glycine max
  Coding DNA Sequence Number=SeqID_65657
  Homolog annotation: Hit_ID=A2I5F0; Match level="QueryCoverage=43%, HitCoverage=63%, E-value=6e-23, Identity=52%"; Hit description =Polynucleotidyl transferase
MWNRLRDIFQDNKNSRVVTLEQEFSHTNMEDFPNAFVYRQWLKELSDQLKNAYNGVATLICQSDPLPPFYQAHSMLTLEEVGLTKKVLAGGGAAMGVHDNDDSHSLSKNSHQNWNHGGKKDQNHNNGGKNNGGNRGGSRVAMVVVTIVADNNNPASNNRGTSNGLPDNGTSPTALERHPWAKTTTDLHGDSSSTHFDSIEVAMDTLGLNPLDANWYMDTSAICR

SEQ ID NO: 157343 - protein, 79 aa, Glycine max
  Coding DNA Sequence Number=SeqID_65658
MEMIKLGDQMRRMSYDNEERKERMRKENYENLGRIHKSSEALSIRGIERMKEDGGMKVIGREEIIEDMEVDKERKGLRE

SEQ ID NO: 157344 - protein, 257 aa, Glycine max
  Coding DNA Sequence Number=SeqID_65659
  Gene Ontology: Mol. function=aspartic-type endopeptidase activity; Biological process=DNA integration
  Homolog annotation: Hit_ID=A5C8K0; Match level="QueryCoverage=59%, HitCoverage=9%, E-value=1e-13, Identity=32%"; Hit description =Putative uncharacterized protein
  Pfam annotation: Domain name=zf-CCHC; Domain location=72-89; Score =13.4; E_value=0.014; Accession=PF00098.14; Description=Zinc knuckle
MKDGFLKHQELKGQPQDAVKLHEEIITLKTTLSKFVNGINNLNKLLGYCRSSIDKFGNEYKRKAYVHDEDKIVCYLCRKIGHMTSRCEDCPKMGSLNPFMTYTKGPKEIWIPKKRIFHVTNILDSRIWLLTTRLNHNLLSISQLCDIGYSVSFNKLNKSIADLQLDDSTTITISSRKKIEILASTQQEAQNHPQSQIISYPIDHVQARLSLETQGYTALISKMEPKHIDEAMQDDNWVKAMQEELDQFQKNDVWNLI

SEQ ID NO: 157345 - protein, 190 aa, Glycine max
  Coding DNA Sequence Number=SeqID_65660
MVVDGVYPCLPVWDAATKKGFELYCKEQLPSRQMKSQIMWMNSQKASASSNDGSDITVSCNVVQVLQLSRKYHTGEASNAAMADGVEPLILDLVSKKSITSNEATSRDKDDHDVLIVYSTSSGTTILNYAQSTTIICDQNVITMQFSNLGVILSLNIQQAQLKMLGVVVAPAPASAPTPVSQPDSIEPPP

SEQ ID NO: 157346 - protein, 53 aa, Glycine max
  Coding DNA Sequence Number=SeqID_65661
MNENFLEFSLLVFGGTGPRTTFFPSCKKTPVLFQLVGLMNTHDEDTRQFFKNS

SEQ ID NO: 157347 - protein, 298 aa, Glycine max
  Coding DNA Sequence Number=SeqID_65662
  Pfam annotation: Domain name=Transposase_23; Domain location=33-103; Score=8.2; E_value=0.00015; Accession=PF03017.5; Description =TNP1ENSPM transposase
MASFIQLQSQMQSQGLAMPPKLLVGPSGNDPETGDSDRCGLYIEAYPALLVAMGRVYEGSTIVHNTPLFPGQVKVSVEEVTDADAPVPVPTDEVSLVGQALHTFLAWPTHLVKSLSQQVVVSPAKPPPKPDPEVDDPLYLMTLTIPELFLRPYQVRWDATEIAHGGQCLSISVLQLWILYLTETCMRVGNSDIYGFLEPQSIQRSGQSQFEFESYIKSWMQSSQRDVYLGAYLNGSDNYLKGIINSAIKGLDDAPQPKSKASARWIVIKYFNDPIPLEPERLKALRIQWAQFYLRVRD

SEQ ID NO: 157348 - protein, 30 aa, Glycine max
  Coding DNA Sequence Number=SeqID_65663
MGSAMTGWISQEKEGKMLVLEGISLGLELP

SEQ ID NO: 157349 - protein, 497 aa, Glycine max
  Coding DNA Sequence Number=SeqID_65664
  Gene Ontology: Mol. function=transmembrane receptor activity; Cellular component=intrinsic to membrane; Biological process=innate immune response
  Homolog annotation: Hit_ID=A7Q656; Match level="QueryCoverage=57%, HitCoverage=50%, E-value=2e-41, Identity=30%"; Hit description =Chromosome undetermined scaffold_55, whole genome shotgun sequence
  Pfam annotation: Domain name=TIR; Domain location=22-117; Score=50.9; E_value=4.5e-12; Accession=PF01582.11; Description=TIR domain
MAEQQIFSDFASSSNSSRKYGVFLSFRCEDTRKNFTSHLYEALMQKKIETYMDYQLEKGDEISPAIECKKKQAQIVIPAFYNIDPSHVRKQNGSYEQAFSKHEEEPRCNKWKAALTEVTNLAGWDSRNRTESELLKDIVGDVLRKLTPRYPSQLKGLTTLATALYVKLSHEFEGGCFLTNVREKSDKEKQPKHGYEDLSRSVISYCEGIPLALKALGASLRIRSKDIWESELRKLQMIPRKGREWVASILEACNFFAASGIEVLLDKSLITISGCNKIEMHDLIQAMDQEIGTDVVEGIILDLDTLTRDLGLSSDSLAKITNIESLHVHSKSLCELDLNGSLSLKEFSVISEEMMGCNNLNTELSLSFLQALPHKIANLSSLQMKLMSLPELPSSLKEMRAFNCTSLETDFTQRLVLQHMLQSHLHNLPDGEDYDSGYFIFSGDHVTDELYPSELGLKLFGSSSKEIFELEIITQISDNESQSRAIGNGVGGSNTEN

SEQ ID NO: 157350 - protein, 565 aa, Glycine max
  Coding DNA Sequence Number=SeqID_65665
  Gene Ontology: Mol. function=metalloendopeptidase activity; Cellular component=cell surface; Biological process=proteolysis
  Homolog annotation: Hit_ID=A7NY13; Match level="QueryCoverage=70%, HitCoverage=36%, E-value=0.0, Identity=80%"; Hit description =Chromosome chr6 scaffold_3, whole genome shotgun sequence
  Pfam annotation: Domain name=Peptidase_M16; Domain location=114-248; Score=135.3; E_value=1.7e-37; Accession=PF00675.11; Description =Insulinase (Peptidase family M16)
  Pfam annotation: Domain name=Peptidase_M16_C; Domain location=271 -455; Score=100.5; E_value=5.1e-27; Accession=PF05193.12; Description= Peptidase M16 inactive domain
  Pfam module annotation: Pfam domain module=Peptidase_M16::Peptidase _M16_C; Domain location=114-248::271-455
MGMKGAPVCLSVDDNVVLKSPNDRRLYRLIHLPNGLRALLVHDPEIYPEGPPKHAPNEDEVEEEEEDDEEDGEYDDDDDDDEDEEEEEEGEEEEEEEEEEEEEEEMDGVKGGGAVAAQSKKAAAAMCVGMGSFSDPDEAQGLAHFLEHMLFMGSDEFPDENEYDSYLSKHGGSSNAYTETEYTCYHFEVKREFLKGALKRFSQFFISPLVKMEAMEREVLAVDSEFNQVLQSDACRLQQLQCHTSAHNHPLNRFFWGNKKSLVDAMEKGINLREQILKLYKDYYHGGLMKLVIIGGESLDVLESWVVELFGAIKKGQANPVFTVEGPIWESGKVYRLEAVKDVHILDLSWTLPCLHQEYLKKPEDYLAHLLGHEGRGSLLSFLKSRGWATSLSAGVGEEGIYRSSIAYVFVMSIHLTDSGIEKIFDIIGFVYQYLKLLREDTPPEWIFKELQNIGNMDFRFAEEQPPDDYAAELAENLHFYPPEHVIYGDYVFKTWDEQLLKQVLGFFVPENMRVDVVSKSFLKSEGAFFFLPCLIGNCLLAFFLSCIIDWQRSKLLTNGYRYAR

SEQ ID NO: 157351 - protein, 71 aa, Glycine max
  Coding DNA Sequence Number=SeqID_65666
  Gene Ontology: Mol. function=RNA polymerase II transcription factor activity; Cellular component=nucleus; Biological process =transcription initiation
  Homolog annotation: Hit_ID=A7Q856; Match level="QueryCoverage=85%, HitCoverage=44%, E-value=1e-10, Identity=55%"; Hit description =Chromosome undetermined scaffold_62, whole genome shotgun sequence
  Pfam annotation: Domain name=TFIID_30kDa; Domain location=30-61; Score=21.9; E_value=2.2e-05; Accession=PF03540.4; Description =Transcription initiation factor TFIID 23-
MNQNPQSSDGRNDDDSALSDFLASLMDYTPTIPDELVEHYLAKSGFQCPDVRLWLLQKIGTLELNFVQGFL

SEQ ID NO: 157352 - protein, 417 aa, Glycine max
  Coding DNA Sequence Number=SeqID_65667
  Gene Ontology: Mol. function=sulfotransferase activity; Cellular component=cytoplasm; Biological process=estrogen metabolic process
  Homolog annotation: Hit_ID=Q8L5A7; Match level="QueryCoverage=70%, HitCoverage=88%, E-value=1e-105, Identity=56%"; Hit description =Steroid sulfotransferase-like protein
  Pfam annotation: Domain name=Sulfotransfer_1; Domain location=145 -387; Score=278.0; E_value=2e-80; Accession=PF00685.18; Description =Sulfotransferase domain
MLQREVSTKSTYAEAQSYNEDMKLTLNPTPTMAARLAMKCTLGHHEFPNPCSRNQKRSLAQWRTTTLDVNGEEESMRGYTEKKRARQEEVIEDDKISQQSTELILSLPREKGWRTPYVYLFQGFWCQPHEIQAIITFQKHFQAKDSDVLVATVPKSGTTWLKALTFATVSRHNFSSFNKNHPLLNFNPHDLVPFFEYTVYDKHDKVPDLSNMHEPRLFGTHVPFASLSKSIKESNCKVIYICRNPFDTFISSWFFANKIKPGSLPTLALDEAFEMYCKGVVGFGPFWTHMLGYWKESIEKPNKVLFLMYEDLKGDINFHLKRVAEFLGCPFTLEEENRGVIENIIKLCSFQKMKELEGEIGDWVNYLSPSMAQKLTKVMEDKLGGSGNGNNESFTMKEGNVDSGGWECVDNGRTEDL

SEQ ID NO: 157353 - protein, 95 aa, Glycine max
  Coding DNA Sequence Number=SeqID_65668
TQGANSAVRDTCRDTMGALAVQDGGGAVREAAVRGNGGAEQGGVGGGGSVHGQDGGVWRWRRRRGGGASGSVSKAVSEDLQAAQQSRIRAVLELY

SEQ ID NO: 157354 - protein, 174 aa, Glycine max
  Coding DNA Sequence Number=SeqID_65669
  Gene Ontology: Mol. function=catalytic activity; Biological process =cellular metabolic process
  Homolog annotation: Hit_ID=A9PGZ8; Match level="QueryCoverage=36%, HitCoverage=16%, E-value=2e-23, Identity=81%"; Hit description =Putative uncharacterized protein
LKTTTNLSQSEATEYSVITVGSSHCGKYHIRQEQDPINVFRYGAQAVQHSQTMIAPGNNGPTSGTANIDDADSGKAAKQALELMGKWEMIDVCDALELLSLVFESEEWFFHRLKVGRPIPIPNLGLQITQLGHVKDLAKAFIHVLGNEKANKEVFNISREKYVMFNGLARACAK

SEQ ID NO: 157355 - protein, 336 aa, Glycine max
  Coding DNA Sequence Number=SeqID_65670
  Gene Ontology: Mol. function=phosphoribosylaminoimidazolecarboxamide formyltransferase activity; Cellular component=integral to membrane; Biological process=purine nucleotide biosynthetic process
  Homolog annotation: Hit_ID=Q84XA4; Match level="QueryCoverage=90%, HitCoverage=50%, E-value=1e-142, Identity=84%"; Hit description =Aminoimidazolecarboximide ribonucleotide transformylase/inosine monophosphate cyclohydrolase
  Pfam annotation: Domain name=AICARFT_IMPCHas; Domain location=218 -336; Score=-74.0; E_value=4e-09; Accession=PF01808.9; Description =AICARFTIMPCHase bienzyme
  Pfam annotation: Domain name=MGS; Domain location=97-213; Score =176.5; E_value=7.1e-50; Accession=PF02142.13; Description=MGS-like domain
  Pfam module annotation: Pfam domain module=AICARFT_IMPCHas::MGS; Domain location=218-336::97-213
  Subcellular localization annotation: CTP_CleavageSite=64; ConfidenceScore=5.73e-01
MFVLGVSSSSFAAAAASAAATTTTSTHHLLCGTLHSASFLSTTHPFPTTSLRSSSLHFRCVPIRAMAEIDTISVSKSASSSAPGSKQALISLSDKKGLAFVGNGLQELGYSIVSTGGTASALESAGVAVTKVEQLTKFPEMLDGRVKTLHPNIHGGILARRDQKHHIEALSTHGIGTFDVVVVNLYPFYDKVTSAGGIEFEDGIENVDIGGPAMIRAAAKNHKDVLIVVDTEDYPALLEFLKGNQDDIKFRLKLAWKAFQHVASYDSAVSEWLWKQSVGDKFPPSLTVPLSLKSPLRYGENPHQKAAFYVDKSLSEVNAGGIATAIQHHGKVGITY

SEQ ID NO: 157356 - protein, 232 aa, Glycine max
  Coding DNA Sequence Number=SeqID_65671
MEYRMDTCTFRKLKPIRSLSNAFQDLIGPIISLSKLRVSYQSSEKSGLMMRVQFHHDPVLDIKIDIPLFSISKLLHKGLCLQKILLDLSENDFPIRSSGNVLRNVERLLAERSFYPVPKFTPRGWLLMNESSKATRYSVNLANNLHEENNDNANNEVERNNEDIKDHTQAQKEAQDPIQGIGGPITRSRAEKTQEALQEIVANMRTIQLYEGTQHLEAYMRGLLVTCIACLE

SEQ ID NO: 157357 - protein, 41 aa, Glycine max
  Coding DNA Sequence Number=SeqID_65672
MADQNGNMVDKIASSASNGSDIVLEACIKKTHACNEISILQ

SEQ ID NO: 157358 - protein, 486 aa, Glycine max
  Coding DNA Sequence Number=SeqID_65673
  Gene Ontology: Mol. function=metalloendopeptidase activity; Cellular component=extracellular space; Biological process=proteolysis
  Homolog annotation: Hit_ID=A7NY13; Match level="QueryCoverage=97%, HitCoverage=45%, E-value=1e-179, Identity=62%"; Hit description =Chromosome chr6 scaffold_3, whole genome shotgun sequence
  Pfam annotation: Domain name=Peptidase_M16_C; Domain location=222 -384; Score=11.3; E_value=0.0012; Accession=PF05193.12; Description =Peptidase M16 inactive domain
FQYEPWFGSRYVEEDIAQSFRELWRNPPEIDASLHLPSQNEFIPSDFSIRASDTCVDDFANSTSPRCLIDEALIKFWYKPDSTFKVPRANTYFRITMKGGYADVKSCVLSELFIHLLKDELNEITYQASIAKLETSVTYVGDMLELKVYGFNEKLPVLLSKFFSVSKSFMPTDDRFKVIKEDMKRALKNANMKPLSHSTYLRLQVLCESFYDADEKLHYLNDLFLDDLKAFIPGLLSQIYMEGLCHGNLSKEEAIGIAKIFKMNFPVNPLPIELRHAERVICLPSSANLVRDVNVKNKSEKNSVVELYFQIEQDFGLGTKEQLGYVVECSPRVTYRISGFCFCVQSSEYHPVYLQSRIENFLNGLEELLDGLDGDSFENYKSGLMAKLLEKDPSLTYESNRLWNQIVEKRYIFDLSKKEAEELKNISKHDVVEWYKTYLKPSSPKCRQLLIRLWGCNTDLKEAEALPKSVQSCHDCWGTIHILIMN

SEQ ID NO: 157359 - protein, 58 aa, Glycine max
  Coding DNA Sequence Number=SeqID_65674
MKEMKREKHVSYSSHDSCKSLSEELSDYLIISIQKFKKGRFGSVAEELAQRARLAKRG

SEQ ID NO: 157360 - protein, 123 aa, Glycine max
  Coding DNA Sequence Number=SeqID_65675
  Pfam annotation: Domain name=SWIM; Domain location=56-88; Score=33.4; E_value=8e-07; Accession=PF04434.8; Description=SWIM zinc finger
MNIYLISDRHPSIISAYNNPSYAYTKKMHWRHLGDIRANKPKTQSPLQTPRPPRRFRVMLQSQKCDCGEYQAKHLPCSHVMTVYKFVNVDPMNYVLTLFTLQHILHIYDTPLVYCHHESLCKI

SEQ ID NO: 157361 - protein, 116 aa, Glycine max
  Coding DNA Sequence Number=SeqID_65676
MVKIRKAESEVRNSGVDGFYKFLGCEYGKRSIYRLAKHRERKEDPEVAKFRKQGLKFLPEMEFLFKGIIATGFATYAPSEDSRQNEGFNIRTEETNDNIDDNTELEVNEPEINTTT

SEQ ID NO: 157362 - protein, 56 aa, Glycine max
  Coding DNA Sequence Number=SeqID_65677
MKKKKVEAASVSLSEAYALSDKLEESGRESAIHARAISSLSESFVSSRTQCARLAK

SEQ ID NO: 157363 - protein, 75 aa, Glycine max
  Coding DNA Sequence Number=SeqID_65678
MGRGMSVHQVDEESEGSPKKRKTKAYETWQKDVIVNVLSKKISLKFLHNRFDKMWKPNGVMEGIDLDNKYFLIRL

SEQ ID NO: 157364 - protein, 173 aa, Glycine max
  Coding DNA Sequence Number=SeqID_65679
  Gene Ontology: Mol. function=protein binding; Cellular component=cis -Golgi network; Biological process=ER to Golgi vesicle-mediated transport
  Homolog annotation: Hit_ID=Q9LZ97; Match level="QueryCoverage=75%, HitCoverage=92%, E-value=1e-62, Identity=87%"; Hit description =Putative uncharacterized protein T1E22_40
  Pfam annotation: Domain name=Sedlin_N; Domain location=9-133; Score= -34.0; E_value=0.0017; Accession=PF04628.4; Description=Sedlin, N -terminal conserved region
  Pfam annotation: Domain name=Sybindin; Domain location=4-134; Score =253.5; E_value=4.5e-73; Accession=PF04099.3; Description=Sybindin -like family
  Pfam module annotation: Pfam domain module=Sedlin_N::Sybindin; Domain location=9-133::4-134
MAAIYSLYIINKSGGLIYYKDYGSAGRMDTNDSLRVASLWHSMHAISQQLSPVSGCLGIELLQADTFDLHCFQSLTGTKFFAVSEPGAQHMESLLKFVYELYTDYVLKNPFYEMEMPIRCELFDINLTQALVAMFHVTLTQLITGNSNQFTVLNDPNLVMETTTVALPVQKLK

SEQ ID NO: 157365 - protein, 121 aa, Glycine max
  Coding DNA Sequence Number=SeqID_65680
MDTSSRGFAFAVKGCYDDGNNDRLLQTKSSSSMTTTMINFSYNDDFFFFNDNNTHSELGFECERERWGATWQHNPLIPLCLLFSDGGLFIFFFEGDDPHPNSNLIWMRKRKMGCGMVYCVV

SEQ ID NO: 157366 - protein, 139 aa, Glycine max
  Coding DNA Sequence Number=SeqID_65681
MRSFSKLIYKRILEEFEARLSQARSDAASSVGESQFTPLDLAEEQRLRSRCWVVVVGPKHKGYLYGTGDLGHTYKCVNDIFMQHTQGSSICAQNAAEINQLREELRQSKEEMRVFQPVVLQFLPPGAQNIIHQHQQPHQ

SEQ ID NO: 157367 - protein, 114 aa, Glycine max
  Coding DNA Sequence Number=SeqID_65682
  Gene Ontology: Mol. function=DNA binding; Cellular component=nucleus; Biological process=regulation of transcription
  Homolog annotation: Hit_ID=Q84PP4; Match level="QueryCoverage=39%, HitCoverage=13%, E-value=3e-20, Identity=93%"; Hit description =Transcription factor MYB102
  Pfam annotation: Domain name=Myb_DNA-binding; Domain location=14-61; Score=28.9; E_value=1.8e-05; Accession=PF00249.22; Description=Myb -like DNA-binding domain
MGRSPCCDENGLNKGPWTPEEDQKLVQHIQKHGHGSWRALPKQAGELLKRASVVDFTDESQPPLADPTRTIEVDNGFKKSKLWKPPRYKDTRVDEVFAAKKSKFKIASGKENAK

SEQ ID NO: 157368 - protein, 84 aa, Glycine max
  Coding DNA Sequence Number=SeqID_65683
MGFGSSEHRGREVEKGSKDVGEVGLGLGPTKCYGDNVVGPNGFIGGVKGAKPLSDFDRESEGEVGALDGVTVRESEGDKGLGFG

SEQ ID NO: 157369 - protein, 161 aa, Glycine max
  Coding DNA Sequence Number=SeqID_65684
MMNEEDESSFRCHSSETAASGLEGIIVGEGLCGDLGASFYVLGDAYGNVFMDEDGEDKVEDDDNDNKEDEESIEYKVEEDYDFDSIRCGRSGGFYAEDAISINHLVNIRKFDIHAMTTRDVAQLDFCDLKIAYQFYCWYAKLVGFFVRMDHIVRNKFREIV

SEQ ID NO: 157370 - protein, 292 aa, Glycine max
  Coding DNA Sequence Number=SeqID_65685
  Homolog annotation: Hit_ID=Q5XM22; Match level="QueryCoverage=34%, HitCoverage=72%, E-value=9e-26, Identity=49%"; Hit description =Resistance-like protein HAAS-2
LLKVTPDEATAETRQAARMYLLHLVGCTLLANKSATHVHVVHLQAFRDLGQAGAFSWGATALVHLYDQLNEASQAPTRQMVGYISLLQCWNYEHFPSVHRCVVDDGYAEASPRAYRWHTVTNVCWMPYAEHRGVRGYDLISSYTGQVRWGTDIDDRWVYFLDHVVPTGELCVVLGQVAPDYMEWFFQILHPFVTLTEDTAEPRPAPPPPPTHDDEFVEPPVPEVPVASDLPTHFVVDCTGCVRIAEHLERAINLRMVTKGTDLYDIMDICQRIARGNDPDDSLMPRQRHRIY

SEQ ID NO: 157371 - protein, 54 aa, Glycine max
  Coding DNA Sequence Number=SeqID_65686
MKFFEKRAPTIAQAMTPKKLLTKRARKDAAREGSSAAPQVEIEFDGHHFRSEEH

SEQ ID NO: 157372 - protein, 118 aa, Glycine max
  Coding DNA Sequence Number=SeqID_65687
MACDSGYRAIIIDTDCAEVIKLVEDPRYHEAQFVDLASEIVKTKETFTSCSIVHVLCQANTMVDCFPKDDLTNDRNVTFYDSLPNFAGTSMRVDANSGVTSSDKPYDKVTNIKVTSPK

SEQ ID NO: 157373 - protein, 49 aa, Glycine max
  Coding DNA Sequence Number=SeqID_65688
MALSNTTRGGWHHGVGCDTPMEERDVEEIEGEKEKKMALSLKITSNDNV

SEQ ID NO: 157374 - protein, 114 aa, Glycine max
  Coding DNA Sequence Number=SeqID_65689
MDGILNLLQATMIPTHDALLYYNGRWNMPRQHDFVGYSFTGKNPKRFDIPSGFTIDGLKDVIKQVAPQGIPHYAIHESQKIRRLFFRQPGHSEYSDKVIKFEIIKLKTDDDVLK

SEQ ID NO: 157375 - protein, 299 aa, Glycine max
  Coding DNA Sequence Number=SeqID_65690
  Gene Ontology: Mol. function=phosphoinositide phospholipase C activity; Biological process=intracellular signaling cascade
  Homolog annotation: Hit_ID=A7UQU7; Match level="QueryCoverage=88%, HitCoverage=55%, E-value=8e-30, Identity=28%"; Hit description=IMP dehydrogenase/GMP reductase, putative
  Pfam annotation: Domain name=DUF1723; Domain location=61-110; Score =55.2; E_value=2.3e-13; Accession=PF08330.1; Description=Protein of unknown function (DUF1723)
MAVEELNEEQQEAPVEEVEYPELKLVSHGRKMTKFRRPALEIEGLVAASRLIPLIACSLDMSDQGLMYAFVERWHKETNSFHLPVGKVTITLDDVASLLHLPIVGAFHNFEQLHVDNVVEMLVELLEVSAAETKIDACHWIIAARAYFLHLLGCTLFANKSVTHVHVVFLDALHDLTQSETYAWGTAVLVHMYDNLNEASKSMVRQLAGHITLLHAFLVSTYHRHLDRLTPDVMCWISYGDHRSFREFEVITSFFDHLRWGPLTVIHRPERVVRQFGYIQTIPPHPTVPSVFVEEVDDR

SEQ ID NO: 157376 - protein, 201 aa, Glycine max
  Coding DNA Sequence Number=SeqID_65691
  Gene Ontology: Mol. function=metal ion binding; Biological process =metal ion transport
  Homolog annotation: Hit_ID=A7R6E7; Match level="QueryCoverage=50%, HitCoverage=61%, E-value=2e-28, Identity=63%"; Hit description =Chromosome undetermined scaffold_1259, whole genome shotgun sequence
  Pfam annotation: Domain name=HMA; Domain location=73-148; Score=29.5; E_value=1.2e-05; Accession=PF00403.17; Description=Heavy-metal -associated domain
MARFSTEAEYKSLALASTEVSLDINFSDLRPLVYMKSPPFKPDMSPPHHEKKDKGNKEEAKDKKKKEEPPPEIVLKVDMHCEACARKVAKALKGFQETNDDHTLESKTGVEEVSADSRTNKVVVKGKTTDPIKVCERLQKKSGKKLELISPLPKPQRRKKNHPKKNHQKWRKKYEPFSLIDLANAYIILHLVGGYQQMSDP

SEQ ID NO: 157377 - protein, 70 aa, Glycine max
  Coding DNA Sequence Number=SeqID_65692
MVQHLVSWLLGFVGTQQLNFKVWRGEDIKTGGVTSKKRASRAKPATRDPTEARAKPAARALSSRSNKSTR

SEQ ID NO: 157378 - protein, 134 aa, Glycine max
  Coding DNA Sequence Number=SeqID_65693
MNLRVGFMKLAMRHIALGLAYASEMKNEFYMESLKDFLDELNMKGEKGLDGAVVAVYDGDDGFRWRKEKKGRKGKVRFGAYHDGGATSPSNDPLQGIGGPMIRSKTKKMKQALHGRILKIKDKEDQCELRVAPN

SEQ ID NO: 157379 - protein, 130 aa, Glycine max
  Coding DNA Sequence Number=SeqID_65694
MHHAPRQLYILSKTIPPLSIIKLSQTQSSESRKHALAEVKLRFCPSSGGVGEEHVRRNNNIDIDMARCFGLGSVLVLAALAASMVVLPLMLPPLPPPPLVLLFFPVGIMAALMLLAFSPSDQNGVVYAST

SEQ ID NO: 157380 - protein, 308 aa, Glycine max
  Coding DNA Sequence Number=SeqID_65695
  Gene Ontology: Mol. function=nucleic acid binding; Cellular component= intracellular
  Homolog annotation: Hit_ID=Q06HM7; Match level="QueryCoverage=45%, HitCoverage=37%, E-value=1e-17, Identity=35%"; Hit description =Transcription factor IIIA
  Pfam annotation: Domain name=zf-C2H2; Domain location=159-183; Score =20.7; E_value=0.0054; Accession=PF00096.17; Description=Zinc finger, C2H2 type
  Pfam annotation: Domain name=zf-C2H2; Domain location=188-213; Score =5.2; E_value=3.1; Accession=PF00096.17; Description=Zinc finger, C2H2 type
  Pfam module annotation: Pfam domain module=zf-C2H2::zf-C2H2; Domain location=159-183::188-213
  Subcellular localization annotation: CTP_CleavageSite=62; ConfidenceScore=5.32e-01
MGLLLTYMVLNFSTSTRCGTSPHTPTRLTLHSALGKSIYWVPQLKLNCDASVNNNGATSCVRVMRDSHGKVLFSFTTNLDELCALFIGSNIAEEAENERAKRVLEEETVKSSNIIGTPEKELQNARGSMFGLDGSVSGRETSCEAPSRMPQSHKIERPYVCSAGNCQACYRRKDHLTCHLLQHQGKVFKCPVESCNTEFSLQSNMKGRVEETHEDSSTSTSDKSYKQHACPETGCGKRRIFEKADEEFRSRPRGGRKRKCPTVEMLVRKRVNPLSQLESWWLCMQDSDQGELSIAMFELAFEGDRYAS

SEQ ID NO: 157381 - protein, 75 aa, Glycine max
  Coding DNA Sequence Number=SeqID_65696
MLLNCAAELFNMCRKCLCIVGYGKGVDGDPVLRGMRIRTTWECVSSVEGGQLGMVGSCLICGSGRVDLRHRPNAT

SEQ ID NO: 157382 - protein, 52 aa, Glycine max
  Coding DNA Sequence Number=SeqID_65697
MVANDDNTSTGNQRVPPLGQVANLFSMPTMGTPKNGSPEMEDLQRKNTALKE

SEQ ID NO: 157383 - protein, 57 aa, Glycine max
  Coding DNA Sequence Number=SeqID_65698
MTKSKDKDLLEGLGGPITRARARKVKEALQQVLSILFEYKPKFQGEKSKVVNDIKLF

SEQ ID NO: 157384 - protein, 97 aa, Glycine max
  Coding DNA Sequence Number=SeqID_65699
  Gene Ontology: Mol. function=metalloendopeptidase activity; Biological process=proteolysis
  Homolog annotation: Hit_ID=A7PN42; Match level="QueryCoverage=43%, HitCoverage=8%, E-value=2e-10, Identity=71%"; Hit description =Chromosome chr14 scaffold_21, whole genome shotgun sequence
MTTLPNGLHIATESTLGAHTAIVSIWIDVGSQFETEETNGTAGTFPVEQGDLHKRWKLVTYLVDSVGIAQFSSRDWLVVGSFRVDGLVVASVAICRC

SEQ ID NO: 157385 - protein, 28 aa, Glycine max
  Coding DNA Sequence Number=SeqID_65700
MDIVEDEKNIGFVNENESESERERCYKY

SEQ ID NO: 157386 - protein, 101 aa, Glycine max
  Coding DNA Sequence Number=SeqID_65701
  Homolog annotation: Hit_ID=A5BJ81; Match level="QueryCoverage=68%, HitCoverage=40%, E-value=3e-24, Identity=75%"; Hit description =Putative uncharacterized protein
MDHEFYWLETPSPTRILNDLKHAFWPFQHDHTKTLFLRAATAANCVDRSDFVGESGSQIALAKAAQHRLDRGVWTSVRFGDMRRSLSDSDLVPLPLDVKKY

SEQ ID NO: 157387 - protein, 104 aa, Glycine max
  Coding DNA Sequence Number=SeqID_65702
MDFVASKHICRDREMLDTLKTDGEFDNFKLGNGGKIKVEGIGSMRMKLYDGAIRSFSNVKFVSSIVVKKKEKKSNIDRNIALPGSNSGWLGAFLVIDANPIPDV

SEQ ID NO: 157388 - protein, 105 aa, Glycine max
  Coding DNA Sequence Number=SeqID_65703
MPQPHGINVDLKEHSNRVSLSPMPKLRRIRLGLTFMIQACARVVVPVGGCIAVRADIGCVLRADCRGCRDWVRLGAVGCGRVAVWTLGAGEGAAGLLLVGELRFD

SEQ ID NO: 157389 - protein, 54 aa, Glycine max
  Coding DNA Sequence Number=SeqID_65704
MELATKYMTIRKEKKLVGGGAPVDDLEVPPIVDDDDEGRGNAIKEDEDHLEDDR

SEQ ID NO: 157390 - protein, 102 aa, Glycine max
  Coding DNA Sequence Number=SeqID_65705
MGHEDEEGDDDNNNNNDDDDDGDDDDNGGHHIDGLSIIDFITGDQLLVDANDVVIAQHARAHIMMIIGGYLISDTSALDRVVLVKPDQTKIGGCLLLLQSWA

SEQ ID NO: 157391 - protein, 1086 aa, Glycine max
  Coding DNA Sequence Number=SeqID_65706
  Gene Ontology: Mol. function=nucleic acid binding; Cellular component= nucleus; Biological process=response to DNA damage stimulus
  Homolog annotation: Hit_ID=A7Q5G6; Match level="QueryCoverage=98%, HitCoverage=80%, E-value=0.0, Identity=63%"; Hit description =Chromosome undetermined scaffold_53, whole genome shotgun sequence
  Pfam annotation: Domain name=Helicase_C; Domain location=917-994; Score=41.0; E_value=4.2e-09; Accession=PF00271.22; Description =Helicase conserved C-terminal domain
  Pfam annotation: Domain name=SNF2_N; Domain location=31-704; Score= -16.4; E_value=7.9e-08; Accession=PF00176.14; Description=SNF2 family N-terminal domain
  Pfam annotation: Domain name=zf-CW; Domain location=274-320; Score =60.8; E_value=4.6e-15; Accession=PF07496.6; Description=CW-type Zinc Finger
  Pfam module annotation: Pfam domain module=Helicase_C::SNF2_N::zf-CW; Domain location=917-994::31-704::274-320
MDLTRVSATCHHLRSLAASVMPYTKLNLFPHQRTAVEWMLHRERNAELLPHPLFVALSTEDGFSFHVNTVTGDIVTGEAPTVKDFRGGMFCDEPGLGKTVTALSLIMKTRGTLADPPDGAQVVWCQHNGNQKCGYYEVSVSGNHITGCTTLGKRDVCQDTSRTNDNHDYSSKRARLIDPDQQITKLHDSCSREENKSPVDACFKESMHSNQFTGSLSRIKKNLHFTFEDEAMISKEREIGEGLIKAKHALDVTSHVSQNKSPGKPKGDCFEYNDTWIQCDACHKWRKLVDNSMANSSAAWFCSMNTDPLYQSCSVPEQHFHNICKITHLPGFHLKGTCGGEKQNVSFFTSVLKEHYSLINSQTKKALTWLAKISTDKLAGMETNGIRGPILNICTASNRHFHKIFQAFGLLKRVEKGVCKWYYPQHLNNLTFDVAALGMALREPLDFVRLYLSRATLVVVPANLVDHWKTQIEKHVRPGQLRVYVWTDHQKPSVHCLAWDYDVVITTFSRLSAEWGPRKRSALIQVHWFRIILDEGHTLGSSLNLTNKLQMAISLIASNRWILTGTPTPNTPNSQLPHLQPLLRFLHEESYGLNQKSWEAGVLRPFEAEMEEGRSRLLHLLQKCMISARKIDLQSIPPCTKKVVYLDFNEEHARSYNELVITVRRNILMADWNDPSHIESLLNPKQWKFRSATLKNVRLSCCVAGHIKVTHAGEDIQETMDMLVQSGLDPTSGEYTSVRYNLLYGGHCVRCKEWCRLPLITPCRHLLCLDCVSIDNTKCTYPGCSKLYEMQSREARPENPKPKWPVPKDLIELQPSYKQAWLMENSDNWDPDWQSTSSSKVSYLVQRLKALRGTNEETYFNTENSNDDLHIENSLHRSDDKSSIQTCSMSSTKTNLNPEKVLIFSQFLEHIHAIEQQLTIAGIKYTGMYSPMHSSNKKKSLAMFQHDSNCMALLMDGSAALGLDLSFVTHVFLMEPIWDRSMEEQVISRAHRMGASRPIYVETLAMRGTIEEQMLDFLQDADNFRRSPIKDATESVDDSGGRGYRSLHDFAESSYLLKLRSVYTNLESPKGSMSEHFKPVETDGML

SEQ ID NO: 157392 - protein, 147 aa, Glycine max
  Coding DNA Sequence Number=SeqID_65707
MGAGCPSKNVGCTKAEAFVGGFARGTQQILKFPKMLFMLFCKLVPLTGAEEIFRGTAEEPSSVGLNGRRFFRGVPRKKLHTLQSHTSSSLHFSNSDHAIGVGLIAFSVERTNKAKGKDKEVAEKGSAGKRKGAFDDNKIGGGRKRNK

SEQ ID NO: 157393 - protein, 318 aa, Glycine max
  Coding DNA Sequence Number=SeqID_65708
  Homolog annotation: Hit_ID=A7UQU7; Match level="QueryCoverage=46%, HitCoverage=26%, E-value=7e-19, Identity=36%"; Hit description=IMP dehydrogenase/GMP reductase, putative
  Pfam annotation: Domain name=DUF1723; Domain location=183-232; Score =57.1; E_value=6e-14; Accession=PF08330.1; Description=Protein of unknown function (DUF1723)
MEPAEEGVLLRAPAEERAGMEKPCHHAYLNSSGSAIQETQDYHCSRLDVAEDVPWRRRPTASARRQRVTQRVEDVPQLAEDVPHASDGSPERTAAADDAEIDRLASDGTADDDEGFPGGPRDPSILIGFVDHVAHNIWSGQRLDLKLVSHGRKVDKFGRPTAEIEGMIAATGLDPLIRCSVITTDLGLVSAFVERWLRETSSFHLPVGEVTITLDDVSSLLHIPITGALHSFEPLATSDVVALLTELLEVTPDEAIAETCQAGGPHAVGCCSSDIPTSFGLVALFSLTECNPCARCAPAGIRDLASRAFSWGAADWST

SEQ ID NO: 157394 - protein, 239 aa, Glycine max
  Coding DNA Sequence Number=SeqID_65709
GFVRSNGGMMLLSEVCPIRESSNDDLSHCHNGSNTTSDHVSSVPAGDVVAANGMTCHDVDVASAKSSSKCYSWVHEEVGSYANSFLTYESIIIFLKSVECCHVDRLDGMIIKSCLVSEHVFICASLGEIHFMYMYSTLLLNLHLIVPFDKFEVDAPCRVSCGSFETPPDGTISVRDLLGFIVRAALVWDFRPPTCEVVATMHFLAAARSKRPSTTSSTQGELLVSEQGTPSSSSSSYYY

SEQ ID NO: 157395 - protein, 294 aa, Glycine max
  Coding DNA Sequence Number=SeqID_65710
  Homolog annotation: Hit_ID=Q2HW86; Match level="QueryCoverage=93%, HitCoverage=42%, E-value=2e-84, Identity=61%"; Hit description =Putative uncharacterized protein
MTAAGGGGQQSEPALVIRQKNLLKTRKKSQVKQEENTLQDFYGNWSPSAAPAKQFQNQLAPSVIQSSPSSIFGQPKQIQGAETLYQNIINPYVTSSVYGNLTNTYPAMPMLSQTQPALSGYEVSPGIVNRVNNSVDSVKPQIMTPQEKIEKLRRRQQMQAMIAIQKQRQQLGHQVPSKSSTQKCPPEIQSHLSDGTDEDLRTFPALDPPIEQDDSNTMSVAVGNDFVEDTVLYGLQHIISKLDIKIRLCIRDSLFRLAQSATQRHYASDTSSTNKSSREELEVAAREESNSQNR

SEQ ID NO: 157396 - protein, 35 aa, Glycine max
  Coding DNA Sequence Number=SeqID_65711
MAILKVQKMGNGSVDDEGSGAAFIAKAEQTEEHKD

SEQ ID NO: 157397 - protein, 113 aa, Glycine max
  Coding DNA Sequence Number=SeqID_65712
MRDIKCREIERKKRKSRRVLRRKTHKQWLPRRKREREVRPPRTVPEKGERRLKSEERTRTVPKNEVGSAVLRSSPLSCLRRDKGSGVVEEGSRVKERRDRRGNNVFPILSGFF

SEQ ID NO: 157398 - protein, 137 aa, Glycine max
  Coding DNA Sequence Number=SeqID_65713
MYQYPFAGHHTDTSETSHSFSGVAEIQPHFSWPTMTPSQQHDAPIPTPNAPFAPQWNRLSKQKRGDNAAAEEILIIMREDGIDHVAHLHDITDTIMTDFDGLEDGLGLEGLWVRVWIKGLWVRFRGFGLRVYGLGLE

SEQ ID NO: 157399 - protein, 249 aa, Glycine max
  Coding DNA Sequence Number=SeqID_65714
DDLVPYVEKLAILSQEQERITEPVAHGPASERRFPPQQFHMLQSSVETRGFDRRREIVQAEDFSQHMEQHGHGMYYTPPTFAQYHSQMYQYPFEGHDTDMSASEHSFGGVAETQPNFSWPTMTPSQQHDAPMATSNAPLGQQWDVPGAIPAMGDLLGVDLRHEFSAEAEEQGRRQRTRRNPDRQARRVMGLCYEFGLGLWVRVRVRVYELILGRRVYELVVGGLRVRGRVCEGLRVRGRVYEVGLVDGV

SEQ ID NO: 157400 - protein, 69 aa, Glycine max
  Coding DNA Sequence Number=SeqID_65715
MLSSATPNPPPPSSQDKQGNTKAKFDDLSLQFVVEQTKNKIFKEEKNSVEDKLTSTNEEVANLKKIVAR

SEQ ID NO: 157401 - protein, 109 aa, Glycine max
  Coding DNA Sequence Number=SeqID_65716
MQSAREAHPVRRLDVEHLSGDTDSPSGGSGTPFSLNSSTCIPTIRPLRQSCMDMDLGSMISSQITQIAQSNFSQLSFPTLITALYDAKGVSSNTLTFEFLSPIINLAYI

SEQ ID NO: 157402 - protein, 151 aa, Glycine max
  Coding DNA Sequence Number=SeqID_65717
MGYHSPLKDYRCLQKGVQHLSVEPDELPLHFALLGRAVFWVIDICIKFIHKCHINVFLRQSGELPVPVPPPKTCHTVCKPTPFPYGFHPLRSTGGSSTFLRGHLQKERQQELVLSTTLAKARRGLARGYALSPNIANKRTKRVLGLARLAC

SEQ ID NO: 157403 - protein, 70 aa, Glycine max
  Coding DNA Sequence Number=SeqID_65718
MKEIFAITAIHNQQFKLNGALYDCNHSSKEIPFPEEFLKVLILSYALLPSERSIELELEKAGVKGGINHQ

SEQ ID NO: 157404 - protein, 248 aa, Glycine max
  Coding DNA Sequence Number=SeqID_65719
MDHEDPYTHFPTFMELCSTMGAFDEDVEVVYLRAFPFSLAGLSTQNMLLRHFHKDMTNLSMRHGRDSNLCCEGTMMSKSPKEAIVIIDSIVASDYQSHHDRAPTQRKAIMELDTQNAILVIIKMATVQHLEIDNKKRKPIICRTKPDLNKTFKEANKAIEVAQVQISLMARDHKISVPLTLLLQVLLTTLMEDNDEKKNKEGVEKENKKNDEVLTSEKVEEKVPEDRPIFQEKDEDMADPVDYFIGGD

SEQ ID NO: 157405 - protein, 70 aa, Glycine max
  Coding DNA Sequence Number=SeqID_65720
MDSSKRETTLTARSPNPIDGVQAGGDVDGVVAATAKVVLFQHVVWLDVEESGDGGLMGAKEGRVRQERHC

SEQ ID NO: 157406 - protein, 198 aa, Glycine max
  Coding DNA Sequence Number=SeqID_65721
GLRTEGTPKMFIDPNNANTATLGEVAETLQYMVSPQGRNTWTVDDLVPYVEKLAILSQEQERIIEPTVQAEDFSQQMEQRGHGMYYTPSTFSQYPSQMYQYPFEGHDTDMSASEHSFGGVAETHPHFSWPTMTHSQQHDAPMATPNAPLASQWNRLSNKGGDSAQEEIQIVKPEGGIDHVVHPHAITDTIMTDFDVSI

SEQ ID NO: 157407 - protein, 327 aa, Glycine max
  Coding DNA Sequence Number=SeqID_65722
  Gene Ontology: Mol. function=hydrolase activity; Cellular component =soluble fraction; Biological process=metabolic process
  Homolog annotation: Hit_ID=A7PWY7; Match level="QueryCoverage=99%, HitCoverage=99%, E-value=1e-123, Identity=65%"; Hit description =Chromosome chr12 scaffold_36, whole genome shotgun sequence
  Pfam annotation: Domain name=Abhydrolase_1; Domain location=66-320; Score=59.2; E_value=1.4e-14; Accession=PF00561.11; Description =alphabeta hydrolase fold
MEKIQHSEVEVKGLKLHVAEIGSGHFLSAYWNTLQNSSKAVVFLHGFPEIWYTWRHQMIAVANAGYRAIAFDFRGYGLSEQPAEPEKETMFDLVHEIVGLLDALSISKAFLVGKDFGAIPGHLTTAVHPERVAGIITLGIPFMLPGPSAVESHLLLPKGFYITRWREPGRAEADFGRFPVKSVIRNIYILFSRSEVPIAADDQEIMDLFDPSTALPPWFSEEDLATYASLYEKSGFKYALQVPYRSINVDAGLSDVKVTIPSLLIMGEKDYVFKFPGMEDYIRSGAVKNFVPDLEIVYIPEGSHFVHEQMPEKVNQFIIEFLDKQNI

SEQ ID NO: 157408 - protein, 37 aa, Glycine max
  Coding DNA Sequence Number=SeqID_65723
MGSGNREKGGGVGLKVKGEGKIFWVCSIKGPKDKVRT

SEQ ID NO: 157409 - protein, 378 aa, Glycine max
  Coding DNA Sequence Number=SeqID_65724
  Gene Ontology: Mol. function=catalytic activity; Cellular component =plasma membrane; Biological process=regulation of abscisic acid mediated signaling
  Homolog annotation: Hit_ID=A7PWY6; Match level="QueryCoverage=100%, HitCoverage=100%, E-value=1e-155, Identity=67%"; Hit description =Chromosome chr12 scaffold_36, whole genome shotgun sequence
  Pfam annotation: Domain name=LANC_like; Domain location=60-378; Score= 368.6; E_value=1e-107; Accession=PF05147.4; Description=Lanthionine synthetase C-like protein
MADRFFPNPMPEFVPETTPSTPQEEEEALTVGDSLPKLLAMPHAPLLERLKRAALDLKETVRDFTLYCGVLGTAFLLFKSYRVTGNGNDLSLCSEIVKACDAASARSRDVTFICGRAGVCSLGAVAAKHAGDDESLKYYLAQFKKIKLSKDLPDELLYGRAVVVDEVIKNGRALGRKGRCPLMFEWYGEKYWGAAHGLAGIMHVLMDMELKPDELEDVRGTLKYMISNRFRSGNYPVSEDDRKSDALVHWCHGAPGMALTLVKAAKVFGDKEFLDAAIEAAEVVWNRGLLKKVGICHGISGNAYVFLSLYQLTGDVKYLYRAKAFACFLLDRAHKLISRGEMHGGDRPYSMFEGLGGMAYLFLDMSDPSLSKFPAYEL

SEQ ID NO: 157410 - protein, 122 aa, Glycine max
  Coding DNA Sequence Number=SeqID_65725
MVVGNTIIEKPRDQWDGEEKKLVQYNLKAKNIITSALGMDEYFRVSDCKSAKDTWDTLQLQEHEMELMRLNQHEEKDKKKKGIALKASSSIQEGSDKEDSNEIDDDDDLSLFVKRFNKFLKN

SEQ ID NO: 157411 - protein, 278 aa, Glycine max
  Coding DNA Sequence Number=SeqID_65726
  Homolog annotation: Hit_ID=A5AT31; Match level="QueryCoverage=29%, HitCoverage=10%, E-value=1e-10, Identity=41%"; Hit description =Putative uncharacterized protein
MAPQGEDPLNLKPNFDATTMMLMTDGVDQPYLASTENSSFGISMLAKKTARCKPNSAKQNKSSQSESNTNKPHQEGRKKTHQKDKCGPNKGKGSKFSTFQKDIHESSSPMEKESNMFIHEVPYLECLWCREESFSNLIKDLLKMYQLDFIAILEPCISGPNADKVINKIGLDGCFRVDANGFLGGNWCLWRTSGTNISVMGSFPYHDQNIEALTVTLKMWNNDTFGNIFQKKEKILVRLEEVNKEIFINPNNNLSGRTMGIETQDPSINPFSTDAKGT

SEQ ID NO: 157412 - protein, 194 aa, Glycine max
  Coding DNA Sequence Number=SeqID_65727
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
  Pfam annotation: Domain name=Transposase_23; Domain location=52-122; Score=6.1; E_value=0.00026; Accession=PF03017.5; Description =TNP1ENSPM transposase
MMESFSQMQSQFQSQMQSQGIALPPEPEVGPSGPRVSTKESCVAPSGNNPGMGDSDKCGLYIEENPSRLVALGRLYEGSTTVHNIPLLHGQVKVGVEEVKDTEALVPVPTDEVTLVGQALNTFLAWPTHLVKRLSEQSRPAGMQAWHWPSFYNVVTGKTLALPNLIALQHIPLSPAGVIAKRPAPIALPNSCAA

SEQ ID NO: 157413 - protein, 101 aa, Glycine max
  Coding DNA Sequence Number=SeqID_65728
MVVYQLCGSDNVCSEELVYMKIINFSLTCPLLGLVLFVLGGSSGTHDQVPEKGDVTADQVRREPHGSIVATAGHRAIAQSNNLEIFVGLRACDMQAPKESK

SEQ ID NO: 157414 - protein, 71 aa, Glycine max
  Coding DNA Sequence Number=SeqID_65729
MGCLVLAFLLVQVAFMVVVRLVVVNNSALALLITVIGGVYTSLIFLGLFGFFPVGTRLFPFRQLESEQGQG

SEQ ID NO: 157415 - protein, 177 aa, Glycine max
  Coding DNA Sequence Number=SeqID_65730
  Homolog annotation: Hit_ID=A2Q1K2; Match level="QueryCoverage=43%, HitCoverage=58%, E-value=5e-10, Identity=41%"; Hit description =SMAD/FHA
MAAFASSTSITDHIDAAIVKLTFDQFHFIATQNSMSTKLDKILQRLTLLEIHYQFSNVLLPSSIPSFEKPVAGVVPQSNTEDRAAKFESSFMEESLNSVSNGSKFTLGSDQKPVFRRGYGFGNHDCTVFHRHMPFKLDHSDSEDTNVVSFEVMKENPFWVYDREALRLFRKLGKGHL

SEQ ID NO: 157416 - protein, 101 aa, Glycine max
  Coding DNA Sequence Number=SeqID_65731
MVSKGECSWGIKGKSQDGGKQCEDWKMVLGELRGSDESGTGGGKESSFNGKSSYFRNLNSRWKYKDYHPQSKTNGYGKGISKGIYGSFILRDYEGKRCDNK

SEQ ID NO: 157417 - protein, 136 aa, Glycine max
  Coding DNA Sequence Number=SeqID_65732
  Homolog annotation: Hit_ID=A7PJ22; Match level="QueryCoverage=61%, HitCoverage=37%, E-value=1e-18, Identity=61%"; Hit description =Chromosome chr12 scaffold_18, whole genome shotgun sequence
MEFSTLQEDDSPWERGNVLSNLALYVFTLHIPFSFGGLSVVALFNGQPVVDPQTEALSLLTIQILELSGALLLLKYTAKPQYKFSNFFKKNKLLSNRNWILSWALGFGFLVLLIFLTYLLADRLFDSQVGLHVFFQ

SEQ ID NO: 157418 - protein, 91 aa, Glycine max
  Coding DNA Sequence Number=SeqID_65733
  Homolog annotation: Hit_ID=A7PWY4; Match level="QueryCoverage=63%, HitCoverage=25%, E-value=1e-07, Identity=47%"; Hit description =Chromosome chr12 scaffold_36, whole genome shotgun sequence
MAVCAANKQGLSLLLAMILKALGPHQYYDSDDEYAPDRVPLLKNAPPHYVVDPGYAHGNDTWRRQVPWKVGEVVLSDASWLRKRTCMLEMD

SEQ ID NO: 157419 - protein, 48 aa, Glycine max
  Coding DNA Sequence Number=SeqID_65734
MKGFRIRAFSVFPLLNPSPLQRGRNRSAAIAEAIEALDMFAISGFYQV

SEQ ID NO: 157420 - protein, 228 aa, Glycine max
  Coding DNA Sequence Number=SeqID_65735
MVRTRGLGHALSRVIGRDRQDEHDAVDVPQRRRPTALARRRRVHIMVDEGVPQVTEDVPHMAEDFPQVTEDVPHMANDVAQMSEDAPQMTVDVDGTVVEDLGRDGAEESHVDEGFPGGPREPSVLISFAEHVVHDIWNGHECPELKLVSHGRKVALIGRLVPTIEGLVVATGLSPLIECSVVIGYPGLISAFVESGAFHSFEALSVDEALFLLMELLEVSGEEARAET

SEQ ID NO: 157421 - protein, 171 aa, Glycine max
  Coding DNA Sequence Number=SeqID_65736
MAAGGVRKVVEVVALEAGYLVLRLWLKLDGAPRRWLDDSGTCEDTRSTPDILLRKQGRPGVKGAVDLEFLDQSNVNLLLWEFSEYPVSLPSLELSVKFINVVLIPVPSYLYSEARGIPGGFPALSGHRSSFPHLAPCPESLGLALQSRLAQARRQASSSQFISALSALMLA

SEQ ID NO: 157422 - protein, 85 aa, Glycine max
  Coding DNA Sequence Number=SeqID_65737
MGAKYLEVVKRGSHPNNGWSPDEIRSCISTTPIPTPEASHSISKALSKLGKQSKGALMNGNRMEKEEREDMPLQGEDESRRSSPP

SEQ ID NO: 157423 - protein, 59 aa, Glycine max
  Coding DNA Sequence Number=SeqID_65738
MTELKQIFFDTKSERHKKQEQEQKRDKNKNKNETKTQTRTQQDANKKTNNRTRTKHELG

SEQ ID NO: 157424 - protein, 179 aa, Glycine max
  Coding DNA Sequence Number=SeqID_65739
MTPTRHPLDTEKSNRALGFSALITGLRQSYGVPVTPSKVIRPPITQAFIEKYCMPRQAQGDAHQAAGAPPPPRQADPTGPLGVERYLQHLVRQQAANHRGQVQIHECLYRFSLSQQGQGSAPFVCPTPEQFGAEVSWPGDWPDAQAGEEPTGSPGKADESHMDKDMTDLLGFLGGSGAT

SEQ ID NO: 157425 - protein, 112 aa, Glycine max
  Coding DNA Sequence Number=SeqID_65740
  Subcellular localization annotation: CTP_CleavageSite=26; ConfidenceScore=5.07e-01
MIAYMRQLKISYFSYVSQRALRGRARARLTGALSKGGEMRGVATNVDKSGAFALTYPPLERKSDLRSSFTCVNQVILFYLRGDHLKALDLKNDPFYLIFNVVTARPNGRNSF

SEQ ID NO: 157426 - protein, 122 aa, Glycine max
  Coding DNA Sequence Number=SeqID_65741
  Homolog annotation: Hit_ID=A7QL08; Match level="QueryCoverage=37%, HitCoverage=63%, E-value=3e-13, Identity=84%"; Hit description =Chromosome undetermined scaffold_116, whole genome shotgun sequence
MVGAGLKKDLRVSRVVPGGSLNAFLFLLIGVISQRLAMVKKKGNKHTWRAQYTDSGFLIWDPGEEDQAGPCEQLDALSPFNPLSEMWQKEKESMDRPHRLHPVGTTRSPQGRLRHPGVADRP

SEQ ID NO: 157427 - protein, 309 aa, Glycine max
  Coding DNA Sequence Number=SeqID_65742
  Gene Ontology: Mol. function=acetyl-CoA carboxylase activity; Cellular component=acetyl-CoA carboxylase complex; Biological process=fatty acid biosynthetic process
  Homolog annotation: Hit_ID=A7ZHS5; Match level="QueryCoverage=100%, HitCoverage=96%, E-value=1e-136, Identity=80%"; Hit description =Acetyl-coenzyme A carboxylase carboxyl transferase subunit alpha
  Pfam annotation: Domain name=ACCA; Domain location=1-141; Score =317.5; E_value=2.4e-92; Accession=PF03255.5; Description=Acetyl co -enzyme A carboxylase carboxyltransferase alpha subunit
  Pfam annotation: Domain name=Carboxyl_trans; Domain location=3-303; Score=-302.7; E_value=0.054; Accession=PF01039.13; Description =Carboxyl transferase domain
  Pfam annotation: Domain name=MdcE; Domain location=74-304; Score= -96.3; E_value=0.1; Accession=PF06833.2; Description=Malonate decarboxylase gamma subunit (
  Pfam module annotation: Pfam domain module=ACCA::Carboxyl _trans::MdcE; Domain location=1-141::3-303::74-304
PIAELEAKIDSLKSIGRSDEKHDINLDEEVQRLREKSVELTRKIFSDLGAWQVAQLARHPLRPYTLDYVRNAFDDFDELAGDRAYADDKAIVGGIARLDGRPVMVIGHQKGRETKEKIRRNFGMPAPEGYRKALRLMEMAERFKMPLITFIDTPGAYPGVGAEERGQSEAIARNLREMSGLKIPVICTVIGEGGSGGALAIGVGDKVNMLQYSTYSVISPEGCASILWKSADKAPLAAEAMGITAGRLKELKLIDSIIPEPLGGAHRHPVDTAAALKQQLLADLADLDVLSTEELLNRRYQRLMSYGYA

SEQ ID NO: 157428 - protein, 139 aa, Glycine max
  Coding DNA Sequence Number=SeqID_65743
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQSTLAAATVIDLESSLESCAVG

SEQ ID NO: 157429 - protein, 196 aa, Glycine max
  Coding DNA Sequence Number=SeqID_65744
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=89%, E-value=9e-90, Identity=83%"; Hit description =Chloramphenicol acetyltransferase
  Pfam annotation: Domain name=CAT; Domain location=6-169; Score=316.2; E_value=5.9e-92; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVLMPLAIQVHHAVVMASMSAECLMNYTSTAMSGRAGRNFFKAVIGA

SEQ ID NO: 157430 - protein, 45 aa, Glycine max
  Coding DNA Sequence Number=SeqID_65745
MALYGSAFAYSNPLKRRFPLCPKLGKGCRSIGRDPSLYLRPSLST

SEQ ID NO: 157431 - protein, 73 aa, Glycine max
  Coding DNA Sequence Number=SeqID_65746
MEKCLVKLQTKFQKDSTVNVGWAAFLPRQLHNKFREDPTVNKGCIAFLPRKLHVAFSRSFIKRLPPEASSWLL

SEQ ID NO: 157432 - protein, 207 aa, Glycine max
  Coding DNA Sequence Number=SeqID_65747
MVSNPSRAQKKDKSSKRKQGECSQATLNRLDTWFTNENKNNDFKMIYAMKNVRIPNTGSVQACADERNFLHGTGKSFLYLCSQRYGSLKNLLMIITRSRLIEVCSLNLRNHLGVGGLTAEDRMFVYHITYILNQGPTTTHRYSNELGTLDRRHHVEEPSITKRRLKKLVKRFFEHEWNMDGEPPATANIDQMEKEAKDEAQQELAHQ

SEQ ID NO: 157433 - protein, 76 aa, Glycine max
  Coding DNA Sequence Number=SeqID_65748
MATEWRRKRERRRHFKEKMSLEEAHHHRRPWIRAWRKKEMNEGRGREEHEILCSKRALKSEPTNTRSIPRFSTKCA

SEQ ID NO: 157434 - protein, 155 aa, Glycine max
  Coding DNA Sequence Number=SeqID_65749
  Homolog annotation: Hit_ID=A2Q4P8; Match level="QueryCoverage=74%, HitCoverage=46%, E-value=2e-12, Identity=37%"; Hit description=IMP dehydrogenase/GMP reductase, related
  Pfam annotation: Domain name=DUF1723; Domain location=56-105; Score =46.9; E_value=7e-11; Accession=PF08330.1; Description=Protein of unknown function (DUF1723)
MVLRGSHADEGFLERPELKLVSNRRKVTLIGRPVPEIEGLVAATGLSQLIGCSVVTSDPRLIFAFMERWHRETDTFHLLVGELTITLDNVSSLLHLPISGAFHSFEALSVDEAVFLLMELLEVSSEEARAETVRACGAYVHLSWVREIYEMRCQA

SEQ ID NO: 157435 - protein, 162 aa, Glycine max
  Coding DNA Sequence Number=SeqID_65750
MWVFHTGRQLDWAHLVRYRMHKALRLNAPLPYPHLVTLFLRHFQISLDSEPYVPIKRSFLIGAAVIDSFGYRKEHDGSWVKKGAQPVDNEGNLPVKDNSSLLRRLLDKFDGLQTFVGDKFDAMELQVDMRFDAMESRITKVEEDVSFIRTCFDPPPPPPSSS

SEQ ID NO: 157436 - protein, 180 aa, Glycine max
  Coding DNA Sequence Number=SeqID_65751
  Homolog annotation: Hit_ID=UPI00006A2D9E; Match level="QueryCoverage =82%, HitCoverage=85%, E-value=8e-12, Identity=18%"; Hit description =UPI00006A2D9E related cluster
LHALAFRGLHVLAFRGLHALVLRGLHIPPSEVHVLAFRGLHVFSFRRLHTLAFRGIHLLSFRGLHVLTFIGLQVLTFRGLHALAFRGKHALAFRGLHILTFRGLHVLAIRGLHALTYRGLHVLAFRGLHVLTFRGLHAVTFRGLHVLAFRGLRPHLRRTTRPRLQRPTRPRLQRATRPRV

SEQ ID NO: 157437 - protein, 166 aa, Glycine max
  Coding DNA Sequence Number=SeqID_65752
  Subcellular localization annotation: CTP_CleavageSite=53; ConfidenceScore=5.69e-01
MATPPASPPPPLPPPPADASVSPSTLKRTRKATRLRSLATRLPGAERPVVNVDLATGKADDTQKKKLRTYLGIVARDKVDVTYDTWKEVPTAQKDLIWEDIQDVQKKAQAIQKQNTAPHVLSHGGYQYLEQKLMAEKTKKRKDWKKLPSPEALRASLTLHLPLDAM

SEQ ID NO: 157438 - protein, 95 aa, Glycine max
  Coding DNA Sequence Number=SeqID_65753
MPAPMPQKRRACRKVPSPETNSDMLMRYGIQACNPSTEPIISGGVMIPTTLASTCCRAAKNAGAGPMRASSPYNKPFSSSGCDIAGLRQTIYQFA

SEQ ID NO: 157439 - protein, 394 aa, Glycine max
  Coding DNA Sequence Number=SeqID_65754
  Gene Ontology: Mol. function=carbohydrate transmembrane transporter activity; Cellular component=integral to membrane; Biological process=carbohydrate transport
  Homolog annotation: Hit_ID=A4WAE6; Match level="QueryCoverage=98%, HitCoverage=97%, E-value=1e-125, Identity=60%"; Hit description =Probable sugar efflux transporter
  Pfam annotation: Domain name=BphX; Domain location=1-140; Score= -78.8; E_value=0.077; Accession=PF06139.3; Description=BphX-like
  Pfam annotation: Domain name=Branch_AA_trans; Domain location=76-383; Score=-338.4; E_value=0.049; Accession=PF05525.4; Description =Branched-chain amino acid transport protein
  Pfam annotation: Domain name=MFS_1; Domain location=18-350; Score =143.6; E_value=5.6e-40; Accession=PF07690.7; Description=Major Facilitator Superfamily
  Pfam annotation: Domain name=Sugar_tr; Domain location=11-391; Score=- 151.7; E_value=0.0047; Accession=PF00083.15; Description=Sugar (and other) transporter
  Pfam module annotation: Pfam domain module=BphX::Branch_AA_trans::MFS_ 1::Sugar_tr; Domain location=1-140::76-383::18-350::11-391
MQSTTVSRKTAWLRVVLLAIAAFVFNTTEFVPVGLLSDIASSFAMKTADVGIMLTIYAWVVALLSLPLMLLTRNVERRLLLAILFILFVASHLLSAVAWDFTSLVLSRIGIALAHAVFWSITASLAIRVAPAGKKTQALSMLATGTALAMVLGVPIGRIVGQYLGWRTTFGMIGLSALVLLIMLVRILPRLPSEHTGSLSSVPMLFRRPALVAMYILVTVVVTAHYTAYSYIEPFMQVVASADENFTTLLLLLFGSAGILGSILFSTLGNKFPSALLIAAIALITLCMGLLVFAAVRPAAITVLCIIWGMAMMMIGLAMQVRVLSLAPDATDVAMSLFSGIYNIGIGAGALLGNQVSLHLQMADVGNVGAIIGLAGLFWCIAIFRRYPQLRSNG

SEQ ID NO: 157440 - protein, 244 aa, Glycine max
  Coding DNA Sequence Number=SeqID_65755
RFRQLNRERIAFATFALQLADDAARQRHAARGQTPAGGCLFILWRQQLLPVERQAEALATVENIVERQIVDAIKAVAITVADVKHIAAGDQPRPIVEDMQAITAPDNHNLAELMPVRWERGLRHAFCHGNRQIAGREGGEVITVTKPTLIGDVRDAHLAVAQQPIEIALRRAAGLLLHLAMQASPASGAGGHPGPAPDRCAPPRAAAPAAAKSAVPAAPDVPATSWPAASSASPAAAPAPSLYG

SEQ ID NO: 157441 - protein, 78 aa, Glycine max
  Coding DNA Sequence Number=SeqID_65756
SSFGYRKDRNGQWLKKDALPPQDERTPSPPPQREDSALMNEVLTELRGLCSYVGECFDSLDTRFAPAWIFASHSLKRM

SEQ ID NO: 157442 - protein, 281 aa, Glycine max
  Coding DNA Sequence Number=SeqID_65757
  Gene Ontology: Mol. function=helicase activity; Biological process =viral genome replication
  Homolog annotation: Hit_ID=Q9LTU4; Match level="QueryCoverage=95%, HitCoverage=24%, E-value=2e-43, Identity=46%"; Hit description =Helicase-like protein
MYNIKDVLDEDIIIGIKNMLDNNNHYAQKFKIARDKLQSSAVSNLKLKLICDRQSDGRLYNMPNTAEVVALIIGDEHIDCNQGTMKLKQYYIQGDCFNNGLLMASELRVDKYMNLSAYNNDPETLGNQKGMRVILPSSFVSGKRYMEQLYFDGMTICGHIGFPDLFLTLTCNPTWQKIQRKVRKSNLTPHDCPDVVSRVFKMKLNQLMNDLKRGHVFGAILGFVYTIEWKKRGLPHAYILIFLQPSNKYPNPKDIDNLISEEIPIKDTYPELYVLDQVASK

SEQ ID NO: 157443 - protein, 330 aa, Glycine max
  Coding DNA Sequence Number=SeqID_65758
VEIYHTELDEFKAELERRNFHKRLTNLADSSIDLALVEEFYANLYSPEGPSPKQGESLPAYSRYCRMPTNIREIEAALCIPDRGFVLNAEGHPRKILRKDLTTLSQVWSVLSYSNLASTSHTSDLTVDRARLIFDLVSQLDMNVRALISGHITSMAQSNSSRLRFPALITALCRSRGVASDSLVFERLSPVINLAYIRKNYWNPDDLTFTIRGARRARARPAEAPSFHIYSSSSNTLQLVEPPDSIPSIEQFNEWVAWPGTQPPLHKEDEGPTAQVPQQMEDESSETSTPEPLIRRKTVVEKQEAAATSEKSLEATPKPPAPVADTTSPQ

SEQ ID NO: 157444 - protein, 67 aa, Glycine max
  Coding DNA Sequence Number=SeqID_65759
MENLHEIAYGNISEAPRLGFSSRKQFFSLISREKREVVAAQLAQASWVASTRRHHLLLEHPGKSKWA

SEQ ID NO: 157445 - protein, 160 aa, Glycine max
  Coding DNA Sequence Number=SeqID_65760
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=73%, E-value=2e-24, Identity=70%"; Hit description=LacZ protein
MDDPKGSSSWLKSLNISDIFGWKGHGEYGALAAIVISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 157446 - protein, 279 aa, Glycine max
  Coding DNA Sequence Number=SeqID_65761
  Homolog annotation: Hit_ID=Q6WAY4; Match level="QueryCoverage=93%, HitCoverage=44%, E-value=9e-30, Identity=32%"; Hit description =Putative uncharacterized protein
YGKILDLTAAEVFTEAVVSLAQYYDQPLRCFTFGDFQMVPTIEEFEEILGCPLEGRKPYLFSGFLPSLSKIAAVVGDSAKELDRMKQTRNGVVGLPRKYLEGKARDMASQEKWGPFADILVLLIFGVVIFPNVDGLVDLAAIDAFLAYHHSKESPVVAILTDLFDTFDRRCEKNSARIVCCLPALCVWLVSHLFQQDTRHPCPLQSYRSCAEKGRVDWDQHLAGIGGNAINWFPRWKEGKEGVLFSCGDYPNVPLIGTRGCPLMVIFHHGDAAEDKGEE

SEQ ID NO: 157447 - protein, 77 aa, Glycine max
  Coding DNA Sequence Number=SeqID_65762
MKAQRQRHYQDYQLLLKAQTNLKAQTYQGNPCGVYPDLSSFIGSGVYLDLSSFTGSGVIQTFVACIKRSAPTQVHII

SEQ ID NO: 157448 - protein, 419 aa, Glycine max
  Coding DNA Sequence Number=SeqID_65763
  Gene Ontology: Mol. function=nucleoside-triphosphatase activity; Cellular component=chloroplast
  Homolog annotation: Hit_ID=Q2PMM5; Match level="QueryCoverage=99%, HitCoverage=20%, E-value=0.0, Identity=86%"; Hit description=Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRSGGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGM

SEQ ID NO: 157449 - protein, 136 aa, Glycine max
  Coding DNA Sequence Number=SeqID_65764
  Gene Ontology: Cellular component=chromosome, pericentric region; Biological process=mitosis
  Homolog annotation: Hit_ID=A7PYM4; Match level="QueryCoverage=80%, HitCoverage=30%, E-value=2e-16, Identity=37%"; Hit description =Chromosome chr12 scaffold_38, whole genome shotgun sequence
MTEQDFTNPIPDFISDLYTRLLIHLNILLEEDKEQVKFHAVEHLQNPDFHVESVRAFKLYNQINEVLTTLEDARMNSVSEIVEEVNAVEAQQTKLEENIILQERNDVERTGYYIDVGVGNVVESASYYIGASTKTM

SEQ ID NO: 157450 - protein, 307 aa, Glycine max
  Coding DNA Sequence Number=SeqID_65765
  Homolog annotation: Hit_ID=A5C7Z4; Match level="QueryCoverage=25%, HitCoverage=28%, E-value=6e-09, Identity=40%"; Hit description =Putative uncharacterized protein
  Pfam annotation: Domain name=Transposase_23; Domain location=51-121; Score=9.6; E_value=0.00011; Accession=PF03017.5; Description =TNP1ENSPM transposase
  Subcellular localization annotation: CTP_CleavageSite=34; ConfidenceScore=5.22e-01
MASFSQMQSQIQSQMQSQGLALPPEPLVGPSAPRVSTKGSCVDPSGNDPKTGDSDRCGLYIEADPARLVALGRVYEGSTVVHNTPLLPSQVKVGVEEVTDADAPVLVPTDEVSLVGQALHTFLAWSTHLVKSLSKHVVVSPAKPPPKPDPEVTWDATVFGVFNLDFPLYIKHEDLSEIAHGGQCLSISVLQLWIPHLTDTSMRAGNSDIYGFLEPQSIQSGHWQMVVILPKEHLVVWFCSLHNRPDNYLKGIINSALKGLDDAPQPKSKAPARWIVVKCNRQKGSTECGYYVMHWISPIILGTFRNN

SEQ ID NO: 157451 - protein, 53 aa, Glycine max
  Coding DNA Sequence Number=SeqID_65766
MGMMETKKENFTKIICQTIWGDSNVSWDSVPSVRKEAMWEELRQLRASNPKGL

SEQ ID NO: 157452 - protein, 143 aa, Glycine max
  Coding DNA Sequence Number=SeqID_65767
MSLDLRVRMLPKANYLGVAVVVLEAVFVKYNRWVVIEPQDYVTVNLPDQPAEKPSIGKNLESLQPANELFLVKCKFQLCASCLKRSNLSQLVAKFSSTKRVILAIVDPALIVVSKSAHVLIAGKSSVLKSPTQALGDEYAVCA

SEQ ID NO: 157453 - protein, 93 aa, Glycine max
  Coding DNA Sequence Number=SeqID_65768
MQQPSPIFYSNKPTEAEHTEAKLHDESTMIQSSSESKNISRESRTSQDFKIQDSRSQESRSRFKYQESRLKISRIKIKIQDSRFKNEEKTQSR

SEQ ID NO: 157454 - protein, 46 aa, Glycine max
  Coding DNA Sequence Number=SeqID_65769
MKQVIGDDARLVKEFKQEMMQAFEMIDLSLMTYFLGNEIKHSQKKC

SEQ ID NO: 157455 - protein, 150 aa, Glycine max
  Coding DNA Sequence Number=SeqID_65770
MPQDVVVGSCLARWSRLAQCHSKEGIGLSGYDPLSPIGMGVQAERIRSQANSKDSRMKFSRIKFQESRIKNNQDQDSRLKIQESREDSIKISIKKFFKTLSSTLSEWMTEKVFQNIKYYKISIKKFLKTCLPKSFYSLVIDYQNIVIDYQ

SEQ ID NO: 157456 - protein, 154 aa, Glycine max
  Coding DNA Sequence Number=SeqID_65771
MFFNLYTGQQSHHNLNWKKYTMQLHASKYYLAHHQHQSYAEPNVPPVHVPEFMSQHHPSQAQYQSTSFSGHASQEYQQSDISHEDEDEKDNNNNNDDDDDDDGDGDGDNDDDNEQEEVEVTDDQEDNKHRQIQSNNMRDPRISRRTRCGTSSHY

SEQ ID NO: 157457 - protein, 354 aa, Glycine max
  Coding DNA Sequence Number=SeqID_65772
  Gene Ontology: Mol. function=nucleotide binding; Cellular component =intrinsic to membrane; Biological process=defense response
  Homolog annotation: Hit_ID=Q8GZF0; Match level="QueryCoverage=50%, HitCoverage=22%, E-value=2e-61, Identity=52%"; Hit description =Resistance protein KR4
  Pfam annotation: Domain name=LRR_1; Domain location=242-264; Score =6.0; E_value=24; Accession=PF00560.24; Description=Leucine Rich Repeat
  Pfam annotation: Domain name=LRR_1; Domain location=267-290; Score =13.3; E_value=0.9; Accession=PF00560.24; Description=Leucine Rich Repeat
  Pfam module annotation: Pfam domain module=LRR_1::LRR_1; Domain location=242-264::267-290
MPSYGVFPEYRDHPDGTPITKEISRIGHGPLRPESNEFCAAGYMRIKLIRRIIYIQRRRHNRSMITNNNGSTKRLPSSKTNYTKRTTMEARKKKARNAYLDGEAQMKKKNESTTTTPSTMVNSSTTTWSWKQQSAREDERNVEEEDELSSQNRRTGTRKRRGTGALLAWADTASLLEMSDALKELRIYCCPKYEMFSYCEMSDDGCDSLKTFRLDFFPALRTLDLRGFRNLQMITQDHTHNHLEFLAIKECPQLESLPGSMHMLLPSLKELRIYDCPRVESFPEGGLPSNLKEMGLYKCSSGLMASLKGAFRDNPCLETLWIGKLDAESFPDEGGEDWPKIAHIPTVDIFGSIR

SEQ ID NO: 157458 - protein, 45 aa, Glycine max
  Coding DNA Sequence Number=SeqID_65773
MGLSGLKEHSNPVTPKAYTPKSPSGPLPPDSGPIPKIILAHRHCS

SEQ ID NO: 157459 - protein, 100 aa, Glycine max
  Coding DNA Sequence Number=SeqID_65774
MIGSLKEEWMNEIIGNLKEVWRNELEEQNKYSLEKKKQELKEAIKIELSKRRSYPKKLVEPVQKSNNVAAHDPLGDFIKNLYDIYKSLLSGMRLNLGFQM

SEQ ID NO: 157460 - protein, 509 aa, Glycine max
  Coding DNA Sequence Number=SeqID_65775
  Gene Ontology: Mol. function=nucleotide binding; Cellular component =intrinsic to membrane; Biological process=defense response
  Homolog annotation: Hit_ID=Q8GZF0; Match level="QueryCoverage=100%, HitCoverage=60%, E-value=1e-144, Identity=76%"; Hit description =Resistance protein KR4
  Pfam annotation: Domain name=LRR_1; Domain location=253-274; Score =6.9; E_value=16; Accession=PF00560.24; Description=Leucine Rich Repeat
  Pfam annotation: Domain name=LRR_1; Domain location=276-298; Score =3.3; E_value=76; Accession=PF00560.24; Description=Leucine Rich Repeat
  Pfam annotation: Domain name=LRR_1; Domain location=331-354; Score =10.4; E_value=3.6; Accession=PF00560.24; Description=Leucine Rich Repeat
  Pfam annotation: Domain name=LRR_1; Domain location=410-438; Score =0.8; E_value=2.2e+02; Accession=PF00560.24; Description=Leucine Rich Repeat
  Pfam annotation: Domain name=LRR_1; Domain location=471-490; Score =7.5; E_value=12; Accession=PF00560.24; Description=Leucine Rich Repeat
  Pfam annotation: Domain name=LRR_1; Domain location=491-506; Score =3.2; E_value=80; Accession=PF00560.24; Description=Leucine Rich Repeat
  Pfam annotation: Domain name=NB-ARC; Domain location=1-137; Score= -103.7; E_value=0.0012; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=253-274::276-298::331 -354::410-438::471-490::491-506::1-137
MRSKEHKLEQLQEDYCWQLFAKHAFRDDNLPRDPGCTDIGMKIVKKCKGLPLALKSMGSLLHNKPSAREWESVLQSEIWELKDSDIVPALALSYHHLPPHLKTCFAYCALFPKDYVFDRECLIQLWMAENFLNCHQGSKSPEEVGQQYFNDLLSSDFTIQQLGELNLHGSLFMELQNIKNPSDALAADLKNKTGLVKLEFRWNSHGKHDDHAKERDVVVIENLQPSKNLEKLSIRKYGGKQFPNWLSDNSLSNVVSLELDNCQSCQHLPSLGLLPFLKNLEISSLDGIVSIGADFHGNSSSSFPSLETLKFSSMKAWEKWECEAVIGAFPCLQYLSISKCPKLKGDLPEQLLPLKKLQISECKQLEASAPRALELSLKDFGKLQLDWATLKRLRMAGPSMEASMLEKSDTLKELFIHCCPKYEMFCDCEMSDDGCDSLKTFPLDFFPALWILDLVGFRNLQMITQDHIHNHLEYLIIRECPQLESLPGSTSLKELRIYDCPRVESFPEG

SEQ ID NO: 157461 - protein, 125 aa, Glycine max
  Coding DNA Sequence Number=SeqID_65776
  Gene Ontology: Mol. function=aspartic-type endopeptidase activity; Cellular component=chromatin; Biological process=chromatin assembly or disassembly
  Pfam annotation: Domain name=Chromo; Domain location=2-51; Score =14.9; E_value=0.0081; Accession=PF00385.15; Description='chromo' (CHRromatin Organisation MOdi
MVLQSKVILRNHQQVQQQLIKWEGLEDDQATWEDTSTIKLTFPDFNLEDKVSFKGEGNVTSATLEGNEEGKGGTKAKRHVANEKGERRSMRLAEVPDVKLQFCCNSEWRIALKTPKELYPTYILS

SEQ ID NO: 157462 - protein, 128 aa, Glycine max
  Coding DNA Sequence Number=SeqID_65777
MSGRLRDEILGKKIGLKGGGYCKKKKFGERGRKRGDRAKQLASGITFLKQLGDTARLQQLVEKNSKELDGLHGFPRLTVGILKTTTLGLPLTENGTLSAIPTEGNCAERPKAALSPFSTERKRAERLE

SEQ ID NO: 157463 - protein, 380 aa, Glycine max
  Coding DNA Sequence Number=SeqID_65778
  Gene Ontology: Mol. function=nucleic acid binding; Cellular component= nucleus; Biological process=RNA interference, production of siRNA
  Homolog annotation: Hit_ID=A7PX99; Match level="QueryCoverage=47%, HitCoverage=40%, E-value=9e-41, Identity=62%"; Hit description =Chromosome chr12 scaffold_36, whole genome shotgun sequence
  Pfam annotation: Domain name=PAZ; Domain location=148-284; Score =55.4; E_value=1.9e-13; Accession=PF02170.13; Description=PAZ domain
MKAPSVTVIPQATRKGQEKEMETGVVFIKIPFQSTMPLAQAFFGGTCVLLRGMMEEIPGNEEAAEPPASSQSPADVPHNMETERMTATKYSIISRNGVGTTGKHLPLLVNLFEVVVNVPDTVFFQYSDFQVSINFEDKRAVESKGIGRKVIDKLYQTYSSELGCKRFVYDGGKTLYTVGPLPLNKYELKVLLEKSFTKRFNMKVKNDDDNSEGQTVDITVYEYFAKRCGIELTSSAYLPCLDVGKPKWPIYLPLELCSLVSLQRYTKVLSPMQRASLVEKSCQKPQDRIKILKSAVGNCYNDDPVLSSCGIFIEKQLSLIEGCVLETPKNIERPYTLIEEEPQLRKSNPVARVERMFDLLASKLNREPKLILCLAREETL

SEQ ID NO: 157464 - protein, 49 aa, Glycine max
  Coding DNA Sequence Number=SeqID_65779
MAKANHQVDKKWIPREEGRPRLGFMRHFPKLNNPGSGRETKSDFSLGSK

SEQ ID NO: 157465 - protein, 443 aa, Glycine max
  Coding DNA Sequence Number=SeqID_65780
  Gene Ontology: Mol. function=protein dimerization activity; Cellular component=nucleus; Biological process=regulation of transcription, DNA-dependent
  Homolog annotation: Hit_ID=Q0GPG6; Match level="QueryCoverage=82%, HitCoverage=78%, E-value=1e-174, Identity=87%"; Hit description=BZIP transcription factor bZIP99
  Pfam annotation: Domain name=bZIP_1; Domain location=154-206; Score =22.8; E_value=0.0013; Accession=PF00170.12; Description=bZIP transcription factor
  Pfam annotation: Domain name=bZIP_2; Domain location=154-204; Score =25.4; E_value=0.00022; Accession=PF07716.6; Description=Basic region leucine zipper
  Pfam module annotation: Pfam domain module=bZIP_1::bZIP_2; Domain location=154-206::154-204
MNVEQKMCKLAKYMERKSRDLNQGTFGEIKEALTRMNNVGPDGNQFGFMPRRSTTKVMYLSNIAYLAKLPTSLEKSPLTNQIEPHRLRLQKVQSSNPGTILVGNTDNQEESAMADASPRTDISTDGDTDDKNQPYDRNEALAAVSDSSDRSKDKSDQKTLRRLAQNREAARKSRLRKKAYVQQLESSRLKLTQLEQELQRARQHGIFISSSGDQAHTLSGNGAMQFDAEYARWLEEQNRQINELKAAVNSHASDTELRMIVDGILAHYDEIFRLKGVAAKADVFHLLSGMWKTPAERCFLWLGGFRSSELLKLLVSQLEPLTEQQLMGITNLQQSSQQAEDALSQGMEALQQSLAETLSTGAPASSGSSGNVANYMGQMAMAMGKLGTLEGFIQQADNLRQQTLQQMHRILTTRQSARALLAIHDYFSRLRALSSLWLARPRD

SEQ ID NO: 157466 - protein, 115 aa, Glycine max
  Coding DNA Sequence Number=SeqID_65781
MAFIPKGYNKMKPCKISYQNIKQKMEFGNKELSVLTNEFHYPGREAVNDKRITKESLSLQKSLLLGKVIQHLSYYEDPIKVFIPILKTFVWQRRVFKVQFTKDSIQGKKQKKPLN

SEQ ID NO: 157467 - protein, 591 aa, Glycine max
  Coding DNA Sequence Number=SeqID_65782
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=77%, HitCoverage=41%, E-value=2e-64, Identity=37%"; Hit description =Functional candidate resistance protein KR1
  Pfam annotation: Domain name=NB-ARC; Domain location=222-525; Score= -0.5; E_value=3.1e-10; Accession=PF00931.13; Description=NB-ARC domain
  Pfam annotation: Domain name=TIR; Domain location=83-202; Score=34.6; E_value=3e-08; Accession=PF01582.11; Description=TIR domain
  Pfam module annotation: Pfam domain module=NB-ARC::TIR; Domain location=222-525::83-202
TVGIEEFSYDPNSDTFITPNNYEPAYHPPSPNQPSPPSHPPLDSEVPIEKQNCHKRRRSEYGGSSSAVGINNQGNVLEKANMNSADDTVAGFTSTLAKSLEDQGFPARVLVDHRDLKKAEIETVRVFIVVLSEHYAICPFRLDKLAEIVDGLGARQRVLPVFYYVPTSDVRYQTGSYEVALGVHEYYVERERLEKWKNTLEKVAGFGGWPLQRTGKTYEYQYIEEIGRKVSEHVACSVELHSRVQKVNELLYSESDDGGVKMVGICGEDGTGKTTVACGVYYSNAAGNRFDYFCFLDKVGECLRNHGFIGLIGMLLSGMIGDSNNNSDIMKFGNTNKGMSILKRKFFEEEKKLFLVLEDIYDEKQLQDIVRLTNCFSSNSKVVITTKDNSLLHRHEIRLYEVERFKTKDAFQLLSLKAFNSKNLKSMYLSILERAETYASGNPFILEVMGSYLRGKSIEECVSALDQYEKVPNKEKQRIVQISFDALEKCHQKMLSCIAFYLNRQDLQVVEEKLYRQFRVSPKDGIKVLLDKSLIKINEHGREHVKQLKQEIQPASNDGSISTDGIGRKYGKIDMNGLEYGIQEIQPASND

SEQ ID NO: 157468 - protein, 160 aa, Glycine max
  Coding DNA Sequence Number=SeqID_65783
  Gene Ontology: Mol. function=RNA-directed DNA polymerase activity; Biological process=RNA-dependent DNA replication
MRGQDIYSSQEETTSSPSSSGNEDQVRGEESSEEVYPHEEVSKLNLTIIPHPKPYKLQWLNEQGEMIVNQQVKITFTHLGTKFVLHPQTPSQVVKDQPTMKVKRGEEEKLEKQKKKKDSKTLSSKAKGKEKEEKDSSKKIVKKENHFTTKGDIKGALLLK

SEQ ID NO: 157469 - protein, 490 aa, Glycine max
  Coding DNA Sequence Number=SeqID_65784
  Gene Ontology: Mol. function=exonuclease activity; Cellular component= intracellular; Biological process=RNA-mediated gene silencing
  Homolog annotation: Hit_ID=A7QMC1; Match level="QueryCoverage=78%, HitCoverage=98%, E-value=1e-101, Identity=77%"; Hit description =Chromosome undetermined scaffold_125, whole genome shotgun sequence
  Pfam annotation: Domain name=Exonuc_X-T; Domain location=108-388; Score=34.5; E_value=2.8e-07; Accession=PF00929.15; Description =Exonuclease
  Pfam annotation: Domain name=zf-GRF; Domain location=444-490; Score =11.0; E_value=0.0015; Accession=PF06839.3; Description=GRF zinc finger
  Pfam module annotation: Pfam domain module=Exonuc_X-T::zf-GRF; Domain location=108-388::444-490
NGNSMEGYTELKNEPGTHPAGDVAEPNCHLGSEFLEPSNEFHTKPTYHQNYSTWTPCHFNSHKVQQCQMNAFESHYYPYPVENPLQYVPINMVAQGYPREQYQEFQYFVVIDFEATCDKDKNPHPQEIIEFPSVIVSSITGQLEACFQTYVRPTCNQLLTDFCKDLTGIQQIQARKKREAWMEMGRLGSSQLGYSVVDLRLTTVIAAIGRWWQLEVGTPESGGRSAIVWTYGAVIASNAILHPFIFSVNCVHGCVRQESQPQSEPRGHFLVRKESAPLYSAVDRGVTLSEALLRHDKWLEKKGIKNSNFAVVTWSNWDCRVMLESECRFKKIRKPPYFNRWINLRIPFREVFGAVRCNLKEAVEIAGLAWQGRAHCGLDDAKNTAHLLALLMHRGFKFSITNSIMWQTADRPLMWKQSPEQPIVFPHSPYKAKDITIPVVQYHPFCFCGVKSSRGMVRKPCPKQGSLFFGCGNWTATRGACCRYFEWASN

SEQ ID NO: 157470 - protein, 555 aa, Glycine max
  Coding DNA Sequence Number=SeqID_65785
  Homolog annotation: Hit_ID=A7Q5C7; Match level="QueryCoverage=96%, HitCoverage=47%, E-value=0.0, Identity=63%"; Hit description =Chromosome undetermined scaffold_53, whole genome shotgun sequence
  Pfam annotation: Domain name=DUF810; Domain location=194-551; Score= -25.1; E_value=5.5e-18; Accession=PF05664.2; Description=Protein of unknown function (DUF810)
MEEENAIELLQRYRRDRRVLLDFILSGSLIKKVVMPPGAVTLDDVDLDQVSVDYVLNCAKKSTLLELSEAIRDYHDHTGLPQMSDTGSVGEFYLVTDPESSGSPPRRPPPTVPIPAVPPVAVSTPPPVFPPSPIVSNVSRSESFDSTQEKELTVDDIEDFEDDDDVAVVEGFRAKRTLNDASDLAVKLPSFSTGISDDDLRETAYEIILGCAGATGGLIVPSKEKKKDKKSSLIRKLGRSKSGSVVSQSQNAPGLVGLLETMRVQMEISESMDIRTRQGLLNALVGKVGKRMDTLLIPLELLCCISRSEFSDKKAFIRWQKRQLKVLEEGLVNHPAVGFGESGRKTNELRILLAKIEEAEFLPSSTGELQRTECLRSLREIAIPLAERPARGDLTGEICHWADGYHLNVRLYEKLLLSVFDMLDEGKLTEEVEEILELLKSTWRVLGITETIHHTCYAWVLFRQYVITREHRVLLHALEQLNKIPLMEQRGQQERLHLKSLRSKVEGERDMSFLQSFLTPIQRWTDKQLGDYHLHFNEVCSTVRLLDILRMWVWV

SEQ ID NO: 157471 - protein, 65 aa, Glycine max
  Coding DNA Sequence Number=SeqID_65786
VTSSEEDPEEDLEELPAVDALDFLEGDEDPLPEMDSPEDVMSASEADSTEDSGPGEMAISGGSSS

SEQ ID NO: 157472 - protein, 129 aa, Glycine max
  Coding DNA Sequence Number=SeqID_65787
  Homolog annotation: Hit_ID=A6FJQ2; Match level="QueryCoverage=29%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARIMARTRGLGRAIGRVVGRDRPGDEDAANVPERRRPTASARRLRVHQMTTEGRDMAKDVADMTDDVPEQAAEAPEMRADA

SEQ ID NO: 157473 - protein, 248 aa, Glycine max
  Coding DNA Sequence Number=SeqID_65788
  Homolog annotation: Hit_ID=A5B939; Match level="QueryCoverage=31%, HitCoverage=63%, E-value=8e-14, Identity=50%"; Hit description =Putative uncharacterized protein
LVPSEVSLRIAGARGRVLSGRCGCSVEPRHGIESSKWAIFGKQNWRCGMNRKLGYGAQLRANLDPTKGVGRLRQQDGGHGSRNPLRRREPGRSGRRADLGGSSNIQMRTLKAEEGKGTGEARLIALCARTPERESELSFLFNSLPTLETAQPEVGSSGWKSTARRVVSASGRWNNVGKGSRQNGSVTSGKGLALRAGHGGPSPEPVGCRWTARAASAARAGRRVPVGGRIGNGPFGASSPGVEQSTQN

SEQ ID NO: 157474 - protein, 82 aa, Glycine max
  Coding DNA Sequence Number=SeqID_65789
MPNIVNLMCFNFNFSENHTLSEALSPLNELGESREEFEKHLRVQRVISSLSETFVSSHVKYLCWEILAKLDAKFNETSENEV

SEQ ID NO: 157475 - protein, 100 aa, Glycine max
  Coding DNA Sequence Number=SeqID_65790
MAEKKEKHVPSPTAWVTKTFEIQYNPKCNITNAPNTIGKSRVRDENLHEFVSGQVFLVDGRHVGVVDFGQSPVYGLDFLVRGVGGNIKNIIKRRARGLQI

SEQ ID NO: 157476 - protein, 69 aa, Glycine max; identical to SEQ ID NO: 155843
  Coding DNA Sequence Number=SeqID_65791

SEQ ID NO: 157477 - protein, 179 aa, Glycine max
  Coding DNA Sequence Number=SeqID_65792
MSIHMAQLIADAIYLFAGMAPTRHPLDLDKSNRALGFPALITRLCQSFGVPVAPSKVIRPPITRAFIEKYCTQRQAQGDAPQAADAPPPHQAGPVGSFDTEHYLRHFVRQQAANHRAHGFTSFPCPTPDQFRAEVAWPGDWPEARAGEALAEAPDEEDEAREDEEMTDLLDFLGGSGAT

SEQ ID NO: 157478 - protein, 131 aa, Glycine max
  Coding DNA Sequence Number=SeqID_65793
MAITFAPGVAHKGLHALAFRGLYVLLFRRLHALAFRGLHVLSFRGLHALAFRGQHVLTIRGLQVLAFRGLHALAVKGLHALAFRGLHVLAFRGLHVLVFRGLHVLPFRGLHVLAIRELHALAIEDYTSSPS

SEQ ID NO: 157479 - protein, 89 aa, Glycine max
  Coding DNA Sequence Number=SeqID_65794
MTKGVEPNLKGTSNALEVLTQCHQVSAGSIDPWHHSMTCTYQSMTIHCHPSMGHTIDLKALCFLAVQNNRRFSTERKGKTLGSIFQLIA

SEQ ID NO: 157480 - protein, 26 aa, Glycine max
  Coding DNA Sequence Number=SeqID_65795
METTTKIKLQIMLNAFYVKRINLVVA

SEQ ID NO: 157481 - protein, 98 aa, Glycine max
  Coding DNA Sequence Number=SeqID_65796
MRGYCMVTRTFCQPGANEPIDVQRLTSSSAPFVILTREARFYSRRPKTFKPGDARDSFLLGRDDQVQWRREVSWFSNFVIFKTLKFVYASDAFSFLFE

SEQ ID NO: 157482 - protein, 61 aa, Glycine max
  Coding DNA Sequence Number=SeqID_65797
MSTHGTDEMGKGVYSSSSITLDLACKQATHLVVLREVSLDRKRGLPLLLRILRCNEEFRPT

SEQ ID NO: 157483 - protein, 143 aa, Glycine max
  Coding DNA Sequence Number=SeqID_65798
  Homolog annotation: Hit_ID=A4EE61; Match level="QueryCoverage=39%, HitCoverage=31%, E-value=3e-09, Identity=47%"; Hit description=GCN5 -related N-acetyltransferase
MQAVIETERLRLEPFALSHLAGLRAMDDDPEIMRYINEGQVKSEDETLATIERVQQRWQRYASGPSGTGAAGNWLATVAQQSGERVCHRSRYGDCAVCYRADRRGLSGGGGTSGKPCIPSGDAAAGYALSRYRAALRPALCGL

SEQ ID NO: 157484 - protein, 288 aa, Glycine max
  Coding DNA Sequence Number=SeqID_65799
  Gene Ontology: Cellular component=mitochondrion
  Homolog annotation: Hit_ID=A5AFX7; Match level="QueryCoverage=31%, HitCoverage=50%, E-value=6e-13, Identity=44%"; Hit description =Putative uncharacterized protein
YALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGTWARSATEDASPDYNSDAEGDRFSWWAFPAGSPADLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 157485 - protein, 102 aa, Glycine max
  Coding DNA Sequence Number=SeqID_65800
MDLRRGWQHKPRSTIATKNKGGYVSSGGWAVDTCDQEQAWLGSGLVEASAIQRSKHCRRGEIDLGVTVRVRYLLPIYEKLNLLHVIIYKEMCEDNHCTLDPS

SEQ ID NO: 157486 - protein, 153 aa, Glycine max
  Coding DNA Sequence Number=SeqID_65801
MDNEEGVQEQMKADLSALKDQMASISEVMSKLQKTIEDKATATASSTVREAEPVLQPALNPGLDRNTAVFGRRYSPEAYPYGLPPNFTPRATPEDLSQAPTFEGQLPPYEDYPGQDDGEGDTHLGPLLHLKDPSPHELPQPNIVRHIPASPTP

SEQ ID NO: 157487 - protein, 30 aa, Glycine max
  Coding DNA Sequence Number=SeqID_65802
MGSPKVPTWSQGMGQGMGTGQKIPPPQGTG

SEQ ID NO: 157488 - protein, 247 aa, Glycine max
  Coding DNA Sequence Number=SeqID_65803
  Gene Ontology: Mol. function=iron ion transmembrane transporter activity; Cellular component=outer membrane-bounded periplasmic space; Biological process=entry of virus into host cell
  Homolog annotation: Hit_ID=P26185; Match level="QueryCoverage=100%, HitCoverage=100%, E-value=3e-55, Identity=92%"; Hit description =Protein tonB
  Pfam annotation: Domain name=TonB; Domain location=169-203; Score =68.5; E_value=2.2e-17; Accession=PF03544.5; Description=Gram -negative bacterial tonB protein
MPLKKMFFNRRISVPFVLSVGLHSALVAGLLYASVKEVVELPKPEDAPISVMMVNTAAMAEPPPPAPAEPEPPQVEPEPEPEPEPIVEPPPKAIVKPEPVKPKPKPKPKPKVEKQVKPEPKKVEPREPSPFNNDSPAKPIDKAPVKQAPAAPVQGNSREVGPRPISRANPLYPPRAQALQIEGNVRVQFDIDSDGRVSNVRILSAEPRNMFEREVKQAMRKWRYEAKEAKDRTVTIRFKLNGTTELN

SEQ ID NO: 157489 - protein, 72 aa, Glycine max
  Coding DNA Sequence Number=SeqID_65804
MKSGDMRGYRMVIRAFRQPGANEPVDVQRLTSSSAPFVILTLEAWCYFYRPETFKSDNAQDSSLLGKDDRVR

SEQ ID NO: 157490 - protein, 82 aa, Glycine max
  Coding DNA Sequence Number=SeqID_65805
MVGVWSVLLMIVLRCLIFLVLASLENSDIVMTFEDDSCLTSLHIGRVVNIEAPPVGVVSSFLENSARKYSMNCVFMGTRGSY

SEQ ID NO: 157491 - protein, 64 aa, Glycine max
  Coding DNA Sequence Number=SeqID_65806
MADAKFAGLLGLAHCLSFSMCPGGRVGGAGLWPRAKFRIGWPPPPPRDQFCCQDFANFGLRPVG

SEQ ID NO: 157492 - protein, 64 aa, Glycine max
  Coding DNA Sequence Number=SeqID_65807
MVSFFYVEHMQVAGGIGAFRDDVTPDTSVINAVSALQEVGLASQTGELRVGEFRGCRPAEAISE

SEQ ID NO: 157493 - protein, 103 aa, Glycine max
  Coding DNA Sequence Number=SeqID_65808
MAEMKMKRNLPRQCQREDAATPPSTPTEDERSMRLEGHEEDQQRSRRRPTKVTKKTQPSFFKRKKKTNEEQIRLDLPRKPNLIWSYWKLPRKCNALIICHFVQ

SEQ ID NO: 157494 - protein, 85 aa, Glycine max
  Coding DNA Sequence Number=SeqID_65809
  Pfam annotation: Domain name=zf-CCHC; Domain location=7-24; Score =9.8; E_value=0.051; Accession=PF00098.14; Description=Zinc knuckle
MNEQVEKKCGLCRQHGHSRNNCPNEERKSGCEIPTSVKWPKQSCGGGGVGMGNEEVRWEVRDKVGNREKKGIKEKKEKEKVSAFG

SEQ ID NO: 157495 - protein, 73 aa, Glycine max
  Coding DNA Sequence Number=SeqID_65810
  Homolog annotation: Hit_ID=A7QHC7; Match level="QueryCoverage=91%, HitCoverage=9%, E-value=1e-25, Identity=86%"; Hit description =Chromosome chr2 scaffold_97, whole genome shotgun sequence
  Pfam annotation: Domain name=DUF1336; Domain location=1-71; Score= -107.4; E_value=0.057; Accession=PF07059.3; Description=Protein of unknown function (DUF1336)
MQSSWIICLSVGSTPCLQGKVVDCNYIRGPKYLEIDVDIGFSTVANGVLGLVIGVITTLVVDMAFLVQIVETC

SEQ ID NO: 157496 - protein, 71 aa, Glycine max
  Coding DNA Sequence Number=SeqID_65811
  Homolog annotation: Hit_ID=A7QHE7; Match level="QueryCoverage=92%, HitCoverage=20%, E-value=9e-22, Identity=77%"; Hit description =Chromosome chr2 scaffold_97, whole genome shotgun sequence
MEKARVAADLAIKDNRQLMEIEFPTAGLGSVPGDGEGGIEMTESMQLIREFCDRFISSEKVTRTRIVIFLI

SEQ ID NO: 157497 - protein, 62 aa, Glycine max
  Coding DNA Sequence Number=SeqID_65812
FVKDFLQDSGNLKRIAWGLDIGTGRGQTKVIDLNIWEAIEIEPYIPTMVAGNTTIEKPREEW

SEQ ID NO: 157498 - protein, 233 aa, Glycine max
  Coding DNA Sequence Number=SeqID_65813
  Gene Ontology: Mol. function=binding; Cellular component=nucleus; Biological process=protein amino acid phosphorylation
  Homolog annotation: Hit_ID=A7PRN9; Match level="QueryCoverage=95%, HitCoverage=57%, E-value=2e-73, Identity=41%"; Hit description =Chromosome chr14 scaffold_27, whole genome shotgun sequence
  Pfam annotation: Domain name=PPR; Domain location=128-162; Score=2.5; E_value=3.9; Accession=PF01535.11; Description=PPR repeat
  Pfam annotation: Domain name=PPR; Domain location=194-227; Score =13.9; E_value=0.17; Accession=PF01535.11; Description=PPR repeat
  Pfam annotation: Domain name=PPR; Domain location=7-41; Score=18.5; E_ value=0.026; Accession=PF01535.11; Description=PPR repeat
  Pfam annotation: Domain name=PPR; Domain location=93-127; Score=19.9; E_value=0.0092; Accession=PF01535.11; Description=PPR repeat
  Pfam module annotation: Pfam domain module=PPR::PPR::PPR::PPR; Domain location=128-162::194-227::7-41::93-127
  Subcellular localization annotation: CTP_CleavageSite=24; ConfidenceScore=5.06e-01
MPQRNVVTWTAMITSNNSRNNHMRAWSVFPQMLRDGVKALSCGQLVHSLAIKIGVQGSSVYVDNSLMDMYATCCDSMDRARMVFDDITTKTDVCWTTLITGYTHRGDAYGGLRVFRQMFLEEGALSLFSFSIAARACASIGSGILGKQVHAEVVKHGFESNLPVMNSILDMYCKCHCESEAKRLFSVMTHKDTITWNTLIAGFEALDSRESLCIFSRMVSEGLVQIASHLLVQ

SEQ ID NO: 157499 - protein, 79 aa, Glycine max
  Coding DNA Sequence Number=SeqID_65814
VASTQTYLPSLEVASTQTYLPSLEVASTQTYLPLLEVASTQTYLPSPEVASNLTYLPPPEVASILTYLPSPEVASFKPS

SEQ ID NO: 157500 - protein, 116 aa, Glycine max
  Coding DNA Sequence Number=SeqID_65815
MVKMPSSMISYQRIKELKHTLNLELTPNASRYNIGKPRKHQANFTFPKKRSIAKLKMGEKGKEDWVWQGAVTRSECAATEQEEEAEHGNESHGLERRHDSPHQLVNNGDTHHPRPP

SEQ ID NO: 157501 - protein, 193 aa, Glycine max
  Coding DNA Sequence Number=SeqID_65816
  Homolog annotation: Hit_ID=A5B6W4; Match level="QueryCoverage=51%, HitCoverage=7%, E-value=6e-09, Identity=39%"; Hit description =Putative uncharacterized protein
MAHAQPGPVDGSLLHLQDNHIFKSSVGRPRENDSSEDVALQLSLKIDGLSVTDFIIGDVRVACQTLLGETQPDKYVKGKMIYLIWLRQNFQQLSVDADDVVIAQHARDSHHICPNTHFKSLLPQMFFDGHSQMFATTFNTPPYAYNLPPSTSWYCPLLPTQMRDMDHEDEEDDDDNNNNNDDDDDDNGGDHVP

SEQ ID NO: 157502 - protein, 332 aa, Glycine max
  Coding DNA Sequence Number=SeqID_65817
  Gene Ontology: Cellular component=flagellum
  Homolog annotation: Hit_ID=A5AS54; Match level="QueryCoverage=99%, HitCoverage=35%, E-value=4e-84, Identity=52%"; Hit description =Putative uncharacterized protein
  Pfam annotation: Domain name=FPN1; Domain location=134-228; Score =9.7; E_value=0.0096; Accession=PF06963.3; Description=Ferroportin1 (FPN1)
MGFFTKVAIIVGGPLVGKLMDHFPRMSAYNCLTIVQASCLIIYTNYKVKQDIALFLKGVILSIFQAAAQLLSAAMIIHAHSVQPTSFSTLLLRPWFVVLVSAWAIERLCVVALGVANERDWIVLVLSFRTLSVPLTFPSTGKPVFKGLEAIKLGWKEYLGQPVLLASLAWVFLYFNIVLMPGSLLTAFLTQRGLHPSIIGGFSGMCALMGVAATFVPSTLVKQFGILKAGAVGLVFQALLLSMAVAVYWSGTISHQSPLLTFLFLIYNVHLLANKAWLVLKKVATGAQILQTGIPSSKANLIGMTEIAVASLVESIMLGVAIIANDLSHLDV

SEQ ID NO: 157503 - protein, 488 aa, Glycine max
  Coding DNA Sequence Number=SeqID_65818
  Gene Ontology: Mol. function=nucleic acid binding; Cellular component= ribosome
  Homolog annotation: Hit_ID=Q9SH74; Match level="QueryCoverage=71%, HitCoverage=83%, E-value=6e-17, Identity=25%"; Hit description =Putative replication protein A1
  Pfam annotation: Domain name=DUF223; Domain location=44-128; Score= -14.3; E_value=0.065; Accession=PF02721.5; Description=Domain of unknown function DUF223
MKPKVMSRKENLLCELYTKKGTWKIFVRITNMWCLNKHNGRQSIEMVLMDHTGTKIGATLWQELFPEFEPKLRCGGAYVIQNAKVVDTHFDYKTTSVKEVDRPEIPPNVHAITSFADIILGVAKPDTLVDIVGVIAKVIERKTVNPTYIVTVKLRDNSHVEIIMTVWEEYALQLDDAIEKNHFVQKPLVVMLTLAKIKETKDKYPLSVQNIKHGSKLYVNGDKNEIQQFHDSLRVPFYIGALDDDGGVSQSQSTQNCQDKFLHNDCYCLTVGTVDEVMIDTPWSYDSCPYCTTTFDPLKIGAACRSCQNHVTHTIPRYKLVVKMEQNGEKANFHFWDAVCIIIFGKTADECRQELIASGDEIKVFPACVDQLLGKTWVVRFKHRIQMHQSYALDFSEQEHHIQSVISTLGLQDEQCISNKSAAVGVASSSQQDYHPTPSLSQSSEYDPGNVAFVTSAKRTSDQQGSSQFDSDDFTTYELSTNKHIKVE

SEQ ID NO: 157504 - protein, 605 aa, Glycine max
  Coding DNA Sequence Number=SeqID_65819
  Gene Ontology: Mol. function=acyl-CoA binding; Cellular component =endosome membrane; Biological process=lipid transport
  Homolog annotation: Hit_ID=A7PRQ5; Match level="QueryCoverage=99%, HitCoverage=99%, E-value=0.0, Identity=53%"; Hit description =Chromosome chr14 scaffold_27, whole genome shotgun sequence
  Pfam annotation: Domain name=Kelch_1; Domain location=128-175; Score =9.5; E_value=0.22; Accession=PF01344.16; Description=Kelch motif
  Pfam annotation: Domain name=Kelch_1; Domain location=180-225; Score =27.5; E_value=5e-05; Accession=PF01344.16; Description=Kelch motif
  Pfam annotation: Domain name=Kelch_1; Domain location=226-269; Score =12.7; E_value=0.093; Accession=PF01344.16; Description=Kelch motif
  Pfam annotation: Domain name=Kelch_1; Domain location=27-72; Score =39.7; E_value=1e-08; Accession=PF01344.16; Description=Kelch motif
  Pfam annotation: Domain name=Kelch_1; Domain location=77-122; Score =27.6; E_value=4.7e-05; Accession=PF01344.16; Description=Kelch motif
  Pfam annotation: Domain name=Kelch_2; Domain location=127-174; Score =32.6; E_value=1.4e-06; Accession=PF07646.6; Description=Kelch motif
  Pfam annotation: Domain name=Kelch_2; Domain location=180-225; Score =23.7; E_value=0.00068; Accession=PF07646.6; Description=Kelch motif
  Pfam annotation: Domain name=Kelch_2; Domain location=230-269; Score =1.0; E_value=35; Accession=PF07646.6; Description=Kelch motif
  Pfam annotation: Domain name=Kelch_2; Domain location=27-72; Score =30.3; E_value=6.8e-06; Accession=PF07646.6; Description=Kelch motif
  Pfam annotation: Domain name=Kelch_2; Domain location=77-122; Score =35.1; E_value=2.6e-07; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=128-175::180-225::226-269::27-72::77-122::127 -174::180-225::230-269::27-72::77-122
MGSLVAETAMKKPMWLYPKVLGFNPSERWGHSACFSGGLMYVFGGCCGGLHFGDVLCLDLEKMNWSKLATTGEKPGPRDSHSAVLVGHKMIVFGGTNGLKKVNDTHILDLVTKEWICPKCEGTPPSPRESHTATLVGDERLVIFGGSGEGDANYLNDLHVLDLRTMRWTSPVVKGDLPVPRDSHSTLATGNKLIVYGGDCGDQYQGDVNVLDMDTMTWSRLKIQGSSPGVRAGHAAVYIIGGVGDKRYYNDIWVFDICTCSWTQLDIRGQQPQGRFSHTAVVADMDVAIYGGCGEDERPLNELLVLQLGAEHPNGRYNISMCKVFGTCWNHEKRTIHGGADTNSTTPRNGNNNMEVLGTSQQKRRRMAVAKVWDVDSEQEEHSLSLSQHSSPSQSDQEQTPGQKANFPVMDSQRYHWFKQINKSPSYCQLDNIPSNNTVLKNITQRSVHLIENQPKDEQYLHVDEDRKGARHTQHLIGAEVRGKVDGAFDSGLLMTAAVNGRVFRGVLFAPGAGVFSTCVEPNCSLSCSFPSTQPFMNSNHVRDSQQVTNCSHAEPCHGLRQPVLAQPTPIMRGTTASLAKEHKMRSDLQGLVLTLGGPASGNHA

SEQ ID NO: 157505 - protein, 60 aa, Glycine max
  Coding DNA Sequence Number=SeqID_65820
  Gene Ontology: Mol. function=transferase activity; Biological process= DNA integration
  Homolog annotation: Hit_ID=A5BLF4; Match level="QueryCoverage=100%, HitCoverage=45%, E-value=9e-22, Identity=81%"; Hit description =Putative uncharacterized protein
MAGGAISWRTVKKTLTATSTMKAEFVSCFKATSHGNNKSESQSKHIDIKYLVIKERVKDK

SEQ ID NO: 157506 - protein, 34 aa, Glycine max
  Coding DNA Sequence Number=SeqID_65821
MCFQSTFFQQIMQLHHPVKKQSKVIIKIARKTEL

SEQ ID NO: 157507 - protein, 239 aa, Glycine max
  Coding DNA Sequence Number=SeqID_65822
  Pfam annotation: Domain name=PHD; Domain location=58-112; Score=10.6; E_value=0.00076; Accession=PF00628.20; Description=PHD-finger
MMNPPPAKPAPPGGDTTLKGECGNCGWKERRLLHRLWIRGMNRLVCTSCVLRLHPSFFCPSCFDFFDHPLSNTSSAFAHRFVSCTKCSSLTHLSCLPSPPPSPFLCPPCSQHNFSFFPDSTAPLDKRRALILLCACKLAAASVAKSLALARTRVERTVREAALARKRARDALDHCSTVEKIKRLGLQGTFDASNSKYLGMGTMNHNHNNVTVLNGFVGPQGKVKADVNNIDAKLPNRVA

SEQ ID NO: 157508 - protein, 84 aa, Glycine max
  Coding DNA Sequence Number=SeqID_65823
MSQTQALRIQLKPNSSSVKLDLTWLIFIPTYTLSTRQLSQYSMTYHRNKLIAIDILSTCRRTRNEESISSLTYSETLQWHLQNA

SEQ ID NO: 157509 - protein, 139 aa, Glycine max
  Coding DNA Sequence Number=SeqID_65824
MEILVSELYGCILSLVVTNDTIRIVKPTKGLKLTEREAEVVFTTGGLSEAKPGIIPDAGLLEFNTEGPVPEDEDVGGAVGIDGAGVNGLGGGSVVGLDCVGGVGGDDDFGVVVVVDDDDGKMHEPVPIHNSEQPVKNGH

SEQ ID NO: 157510 - protein, 178 aa, Glycine max
  Coding DNA Sequence Number=SeqID_65825
MGETQNNDPHNFKDSQDPYSQFSIRQKQKASEETDETETESERSSSETERSYSDEEEVTGYMDISNILMMRSTEEPFYDSPVEEEPVISKSSSSKPNAGPWFTLDDTTPREWRKKLIEMGAWLDTTFMKDVDPYKVIKEFCCQMMGTLKEWYHNLGAVRQNQFHELGSTAAVLGTLHQ

SEQ ID NO: 157511 - protein, 80 aa, Glycine max
  Coding DNA Sequence Number=SeqID_65826
MEYDSLSRCLGGEMVDTRDSKSRAKERGEQLNNFTCNVPSVGERNSNYNFETCSNGASSTTTQIIITKNKGVIANRLTHL

SEQ ID NO: 157512 - protein, 254 aa, Glycine max
  Coding DNA Sequence Number=SeqID_65827
EGTSAAPEFDSHRFRSAEHQQHFEAIKGWSFHRERRVQLRDDEYTNFQEEIARRHWTSLVTPMAKFDPDIVLEFYANAWPTEDGVRDMRSWVRGMPPTRHPLDPDKSNRALGFPTLITGLCQSFGVPVTPSKAQGDAPHAADAPPPPHQADPAWSLGMERYLQHLVRQQAANHRGQVQIHECLYQLSLSQQGQGFVPFVCPTPNQFRAEVAWPGDWPKAQAGEAPAGAPGDAEEARMDEEMTDLLGFLGGSGAM

SEQ ID NO: 157513 - protein, 115 aa, Glycine max
  Coding DNA Sequence Number=SeqID_65828
  Homolog annotation: Hit_ID=A5BP71; Match level="QueryCoverage=65%, HitCoverage=19%, E-value=2e-11, Identity=46%"; Hit description =Putative uncharacterized protein
  Pfam annotation: Domain name=zf-CCHC; Domain location=88-105; Score =18.7; E_value=0.0022; Accession=PF00098.14; Description=Zinc knuckle
MVVIVNAEACGYVSMNYYQYIDVVYTNEHILKAYSAQWWPLGNEAAIPPSDDAWTLIPDPTTIRAKGRPKSTRIRNEMDWVEPSEHQPKCSRCGAEGHNRRRCPMQSERGSCSNR

SEQ ID NO: 157514 - protein, 155 aa, Glycine max
  Coding DNA Sequence Number=SeqID_65829
MHAFFSFFCVGRGLASLLAYHVSLFLIIYEKPSTRKVSVFGISFVHFCAWFVADSGTCMGILFVTHAIFPSEGRATRSMMACSPDKIRNINGSKETLKLAVKISDLWFIGTPNKFEQAEMVFVDSDVYYYLLFSPLCCNFNGIQGDEIHAICKQD

SEQ ID NO: 157515 - protein, 183 aa, Glycine max
  Coding DNA Sequence Number=SeqID_65830
MMMRSQDIYSSQDEATTSPSSSESEEAKGEESSEEIYPQEEGQPLMVKEECKETLVSTATPLGLEVIPQVKELLDEGLVLKSLNPCALLVPKIGVPTDPKRIKIIPDWPTPPTPFIELVRNHVPSWEDAHERSMKNLGILRSNPFQGGGDDAILPPKGTLDRRLQEAWARATKEGPRVLMNLR

SEQ ID NO: 157516 - protein, 67 aa, Glycine max
  Coding DNA Sequence Number=SeqID_65831
MYKNNWIQPRPMGSEIYPEVHENPKAFFNSSSSILLEPLARGSSDWSLPREDCINPDAKIHEGRKLP

SEQ ID NO: 157517 - protein, 127 aa, Glycine max
  Coding DNA Sequence Number=SeqID_65832
AVHVFSTFEFGAVFHDCLREDPQGNPPYSTFVRSTMNVIALRCSCVSIIKCEAYGDWEARYSVVFQIEEKEEVEMRVVITEGAGRTKSVSYLCFPLIFDESPETSQKLKGSRLAWFVKFRNVAKIEK

SEQ ID NO: 157518 - protein, 181 aa, Glycine max
  Coding DNA Sequence Number=SeqID_65833
MPLSPVILVTLADSELMSVTPSFLWLGGTYLHRTTWLFLYGNGIGLTTEGCQGIWGATSLVKCITKGSGFLRPSSSVDCMHICCSSPPSLPTSSRPWSIICCNRSPTAKHASMLCDKPYGGRHVLQRFGPTRPTRLDDINSSPSMIVKRVCLYVGSVLLKRQPSGFYQTLVLAFEGHALFG

SEQ ID NO: 157519 - protein, 137 aa, Glycine max
  Coding DNA Sequence Number=SeqID_65834
MAAMMEAMMSIKEMMKVSTAYRAHARAKSNGYGRQRFGKYGRPRDVQIQNEYAFPLYGLPPNYTPPNVAYTPNEDVNNSTPMLIESRQLHHIHVSQPMGETHEIPHHYLADFEPCLGYATKGQAVGGIPLQNTLEGP

SEQ ID NO: 157520 - protein, 307 aa, Glycine max
  Coding DNA Sequence Number=SeqID_65835
  Homolog annotation: Hit_ID=Q6WAY6; Match level="QueryCoverage=98%, HitCoverage=69%, E-value=1e-19, Identity=24%"; Hit description =Putative uncharacterized protein
MVSIWDLARVEVSMEPIASLAQYYDRPLRCFIFGDFQLSPMVEEFEEILGCPLGGRKPYLFSGFYPSLARISKKVQISAQELDRQRQVENGVVGIPRKYLEGVLFPNVDGLVDLAAIDVFLAYHNHKESPLSRWGWFHTFFSKKAGPPIRYKEGRIKILSSCEGCPNVPLMGTRGCINYNPVLAIRQLGYPMRGVPSDESITPFIARGFSDHNARDRELRGSSNGIIGGYHKWLRVRTQGLDWLPNLKTVRDDEVKASEESDEVQALKAELERARVVEEKFKSIAIKGSNSELKLRRGERNHHGSKA

SEQ ID NO: 157521 - protein, 346 aa, Glycine max
  Coding DNA Sequence Number=SeqID_65836
  Gene Ontology: Mol. function=phosphotransferase activity, alcohol group as acceptor; Cellular component=intracellular; Biological process=carbohydrate metabolic process
  Homolog annotation: Hit_ID=A4W9V7; Match level="QueryCoverage=100%, HitCoverage=92%, E-value=1e-170, Identity=85%"; Hit description =Anhydro-N-acetylmuramic acid kinase
  Pfam annotation: Domain name=UPF0075; Domain location=1-339; Score =718.5; E_value=4.9e-213; Accession=PF03702.5; Description =Uncharacterised protein family (UPF0075)
MVAQQASLTWPIRLSLKEDILSICQGQQLTLSQLGQLDVRLGALFADAVQALMQKEHLRPQDVVAIGCHGQTVWHEPIGDAPHTLQIGDNNQIVAKTGVTVVGDFRRRDIALGGQGAPLVPAFHQALLAHPSERRMVLNIGGIANLSMLIPGQPVRGYDTGPGNMLMDAWIWRQCGQPYDKNAEWASEGKVIIPLLQSMLSDPYFALPAPKSTGREYFNFGWLERQLASFPALAPQDVQATLAELTAVSVSEQVLLSGGCERLLVCGGGSRNPLVMARLAGLLPGTEVTTTDAAGISGDDMEALAFAWLAWRTVAGLPGNLPSVTGAREASVLGAIFPANPRHNQS

SEQ ID NO: 157522 - protein, 247 aa, Glycine max
  Coding DNA Sequence Number=SeqID_65837
  Gene Ontology: Mol. function=aminoacyl-tRNA ligase activity; Cellular component=cytoplasm; Biological process=tRNA aminoacylation for protein translation
  Homolog annotation: Hit_ID=Q8FH88; Match level="QueryCoverage=98%, HitCoverage=57%, E-value=1e-124, Identity=91%"; Hit description =Tyrosyl-tRNA synthetase
  Pfam annotation: Domain name=tRNA-synt_1b; Domain location=33-247; Score=217.1; E_value=4.1e-62; Accession=PF00579.16; Description=tRNA synthetases class I (W and Y)
MENLMASSNLIKQLQERGLVAQVTDEEALAERLAQGPIALYCGFDPTADSLHLGHLVPLLCLKRFQMAGHKPVALVGGATGLIGDPSFKAAERKLNTEDTVQEWVDKIRKQVAPFLDFDCGDNAAIAANNYDWFGSMNVLTFLRDIGKHFSVNQMINKEAVKQRLNRDDQGISFTEFSYNLLQGYDFACLNKLHGVSLQIGGSDQWGNITSGIDLTRRLHQNQVFGLTVPLITKADGTKFGKTEGGA

SEQ ID NO: 157523 - protein, 51 aa, Glycine max
  Coding DNA Sequence Number=SeqID_65838
METGNTYFSHEMQRVERFTRAWILRFIGGVLFVDKSSNKVSVAATGKSTYW

SEQ ID NO: 157524 - protein, 63 aa, Glycine max
  Coding DNA Sequence Number=SeqID_65839
MYFREENPSRGASAMLPRRFREQFREDFPSFFAILRSSTDRQWSNTLTFLSFQNQEIIKGPMP

SEQ ID NO: 157525 - protein, 82 aa, Glycine max
  Coding DNA Sequence Number=SeqID_65840
FLSGFLVEPIIRLIKVILVASTLTYLPSLEVASTLTYLPSLEVASTRTYLPSPEVASTLAYLPSLEVVSSKNSTACIKRSTP

SEQ ID NO: 157526 - protein, 1201 aa, Glycine max
  Coding DNA Sequence Number=SeqID_65841
  Gene Ontology: Mol. function=2-methylcitrate dehydratase activity; Cellular component=outer membrane-bounded periplasmic space; Biological process=propionate catabolic process
  Homolog annotation: Hit_ID=Q3KCA6; Match level="QueryCoverage=35%, HitCoverage=93%, E-value=1e-117, Identity=53%"; Hit description =MmgE/PrpD
  Pfam annotation: Domain name=MmgE_PrpD; Domain location=763-1195; Score=185.8; E_value=1.1e-52; Accession=PF03972.5; Description =MmgEPrpD family
  Pfam annotation: Domain name=NMT1; Domain location=14-231; Score= -92.5; E_value=0.085; Accession=PF09084.2; Description=NMT1THI5 like
  Pfam annotation: Domain name=Polysacc_deac_1; Domain location=230 -377; Score=91.8; E_value=2.1e-24; Accession=PF01522.12; Description =Polysaccharide deacetylase
  Pfam annotation: Domain name=Polysacc_deac_1; Domain location=494 -641; Score=51.2; E_value=3.6e-12; Accession=PF01522.12; Description =Polysaccharide deacetylase
  Pfam annotation: Domain name=SBP_bac_3; Domain location=2-223; Score =136.0; E_value=1e-37; Accession=PF00497.11; Description=Bacterial extracellular solute-binding proteins, family 3
  Pfam module annotation: Pfam domain module=MmgE_PrpD::NMT1::Polysacc _deac_1::Polysacc_deac_1::SBP_bac_3; Domain location=763-1195::14 -231::230-377::494-641::2-223
MPNYPPMDFKDPATNQLSGVDYELGQAIGEKLGVKVNWQEIAFEQMVNAVVTKRVDLVMSGMTDTKERQKVVNFIDYFKTGPQFYTLAARSDINSATDLCGKKVGTSRRTTFPQEIATWSKAHCEAAGKPAIIVVGAEGTADARTQLRQRRLDGAVQGSETLPYIMNLEKGTFKPLDKAFSFQYTGMALGKDAGELTTAIQAAINAMIADGSYQKILSKWGLSDNGIAEATGKRGCMALAFDLDGPTGDAMLNGSLWSTPEYFTFGAYGPFRALGRLLDLLRAFQLPATFFVPAWVVEQWPRQCQAIIEQGHEVAYHGYRHESFWAITPDEQRAVMARSAAIFQQHLGIRACGFRTPSGDWHAETPQILREAGVIYSSSMRGDDRPYSIAVAGHTPLVEIPGKWEMDDYASLAYTRQPDFPQGGDRIASYAHTGDNWQREFDGAMAEGLCLTTLFHPKISGQPGRLLLLEQLFAHMTARDDVWSSNMTEHSRWPSGKQSAAIITIDYHDIHGILTQAPAVAGRDKTLSVWRYGTLRGVDRLLDLLAEKQLLASWCLPAIVAEEQPQVLQRIVAAGHEIACSGERHEDFSALTLAQQIASVTRGCERLAQLTGQPIAGFRTPAGQWKPGLAAALATHGIRWSSSWRGDDLPYFHPGTRLVELPMHYTLEDAPYFAFNLSPAIPPGQSRIAPYGETLANLTQDFHGFHRFGLCYLLRLHPEIIGTAGRIGLLRQLLETLQQHEVWIATAGQVAAHWQTQADNDADHPAEVFARVSGAQAKRHLLDTLGAALAGCDSPIWRECRALVAEEGGSAVAQLWGCAQQASPRQAAWLNGVAAHMYELDDTGGCDHSGAVVLPALLAALPLATQPVDGREFLTAMVVGYDIGRRVLEACGGYAAHNGAGWHSTASCGVFGAAAAVSCLLRLPAAQCASALGIAASFSGGLWGFIHDGSHTKKLHAARAAEGGVQAALLAQRGISGPAAVFEARWGGFLQTLAGETQQPAALTDQLGEVWKLARCSIKPYAACRGTHAAIDALGLLLKQHAVATGDIARIVVGLNPFLLEMCGTRELTSLAAAQMSLPYALTARALFGSAELASYDDSRRLSAEAAALMARIELEIDHQQGRDDEPWVRLETVQGQQWQQHVAVPSGSPANPLSDAALHAKYRSLAARVLPAAQVQQLETLCLTLDNVADVRQVAVLLAT

SEQ ID NO: 157527 - protein, 367 aa, Glycine max
  Coding DNA Sequence Number=SeqID_65842
  Gene Ontology: Mol. function=transcription factor activity; Biological process=regulation of transcription, DNA-dependent
  Homolog annotation: Hit_ID=Q3KCB3; Match level="QueryCoverage=76%, HitCoverage=87%, E-value=6e-78, Identity=51%"; Hit description =Transcriptional regulator, LysR family
  Pfam annotation: Domain name=HTH_1; Domain location=28-87; Score =48.0; E_value=3.4e-11; Accession=PF00126.18; Description=Bacterial regulatory helix-turn-helix protein, lysR family
  Pfam annotation: Domain name=LysR_substrate; Domain location=111-310; Score=32.2; E_value=2e-06; Accession=PF03466.11; Description=LysR substrate binding domain
  Pfam module annotation: Pfam domain module=HTH_1::LysR_substrate; Domain location=28-87::111-310
MESKVSQSGNNANNRGDNAVLALSNIDLKLLRVFKCVVEAGGLTAASHELNIGLAAISKQVSDLEIRLGMTLCSRGREGFELTQYGINVYQATLELFVSLNLFRERLHNSRNELLGDIAICVVDNTISDPHSPVTSAVQQLHQKAPKVQIRLQTAQLDDIERGISEGRFHCGIAPVYEMKNEFDYFELYKEYAKLYCAASHPLYCGSCDKNISVDVLRQQKIINHLYVTPRDERRLIPVQESGVQAVQVESVAMLILTGHFIGYLPEHYAAPFIARGQLCAGVERCGGGALIWCVRPGFCWHGMGKCTLMPSPRPSPTGRGRRSLRARETQPADKGEAASGNSNQNAYVSRLYITVVASSSPAVDSA

SEQ ID NO: 157528 - protein, 205 aa, Glycine max
  Coding DNA Sequence Number=SeqID_65843
GASAVPAGEFLAAGAGPSVAGDQRQRAGDSGGRWLCGLRYPSRRQGVPPAAGDAGGCRSDLSAGGGAGDCRAGHGLWRCAGGDGAVSIWAVADSAGHAGGTGQRSGQQPAGAGGTGDYGRRAHLCDDQHRHRDHRLNRRGGESGFAGDYRSERLQYRLCDSGRAAGGAAGADLRPAAGAVAARTQWFIGKPEKSHEVRHDNAHMR

SEQ ID NO: 157529 - protein, 386 aa, Glycine max
  Coding DNA Sequence Number=SeqID_65844
  Gene Ontology: Mol. function=motor activity; Cellular component=cell projection
  Homolog annotation: Hit_ID=UPI00016621D1; Match level="QueryCoverage =85%, HitCoverage=40%, E-value=3e-24, Identity=36%"; Hit description =UPI00016621D1 related cluster
HTLAFRGLHVLAFIGLHALTFIGLRVLTFRGLHALAFKGLHVLTFEGLHALTFRGLHVLSFIGLHAFAFRGLHVLPFRGLCVLGFRGLHVLTFRGVHVLTFRGPHALAFRGLHILAFIGLHALTFRGLRVLTFRGLHALAFRGLHVLAFVRLHALTFRGLHVFAFIGLHTLAFRGVPVLPFRGLRVLTFRGLQVLGFRGLRVLTFRGLHVLAFIGLHTLTVRGLHVLTFRWLHTVTLRGLHALAFRGLQVLAFIGLHALAFRGLHDLPFRGIHALAFVGLHGLTFRGLHVLAFIGLHALAFRGLHVIAFIGLHTLTIRGLDALAFRGLHVLAFIGLHLQRTISPHLQRTRHPRLQRTTQPHLQRTTRPRLQRATRPRHRGPTHPHF

SEQ ID NO: 157530 - protein, 160 aa, Glycine max
  Coding DNA Sequence Number=SeqID_65845
  Gene Ontology: Mol. function=oxidoreductase activity; Cellular component=endoplasmic reticulum; Biological process=electron transport
  Homolog annotation: Hit_ID=Q2MJ01; Match level="QueryCoverage=50%, HitCoverage=16%, E-value=1e-30, Identity=74%"; Hit description =Cytochrome P450 monooxygenase CYP704G7
VRWDDIEAARRNRVSPLEIEPSGSASNSINLMSAGLKWTRIGMTSVKLEFPTPALSAPLTLLVVQILFRKLNKRHNRKNYHPVADTIFNQMLNFNRLHHYMTDLAAKHRAYRLLNPFRYEVYTTEPTNVEYILKTNFENYGKLPMLKILLGGMGMCGDDM

SEQ ID NO: 157531 - protein, 51 aa, Glycine max
  Coding DNA Sequence Number=SeqID_65846
MADRGRGGGRRTFNRGTRRGTHSLRDPITTNPSPSSIHISTSELELMKHWA

SEQ ID NO: 157532 - protein, 169 aa, Glycine max
  Coding DNA Sequence Number=SeqID_65847
  Subcellular localization annotation: CTP_CleavageSite=35; ConfidenceScore=5.69e-01
MPIQQRAPAQPQRAPTQNLAPTQPRPIGSSNQSTSANLGRNFLVKKLAEFAPIPMSYANLLPSLVANQMAAVQSLIDASWLTFQEDGPNIKTNPLPSHGRPVVNAVEECEPQMPKQLKDVVTSRRFILKALCEAGIICFDGGEGDTFLIHPGAAHDVEACPVAEDCCKG

SEQ ID NO: 157533 - protein, 110 aa, Glycine max
  Coding DNA Sequence Number=SeqID_65848
  Subcellular localization annotation: CTP_CleavageSite=50; ConfidenceScore=5.02e-01
MNNCLLAKSMNTLEVTSLLKSLQVLAHIRYLAPFRMRFTSLQRITDSLIRGRSTSGVQGKLRCLAIAITVYYIWLPRNKLIFENYQFSVIEVISKIKFLMYRQAHLLHLF

SEQ ID NO: 157534 - protein, 79 aa, Glycine max
  Coding DNA Sequence Number=SeqID_65849
MPHPNTAGASQPHPIPPLHFSVGGPPSTTKEKGQLDLIKERLRAVEGSGDYPFVDMTDLCLVLDVVIPPKFKVLDFDRY

SEQ ID NO: 157535 - protein, 129 aa, Glycine max
  Coding DNA Sequence Number=SeqID_65850
MFDGGGAVTATDGPRLAVPWRYAPEKPSEKKEEVTGINLLIAKVTNITGLSGVTRSGRVFVVPNPSMRPMDAKGKAKVVVEETNQAGPTLDEDVLTGRFAEKGGDSSGRKVAIEEANDFAHLIKGCRPL

SEQ ID NO: 157536 - protein, 87 aa, Glycine max
  Coding DNA Sequence Number=SeqID_65851
MTPTHDALLYYKGRWNMPRQHKFVGYSFTGKNLKKFYIPFGCTMDEPKDLIKQVAPHGIPPYGMHETQTVMEMEDDMSWSQHDSMQN

SEQ ID NO: 157537 - protein, 179 aa, Glycine max
  Coding DNA Sequence Number=SeqID_65852
PCDERWSVVLHGKTIGVNVEDDDSYIDTYVSSLSTQMSPNIVGEEEADDVHANRNDHDEGELINIQMATPPSSPPPPPPPTGIASQSLSTLKRTRKATRLRSLADELKNSTDKHVWLGVVIGWVTFWKVSQEACETFIDPKSRQRRLSMSQKRLSTMGSNWWRVMTNEELSKVSSREVS

SEQ ID NO: 157538 - protein, 54 aa, Glycine max
  Coding DNA Sequence Number=SeqID_65853
MDKSLREEEDEWRERKKRSTKFCASNELWFNPLIQDQVQDSPLSALRYHEACKA

SEQ ID NO: 157539 - protein, 113 aa, Glycine max
  Coding DNA Sequence Number=SeqID_65854
GDGGGGDDNDNGGGCYDRDGGEGAMTVVVVMVIVVATMEAVIRVVVAKATTLMIGLVTMAMVETKVMTMVIVAVIVVVTVREGRAKRNSNPRRNYAERAGAHWAQFQPERELR

SEQ ID NO: 157540 - protein, 109 aa, Glycine max
  Coding DNA Sequence Number=SeqID_65855
  Homolog annotation: Hit_ID=A7QXA9; Match level="QueryCoverage=73%, HitCoverage=15%, E-value=5e-25, Identity=68%"; Hit description =Chromosome chr19 scaffold_218, whole genome shotgun sequence
MWEKLHITGMHVEGKVLVGVKLLPTWSIIGRLRVCFVEPPYFQMTVKPMFACGLDVIELPCIAGWLVKLLSIAFEQTLVEISGSLCERSNGCIQIQDKNTKENTYSKMV

SEQ ID NO: 157541 - protein, 74 aa, Glycine max
  Coding DNA Sequence Number=SeqID_65856
  Gene Ontology: Mol. function=aspartic-type endopeptidase activity; Biological process=DNA integration
  Homolog annotation: Hit_ID=A5ATT1; Match level="QueryCoverage=60%, HitCoverage=40%, E-value=5e-08, Identity=62%"; Hit description =Putative uncharacterized protein
MMADGDKKALLQKAHSAIILSLGDKVLRQVSKETTAAGVWSKLEDLENIDVTIDDEDQALLLLCSLPKSYSHFK

SEQ ID NO: 157542 - protein, 169 aa, Glycine max
  Coding DNA Sequence Number=SeqID_65857
MVRTKGLEHTLGRTIGKALRSREASDDDNDVPQRRRPIAYSRKQRQKARAIEDPSTAAMELNEKQQQPPVEDDVININDFPSGPHDTSVLRDFENHVVAFVDRVKEHDEAACRITLLQIYEHFPSVGSAIATKDYDQQRPCACQWTSGKALSVSMYRRRLDRLTSDVVC

SEQ ID NO: 157543 - protein, 257 aa, Glycine max
  Coding DNA Sequence Number=SeqID_65858
  Gene Ontology: Mol. function=catalytic activity; Cellular component =peroxisome; Biological process=fatty acid biosynthetic process
  Homolog annotation: Hit_ID=A7PLT1; Match level="QueryCoverage=34%, HitCoverage=17%, E-value=4e-24, Identity=64%"; Hit description =Chromosome chr14 scaffold_21, whole genome shotgun sequence
  Subcellular localization annotation: CTP_CleavageSite=69; ConfidenceScore=5.19e-01
MPFPLSLCPSFPLCSFLFPFGPPFPSSFALNYHDPFPFLHPQPPRAPIFFSLLCTSQDHYCTSLGDVAHSSMLGYGLTESAVTRITPEEANRVGATGKLIPSIEAKIVNPETGEAMFPGEQGELWIKGPYVMKGYAGDPKATSETLVDGWLRTGDLCYFDNEEIILYKRAVQDKNLLLKRTGSGSSPHHPSSHLLPLSCTKCDSCILKSNLQFLTFEVNKFVLMCCFVQYSLILEIAHECEINQLTQQERVVEVERK

SEQ ID NO: 157544 - protein, 356 aa, Glycine max
  Coding DNA Sequence Number=SeqID_65859
  Gene Ontology: Mol. function=catalytic activity; Cellular component =peroxisome; Biological process=fatty acid biosynthetic process
  Homolog annotation: Hit_ID=A7PLT1; Match level="QueryCoverage=79%, HitCoverage=49%, E-value=3e-49, Identity=40%"; Hit description =Chromosome chr14 scaffold_21, whole genome shotgun sequence
MRECKCTPRDNLDPPHGDNWHKYVLHPSHIFLFLVALLAEHESRTSTCSPVVTDPRSGFYRDSRTFHSLKPPLRLPLPNAAVSVASFALSLRCNSLFPDSSTTIIDSATSHRLSCGELLHRAKTLASNLTTILKLTKGDTALVLYPNILQVSILYFALLSLGVVVSPTNPLSTRFELTHFFNISNPTIVFTVTSVVEKTRQFQVKTVLLDSPEFDSLTKSQIQSKTGLTKGPYSENEHVSNTPVTQSDVAAILYSSGTTGMIKGVMLTHRNLTAIVAGYDTVREKRKEPAVVLFTVPFFHVYGFSFSQGAIMLSETMVVSNSAQVRPTPTRLRPARVKSAPIHLKDYHVDNVHGPP

SEQ ID NO: 157545 - protein, 347 aa, Glycine max
  Coding DNA Sequence Number=SeqID_65860
  Gene Ontology: Mol. function=catalytic activity; Cellular component =peroxisome; Biological process=fatty acid biosynthetic process
  Homolog annotation: Hit_ID=A7PLT1; Match level="QueryCoverage=95%, HitCoverage=60%, E-value=4e-85, Identity=51%"; Hit description =Chromosome chr14 scaffold_21, whole genome shotgun sequence
  Pfam annotation: Domain name=AMP-binding; Domain location=68-347; Score=-38.5; E_value=9.7e-06; Accession=PF00501.19; Description=AMP -binding enzyme
  Subcellular localization annotation: CTP_CleavageSite=79; ConfidenceScore=5.23e-01
MDERKRIDPRSGFNRASRIFHSLKPPLPLPPPNATFSATTYALSLRRNSLFPDSTTALIDATTGHRLSHYEVINRIETLANNFTSILKLSKGDTALILSPNLIQVPILCFALLSLGVVVSPANPISTRSDLTRFFHLSKPAIVFTVTSVVEKTQDFHVRTVLLDSPEFDSLTKTRIQIHPPSPLVSPVTQSDVAAILYSSGTTGMMKGVVMTHRNLTALAAGYDAVRVNRKYPAVFFFTMPFFHVYGFTLSFRAMVLSETVVIMERFSLRGMLSAVERFGVTHLAVVPPLMVALTKDSVTNGYDLKTLEGVTCGSSPLGKETAEAFKAKFPNVMILQVCLRKSYIMT

SEQ ID NO: 157546 - protein, 52 aa, Glycine max
  Coding DNA Sequence Number=SeqID_65861
MITKDDDKGDDKKLKGQSKNEFKIFKIESRIKIQEIKISRIKIRLNQDKYEK

SEQ ID NO: 157547 - protein, 69 aa, Glycine max
  Coding DNA Sequence Number=SeqID_65862
MVFESDSDLASPRSTKLRASLAMQMHKLQKIVEKRMRERFDEIQRSTQELSGRMKDIERKRHHWLPYSS

SEQ ID NO: 157548 - protein, 64 aa, Glycine max
  Coding DNA Sequence Number=SeqID_65863
  Subcellular localization annotation: CTP_CleavageSite=47; ConfidenceScore=5.27e-01
MSRGSQVSSLGRGLGYQPWCTSSLFHCQSRYHGAPPRPLSRFVVPFRAYSTTTQQQNPFPQISS

SEQ ID NO: 157549 - protein, 45 aa, Glycine max
  Coding DNA Sequence Number=SeqID_65864
MAEKKKGEVRRSFQQGQPPMRNWMYRTLAQMGMSNQGLPLCPYWK

SEQ ID NO: 157550 - protein, 126 aa, Glycine max
  Coding DNA Sequence Number=SeqID_65865
MARAPDNIKSINGSKEALKLAIRITDLWFVGTPNRSEQAEMVIIDSHEGDIDLNVSPLALDKLLGYVLAFKIKVQPKFNNVVVLRYSNDLDLINVVVDMLPDAEACSNVHAPILDSDDPFQLESIS

SEQ ID NO: 157551 - protein, 182 aa, Glycine max
  Coding DNA Sequence Number=SeqID_65866
MASRNENVPAEVYYDAYVVDCDKGIQFKGGNKTQLLGGSLNYYETTPQLNEHSQLNVDPTTDIHVAQSESNEMSHDYHAQNGLPDEVVGDFNDDEDEILADNNNNNNNDNDIQFLFPKTSTKNVYRPSPNSADVSDNQVPDNPDYRHFLDQQQQSNLHDNELYVGQRFCQLEDLKRRKDVEH

SEQ ID NO: 157552 - protein, 137 aa, Glycine max
  Coding DNA Sequence Number=SeqID_65867
MTFLGETSSWTIANSRLAFIFPNGSITHNQTGVYFQSPTPTPITPDGILNLLQSTITSTHDAMLYYNEKWNIPHQGGFLGYSFTGTNPIRFDIPLRRNIKKLKDVIKQVAPLRVLPYGIHESQVVKRLFFRQLDHTK

SEQ ID NO: 157553 - protein, 213 aa, Glycine max
  Coding DNA Sequence Number=SeqID_65868
MVIDTAVWKEVVDLDMGGVCKFDEAPDGYNKMQTYRGILLDPARNLRNRLGVGGQTIEDRMLVYLITYILILRSSNHAQVTDDDLHIVYGLKSSIKMNWVLLIEDIMLKSCHLVDYEFPCVVLASRFIDYFNFDVSNRIVDFTKASSEIIKRHLKKLGMRFSKKSLYSQVSPNALKWKFKFGIKAKKGEIVRDRGSNMKKLEKVVFLHVQLFE

SEQ ID NO: 157554 - protein, 200 aa, Glycine max
  Coding DNA Sequence Number=SeqID_65869
MVKEKCKEVSVSSKRLAKKESHFAIKIKIKETFPLRQPPHLLFCKKTLVSTTTPFGLEVIPQVKELLNEGLVRIIRHQIPKIGDMMNVLSGATLIFKITHAPNIFMIRVHRDSLGISTDPKRIKVIPEWPTPPSIRKIWGFHDLTNFYKREETMSFKNLFKGRGNDEILPPRELDRRLQEDWARDAKEGPRVLMSLRVDF

SEQ ID NO: 157555 - protein, 120 aa, Glycine max
  Coding DNA Sequence Number=SeqID_65870
  Pfam annotation: Domain name=zf-CCHC; Domain location=79-96; Score =10.9; E_value=0.034; Accession=PF00098.14; Description=Zinc knuckle
MKLQAELSYLKDMFGKMNKENSDLSHLLSVQKHTTDKTSLGYNKKTTFSKKTKFASSKKVNPNKVSKKKNIVHSKPKAKTCHYCMKRGHTSYKCYVRRFNVPRGVPKGKGLAMVLGKWLL

SEQ ID NO: 157556 - protein, 192 aa, Glycine max
  Coding DNA Sequence Number=SeqID_65871
  Gene Ontology: Mol. function=serine-type endopeptidase inhibitor activity
  Homolog annotation: Hit_ID=P01070; Match level="QueryCoverage=69%, HitCoverage=63%, E-value=3e-26, Identity=48%"; Hit description =Trypsin inhibitor A precursor
  Pfam annotation: Domain name=Kunitz_legume; Domain location=1-146; Score=83.6; E_value=6.4e-22; Accession=PF00197.9; Description =Trypsin and protease inhibitor
SIGWNKSNRNWKRNMPSHSCAISHELDKGIGTIISSPLKIPFIAEGYPLNIKFGPFLVITLCSSIPSDWTIVNGLPEGPAVKIGAQKNTEDGWFKIEKASPFGYKLVFCPLLEDSTCWDIGIDIDDNGIRHLVVSKVNLLLVVFQKFDEAPLALNNLVLPSTQIKLEDRPSTGTKHYPGLILVIIYAQQNGP

SEQ ID NO: 157557 - protein, 108 aa, Glycine max
  Coding DNA Sequence Number=SeqID_65872
  Gene Ontology: Mol. function=SNAP receptor activity; Cellular component=integral to membrane; Biological process=intracellular protein transport
  Homolog annotation: Hit_ID=Q2HSW7; Match level="QueryCoverage=98%, HitCoverage=43%, E-value=6e-27, Identity=59%"; Hit description=T -snare
MQKNKASVAALNAEVRRTKGRLMDELPKLRKLMHKKVDLVLALLERIQAIPNGTSGAVVQTTGWTTTSSQPHINFDSSEGHLASDYFLQSEESSQFRQEYEMRRMKRL

SEQ ID NO: 157558 - protein, 700 aa, Glycine max
  Coding DNA Sequence Number=SeqID_65873
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A5C6S7; Match level="QueryCoverage=98%, HitCoverage=65%, E-value=2e-84, Identity=32%"; Hit description =Putative uncharacterized protein
MSVRGGDADVFQKNCLEFNLYEPRRDKTVKGQLLATGVVDLAEYGALKESLSTSVPMNCKRSYRNTDQPLLFIKIRPVERNRASALLKDSNGGDSVSTLMNEEYAEEAEIASFTDDDVSSHSSVAAVSTSIESTGFTQPKFGTNEPISNNTGVNAKKHPLASERRLENMNMVQEDTHKLERSSYVSSTDVSPVIRSLVNGHASNSPNRNSLSIQKLAASPSADSSSPSSVCDNLDINPRSMTRSSGHESLGQSFHEKLANYRNIVADVQRNSNESTFGIYSKHTSSQDRGHFTSKNPGYENFDTTKCDDKLNGRCKEADKYFMKERSNLDGNERSNLDGQNYIEDEQLVAQEARDQALLGSNTHSYGESNTSMQENILKSERLKNTKSVRLPGDSVRNAELNENGILGDAQNSSGNRSNDRRDSKILAKEIRSGTLDGKIEHLEKKIKMLEGELREAAAIEAALYTVVAEHGNSTSKVHAPARRLSRLYLHASKENLQERRAGAAKSSVSGLVLVTKACGNDVPRLTFWLSNTIVLRTIISQTVKVPPNPAGSGRRKKTEGEEGCGKITTSLRVKGLYPRKTENTALGYEGFGNWDDPHIFILALEKVEAWIFSRIIESIWWQTLTPHMQHTMVTNKEVMSATRKDYRRTSSSCDQKQGNLSLYIWKNAFREACERVCPIRARGHECGCLSMLSRLVSLI

SEQ ID NO: 157559 - protein, 91 aa, Glycine max
  Coding DNA Sequence Number=SeqID_65874
MDKATPSIPRLAPTIEQIKRDNSELPPTTQYQLPKVKDNNNKSSMTTPFKLKDVNKEITPKDIGSLMEHANYTNKYLQVLGESISKEKGLY

SEQ ID NO: 157560 - protein, 676 aa, Glycine max
  Coding DNA Sequence Number=SeqID_65875
  Gene Ontology: Mol. function=RNA-directed DNA polymerase activity; Biological process=RNA-dependent DNA replication
  Homolog annotation: Hit_ID=Q1RU73; Match level="QueryCoverage=61%, HitCoverage=87%, E-value=1e-65, Identity=36%"; Hit description =Putative uncharacterized protein
  Pfam annotation: Domain name=DUF247; Domain location=1-413; Score =124.3; E_value=3.5e-34; Accession=PF03140.6; Description=Plant protein of unknown function
LVSIGPIHHGAEKLQLGEKYKLMWAAMYLERTKQDAQTLYQKIASNIEQLKDLFAEDVIRDFPDDEKLSWSWMLFVDGCSLLQILEKGELQDPKEMNVKVDQLVLVWQDVLLLENQLPYHVLKLLSDHEDDAKLVKSMNEFLKCHHLSPELRSKKQDIGNSMTKDEHRALDEEGYTSVYVKNEDILHGEHKIEISQESPIHLLDQLRRYVLDDPHKKQKNETGNVKKEDQNTNEDLDMTTYRNIQELRAAGIKLKRDKSRRRLRDVSFSYRWMCLCAELTLPQITVDDTTTPTFLNLIAYEMCPDFKNNFEICSFVVFMDSLIDHPEDVKELRAAKVLHNALGSDEDVAKLFNTISADLVPDMESYLHVRRQIEKHYRSKYRTWIALGYHTYFSNPWAVIAFHAALVVLVLTFIQTWSLSGSAHRPSTSAHKVPLNLPHTLLTKLLPEKRVQANIAQMSSLEKVSLNINPHFLKQDDAVGGGEEGEDVGDEVAHAVAEGGPMAEVLREVHLLRRPEGGLDFLIHFPNFKVEKKMHVVQGRMEDLENQLNQNTGRHYGGNRVGNVGLTQHRMEGQNRIEGVKLNVPPFKGAGDRYIDRDEKGDAKEEYYKEMEKTLVRANIEEETEDTIAHFLSGLNSNIRDVVELQEYVELDDFLHKAVWATEIWMTPLPVKEDKS

SEQ ID NO: 157561 - protein, 69 aa, Glycine max
  Coding DNA Sequence Number=SeqID_65876
MGDDRGRGWWLAKDRSRDFLVVVVEAGSEVDRNGREGKGCSGTDLEASNEAMEHSMKVNGSSSLYCFYL

SEQ ID NO: 157562 - protein, 105 aa, Glycine max
  Coding DNA Sequence Number=SeqID_65877
MDSRRLTSQGRLTWWLGEEEEVFKMFGTTKSSFSPLSCNLVQSTNKVKVTVAKPHSSVGKKDPPGNKAHDVKQALSRSGIGGLTGLSRQAAAAAAAATEVQARQP

SEQ ID NO: 157563 - protein, 128 aa, Glycine max
  Coding DNA Sequence Number=SeqID_65878
MSKMLMNDGHIYGKRVFAAAVQLPRFTRKKGMNGNKLKVTLKETNSQPFLNEHDYMNAKLKRISQTRAVLKVFPRGSPFSRNWPCMAPVLMAPRGQGSAIPSSVFAFAELALEAPAAVATSVQEKLQP

SEQ ID NO: 157564 - protein, 172 aa, Glycine max
  Coding DNA Sequence Number=SeqID_65879
MVVTVRSERVLRQLGYILSIPSPPVSASLSYDDIDDRWMHFSDHVVAVGDLCVVPGQVSADYMEWFFQISHPFMIPIQASDQPRHAPAPDHEDYMQPDIPQVPVAFDPPQHAVDDYEGYEAIAERLERVLNLRMVTAGTKLHDIMQDCLRIVRGGASTDGSVRARQRRHTKL

SEQ ID NO: 157565 - protein, 74 aa, Glycine max
  Coding DNA Sequence Number=SeqID_65880
MTLSPCEGEDLEREGGREGTEGEARSPIEDGEGLEREGGREREADTEPLPWREAVEGKGLERDSSREEIQESEK

SEQ ID NO: 157566 - protein, 156 aa, Glycine max
  Coding DNA Sequence Number=SeqID_65881
MHLKCDTSVEASFMMMNQAILMMPKAQVIDSRLIQDFKIKHQESNPRFKIQKKKSRSNKGYIYLGCNTENKRGYISCGSVQVEGTSTWFFKENKEGYIPCGSMLVKDFTRINIEGDSDPQTNHLNNVVELRSTQLTQDTAVSVTANTMVSATADTG

SEQ ID NO: 157567 - protein, 113 aa, Glycine max
  Coding DNA Sequence Number=SeqID_65882
NDPDTGDSDKCRLYIKENPPRLVALGRVYEGSTTVGVEEVKDAEAPVPIPTNEVILVGQTINTFLAWPTHLVKRLSEQAVVSLVKPPDRPDHEVDDPLYLMTLIIPQLFLKPM

SEQ ID NO: 157568 - protein, 48 aa, Glycine max
  Coding DNA Sequence Number=SeqID_65883
MVKYRAKSKTEMNRGTRGRVRMDARPVTNRLLSRIRLRTIEKRYWEVA

SEQ ID NO: 157569 - protein, 119 aa, Glycine max
  Coding DNA Sequence Number=SeqID_65884
MHRRLQTHHQHLIRLIQLGHLAWSGIYSTWFASRRPNHRGQVQTHECLYQLSLSLQSQGFAPFACPTSDQFRAEVAWPGDWPEAQAGEAPVEAPGDAEEVCMDEEMSDLLGFLGGSGAT

SEQ ID NO: 157570 - protein, 83 aa, Glycine max
  Coding DNA Sequence Number=SeqID_65885
MLGLTNDSPQISASPHQLDFAPYASGPYNAQWNAPGLLHDTHTLLSSRILREMEVEEPWLRLRLPLNYQVDMGANHHRTPELG

SEQ ID NO: 157571 - protein, 259 aa, Glycine max
  Coding DNA Sequence Number=SeqID_65886
MPSSPRRDFSSYLAEAPKNPSQHLPICPISTKLFGLCRKPLQSSAHPAKGTRSNTKGPHSKLGSYTTSPHQQLHSGHKLQSRKEFSGKETCEIQSHPDVIRRLATIFDRQPNGSGDPWEFSSFLSLNEDGPNVKTNPLTSHGGLAVITVEECGPQRLKQMKDVVTSKRFILKALHKAGIICFDGDEGDTYLIHTGTAHDVEVYPVAEDLLQRIMDQGRFEVSGARKWEQHVCMQSADKSPSKPKPLVIHFTEDAATQKP

SEQ ID NO: 157572 - protein, 71 aa, Glycine max
  Coding DNA Sequence Number=SeqID_65887
MGSCKKGVQRQDWCSLILRSGRVCCCRNMPFCGRAKVRVTGALSKGGKMRGVATNVYLWKTSEKPKETGSK

SEQ ID NO: 157573 - protein, 118 aa, Glycine max
  Coding DNA Sequence Number=SeqID_65888
VDSRGSHLHALAFRGLHVLAFRGLHALTFRGLHALAFIGLQALAFRGLHVLTFRGLHVLAFRGLHALTFRGLHVLTIRGLHVLAKMCLASIIRQFVKFQDMPKNQFVKFPGSWEHKEW

SEQ ID NO: 157574 - protein, 107 aa, Glycine max
  Coding DNA Sequence Number=SeqID_65889
MKPADRPDHDVDYPLYLMTLTIPQLFLKPLQVMWDAIVFGDFNDNFPLYIKHEGLFEIAHDGQCLSISVIQLWILHMSETSMQAGNVDVYGFLEPQSIQRSGQSQFE

SEQ ID NO: 157575 - protein, 135 aa, Glycine max
  Coding DNA Sequence Number=SeqID_65890
MQQQQQQQKQQATEAPSQPSLEELVRQMTIQNIQFQQETRASIQSRTNQMGQMATQLNKAQSQNSDKLPSQTVQNPKNVSVITLRSGKQIEVPPPVAAPAPEPVKLHSTPEKEDEIVAQKRKLPDHERANKNFHA

SEQ ID NO: 157576 - protein, 62 aa, Glycine max
  Coding DNA Sequence Number=SeqID_65891
RAVASSDDASEMIIRGGDGVTTSSSGEGGGFTTGVRGSVGISSTCAGASSRGAASLGLPNGS

SEQ ID NO: 157577 - protein, 214 aa, Glycine max
  Coding DNA Sequence Number=SeqID_65892
MTEGCGEGFCLANLPGDAFSLWGNFFEAKKQMMADAKFAGLLGLGKPLVEILPPGQLRGFCPLLAWLGSRCWVMAPILPTLACAPLAKSVPRWWIIMQNEREPTNGSLFWPNIVEEERDTGLIGEGRIKATRAESQWIVAARPLCHLQYPVAYLSRLQGFYPPLDGNCASRRLVGLIRLTRVTNGTCLWGAEAPYCWSANGRRAHASLLARILT

SEQ ID NO: 157578 - protein, 82 aa, Glycine max
  Coding DNA Sequence Number=SeqID_65893
MNRTRNLGMMVVCFRTSEPIMVRTRGLGRALGQVTGRGVGRGDRDDSDDAPQRRRPTASARRQRVAVTADHIDEPVIPAPDV

SEQ ID NO: 157579 - protein, 77 aa, Glycine max
  Coding DNA Sequence Number=SeqID_65894
MYKSYLNQKQASDQEVHPYLKFEAPQCRGVLHDFENGFSLQFGVEMEKNFGASMEASMVEKKKEEKQHGREEKLMNF

SEQ ID NO: 157580 - protein, 87 aa, Glycine max
  Coding DNA Sequence Number=SeqID_65895
MHFIIFFSDSYRLFTFMVATRLEEASFMMMNQVDSSSFDDGIKPKRMISRLSQQGQDRDKIKINFKIQEMTSRRIKIQEKMISQEKN

SEQ ID NO: 157581 - protein, 61 aa, Glycine max
  Coding DNA Sequence Number=SeqID_65896
MFSGLDLTDSSECRPWGVTLTSLPMILPSESDWTYKCMIVRWMAIENLMLEDVGTQCSDRM

SEQ ID NO: 157582 - protein, 185 aa, Glycine max
  Coding DNA Sequence Number=SeqID_65897
DYTKNQYQPEASIVERYVAEEAIEFCSQYIEIVQYVWLPDQDPCDSRLSVLLQGRPIGISNQNDDSTLDICETLAFSTKVPFIIEENEVDDDHGNIAKVPFAFKLSFRGGSGPQKQKFHNYLGVIAREKIPIVHSNGKDVPESQKDLVWDDIWALDRRLQEDWARDAREDLRVLMSLRVDFRSMG

SEQ ID NO: 157583 - protein, 99 aa, Glycine max
  Coding DNA Sequence Number=SeqID_65898
VRGCEHATDAGHAAQPHDIGYLGRQRADVGGFFLPFAWRCIPPWNCMAVLYGNEIGLTTEGYQGVWGAASLVKYITKSLGFPRPPSSADCMHMCCSSPP

SEQ ID NO: 157584 - protein, 197 aa, Glycine max
  Coding DNA Sequence Number=SeqID_65899
MRAKARVMSEIKEVQEQMKADMEPMKEQMPTMMESMMSMRKMIEVNTVTVVAASTATEVDPTHPSSINQASHLVPDMIGQGGEALGSTGSPHFVQVQSKHSFRPYGLPPNYTPPNVAHAPDENVDNSAPIPIESQQHKSGHAQVPQPMGERPEVPRDHTLANFEPHLGYATKGQAFGGMPLPNPLGGPQYRPQPHLQ

SEQ ID NO: 157585 - protein, 198 aa, Glycine max
  Coding DNA Sequence Number=SeqID_65900
NVIRAPRLLAPKQQCRPSICIGEIGNQVDTAHGHDSHMCRLSMLKHNFTLDETELELHKARPRGQIREGADERENGVAAQNDSQSPVAASFPCVLSDFNFSFSLLLAFDEGFIVNGLVWVATVTEGAMVCLKWRFAEAENEFHRARNQELVNICKRNHQSDRSKLDVQQKRKFKLKEGKLKERRLRLNMKQSDRLWQK

SEQ ID NO: 157586 - protein, 112 aa, Glycine max
  Coding DNA Sequence Number=SeqID_65901
MQKRFTHTVNHLASLGRIFPNKDLINKVFRCLSRDWQPKEHEMELQRLNQHEENDKRKKGIALKASSSIQEESDNEDLEEDEDLNIFVKRFNKFLKMRGNQRRQNFKPKRRT

SEQ ID NO: 157587 - protein, 80 aa, Glycine max
  Coding DNA Sequence Number=SeqID_65902
MRGYLMVTRTFRQPGENEPIDGRRLTSSSAPFVVLTMKSGDMRSYLMVIRTFREPAENKPVDARRLTLSSAPFVVLTLEV

SEQ ID NO: 157588 - protein, 262 aa, Glycine max
  Coding DNA Sequence Number=SeqID_65903
  Gene Ontology: Mol. function=hydrolase activity; Biological process =lipid metabolic process
  Homolog annotation: Hit_ID=A4W692; Match level="QueryCoverage=73%, HitCoverage=93%, E-value=2e-74, Identity=80%"; Hit description =Transport-associated precursor
  Pfam annotation: Domain name=BON; Domain location=141-198; Score =41.0; E_value=4.2e-09; Accession=PF04972.8; Description=Transport -associated domain
  Pfam annotation: Domain name=BON; Domain location=62-125; Score=59.1; E_value=1.5e-14; Accession=PF04972.8; Description=Transport -associated domain
  Pfam module annotation: Pfam domain module=BON::BON; Domain location =141-198::62-125
MTRLKISKTLLAVTLGSVLVSGSALAESSTMDKAQSTADTAGQKIDSSMNKVGNFMDDSSITAKVKAALVDDEAIKSTDISVKTDKKVVTLSGFVESQAQAEQAVKVAKGVEGVASVSDKLHVRDGKNASVKGYAGDAATTSEIKAKLLADDIVPSRKVKVETTDGVVQLSGTVDSQAQSERAESIAKAIDGTAAWAAKIVFVVGQLALVCEGGGQRGIFTAGVLDEFMRAQFNPFDLYFGTSAGAQNLSAYVCNQPGYARK

SEQ ID NO: 157589 - protein, 104 aa, Glycine max
  Coding DNA Sequence Number=SeqID_65904
MGDLLGVDLRHEFSTETEQQGRRQHARRNPDRQARRFRVYGVGLREKRFKAYGLGFRVYGLGLRVYGLVFKALVLGLGLRVYGLGFKALVLGLGLRVYGLGFKA

SEQ ID NO: 157590 - protein, 146 aa, Glycine max
  Coding DNA Sequence Number=SeqID_65905
MGLNIEKLKNIVISLEMATTVEVEVRKVVVVSEPMVVVEVQERMTLRLANCIVMAFYTERQNYSFSYRWCPTKGSIAWPIMSGTSSRVTVLSEACRVESRISFIDYRYLVIDCTIVCDMNDNGMEKEEREETPLQGEDESRRSSPS

SEQ ID NO: 157591 - protein, 154 aa, Glycine max
  Coding DNA Sequence Number=SeqID_65906
  Gene Ontology: Mol. function=oxidoreductase activity, acting on NADH or NADPH, NAD or NADP as acceptor; Biological process=electron transport
  Homolog annotation: Hit_ID=A8GB23; Match level="QueryCoverage=100%, HitCoverage=66%, E-value=4e-74, Identity=88%"; Hit description =NAD(P)H dehydrogenase
  Pfam annotation: Domain name=Flavodoxin_2; Domain location=2-154; Score=74.6; E_value=3.3e-19; Accession=PF02525.8; Description =Flavodoxin-like fold
MSRVLVLKSSILGEYSQSGKLVDFFVEQWRETHPEDRFTVRDLANPTLPELDGEVMAGFTAGDKPLTPHQQSTLALSDELIAELKSHDTLIISAPMYNFNIPTQLKIYFDLIARAGQTFRYTSAGAEGLVTSKKAIVISSRGGIYADTPTDLIT

SEQ ID NO: 157592 - protein, 44 aa, Glycine max
  Coding DNA Sequence Number=SeqID_65907
MADEQHQRITLEDYSSSSVPQFFTSIARPEERPRGGFTRLRVIV

SEQ ID NO: 157593 - protein, 57 aa, Glycine max
  Coding DNA Sequence Number=SeqID_65908
MDQVQRQSFSKLAPTIEEFEGILGCPIGGRKPYLFSGYYPSMERVVGVVKILECELD

SEQ ID NO: 157594 - protein, 70 aa, Glycine max
  Coding DNA Sequence Number=SeqID_65909
MGYYQTSESKLSPVGICPGLPCLFLSVSVGFRDMKLAKYSLKAQVEKDEGPSGEGQSPRVEKDEGPSGEG

SEQ ID NO: 157595 - protein, 250 aa, Glycine max
  Coding DNA Sequence Number=SeqID_65910
  Gene Ontology: Mol. function=nucleic acid binding
  Homolog annotation: Hit_ID=Q8H0P8; Match level="QueryCoverage=99%, HitCoverage=94%, E-value=2e-86, Identity=65%"; Hit description=RNA -binding protein
  Pfam annotation: Domain name=RRM_1; Domain location=146-227; Score =18.5; E_value=0.0029; Accession=PF00076.13; Description=RNA recognition motif. (a.k.a. RRM, RB
MADGYWNRQQAFLPHSGMLKRPRSDYGNEMHNHVARDDDRTGHRMLKDTQTIGSAYDHYLQSGQLSSFTSGEVSAVGGLGLARGGGGGLSGHSLADPAVMGRHGGGGSDLAPNGRGVNYGGQLPVDAVSRPGPETGSLPPDASSTLYVEGLPSDSTRRELFIFLNLTLDIFRPFVGYREVRLVSKESKHRGGDPHYLCFVDFANPACAATAMSALQGYKVDELNPESSHLRLQFSRYPGPRSGPAFRSKR

SEQ ID NO: 157596 - protein, 120 aa, Glycine max
  Coding DNA Sequence Number=SeqID_65911
MRGTRQVGGEFHGERNPWRRGWPWRLRGGPGWQRKVRHLPLKSGEEGSRRLSFHLQQSILLSPLLHVDSMQESSRRPCLKLSSACLSLSMHFTCDEELNPRMDAWVCKKHTNIANKIFRE

SEQ ID NO: 157597 - protein, 57 aa, Glycine max
  Coding DNA Sequence Number=SeqID_65912
MAFGLTIDSGFGGGLACLGETGYLCPFGSFGGARSKKGRDLLKDGYWVAFTGCVNQI

SEQ ID NO: 157598 - protein, 57 aa, Glycine max
  Coding DNA Sequence Number=SeqID_65913
MVFGLTIDSGFGGGLVCLGETGYLCPFGSFGGARSKKGRDLLKDGYWVAFTGCVNQI

SEQ ID NO: 157599 - protein, 168 aa, Glycine max
  Coding DNA Sequence Number=SeqID_65914
  Gene Ontology: Mol. function=receptor activity; Cellular component =integral to membrane; Biological process=xylan catabolic process
  Homolog annotation: Hit_ID=A7QGE1; Match level="QueryCoverage=100%, HitCoverage=82%, E-value=9e-38, Identity=49%"; Hit description =Chromosome undetermined scaffold_91, whole genome shotgun sequence
  Pfam annotation: Domain name=LRR_1; Domain location=16-38; Score =12.7; E_value=1.3; Accession=PF00560.24; Description=Leucine Rich Repeat
  Pfam annotation: Domain name=LRR_1; Domain location=40-61; Score =12.7; E_value=1.3; Accession=PF00560.24; Description=Leucine Rich Repeat
  Pfam module annotation: Pfam domain module=LRR_1::LRR_1; Domain location=16-38::40-61
NNLNGEIPDEIGNLNLLEFLDLSRNHFSGKIPSTLSKIDRLSVLDLSNNNLIGRIPRGRQLQTFDASTFGGNLGLCGEQLNKSCPGDETIAKPQGLAIDGEDDNSIFYGALYMSLGFGFFTGFWCLLGTILLWQPWRITYMRFLNRLTDYILVTMEVNMGKCYRWLTG

SEQ ID NO: 157600 - protein, 110 aa, Glycine max
  Coding DNA Sequence Number=SeqID_65915
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=64%, HitCoverage=69%, E-value=2e-33, Identity=95%"; Hit description=LacZ protein
MQGRVNMIRLTSRKGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 157601 - protein, 586 aa, Glycine max
  Coding DNA Sequence Number=SeqID_65916
  Gene Ontology: Mol. function=ATPase activity, coupled to transmembrane movement of substances; Cellular component=integral to membrane; Biological process=transport
  Homolog annotation: Hit_ID=A7QTU6; Match level="QueryCoverage=96%, HitCoverage=56%, E-value=0.0, Identity=55%"; Hit description =Chromosome undetermined scaffold_171, whole genome shotgun sequence
  Pfam annotation: Domain name=ABC_membrane; Domain location=15-322; Score=13.8; E_value=0.00048; Accession=PF00664.14; Description=ABC transporter transmembrane region
  Pfam annotation: Domain name=ABC_tran; Domain location=367-550; Score= 144.1; E_value=3.8e-40; Accession=PF00005.18; Description=ABC transporter
  Pfam annotation: Domain name=MMR_HSR1; Domain location=368-454; Score= -13.0; E_value=0.016; Accession=PF01926.14; Description=GTPase of unknown function
  Pfam module annotation: Pfam domain module=ABC_membrane::ABC _tran::MMR_HSR1; Domain location=15-322::367-550::368-454
MNNNKAPQFSKKWSVLTVEVDIWLMSKGEILQDAPYHQLLSSSQEFQDLVNAHKETSNSNQFVNATSSQRHLTSAREITQVFMERQCKATNGNQLIKQEEREKGDTGLKPYLQCLATVALGMKSSKKLFSQLMDSLFCAPMSFYDSTPLGRILTRVSSDMSIVDVDMPFYLGFAVGGPIICCSNIIVLAIVTWQVLVVSIPMVYIAIHLQKCFFASAKEVMRMNGTTKSFVANHVSETVAGVVTIRAFEDEGRFFEKNLDLIDINASAFFHSFSSNEWLILHLEMVSAVVLSFAALCMVMLPPGTFAPERINQYMHIPSEAEEVIEGNRPPLNWPDAGKVEINDLQIRYRPEGPLVLHGITCTFEGGHKIGIVGRTGSGKSTLISALFRLMEPASGKIVVDGINISSIGLQDLRSRLCIIPQDPTLFNGTVRYNLDPLSQHSDQEIWEVLGKCQLQEVVQEKEEGLNSSVVGEGSNWSMGQRQLFCLGRAMLRRSKILVLDEATASIDNATDMILQKTIRTEFADCTVITVAHRIPTVMDCTMVLSISEGNLAEYDEPMSLMRKEGSLFRQLVNEYYSHFQCAESH

SEQ ID NO: 157602 - protein, 404 aa, Glycine max
  Coding DNA Sequence Number=SeqID_65917
  Gene Ontology: Mol. function=ATPase activity, coupled to transmembrane movement of substances; Cellular component=integral to membrane; Biological process=transport
  Homolog annotation: Hit_ID=A7QTU6; Match level="QueryCoverage=100%, HitCoverage=27%, E-value=1e-100, Identity=49%"; Hit description =Chromosome undetermined scaffold_171, whole genome shotgun sequence
MEDFWSMFCGDRDCPGTRGKTFCHDLKFLKDPSTCINQFLIICVDVLLLVMLGFILIQKSLFRPFRGQFCVERYSNLQLISAVTNGSLGLLHLCLAIWVLENIRKSYTLFPLNGWVLELFHGFRWFLVGLSVSLQLKQLSRSSLWLFSLLTVFVSTILCVSSMSYAISSRELSFKAALHVLSFTGAVLLLLCTYKVYKCEDTDRDIDEGLYDPLNDHFNEVDPDNYLTPFANAGFLSRMSFWWLNPLMKRGQEKTLQDEDIPKLRESDRAGSCYLSFVEQLSRQKGKEKFSQSLVLWTLILCHKREILMSGLFALLKVLTLSTGPVLLNAFILVSEGNGSFKYEGYVLVVSLFVIKIIESLSQRQWYFRTRLVGMKVRSVLTAAIYKKLLRLSSSARLNHSGGE

SEQ ID NO: 157603 - protein, 1481 aa, Glycine max
  Coding DNA Sequence Number=SeqID_65918
  Gene Ontology: Mol. function=ATPase activity, coupled to transmembrane movement of substances; Cellular component=integral to membrane; Biological process=transport
  Homolog annotation: Hit_ID=A7QTU6; Match level="QueryCoverage=100%, HitCoverage=100%, E-value=0.0, Identity=70%"; Hit description =Chromosome undetermined scaffold_171, whole genome shotgun sequence
  Pfam annotation: Domain name=ABC_membrane; Domain location=310-579; Score=86.5; E_value=8.2e-23; Accession=PF00664.14; Description=ABC transporter transmembrane region
  Pfam annotation: Domain name=ABC_membrane; Domain location=918-1186; Score=73.3; E_value=7.7e-19; Accession=PF00664.14; Description=ABC transporter transmembrane region
  Pfam annotation: Domain name=ABC_tran; Domain location=1262-1445; Score=158.2; E_value=2.3e-44; Accession=PF00005.18; Description=ABC transporter
  Pfam annotation: Domain name=ABC_tran; Domain location=654-825; Score= 167.0; E_value=4.8e-47; Accession=PF00005.18; Description=ABC transporter
  Pfam annotation: Domain name=MMR_HSR1; Domain location=1263-1349; Score=-18.9; E_value=0.058; Accession=PF01926.14; Description=GTPase of unknown function
  Pfam module annotation: Pfam domain module=ABC_membrane::ABC _membrane::ABC_tran::ABC_tran::MMR_HSR1; Domain location=310-579::918- 1186::1262-1445::654-825::1263-1349
MEDFWSMFCGESDCPGTGGKPPFCYDFKFLKDPSTCTNQFLIICFDLLLLIMLAFILIQNSLFRPFRGHQFGLARFSNLQLISAIINGSLGLLHLCLGIWVLEEKLRKSLTLIPLDLWLLELFQGFRWLLVGLSVSLQFKQLPRSWLWLFSLLTLFFSTVFCVLSMSYAISSRELSFKEALGVLSFPGSVLLLLCTYKAYKCEDTDGEIDEGLYDPLNGHFNEVDPDNYVTPFAKAGFFSRMSFWWLNPLMKRGKEKTLQDKDIPKLRESDRAESCYLSFLEQLNREKGKEPLSQSSVLWTIVFCHRREILMTGLFALLKVLTLSTGPVLLNAFILVSEGNESFKYEGYVLVISLFIIKIIESLSQRQWYFRSRLVGMKVRSLLTAAIYKKLLRLSSAARLTHSGGEIMNYVTVDAYRIGEFPYWFHQSWTTSLQICIALLILFNAIGVATIASLVVIVLTVLCNAPLAKLQHKFQSELMVAQDERLKASTEALTNMKVLKLYAWETHFKNAIERLRNLELKLLSSVQLRKAYNIFLFWTSPILVSAASFGTCYFLNIPLRANNLFTFVATIRLVQEPITAIPDVIGVVIQAKVAFARIVKFLEAPELQSENFRNRSFDESNKSPISIKSADFSWEGNASKSTLRNINLEIRHGQKLAICGEVGSGKSTLLATILGEVPMIKGTIEVYGKFAYVSQTAWIQTGTIQENILFGSDLDAHRYQETLRRSSLLKDLELFPHGDLTEIGERGVNLSGGQKQRIQLARALYQNADVYLLDDPFSAVDAHTATNLFNEYIMDGLKEKTVLLVTHQVDFLPAFDSVLLMSNGKILEAAPYHHLLSSSQEFQDLVNAHKKTAGSDKPMNVTSSKRRSTSVREITQAFKEKHLKEANGDQLIKEEEREIGDTGLKPYMQYLNQTKGYIYFFVASLCHLLFVICQILQNSWMAANVDNSQVSTLRLIVVYFLIGAISTIFLLIRTLLIVALGIQSSTNLFLLLMNSLFRAPMSFYDSTPLGRILSRVSSDLSIMDLDVPFIIAYTVGGTTNFYSNLAVLAIITWQILLVCVPMVYITIRLQRYYFSTAKEVMRMNGTTKSIVANHVAETTAGVVTIRAFEEEDRFFEKNLDLIDINASPFFHSFASNEWLIQRLEIISAILLSSTALCMVMLPPGTFSSGFIGMALSYGLSLNAQLVFSIQSQCNLANYIISVERLNQYMHIPSEAKEVIEGNRPPSNWPVAGKVELNDLKIRYRLDGPLILHGITCTFKAGHKIGIVGRTGSGKSTLISALFRLVEPAGGKIVVDGVDISSIGLHDLRSRFGVIPQDPTLFNGTVRYNLDPLAQHSDHEIWEVLGKCQLREAVQEKQEGLNSSVVEDGSNWSMGQRQLFCLGRALLRRSRILVLDEATASIDNATDLILQKTIRTEFADCTVITVAHRIPTVMDCTMVLSISDGKLVEYDEPTSLMKKEGSLFKQLVKEYWSHFQSAESH

SEQ ID NO: 157604 - protein, 258 aa, Glycine max
  Coding DNA Sequence Number=SeqID_65919
  Homolog annotation: Hit_ID=A7QGD5; Match level="QueryCoverage=84%, HitCoverage=97%, E-value=9e-72, Identity=65%"; Hit description =Chromosome undetermined scaffold_91, whole genome shotgun sequence
METSHPLSIESFSYSWLVNLKPSLESLDGSLRTSLDASDETSSFIEMDPRMTPSKRFFRNSQDFKFDFPISQSPRTLVDADELFSNGYLMPLFVESLKMEAFEASDVIPSLPSSSHVPKSVVPNSHSRCPSLKRCKTLSRRIFLKYLNFLRPLYRRLRGGKSGSKPESVVKRTVSAKNRGYYSETSPRISVAYSADDWRKSCDSESSIYEAVLHCKRSIAYVVFKVLNCSHGHNFIVILDIAGNCGCNCDRKSPKTLT

SEQ ID NO: 157605 - protein, 597 aa, Glycine max
  Coding DNA Sequence Number=SeqID_65920
  Gene Ontology: Cellular component=integral to membrane
  Homolog annotation: Hit_ID=A7QGD4; Match level="QueryCoverage=79%, HitCoverage=98%, E-value=0.0, Identity=72%"; Hit description =Chromosome undetermined scaffold_91, whole genome shotgun sequence
  Pfam annotation: Domain name=C4dic_mal_tran; Domain location=224-489; Score=311.2; E_value=2e-90; Accession=PF03595.8; Description=C4 -dicarboxylate transportermalic acid transport protein
MENNINIEIAEQGSPEVPSLIRYISSSDVAGFDTADSQPPSPYAQGSEETSPRRQHDEPVVINHQRKYSISMPLSSEQVQLQPLDNKTDGIPISSSQSGTANSNHPQASKCYSQPMPKGYVPQEADNGVKIDNHPGIKAFKDKRFDSFKTWSGRLERQLTILRGKSPRATAQDGNNNSSSTDRPLPVDRYFDALEGPELETLRASEETVLPQDKQWPFLLRFPISSFGICLGVSSQAILWKALATSPSTQFLHISLKVNLILWFISIALVTTVFTIYLLKIILYFEAVRREYYHPIRVNFFFAPWIALLFLALGVPPSVTKDLLHVLWYILMTPILCLELKIYGQWMSGGQRRLSKVANPTNHLSIVGNFVGALLGASMGLKEGPIFFFAIGLAHYTVMFVTLYQRLPTNETLPKELHPVFFLFVAAPSVASMAWANIQGSFDYGSRIAYFIALFLYFSLAVRINFFRGFTFSLAWWAYTFPMTGAAIATVRYSNRVTNPVTKTLCVILSLISTLIVIALLVSTILHGFVFRNLFPNDLAIAISYRKRRPQKKWLGLRYRSHDSKEIENYLKFVNSDKIDLEASAPLPNGTEDTPSI

SEQ ID NO: 157606 - protein, 80 aa, Glycine max
  Coding DNA Sequence Number=SeqID_65921
MSNERKAHAFPNDFGIPPSKMFDRIDKDSNRDGNLLLSGIFPSVEGKIKDGKGTRKIEFRGPPWKDKMIGKATISAKHML

SEQ ID NO: 157607 - protein, 258 aa, Glycine max
  Coding DNA Sequence Number=SeqID_65922
MASYGAFLLLHFAAIDLQEAKDSIDEEDPRPTSSTWSYIKVPVERNSFINVKPTMTIGMFGKSLNTKLSQDFFQVCLVLGYSLRLDDHVVAINLNVSSDMLLENSVHQSLRVCIFGARHVQISIIDAYSPFGVGLFYHDDVGELGKIFDFSDEVGIEEFVHFFSDSFAVVATYPLVRGRRGDHGCVFQERKMGGVATNVYSRKTSEKLERCGLRTLIVKGSGVVFMHGEGCFPLSYVSSIAMRKSDLCSSLKSGKVTC

SEQ ID NO: 157608 - protein, 289 aa, Glycine max
  Coding DNA Sequence Number=SeqID_65923
DSLEEQASQGSFVAHGRQDVLTAGIGRPKHPGHVRVAGASVAIKQYFGLAPRTSHSSSSMALEDLEQLTQKIRDQLEESIKEKMQSEGLTLPLKPEVGPLAASVSTKESYVDPSVNDPNMGDSEKCGLYVEENPPCLVTLGRLYEGSKTVHNIPLRHDQVKVGVEEVRDADAPIPVPTKEVMWDATMFGVFNGNFPLYIKHEDLSKLAHGGQCLNISVIQLWILTDNYLKGIINRLVLFFNTFALALVGNINIIIVKYASMFVLNNALKGLDDTPQSKSKAAARWIVVK

SEQ ID NO: 157609 - protein, 24 aa, Glycine max
  Coding DNA Sequence Number=SeqID_65924
MVKCRAGSKGRDQSRYLGTDASRD

SEQ ID NO: 157610 - protein, 156 aa, Glycine max
  Coding DNA Sequence Number=SeqID_65925
ATLWQELFTELRDKLHCGSSYLIQNLRIVDNQSEYRVSPVPLLVYFLKTSFVKEIQHPEIPSNIYLITPFADIISGVAPCHTLVDIVGVVADLIDVKIVNPPHRMTVRLRDNSNCEILMAIWEDYAIQLHDAIDKNLLLQEPLVVMLTLGKIKDAT

SEQ ID NO: 157611 - protein, 119 aa, Glycine max
  Coding DNA Sequence Number=SeqID_65926
MKKLPEFALIPISYGDLLPFVIANQLAVCVALKHKVQSWIDAGWLTFQEDGPNVKTNPFTNHRGPMVSMVSFYRHKGDSCLMHPGASHDIEACSTTEELLQQLMDQGRFEISEGTRENS

SEQ ID NO: 157612 - protein, 59 aa, Glycine max
  Coding DNA Sequence Number=SeqID_65927
MAILIVNTSTTFHRDERLGNTYAIHGKSEKSVDLLGGGVGVRHCFGLGQQPGKFLTPVQ

SEQ ID NO: 157613 - protein, 177 aa, Glycine max
  Coding DNA Sequence Number=SeqID_65928
MERKDKELRGSNNSIIGDYHKWLKARTQGITWLLKLSSSSEEEVEVPEESEKVQALKAKLERTRVVKEKLNQGQEKYKEKVNLAASHGLRLEDEHAKVSALEMEGEARERVIESLHGEAMKWMNRFALTLNGSQELPRLLARAKAMANVYPAPDEVHWLFDYCQHMIKLMSHIIRNR

SEQ ID NO: 157614 - protein, 54 aa, Glycine max
  Coding DNA Sequence Number=SeqID_65929
GDQLGSRCFVRMLQPCGIGTGLKEHSNRVTPKAYTPKSPSWPLPLDSGPTQKTF

SEQ ID NO: 157615 - protein, 85 aa, Glycine max
  Coding DNA Sequence Number=SeqID_65930
  Homolog annotation: Hit_ID=A5BSQ4; Match level="QueryCoverage=83%, HitCoverage=8%, E-value=2e-09, Identity=50%"; Hit description =Putative uncharacterized protein
MGADPERRDKLIELLPQDGVYGPLVLAFSVVSNSFGGSGKAFSEGNCEGQIKVATDDLSSANKIGEAGFGPVYKGQLLDGTFIAV

SEQ ID NO: 157616 - protein, 130 aa, Glycine max
  Coding DNA Sequence Number=SeqID_65931
  Gene Ontology: Mol. function=beta-lactamase activity; Biological process=beta-lactam antibiotic catabolic process
  Homolog annotation: Hit_ID=P62593; Match level="QueryCoverage=80%, HitCoverage=36%, E-value=3e-53, Identity=99%"; Hit description=Beta -lactamase TEM precursor
MAPDAVFSPYASVRKSMSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSQSQKSILRMA

SEQ ID NO: 157617 - protein, 115 aa, Glycine max
  Coding DNA Sequence Number=SeqID_65932
  Homolog annotation: Hit_ID=Q2HW90; Match level="QueryCoverage=79%, HitCoverage=18%, E-value=2e-10, Identity=37%"; Hit description =Putative uncharacterized protein
MGINQTGKRFYQVKIKGLDVTNLKELGRLVGPLQMQAFCKAYGKILDLTIAEIFTEVVVSLTQYYDQPLRCFTFGDFQLVPTVEEFEEILGCPLGGRKPYLSSGFLPSLSKIAVV

SEQ ID NO: 157618 - protein, 472 aa, Glycine max
  Coding DNA Sequence Number=SeqID_65933
  Gene Ontology: Mol. function=phosphatidylglycerol-membrane -oligosaccharide glycerophosphotransferase activity; Cellular component=integral to membrane; Biological process=glucan biosynthetic process
  Homolog annotation: Hit_ID=A7MG94; Match level="QueryCoverage=99%, HitCoverage=61%, E-value=0.0, Identity=67%"; Hit description =Putative uncharacterized protein
  Pfam annotation: Domain name=Sulfatase; Domain location=30-330; Score= 34.7; E_value=1.7e-07; Accession=PF00884.14; Description=Sulfatase
VKELIASHARQADSDFETYYKTPNKQINAPKLNLVYIYGESLERTYFDQQAFPGLAPELSREKDHSIDFSNTEQLPGTDYTIAGMVASQCGIPLFAPFDGNASASLSSFYPQNICLGDILKHSGYENWFIQGADLRFAGKDTFLLSHGFDAANMYGSQELKSRVADPSYRNNWGFYDDTVMDEVFEKYEELSRQQKRFALFTLTVDTHHPDGFISRSCQRKSYSYDGKPNQSFSAVACSQEHVARLIARIKASPWFKNTVIVVSSDHLAMNNTAHQYLIKQPRRDLFMVIRGDQPQAEVLDGKRSTLDNGATVLDILGGDNAIGLGRSGLSSASLSSQFDDMAKKVTAWKADIIQLWNFPSQMKTFTIDQPKNTFSFSGATFRLPILFRVSDHQVEPLPEGEYAAPLRFQLADFAASDKFVWVDRCFKMGRLWQPALALSTDLCLAMGQTGGQPTVTRIDQPVWQGKAQFPQ

SEQ ID NO: 157619 - protein, 266 aa, Glycine max
  Coding DNA Sequence Number=SeqID_65934
  Gene Ontology: Mol. function=receptor activity; Cellular component =cell outer membrane; Biological process=amino acid transport
  Homolog annotation: Hit_ID=A7MFM4; Match level="QueryCoverage=87%, HitCoverage=88%, E-value=9e-85, Identity=67%"; Hit description =Putative uncharacterized protein
  Pfam annotation: Domain name=Lipoprotein_9; Domain location=13-248; Score=353.3; E_value=4e-103; Accession=PF03180.5; Description=NLPA lipoprotein
MALFSSVASAAALRVAADPVPHSEILNYIKQTDKQLDLKVIELNGNLNANELLARGDVDANYFQHVPYLRDQEKALGEKFAVVATVHIEPLGIYSHKVKSLKDLPDGAQVAVPNNVTNLSRALYLLQANGLITLKSRSASTLVTTADISDNPHHLKIIEVEAPQLPRALDDAQLAIINGNYALQAGLVPSKDALALEQAKDNPYANVLVTTPKLANDPRILALAKDLESKQTAEFINQHYKGSVIPGGAPAVLWYISPPTPVAPAA

SEQ ID NO: 157620 - protein, 108 aa, Glycine max
  Coding DNA Sequence Number=SeqID_65935
MLICPCGRIVPTRHPVDLKESNKALGFPALVTGLCQSYRVPVPPARSCRHDIGIAPARPPVDPEKSNRVLGFLALITGLCQFYGVPVAPTKVIRPPINWTFIKKYSAP

SEQ ID NO: 157621 - protein, 25 aa, Glycine max
  Coding DNA Sequence Number=SeqID_65936
TPKSIDKQEANVVICHPFEDVSISR

SEQ ID NO: 157622 - protein, 199 aa, Glycine max
  Coding DNA Sequence Number=SeqID_65937
MPTRKNKAVSIFWMPPFHGKSSKSDQDLSTRVRPSEAKQEWGALLVFGIVLFPNVDGLVDLAAINAFLAYHHSRESPIIAVLADAYDTFDLRCKKSRKSKLGGTLGRIPKHPLDGNKGNDIIGGYLKWLKAQTQGITWLPKLKSPSGEEAKVPKESEEVQALKAELERTRVVKEKLKTTVTRVRKECDELRDVNMTTIE

SEQ ID NO: 157623 - protein, 141 aa, Glycine max
  Coding DNA Sequence Number=SeqID_65938
MHKALRANAPLPYPQLVTLFLRHFQIPLDDEPFVQVKRSFAIGAGAVTSFGYHKDHNGQWLKKDALLPQDERTPSPPPQRDDSTLMTEVLTELRGLRTYVGERFDSLDGRFAGMDIRLTQLEEDVGYIRQSFDLPPPPPPS

SEQ ID NO: 157624 - protein, 198 aa, Glycine max
  Coding DNA Sequence Number=SeqID_65939
PRTKPSLPGLSAFRHDNYWAKRAWLQLSRYVLFLRMESRKRARTEDIPSSSTPAPPSITIGQDVQGSQTLVPMLQSSFRGQFISMHSLQELAHNRPIITMKHFLKQVAWPEAQLPLVDLEPADPQSPMVNPLSSPKREVVPPSPPLIIISDASSDEVAASPDSPAGEIVDLPTSLVGGISDLSDLSSGEDVALTDSPV

SEQ ID NO: 157625 - protein, 195 aa, Glycine max
  Coding DNA Sequence Number=SeqID_65940
  Homolog annotation: Hit_ID=A5ZQM3; Match level="QueryCoverage=28%, HitCoverage=51%, E-value=1e-20, Identity=82%"; Hit description =Putative uncharacterized protein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 157626 - protein, 131 aa, Glycine max
  Coding DNA Sequence Number=SeqID_65941
  Gene Ontology: Mol. function=protein binding; Cellular component=cell projection; Biological process=cellulose and pectin-containing cell wall organization and biogenesis
  Homolog annotation: Hit_ID=Q86AI8; Match level="QueryCoverage=96%, HitCoverage=36%, E-value=9e-14, Identity=33%"; Hit description =Similar to Homo sapiens (Human). Mucin 2
MPSPSEDFRFSPSEDYTSSPSEGYMPSPSEDYMSSPLEGYTPSPLEDYTSSTSEGYTPFPAEDYTPSPYYASLPLEGYTPSPSEDYTSSPLEDYMSSPSEGYTPSHSEDYTFYPSEGYNPSLQRTTRPRLH

SEQ ID NO: 157627 - protein, 145 aa, Glycine max
  Coding DNA Sequence Number=SeqID_65942
  Gene Ontology: Mol. function=aspartic-type endopeptidase activity; Cellular component=small subunit processome; Biological process=DNA integration
  Homolog annotation: Hit_ID=A5AIV5; Match level="QueryCoverage=92%, HitCoverage=21%, E-value=3e-20, Identity=41%"; Hit description =Putative uncharacterized protein
  Subcellular localization annotation: CTP_CleavageSite=42; ConfidenceScore=5.20e-01
CISLSIEGSSSWILDSGASDHISGNKSSFSSFSFPKIPHHVTVANGSKVVSQGSGQEHGTGRLIGEGHESQGLYYLESSPPGACFAISKPKLLHDRLGHPSLPKLKMMVPSLKNLRVLDWYSTSVYMSSHTTTKWHSRKEESSSS

SEQ ID NO: 157628 - protein, 65 aa, Glycine max
  Coding DNA Sequence Number=SeqID_65943
  Subcellular localization annotation: CTP_CleavageSite=21; ConfidenceScore=5.14e-01
MESCNGWRKPNSLHGTLPSVVMQMKVARKRTCVALRMMMMNLHSIILQITTEMEVNEMSEIGDGD

SEQ ID NO: 157629 - protein, 142 aa, Glycine max
  Coding DNA Sequence Number=SeqID_65944
MVLKEHALRFVDCGGVGSTVSSVSGGVCLGESVVEFSYGLKRARSQVRGLWWCWKYLSSFTTASISLFMHLGFKPVRHPDATNVDDHEEKCDTVSNLQNCSYGASTRSYFFAGFAAQRNSTKRLGTGVVSLLVLLLKGIMQK

SEQ ID NO: 157630 - protein, 498 aa, Glycine max
  Coding DNA Sequence Number=SeqID_65945
  Gene Ontology: Mol. function=RNA methyltransferase activity; Biological process=RNA processing
  Homolog annotation: Hit_ID=A7R7Y4; Match level="QueryCoverage=55%, HitCoverage=87%, E-value=3e-62, Identity=47%"; Hit description =Chromosome undetermined scaffold_2098, whole genome shotgun sequence
  Subcellular localization annotation: CTP_CleavageSite=24; ConfidenceScore=5.14e-01
MSGSRSRFHGFRGASLSASFYQVPPSAVPAMLDCILVSTGLSPPSLFASLLHDFPRILLKDITNEGDDDLDADKRLHLVSMVGAFCHLLKKMGADCDAVRSFVWRCFLPLVKVLQPLQHDLLNQITELFMGVVIETCAWEVLEATSVPIFLRSVGLSMGMLHNDDLDFYEWSSNSSHQDSYDVMIDPLMDKELLLSLSNSFKLLTSCNLLSVILEAALQYMQTDTLPKSAERKGCIVDKFVNILIWELSNMIERMLLHSPEHRSCAVGLLLPIILKALPANGSFEISIRGQKHGFSREYFFIKLWNCCRTLFSIGPLERRAAYTILSLYFAFSWSSEECEDADIDTIIKTEEFDIRAEKEFWDEIKIALNQTESGQVDKESLVRKQSLHILKMVLNIQGGTNSISSISKGNTNEKCSVPHGVTKREKWAYKEAKSLGVGNLPMIDELVINSQQYWGAFVLLYEMLEEYGTHLVEAAWNHQRLRVDEGELREQTPHYRI

SEQ ID NO: 157631 - protein, 795 aa, Glycine max
  Coding DNA Sequence Number=SeqID_65946
  Homolog annotation: Hit_ID=A2Q4W6; Match level="QueryCoverage=40%, HitCoverage=47%, E-value=1e-16, Identity=21%"; Hit description=RNA -binding region RNP-1
  Pfam annotation: Domain name=RRM_1; Domain location=68-138; Score =36.8; E_value=7.9e-08; Accession=PF00076.13; Description=RNA recognition motif. (a.k.a. RRM, RB
MVREMERERESRERNSGWERVRTRKERRARVRFRESEGSHLTIEGLATGQHQSYTRANWRDHKDVISFYFTRFPEDATAKDLWFHFKQQGDVREVFIPRKRNNQGRRYGFVRYKGVRDVHQLQQHLDNRFFGGMKMNVNIPKYGRPKKGEPQTVERGTAETGQTQKGRTEVYLSRLPEANMGIQGRSFAEVVNTNIPKPAQRRTTAKLQYISSNATSEVNLDIPMTGKQWLKEAWVGRLKNLASFDSIEEAIWWDSGQNISPKYIGDDMVLLLGLTEENAEKMMNEEDEGWGDLFYSIEKWNPSLRPGFRLTWIQCWGIPLVAWDMNCIKQIVAGIGEMVEAEESLEDQRRYDVARILVKTPWKPLIQHTVNIHIQGEIFPVHIAEEIGLFGARWQPRRERDFSSSEEILSDDCNDDAWSGSELQGWRYKARTESVAEEIRTVAKGGTMEAEAMEDMATEGVVGGEEDNRRGISEIVPWKTQRGASAQSETVDDTEDRGGDEERSPRGVEEGRLRQVSRSEGPATVAAGADQNGNAIGTKSGHDPKDKAIVRWVVKQADKALTGDKCVQTRDRELPVSQEEGKTDLGKEDNLGGDVGSDGLGNLYENSMRRQTRYVGGMVYEEDKHNFESPSPKSRDKEMMGLLDLGQAINTPPKLCPSPKNGPVLKTTPLPTPLLTYSRKGKMKRVKAQIGEVVSNQVLSSPEHVQNGPFQRDNEGRGSANPQIQTETSSTHNRQENQLQEETFDSHEESLWTMIKELGLTTGKTQRDYVQQLTEMEDRDGKEADSLGGRGRDS

SEQ ID NO: 157632 - protein, 94 aa, Glycine max
  Coding DNA Sequence Number=SeqID_65947
  Homolog annotation: Hit_ID=A5AT23; Match level="QueryCoverage=97%, HitCoverage=9%, E-value=4e-26, Identity=68%"; Hit description =Putative uncharacterized protein
MDIDYAIRKDKLPAIADESSLVDVALYKWCERPNQLRMMFFKTKILAGIHGFVDQHEKVLDLLKAIDDQFITSDKALARTLIMNLSSLRLTSVK

SEQ ID NO: 157633 - protein, 108 aa, Glycine max
  Coding DNA Sequence Number=SeqID_65948
  Gene Ontology: Mol. function=structural constituent of ribosome; Cellular component=ribonucleoprotein complex; Biological process =translation
  Homolog annotation: Hit_ID=A5BH65; Match level="QueryCoverage=100%, HitCoverage=100%, E-value=9e-30, Identity=56%"; Hit description=40S ribosomal protein S24
  Pfam annotation: Domain name=Ribosomal_S24e; Domain location=24-101; Score=-4.0; E_value=0.032; Accession=PF01282.10; Description =Ribosomal protein S24e
MADKAVTIRTRMFMTTRLLSGKQFVIDVLHPGSANDSKAELKEKLRRMYDEKDTNPLRMLRSVSLSTGLSGKEEKSRKQMKERKNRAKKIRGVQKTKASDAAKTGKKK

SEQ ID NO: 157634 - protein, 246 aa, Glycine max
  Coding DNA Sequence Number=SeqID_65949
  Gene Ontology: Cellular component=integral to membrane; Biological process=negative regulation of apoptosis
  Homolog annotation: Hit_ID=Q6U1L7; Match level="QueryCoverage=86%, HitCoverage=86%, E-value=9e-73, Identity=62%"; Hit description=Bax inhibitor
  Pfam annotation: Domain name=UPF0005; Domain location=26-235; Score =52.9; E_value=1.1e-12; Accession=PF01027.11; Description =Uncharacterised protein family UPF0005
  Subcellular localization annotation: CTP_CleavageSite=48; ConfidenceScore=5.07e-01
MDTFFKSPSSSSSRSSWSYDTLKNFREISPLVQNHIKLVYFTLCCAVVAAAVGAFLHVLWNIGGFLTTVASIGSMFWLLSTPPFEEQKRLSLLMASALFQGASIGPLIGLAFAIDPGLIIGAFVATSLAFACFSAVALVARRREYLYLGGLLSSWLSILMWLHSDSSLFGGSIALFKFELYFGLLVFVGYVIVDTQVIIERAHFGDLDYVKHALTLFTDLAAIFVRILNIMLNNSSKRNEKKRRRD

SEQ ID NO: 157635 - protein, 646 aa, Glycine max
  Coding DNA Sequence Number=SeqID_65950
  Gene Ontology: Mol. function=transporter activity; Cellular component= integral to membrane; Biological process=transport
  Homolog annotation: Hit_ID=UPI0000196CE7; Match level="QueryCoverage =75%, HitCoverage=96%, E-value=0.0, Identity=63%"; Hit description =transporter-related
  Pfam annotation: Domain name=MFS_1; Domain location=118-522; Score =121.6; E_value=2.3e-33; Accession=PF07690.7; Description=Major Facilitator Superfamily
  Pfam annotation: Domain name=Sugar_tr; Domain location=123-563; Score= -172.2; E_value=0.03; Accession=PF00083.15; Description=Sugar (and other) transporter
  Pfam module annotation: Pfam domain module=MFS_1::Sugar_tr; Domain location=118-522::123-563
  Subcellular localization annotation: CTP_CleavageSite=58; ConfidenceScore=5.16e-01
MTGLACIAIATDKSCFTAKPKAAKLNGGDGNVIPHRPSQTPRVTLSIQQPPPFSLPPKAFPFSPLQHRKKKGKTKKEQDGLMSRHCDCCCGGIPPGLLLIRGKQWNLQTYRYMVLLTTFIAYACYHASRKPTGIVKSVLCPEHKGTNQGWSPFNGHDGTSKLGEIDVAFLACYSMGMYVAGHLGDSLDLRLFLTTGMVGSGIFVSLFGMGYFWNMHSFLFYLSMQMIAGMFQATGWPSVVAVIGNWFGKRKRGLIMGVWNAHTSVGNISGSLLAASVLEYGWGWSFVVPGVVIVLGGVLVYLFLAPYPEDVGFSCVHGGGGGGDEEAQVNGVKKGGGGGGVAPPTREGSVNRKSVGLVEACMIPGVIPFALCLFFAKLVAYTFLYWLPFYLTQTAEIGGKYISVKSAGNLSALFDVGGIFGGILAGYVSDKLNARAITAASFMYAAIPSMLLYRHYGSVSMNANIGLMMVSGLFVNGPYALITTAVSADLGTHSSLKGDSRALATVTAIIDGTGSVGAALGPLLTGFISSRGWDEVFMMLVLGAFIAGLLLSRLIIAEIAERSGKPLSSGQQNPEATASQPLLEERLWKVPKGITTHNWGWNLISFHRELIFSRDNCGDLLLALNHLDTRYSKVTFVPLILVSHSF

SEQ ID NO: 157636 - protein, 528 aa, Glycine max
  Coding DNA Sequence Number=SeqID_65951
  Gene Ontology: Mol. function=triacylglycerol lipase activity; Cellular component=chloroplast stroma; Biological process=lipid metabolic process
  Homolog annotation: Hit_ID=A5BSP2; Match level="QueryCoverage=99%, HitCoverage=90%, E-value=0.0, Identity=67%"; Hit description =Putative uncharacterized protein
  Pfam annotation: Domain name=Lipase_3; Domain location=260-408; Score= 167.3; E_value=4.2e-47; Accession=PF01764.16; Description=Lipase (class 3)
  Subcellular localization annotation: CTP_CleavageSite=76; ConfidenceScore=5.79e-01
MMQISSTIPAPNLHMFQTRRTSFRCRASPLNPTTSSSPQSIKSVSDSTRLHLSNLDNLLQKQSPTTQPKQQEELTLAATIQNNKTTTTEKKGKNVLEGLNLARLWPDMKATEEMSPRHLNRLQRLLSKTDEYSPRNTLGSLWREYHGSHDWKGMLDPLDENLRREVVRYGEFVQAAYHSFHSNPAMSAEEPPLPRHMVLPDRSYRITKSLYATSSIGLPKWVDDVAPDLGWMSQRSSWVGYVAVCDDRREIVRLGRRDIVISLRGTATCLEWVENMRAQLINIDSSSSSRGKPKVECGFLSLYKTRGSHVPSLKESVIEEVKRLMKLYQGETLSITITGHSLGAALALLVADDVSMCSTDVPPVAVFSFGGPRVGNRAFGDKLAAQNVKVLRIVNSQDVITKVPGMLVSEEVEKKLRNSKLGAGVLDIFDEYSHTGTELRVDTKMSPFLKPDADMACCHDLEAYLHLVDGFLASNCPFRANAKRSLARLMQDQGANVKKLYTSKAKALSLNLQRQASFSISGCLPSPS

SEQ ID NO: 157637 - protein, 93 aa, Glycine max
  Coding DNA Sequence Number=SeqID_65952
  Gene Ontology: Mol. function=transcription factor activity; Cellular component=nucleus; Biological process=regulation of transcription, DNA-dependent
  Homolog annotation: Hit_ID=A9Y0K9; Match level="QueryCoverage=81%, HitCoverage=31%, E-value=8e-24, Identity=69%"; Hit description=ERN3
  Pfam annotation: Domain name=AP2; Domain location=23-74; Score=49.5; E_value=1.2e-11; Accession=PF00847.11; Description=AP2 domain
MEYQNQRAKEGRFCEKLKIKNKPKFVGVRQRASGKWAADIKDTSKKIRLWLGTYQTVEEAARAYDEDVCLLRDIKTGGVTSKKARKIEEKKKI

SEQ ID NO: 157638 - protein, 26 aa, Glycine max
  Coding DNA Sequence Number=SeqID_65953
MARRMGAAIEDGDKLAYLERDVIFKC

SEQ ID NO: 157639 - protein, 487 aa, Glycine max
  Coding DNA Sequence Number=SeqID_65954
  Gene Ontology: Mol. function=peptidase activity; Cellular component =proteinaceous extracellular matrix; Biological process=proteolysis
  Homolog annotation: Hit_ID=A7PK60; Match level="QueryCoverage=70%, HitCoverage=58%, E-value=5e-84, Identity=48%"; Hit description =Chromosome chr15 scaffold_19, whole genome shotgun sequence
  Pfam annotation: Domain name=MORN; Domain location=116-138; Score =24.1; E_value=0.00054; Accession=PF02493.11; Description=MORN repeat
  Pfam annotation: Domain name=MORN; Domain location=139-161; Score =33.2; E_value=9.1e-07; Accession=PF02493.11; Description=MORN repeat
  Pfam annotation: Domain name=MORN; Domain location=162-184; Score =24.9; E_value=0.00031; Accession=PF02493.11; Description=MORN repeat
  Pfam annotation: Domain name=MORN; Domain location=185-207; Score =30.6; E_value=5.7e-06; Accession=PF02493.11; Description=MORN repeat
  Pfam annotation: Domain name=MORN; Domain location=208-230; Score =19.0; E_value=0.018; Accession=PF02493.11; Description=MORN repeat
  Pfam annotation: Domain name=MORN; Domain location=296-318; Score =33.8; E_value=6.1e-07; Accession=PF02493.11; Description=MORN repeat
  Pfam annotation: Domain name=MORN; Domain location=319-341; Score =31.6; E_value=2.8e-06; Accession=PF02493.11; Description=MORN repeat
  Pfam module annotation: Pfam domain module=MORN::MORN::MORN::MORN::MOR N::MORN::MORN; Domain location=116-138::139-161::162-184::185 -207::208-230::296-318::319-341
  Subcellular localization annotation: CTP_CleavageSite=53; ConfidenceScore=5.67e-01
MTFPLFQTPFGAKFPTSKLLPRFRFLLFLPLPSLYLLFSNPSPLDFFSVIAFSAALFVSLNLALSFFTRLFPTKFSSSSSSSSPQPVVWSIGSNPKQVKNTNWGCWVQVYSNGDVYEGEFQKGKCWGSGVYHYHMHGRYEGGWVDGKYDGYGVETWARGSRYRGQYREGLRHGMGIYKFYCGDVYGGEWSNGQCHGFGVHTCIDGSRYVGEFKWGVKHGLGQYHFSCALVTCWSWVRIRKQPLCICKGKAAYNIPPSYLRIAKSLWAMRITKVIDDLPEDDKFASVPGSIKNGDIYAGEYFADKMHGFGVYQFQNGHRYEGAWHEGRRQGLGMYTFRNGETQCGHWQNGILDDPKRHNSPTGSPCAVDHAKVFNAVQDAHSAAEKAYNMAKVDDGVNKVVAAANKAANTARDAAVFPFLVSLYSYEVPAWNHFLSLNSMADCGAKLKIWEAQFRYHLYDQTYTSNNDNGGDIATISTGTHAKGVKQA

SEQ ID NO: 157640 - protein, 76 aa, Glycine max
  Coding DNA Sequence Number=SeqID_65955
MEALAGTRRRRHRMAEDVFFWLLMGHDARVYVVGRVQPEVSSCSTASGDGGGDRHHVAPESYAHACPVRVRRGTRR

SEQ ID NO: 157641 - protein, 197 aa, Glycine max
  Coding DNA Sequence Number=SeqID_65956
  Homolog annotation: Hit_ID=A5B5G7; Match level="QueryCoverage=91%, HitCoverage=12%, E-value=5e-08, Identity=25%"; Hit description =Putative uncharacterized protein
MASNKRKAPSTPTQARFDRSRFTSQEAWERYTDVVVPRKILPERNVILHHTEFDEFTEELECRNWHKELTNFMDSSRAISIVKEFYANLYDPDDKPPKQVNVRGCLVKFDANTLNSFLKTPEILEEGKNFPVYSRFCCSKPEPQESAARLCIPGREFELNADGLPLKILRKNLTTLAQTWSFLSFSNLVPTSHTSVR

SEQ ID NO: 157642 - protein, 55 aa, Glycine max
  Coding DNA Sequence Number=SeqID_65957
VTDCTICCEAHETSQCNLTNYNTQEIHFMGNQQRQGYTQGGFLGFQQGPYNQQGQ

SEQ ID NO: 157643 - protein, 99 aa, Glycine max
  Coding DNA Sequence Number=SeqID_65958
  Homolog annotation: Hit_ID=A5BEV8; Match level="QueryCoverage=86%, HitCoverage=10%, E-value=1e-15, Identity=46%"; Hit description =Putative uncharacterized protein
MSLLVDGLTKVTMDKWMDITNMRYVIASRYNVILVSLSQQQSMTFFPLRSQQPVDSSMHRIICIGHVYDNHFVQVYLKDHCPLPHVALLCSSNCYPQAK

SEQ ID NO: 157644 - protein, 218 aa, Glycine max
  Coding DNA Sequence Number=SeqID_65959
MGPFDEDAINQFLGHPLVLEEGQHYEFSLRRSQASGFDKEAIGQLLYIPGEDFAQSVMGRRVRIMRTSMTTLTQICMTLLLNNILPSDHNFLSSLAEVLVDLCHLDPGECSCGLVDLIHHLSIYRDHASQTPSGPRKVQQSTGVSGLDHGPLPVLWGVGIIVGPSTTATGRGLVASNHRCTTATSTVATISRVHLCSHVKDGAPDAHIYAACDRPSSS

SEQ ID NO: 157645 - protein, 134 aa, Glycine max
  Coding DNA Sequence Number=SeqID_65960
MQLVGKEKQKETQIVLQDIEATTTLEEEPLSSEASSSFPTQGQSHTILAEANIMAEEPRRVTLEDYSSSSVPQFFTSIARPEVQAQNITYPHSLIQLIQNNLFHGLPNEDPYTYLVTYIEICNTVRLAGVPEDA

SEQ ID NO: 157646 - protein, 222 aa, Glycine max
  Coding DNA Sequence Number=SeqID_65961
  Homolog annotation: Hit_ID=A7UQU7; Match level="QueryCoverage=88%, HitCoverage=34%, E-value=2e-14, Identity=31%"; Hit description=IMP dehydrogenase/GMP reductase, putative
  Pfam annotation: Domain name=DUF1723; Domain location=167-216; Score =56.6; E_value=8.8e-14; Accession=PF08330.1; Description=Protein of unknown function (DUF1723)
MVRTRGLGRALGHVTGRGVGRGDHDDSDDASQCRRPTASARRQQVLVTAVHDEPVVPVPDVETDVFSNDPMAPSDVKDIGADIPADTGAQATKDEHEGFPGGPSDPSVLTQYAGHVACSVWTGEERPELKLSSHKRKIHSLGRPVPAIERLVAGTGLSPLITCSVDTSDRGLLSSFVERWHQETSSFHLPVGELTITLDDVSSLLHLSVVGDLQYLSALTHG

SEQ ID NO: 157647 - protein, 65 aa, Glycine max
  Coding DNA Sequence Number=SeqID_65962
MGSKWLEVENVPCPFAKRKPCAKRIFGHELSQESLALSAQPLHLMLIWSAKLAKAELSPFQFNLN

SEQ ID NO: 157648 - protein, 35 aa, Glycine max
  Coding DNA Sequence Number=SeqID_65963
MALRSANMHNSSFFQILPHVQPRSVALNGWLAKLT

SEQ ID NO: 157649 - protein, 74 aa, Glycine max
  Coding DNA Sequence Number=SeqID_65964
MGPTYSDMGCKLALEDKKRVAFRRRQRHEHVDAARHAKPCNCSSLASQQQKATMQNLSSSTEVCPEMGMLWIKE

SEQ ID NO: 157650 - protein, 22 aa, Glycine max
  Coding DNA Sequence Number=SeqID_65965
MDPIRRIQKKGFSIDSNALPTR

SEQ ID NO: 157651 - protein, 195 aa, Glycine max
  Coding DNA Sequence Number=SeqID_65966
  Subcellular localization annotation: CTP_CleavageSite=44; ConfidenceScore=5.19e-01
MPKLPLPPFFLKNAIFFPEKLLTSIFRKLCFSFSLFRGALPLVRGGSSVEHSGEGEGFGIELCSGRWRQTRYADGGLFVADMDEYEWMYEIMSERGDMDYENVESCGANEPHVDCSDAFKTSQVFECREDVLRWARSVAHENGFVAVILRSDTNTGVASISVGKKNLSEETLGLGNVGVPSSFVASQWLEEKAGW

SEQ ID NO: 157652 - protein, 257 aa, Glycine max
  Coding DNA Sequence Number=SeqID_65967
  Gene Ontology: Mol. function=carboxylesterase activity; Cellular component=cytoplasm; Biological process=biotin biosynthetic process
  Homolog annotation: Hit_ID=Q6CZL9; Match level="QueryCoverage=99%, HitCoverage=100%, E-value=2e-93, Identity=67%"; Hit description =Carboxylesterase bioH
  Pfam annotation: Domain name=Abhydrolase_1; Domain location=40-251; Score=115.2; E_value=1.9e-31; Accession=PF00561.11; Description =alphabeta hydrolase fold
  Pfam annotation: Domain name=Thioesterase; Domain location=14-253; Score=-24.2; E_value=0.0022; Accession=PF00975.11; Description =Thioesterase domain
  Pfam module annotation: Pfam domain module=Abhydrolase_1::Thioesterase ; Domain location=40-251::14-253
MSSLYWHTTGTGDRDLVLLHGWGLNAEVWQHIVPRLSPHFRLHLVDLPGFGRSQGFGPLSLAQMAQQLLPQLPARAVLLGWSLGGLVASQLALSQPDRVAALISVASSPCFTARDEWPGIQPETLATFQQQLSSDFQRTVERFLALQTMGTENARQDARQLKEVVLSQPMPSVAVLEGGLNILRHDDLRSALDGLTLPFLRIYGALDGLVPRRIAPQLDARWPHSQSVVIAKAAHAPFISHPEAFCQQVQQFIHAAT

SEQ ID NO: 157653 - protein, 303 aa, Glycine max
  Coding DNA Sequence Number=SeqID_65968
  Gene Ontology: Mol. function=motor activity; Cellular component=cell projection
  Homolog annotation: Hit_ID=UPI00016621D1; Match level="QueryCoverage =97%, HitCoverage=40%, E-value=2e-24, Identity=35%"; Hit description =UPI00016621D1 related cluster
GLHVLAFKGLHVLTFKGLHVLTFKGLHALTFSRLHVLPYRGLHVLTFKGLHALAFIGVNALTFRGLHVLAFRGLHAFTFRGLHVLTFKGLHVLAFRGLHVLTFKGLHVLTFKGLHALTFSGLHVLAFRGLHVLTFKGLHALAFIGLNALTFGGLHVLSFRGLHTLTFRGLRVLNYRGLHTIAFRGLHTPSPSEGYTPSPLEGLHALTFRGLHVLSFRGLHVLTFRGPHALTFRGLHVPVVLTFRGLHALTFRGLHVLAFRGLHVLTFRGLHALAFVGLHAFTFRGLHVLAFRGLHALSFRGLH

SEQ ID NO: 157654 - protein, 68 aa, Glycine max
  Coding DNA Sequence Number=SeqID_65969
MALPRLTCALKSGRGIVMLDFKLIAHFPHHLIIQVGAIVRDNLPRQTVSADDLLLNEPDHHTPGDASV

SEQ ID NO: 157655 - protein, 192 aa, Glycine max
  Coding DNA Sequence Number=SeqID_65970
MTQELVARGDTLWLSAPRHSVTPSVIDEQRPMWSSPPFPEMSASSGGDFFKSHKLSRTTGGGPDDMRRQNLVIPHPFAIRHSRVRWHTETNYGHSALFCHPEAAGPMTCGDKIWSFRTPLPFRHSHVRWHAETNYGHSAPFCHLEAAGPMTCGDKIWSFRTPLPFRHSRVRWHAETNYGHSAPFVNRGRQAR

SEQ ID NO: 157656 - protein, 42 aa, Glycine max
  Coding DNA Sequence Number=SeqID_65971
MADALATLASMFQLTPHGDLPYIEFRCRGRPAHCCLVEEERD

SEQ ID NO: 157657 - protein, 62 aa, Glycine max
  Coding DNA Sequence Number=SeqID_65972
MENIDERIMKMEMNCEAGFMCAQVSRTVHQTGGSCTGTNTQAANKKQIMLAMKILKMKISYL

SEQ ID NO: 157658 - protein, 216 aa, Glycine max
  Coding DNA Sequence Number=SeqID_65973
  Gene Ontology: Mol. function=motor activity; Cellular component=cell projection
  Homolog annotation: Hit_ID=UPI00016621D1; Match level="QueryCoverage =68%, HitCoverage=40%, E-value=3e-16, Identity=36%"; Hit description =UPI00016621D1 related cluster
MPSPLEGYTSSPSEDYTLHVLVIRGLHPLAFRGLHILTFRGLHALTFGGLHVFTLRGLHTLAFRGLHALTFRGLLALTFRGLHVLAFRGLHALSFRGLHVLAFRELHALTFRGLHILTFRGLHILTFRGLHILTFRGLHVLTFRGLHVVTFRGMHVLAFRGLDVLTSPSEGCTPSPSEGCTPLPLRTTRARHQRAARPNLQRTTRPRQQRAARPHL

SEQ ID NO: 157659 - protein, 159 aa, Glycine max
  Coding DNA Sequence Number=SeqID_65974
MVIDQSLFYDLTQLSSEGVPFEGTLIDDWKFEFFVHDARRLVCTNQADMTGRLLAGSLAFERRILHYLIGRILLPKSSNLAQVSEEDLIVMWAFHKGLKIDWAHLIRYRMHKSLRLNAPLPYPHLVTFFLQHFNIPLDSEPYVPIKRSFLIGTAVIASF

SEQ ID NO: 157660 - protein, 216 aa, Glycine max
  Coding DNA Sequence Number=SeqID_65975
MGEIEEMQERMKADMEAMKEKMATMMEAMMSMKKIMEVNAAAVAATSAIAEVDLTPLSGLNQINHPTSDRVGQGSKELGSMGGPHCVQIQKKYAFPPYGLPLNYTPPNVARAPDGNVDKSAPILIESQQPQSDHAPVSQPMGETHEVPHHNLADLEPRLGYSIEGQAVGDVPLPNTLEGPSVSPTTTTLVSYCRESPSCYGGKGEIGSYRGKAKGH

SEQ ID NO: 157661 - protein, 96 aa, Glycine max
  Coding DNA Sequence Number=SeqID_65976
MGKKMLQMGIEDQKISFDLFHEDRDHPSQNVCLKVHVMEERRHEKKVLEVGTLAGSAKCQSLTGFEFLEKVLSAACYAKPEMLTGPDAILPPKGIG

SEQ ID NO: 157662 - protein, 109 aa, Glycine max
  Coding DNA Sequence Number=SeqID_65977
IAPARHPVDPEKFNRVLGFPALITDLCQFYGVPVAPNKVIRPPTNRAFIKKYCVPRQAQGKTPQQPGDGRQRATDALPPPPEPLSSSTKVGVLPTTCGQPAGDQVQSQR

SEQ ID NO: 157663 - protein, 153 aa, Glycine max
  Coding DNA Sequence Number=SeqID_65978
  Homolog annotation: Hit_ID=A5BKB8; Match level="QueryCoverage=32%, HitCoverage=14%, E-value=1e-18, Identity=93%"; Hit description =Putative uncharacterized protein
IIAIVGLQRGIPSKRESSARVDYVPALCTHRPSLLPIEWSGEVFGLRRREPAEGSLSMPHNQIDPANLFIHLPSGGEGMTTAPRAPGLLVLATNTNPGASCAKELKSVKCDSRGPGDGNPVNHRVFERKLRPKPLGRGHACLGVTHRFPNANM

SEQ ID NO: 157664 - protein, 104 aa, Glycine max
  Coding DNA Sequence Number=SeqID_65979
  Pfam annotation: Domain name=SWIM; Domain location=24-56; Score=15.1; E_value=0.011; Accession=PF04434.8; Description=SWIM zinc finger
MQGIGEFEVQEIANKRLDRRAMACTVKLNEWSGDCGQFQALRLPCLHAIAARVFCNLNYDNFVDPVYKLKNIFKVYQHHFHSLGSEDTWPQYLGSYFMSDPSKR

SEQ ID NO: 157665 - protein, 60 aa, Glycine max
  Coding DNA Sequence Number=SeqID_65980
MPKDRGTCLDFRDCHHEKGGDCRQRIKLNVLMMPKDHMLLKALFKTKKLKIFKMDDQDSL

SEQ ID NO: 157666 - protein, 59 aa, Glycine max
  Coding DNA Sequence Number=SeqID_65981
MIKARQKGGKKGGGCRPARPGELRSPKRAGLLPPEGTAFCWNILEVPSGPDCYLHTHVY

SEQ ID NO: 157667 - protein, 420 aa, Glycine max
  Coding DNA Sequence Number=SeqID_65982
  Homolog annotation: Hit_ID=A7UQU7; Match level="QueryCoverage=62%, HitCoverage=61%, E-value=2e-22, Identity=27%"; Hit description=IMP dehydrogenase/GMP reductase, putative
  Pfam annotation: Domain name=DUF1723; Domain location=83-126; Score =11.3; E_value=0.024; Accession=PF08330.1; Description=Protein of unknown function (DUF1723)
MIRTRGLGLTLGRTIGKDPPTAEEELVDVQAEAPIHEGATDVEGFPGGSHDTFVLSDFENHIALRERPELKLSSHGRKVTKIGRPAPEIEGLETSSFHFPVGEVSITLDDVAALLHLPIVGAFHSFEQLNVDVVVDLLVELLEIEACEWIVAAQAYLLHLLGCTLFANKSATHGVVALVHMYDHLNDVSKSTAKQLAGYITLLQCWIYEHFLSVAASVPAEDYDQRRPRACCWTSGKALQILRYWRRLDRLTLDAVCWIAYGDHRAFREFEVTSLFSGHIRWGPYMVIHRSEKYVAHVGQLCTVPSHYLADYLDWFYRISHPFMTPAQSGDPSRVLLVQEEEQFVEPHMYDQLMAATAPNEADIDQHDLRHAVDDFAVIADRLDMLLNLRILTEGIGAYVVVDECVGIARRYTGDPPVAY

SEQ ID NO: 157668 - protein, 36 aa, Glycine max
  Coding DNA Sequence Number=SeqID_65983
MEKRARKGTRRRRECERVNGEEESASEIGRVKYNLK

SEQ ID NO: 157669 - protein, 123 aa, Glycine max
  Coding DNA Sequence Number=SeqID_65984
  Subcellular localization annotation: CTP_CleavageSite=36; ConfidenceScore=5.79e-01
MASPPASSPPSPPLPPPPSAPSDVSASPSAVKRTHKASRLRSLSTRPPGVERPVVHVNPVIGKADGPHRKKLRTYLGIVARDKVDVTYENWKEVPTAQKDLIWKDIQAEFEIPEASDSRTKRK

SEQ ID NO: 157670 - protein, 203 aa, Glycine max
  Coding DNA Sequence Number=SeqID_65985
MEEAYQRHLTVTATVVLNLGFAYFDLTQSTNLMSQDTLLEPPLSLSFLPLLKLGVGTSSLGATTSAGVFSARTGGELTGIGPSGELIGTGAGGKLTRVTIGGVAVGGLAAGGVVAGGVATGAGAAALDGGDATVGDEAGGVAVATLGNANKKTYLTRKINRGRGGRRGKGRRGGGQRKGLPGSGGSQRKERWLGFSKTLLGKP

SEQ ID NO: 157671 - protein, 226 aa, Glycine max
  Coding DNA Sequence Number=SeqID_65986
VLSYSNLALTSHTSDLNMDWARLVYGLVMKMDMGVGLLISGQISQMAQSNSSRLGLPALITTICFARGVVPDSLTFESLSPAINLGPSSSAPLALASTPTPSVALALVPTPAGTSTQSSDLISIHNLAQHRSIISMEEFIAQVAWLGVQPSPLGGGGASIAQEPQPQPEVTLEVRPETTPRTSPVTTPLVEVSDEEDVTIDTDHATNMATAQSTWDPWPATAQETS

SEQ ID NO: 157672 - protein, 70 aa, Glycine max
  Coding DNA Sequence Number=SeqID_65987
MVRIGGGEYRVDKGAAPKMLNCLIERGLIRMQFDVAELCFWQQSDSRGCFNGLILSPKQGLSDNLEKRSH

SEQ ID NO: 157673 - protein, 107 aa, Glycine max
  Coding DNA Sequence Number=SeqID_65988
MTPSQIQNSPNNYQVTNDISKWAGFSAFLISHKGNYCLQCFHGLGGVQHMMLALGYNTTDANITTLEILVWDSPMENFLDDVFFDLFDVLIGDPSKGLITRDSKVEL

SEQ ID NO: 157674 - protein, 252 aa, Glycine max
  Coding DNA Sequence Number=SeqID_65989
MQSQGLALPPEPEDGPSAARVSTKGSCVDPSVNDPDTSDLDKYGLYIEDNPPHLVALGRVYEVNVEEVKDADAPVPIPIDEVNLVGHTLNTFLAWATHLLKRLSEQGAVGPTKPANRSDHEVDDPLYLMTLTIPQLFLKSLLVMWDATMFGVFNQDFPLYIKHEDLFEIAHGGQCLNISVIQLWIMHLIETSMRAGNFDVYGFLEPQSTQRSGQSQFESESYMKNWMQNSKHDVYLGAYLNGPDNYLKGIIS

SEQ ID NO: 157675 - protein, 159 aa, Glycine max
  Coding DNA Sequence Number=SeqID_65990
MEEPFFRNSSGKFLEEVFRETSGRSVLPVDVWFLPEEHFFRNVSGTASSRSFGRTPNGSSGSLRREPPFPIFSGVFYPKVTILRFHCYNNAGYYKQMGVRETNLVRGEEEDELHAWLAEKKKQFAEKKQFVEREKKLHERNSRSRKSFFRRGGLFIIFC

SEQ ID NO: 157676 - protein, 289 aa, Glycine max
  Coding DNA Sequence Number=SeqID_65991
  Gene Ontology: Mol. function=nucleoside transmembrane transporter activity; Cellular component=membrane; Biological process=transport
  Homolog annotation: Hit_ID=A5AZ51; Match level="QueryCoverage=75%, HitCoverage=54%, E-value=9e-84, Identity=70%"; Hit description =Putative uncharacterized protein
  Pfam annotation: Domain name=C4dic_mal_tran; Domain location=15-218; Score=-88.5; E_value=0.073; Accession=PF03595.8; Description=C4 -dicarboxylate transportermalic acid transport protein
  Pfam annotation: Domain name=Nucleoside_tran; Domain location=112 -287; Score=-145.0; E_value=0.051; Accession=PF01733.9; Description =Nucleoside transporter
  Pfam module annotation: Pfam domain module=C4dic_mal_tran::Nucleoside_ tran; Domain location=15-218::112-287
MENNEPPRRLEGKHAAMAVCWLLGTGCLFAWNSMLTIEDYYVYLFPKYHPSRVLTLVYQPFAVGTLAILAYKEDRINTRIRNLFGYTLFFISTLSILILDLATSGKGGLGTFIGICVISGAFGIADAHTQGGMVGDLSYMLPEFIQSFLAGLAASGALTSALRLITKAAFENSKNGLRKGAIMFFAISTFFELLCVLLYAFVFPKLPIVKYYRSKAASEGSKTVSADLAAVWHTGLDDNVDIFFGVIQWLLHCLCSHFSTQRLQGTGTKCLGKFVGVVSSWRYLCRGNT

SEQ ID NO: 157677 - protein, 252 aa, Glycine max
  Coding DNA Sequence Number=SeqID_65992
  Gene Ontology: Mol. function=diacylglycerol kinase activity; Biological process=activation of protein kinase C
  Homolog annotation: Hit_ID=Q9C5E5; Match level="QueryCoverage=77%, HitCoverage=39%, E-value=8e-83, Identity=75%"; Hit description =Putative diacylglycerol kinase
  Pfam annotation: Domain name=DAGK_acc; Domain location=37-171; Score=- 15.3; E_value=6.6e-06; Accession=PF00609.10; Description =Diacylglycerol kinase accessory domain
MAQPPMLRTYQMNTRVVGSKTMIVILTPLSGSKELAIFSLPTSTAVDGMVLTLGNIAQLAKVKFMKRHGEWQDLEIPPSIQSIVCLNLPSFSGGFNPWGTPNRRKQSDRDLTPLFVDDGLLEVVGFRNAWHGLVLLAPKGHGTRLAQAHRIRFEFRKGAADHTFMRIDGEPWKQPLPIDDDTVVVEISHLGQVNMLSTHNCKSKSVYDPSSPHHEDEEDDTDEEDSVAEEFRKFGAADTFRIPDEVDASQHS

SEQ ID NO: 157678 - protein, 74 aa, Glycine max
  Coding DNA Sequence Number=SeqID_65993
MLPQRSSPLIIAVQEPAIVQEQVNEPILEPIQQPMNPMHEPSRKSTRVHHAPDRLNLMVLDDTSNEVYHDDDDP

SEQ ID NO: 157679 - protein, 642 aa, Glycine max
  Coding DNA Sequence Number=SeqID_65994
  Gene Ontology: Mol. function=oxidoreductase activity; Cellular component=extrinsic to mitochondrial inner membrane; Biological process=electron transport
  Homolog annotation: Hit_ID=A7Q378; Match level="QueryCoverage=86%, HitCoverage=98%, E-value=0.0, Identity=72%"; Hit description =Chromosome chr12 scaffold_47, whole genome shotgun sequence
  Pfam annotation: Domain name=Pyr_redox; Domain location=270-377; Score=68.9; E_value=1.7e-17; Accession=PF00070.18; Description =Pyridine nucleotide-disulphide oxidor
  Pfam annotation: Domain name=Pyr_redox_2; Domain location=92-424; Score=93.8; E_value=5.5e-25; Accession=PF07992.5; Description =Pyridine nucleotide-disulphide oxidore
  Pfam annotation: Domain name=efhand; Domain location=430-458; Score =28.7; E_value=2.1e-05; Accession=PF00036.23; Description=EF hand
  Pfam module annotation: Pfam domain module=Pyr_redox::Pyr_redox _2::efhand; Domain location=270-377::92-424::430-458
MAQATIDLNRDGKDMSGRIHQLACTTVLPPFPTISNPNKKVLGKRRVYCYKRHTLEASLDSDIHLRLISSGGLVAYCDAKPEYVNHESKKKKVVVLGTGWAGTSFLKNMKSNSYDIHVVSPRNYFAFTPLLPSVTCGTVEARSVVEPIRSITRKYIHLLTRRNSVEQSGVNIHFSEAECYKIDNKNNKVYCRASKDKKLGGQEDFSIDYDYLVIAMGGRSNTFNTPGVQEHAHFLKEVDEALKIRHSVVDLFERASLPSLPVEEKKKLLSFVVVGGGPTGVEFAAELHDFVLEDMAKLYPSLKDYVKITLLEAGDHILNMFDKRITEFAEQKFARDGIDVRLGSMVVKVGENEITAKERASGQVVSIPHGMVVWSTGIGARPEVVEFMKQLGQVNRRALVTDEWLRVEGSDNIYALGDCATINQRRVMEDIAVIFSKADKNNSGKLDLKEFKDVVGDIIERYPQVDIYLKKNQMRDMASLLKKSQESNIIVDIEYFKEALSKVDSQMKNLPATAQVAAQQGVYLADCFNRMEECEKYPEGPLRFRGVGRHRFRPFRHLGQFAPLGGEQTAAQLPGDWISIGQSTQWLWYSVYTSKQVSWRTRFLVVGDWGRRFIFGRDSNTCCILPTGYGQPWDLSELVEGS

SEQ ID NO: 157680 - protein, 410 aa, Glycine max
  Coding DNA Sequence Number=SeqID_65995
MRACQLMILLDVIHQMSGWVALAFGTLVTTFHGALQDKDLFPNTKREVSILKPPLPRWVKLNCDGTLINYFWKVGHKGLVRGDSGRFILGFSIKLGIGGGGGSEEDEAMGFRGLEIFVLRRSLCKLTLEGFLYWRNEKTVTNQKISLLAGYTCPSCTDSASGPDVFALACSRGEGRGSMDLAQCSRGFRGLEIFVLRRSLCKLTLEGFLYWRNRKEVTNQKISLQEGYTCPGCTDSASGPGIFALACSGGEVPNQPPVLEISNNLVKSFTSKDPQGMYPPLFSLNNLVDVPSTRTDSQEIYPLLFSVNNPNRCTLYLYHKGCTLQCVKTKFSGGFRGLEIFVLRRSLCKLTLEGFLYRRNGKAVTNQKISLLAGYTCPGCTDSASRPSVFTLACSRGKGRGGMDSAHCSR

SEQ ID NO: 157681 - protein, 88 aa, Glycine max
  Coding DNA Sequence Number=SeqID_65996
  Homolog annotation: Hit_ID=A9P8A4; Match level="QueryCoverage=60%, HitCoverage=53%, E-value=4e-22, Identity=81%"; Hit description =Putative uncharacterized protein
MDHHGPPKVACWKDPMSPSKWKEEHFVIVSLTGWGLLIYGGYKLATGGKGKKEELRVFKYPTLAVCLLISNIVRQETNQISSEGAKDQ

SEQ ID NO: 157682 - protein, 438 aa, Glycine max
  Coding DNA Sequence Number=SeqID_65997
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=A9PDW8; Match level="QueryCoverage=84%, HitCoverage=84%, E-value=1e-175, Identity=78%"; Hit description =Putative uncharacterized protein
  Pfam annotation: Domain name=Branch; Domain location=88-313; Score =410.4; E_value=2.6e-120; Accession=PF02485.12; Description=Core-2I -Branching enzyme
VLADLGLNSSAGTENSEGALKFDLGLAVPQEYEEKSILGLLSSDGGGEQSPFEIISFKRSEDSSGYFVESDIEKSLNVSVVKREAPRFAYLISGTKGDSHRMMRTLEAVYHPRNQYILHLDLEAPPRERLELANAVKADPIFRGVENVRVMSQSNLVTYKGPTMIACTLQAIAILLKESSEWDWFINLSASDYPLMTQDDLLHVFSNLSRNLNFIEHTRIAGWKLNQRARPIIIDPALYLSKKSDLALTTQRRTLPTSFKLFTGSAWVVLTRSFVEYCIWGWDNFPRTMLMYYTNFISSPEGYFHTVICNTEEFHHTAINHDLHYIAWDTPPKQHPISLTVKDFDKMVKSKALFARKFAKEDPVLDKIDKELLGRTHRFSPGAWCVGNTDGGADPCSVRGNDTMFRPGPGAERLRELLQVHINNQQALTSAVLVLVSV

SEQ ID NO: 157683 - protein, 116 aa, Glycine max
  Coding DNA Sequence Number=SeqID_65998
MVKIYLKLSIENSQEEMLGYKCEVSLCGGSWSTGVSLESPQQLVSEPKVQDGDRLRRVCKYRRWPEWLAAQRAPQGKRAGQVPQVSLCGGSWSTGVPLESPQHQTPNALEHLLNGY

SEQ ID NO: 157684 - protein, 82 aa, Glycine max
  Coding DNA Sequence Number=SeqID_65999
KEWDIISTKCLWQEEQPFLEREFLVEGNHGKEIEPDETQVTSDNITQEHEMETERPFFDVLKLGQSSLTQTIMAQEPATIQE

SEQ ID NO: 157685 - protein, 72 aa, Glycine max
  Coding DNA Sequence Number=SeqID_66000
MPDLNKTFKEATKAIGVAQVLLTTCMEVLQIKRFRWDNWQNKCLSMKVDPSQQPQKSTQENNVRQLQLGGGQ

SEQ ID NO: 157686 - protein, 163 aa, Glycine max; identical to SEQ ID NO: 141795
  Coding DNA Sequence Number=SeqID_66001
  Homolog annotation: Hit_ID=Q6UUU1; Match level="QueryCoverage=52%, HitCoverage=55%, E-value=8e-19, Identity=61%"; Hit description =Putative uncharacterized protein

SEQ ID NO: 157687 - protein, 149 aa, Glycine max
  Coding DNA Sequence Number=SeqID_66002
MEQVSIGHRNLGMAFVDNWVVDKENGCYWLSNDIVGLVGNLAISASTLSPAKTKSAKLEGRQPLGPYMNGLRKMVLGASSPLVLVKVQHLKHGNDHVRVLGKTLLGGALPSQMQGFWLWAKLRALQSVGMGTTNCLPSSGISEARLEVG

SEQ ID NO: 157688 - protein, 122 aa, Glycine max
  Coding DNA Sequence Number=SeqID_66003
MKAQVEKDEGPEAEALSRPLMLLKAQTNLKAQTYQGNPCGVYPDLSSFIGSGVYPDLSSFIGSGVYPDLSSFIGSGVYPDLSSLTGSGVYPDLSSFTGSGVYPDLSSFTGSGVIQTFVACIK

SEQ ID NO: 157689 - protein, 159 aa, Glycine max
  Coding DNA Sequence Number=SeqID_66004
  Homolog annotation: Hit_ID=A1JJA1; Match level="QueryCoverage=42%, HitCoverage=14%, E-value=1e-12, Identity=53%"; Hit description =Putative DNA-binding protein
  Pfam annotation: Domain name=HipA_C; Domain location=12-81; Score =10.4; E_value=4.9e-05; Accession=PF07804.3; Description=HipA-like C -terminal domain
MVASVRRSEGVLCGLRRGLRGTLSDCGTVGWLPGRRVREAANSTARLWAFGMLIGNTDMHAGNLSFISRHGRPYHLAPAYDILPMGFAPRAGGAIVNTLRPASLPEVVSSDTWREALALAEEFLSLANSCDGFSDRFAPCLAALQQHLDEARARIARLG

SEQ ID NO: 157690 - protein, 165 aa, Glycine max
  Coding DNA Sequence Number=SeqID_66005
  Gene Ontology: Mol. function=oxidoreductase activity; Biological process=metabolic process
  Homolog annotation: Hit_ID=Q9HUX8; Match level="QueryCoverage=84%, HitCoverage=52%, E-value=7e-24, Identity=43%"; Hit description =Probable short-chain dehydrogenase
  Pfam annotation: Domain name=KR; Domain location=29-159; Score=-59.6; E_value=0.0007; Accession=PF08659.1; Description=KR domain
  Pfam annotation: Domain name=adh_short; Domain location=26-165; Score= 32.1; E_value=9.5e-08; Accession=PF00106.16; Description=short chain dehydrogenase
  Pfam module annotation: Pfam domain module=KR::adh_short; Domain location=29-159::26-165
MDMMVVILSAHQYDDHHTEGFSMSHQLALITGASSGIGATYAKQLAARGNDLILVARDAARLSALAQSLREAHGVEVSVLAADLTRHEDLVRIDSELRNNTRITTLINNAGMTVEGEFIDASIDQTQTMLALNVVALTQLSHTAAQVFRSRNAGTIVNVASVLAL

SEQ ID NO: 157691 - protein, 43 aa, Glycine max
  Coding DNA Sequence Number=SeqID_66006
MSGKRHNVRVVKRDTVDGSFWFRQTIPFWRFYSLGRGYFLIRI

SEQ ID NO: 157692 - protein, 161 aa, Glycine max
  Coding DNA Sequence Number=SeqID_66007
MAPTRHPLDPDKSNRALGFPALITGLCQSFGVPVAPSKVIRPPITRAFIEKYCTQRQAQGDAAQATDAPQPHQAGPAEVFDMKQYLRHLVRQQAANHRAHGFTSFPCPTPDQFRAEVALPGDWPEAQAGEAPAEAPDEADEAREDEEMTDLLDFLGGSRAT

SEQ ID NO: 157693 - protein, 49 aa, Glycine max
  Coding DNA Sequence Number=SeqID_66008
MEVTLAIREVCVASFSRNLLKELSSSFSRKLLKEASQGSFSRKIVKEAS

SEQ ID NO: 157694 - protein, 154 aa, Glycine max
  Coding DNA Sequence Number=SeqID_66009
  Pfam annotation: Domain name=zf-CCHC; Domain location=77-94; Score =30.2; E_value=7.5e-06; Accession=PF00098.14; Description=Zinc knuckle
MELRRLNRNEENDKKKRSIALKASSSIQEENEEEDSNDEEDFSFFVKKFQKFIKKRRIDRRQNFNNGRKSQDDSQVLRCYKCNQIGHIKFNCPSNEEWSEKSEKKRFDERRTKKAYIAWDDNDSSNGLEKEINLLTKDYESDENISHQKQGEKA

SEQ ID NO: 157695 - protein, 71 aa, Glycine max
  Coding DNA Sequence Number=SeqID_66010
MVNPPSSSEREVVPPSPPLIVISDASSDEATAPPDSPARETADPPASPVGGIADLSDSSSGEAVALTDSPV

SEQ ID NO: 157696 - protein, 89 aa, Glycine max
  Coding DNA Sequence Number=SeqID_66011
  Subcellular localization annotation: CTP_CleavageSite=31; ConfidenceScore=5.02e-01
MPMRGRNNTIVNTHRRRTKHAIGRLGRRPTKVTKKTQNKTHKKTQPSFFKRKKKDSKKDVKVTNEGHEEVAMARKKRNGEEGGRKQQKS

SEQ ID NO: 157697 - protein, 168 aa, Glycine max
  Coding DNA Sequence Number=SeqID_66012
  Homolog annotation: Hit_ID=Q6WAY6; Match level="QueryCoverage=31%, HitCoverage=9%, E-value=9e-09, Identity=50%"; Hit description =Putative uncharacterized protein
EGGAGVLCSCEGFPNVPLMGTRGCINYNPMLAIRQLGYPVRRAPSEEIIVLLIARDKELRGSNNGVIRDYHTWLKARTEEAEVPEESEEVQSLKAKLERARGVKEKFKMTATRVRKECDELRDVNMAMAEGTQALKGRKGRVKDGKYDIRGQVEGLSKVEEEFNRTTE

SEQ ID NO: 157698 - protein, 102 aa, Glycine max
  Coding DNA Sequence Number=SeqID_66013
  Subcellular localization annotation: CTP_CleavageSite=38; ConfidenceScore=5.71e-01
MADSSKKRKGSSASASASRAHRSGASSAFTAPIPPSLSSSTLFSSEEQQKWYSNLFSSRSIIDPKFIDMEFFFAETFDCIQAFQNLGLIPFMSLQLPIYPEL

SEQ ID NO: 157699 - protein, 114 aa, Glycine max
  Coding DNA Sequence Number=SeqID_66014
HPLVLEEGQRYEFSQRRSQALGFDEEAIGQLLCVPGQDFARSVTRRWVQIMCTSMTTLTEIWMALLLSNILPNDHNSDLSLPKCQLVYAILTQVSVHVAQLISDAIYKFVGITP

SEQ ID NO: 157700 - protein, 140 aa, Glycine max
  Coding DNA Sequence Number=SeqID_66015
MRLPGKESLLMKSPITINEILDVSILFLNDHLEETLGSTKIEEIHSKCINLAQLSLQLEIFLLFLFASEGKDYGESGFWLKVCRMARHDTCRGLVWLKDKRDAPHYFHDTNAKMMIWKLYAKLVMHASTRTLKCQPFMVM

SEQ ID NO: 157701 - protein, 145 aa, Glycine max
  Coding DNA Sequence Number=SeqID_66016
  Gene Ontology: Mol. function=ATP-dependent helicase activity; Cellular component=intracellular; Biological process=RNA processing
  Homolog annotation: Hit_ID=A7P4V9; Match level="QueryCoverage=79%, HitCoverage=7%, E-value=1e-28, Identity=58%"; Hit description =Chromosome chr4 scaffold_6, whole genome shotgun sequence
MTQKLRLESAVTKGIDGLCSKTIADCVEALIGAYYVGGGLTAALHVMQWLGMNVGHDSPLVHEAITRTLLRSNVPKAYYINSLELKFGYEFSTKGLLLEAMTHPSQQELEPGICYCYQESSTSSSVLFQNSSKSSNKVHEFNGGK

SEQ ID NO: 157702 - protein, 305 aa, Glycine max
  Coding DNA Sequence Number=SeqID_66017
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIDHRSPTRHNLSLYLHLLSRPCNFTVLIGRIVAFPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 157703 - protein, 117 aa, Glycine max
  Coding DNA Sequence Number=SeqID_66018
  Homolog annotation: Hit_ID=A8ARU6; Match level="QueryCoverage=40%, HitCoverage=60%, E-value=4e-15, Identity=76%"; Hit description =Putative uncharacterized protein
MAYERGGDFLEDARKILNREAFPPGGSLVRSPVPAFRFTGVIPLLWPRLSHSTPDTQFRVGSSLPSWTVCTNPPFSPTAAPYPETIVLSPTRKDMQKHHWQQPLVIDLEKLVLKSCA

SEQ ID NO: 157704 - protein, 42 aa, Glycine max
  Coding DNA Sequence Number=SeqID_66019
MDKSWKVGEDEWRERERRSTEFCASNESTNPRSRPRFSTKCA

SEQ ID NO: 157705 - protein, 101 aa, Glycine max
  Coding DNA Sequence Number=SeqID_66020
MGQLQRQAFRKAYGKIWDLATIEVSVDVNASLTQYYDHPLRCFTFEDFQLVLTVEEFEEILGCLLGGRKPYLFSGFYPSMARVAKSCPLSKCGRVSGPCRN

SEQ ID NO: 157706 - protein, 183 aa, Glycine max
  Coding DNA Sequence Number=SeqID_66021
MRRGSGKVPEELLDALAGGKIKLKTPEEAMERIKNMVANDHAILRDRAYTPKKKSLLELTSQDVVLAQNKLLTKTLETLIATLSNLPQQLHAVQPPSTMHSGGCNICWGAHESGSCMLRITTDSKATTKEDRRDSTKGEISHWAQAGGIIRRTSSTRSKKVNLSRIPTKRSIFMRRPTSLRRH

SEQ ID NO: 157707 - protein, 88 aa, Glycine max
  Coding DNA Sequence Number=SeqID_66022
MPQPNTAEAPQHCPLQPLHFLVGRLPPIKEKREKLDLIKERLRVVEGFGDFSFVDMAELCLVPDVVIPRISRCQISISARGLLAPRTT

SEQ ID NO: 157708 - protein, 125 aa, Glycine max
  Coding DNA Sequence Number=SeqID_66023
SSSSLLSKAILGGEAPSSLAYSLVDASIKAPQSSFHQGLSQSYGVPVTPSKGDAHQDAGAPPPPRQANLAGPLGAANHRGQVTWPGDWPDAQAGEEPTGSPDEADESQMDEDMIDLLGFLGGSGP

SEQ ID NO: 157709 - protein, 164 aa, Glycine max
  Coding DNA Sequence Number=SeqID_66024
MSISPCGSISWSVPSRHRVCAPYEGFLGLGEVQQGPRVPGSDHQALINRAFNEKFCAPRQAQGEAPQQPGDDQQGATDASPPPSGSTSAHLQKLECCLRHVADQYWAHDRQIVITRPAQDVKEALLGGNLELAAKKLPATRSRKGTIEEGSNATPQSDTGFDKH

SEQ ID NO: 157710 - protein, 306 aa, Glycine max
  Coding DNA Sequence Number=SeqID_66025
GVMAEVNEVQERMKADMEAMKEQMVTMLEAMMSMKKIMEVNAAARLHTLDFRGLHALTFRGLHILTFRGLHAFAFRGLHVLAFRGLHVLTFRGLHILALRGLQSSSSEDIKGLHVLVYRGLHALAFRRLHALDFKGLHVLAFRVLHALAFRGIHVLTFRGLQALAFGGLQTLALRGLRLQRTTRPRLQRATGPDLQRTTSPRRQRAPCPRLQRTTRPRLQRTACPYLGRTTCPHLQRTTRPNLQRTTRMHVLAFRGLHILAFIGLHVLAFRGRHTHTFRGPHILTFRGLHAHQHDHSYTDMDDIAT

SEQ ID NO: 157711 - protein, 113 aa, Glycine max
  Coding DNA Sequence Number=SeqID_66026
MIVRSFGFDGPYDVYPPHGKRPRGGHDIQGMWRSIDIVRERLTFMAFPYMGTTITFHIEPVITCSQDLPGHSMPIGMRSTRTLMDFLDHVAYRPIPLPPDNNAGLPRHQNSTY

SEQ ID NO: 157712 - protein, 216 aa, Glycine max
  Coding DNA Sequence Number=SeqID_66027
  Gene Ontology: Mol. function=chitin binding; Cellular component =extracellular region; Biological process=chitin metabolic process
  Homolog annotation: Hit_ID=UPI00006A17C9; Match level="QueryCoverage =68%, HitCoverage=100%, E-value=1e-14, Identity=30%"; Hit description= UPI00006A17C9 related cluster
  Subcellular localization annotation: CTP_CleavageSite=12; ConfidenceScore=5.03e-01
MLVSMIRTRLFVAARVKSCPGMQSSYAIASPSSCARTVGPPPISGGGPGTDKRKLLAPHPGAQAPLKARTCSPLKARTCSTLKARTCTPLKAMTCSPQKVRTRSPRKARACSPRKAMACSPLKVRMCGPLKVRACRPLKARTCSPLKARTCSPLKARTCSPLKSSEGEDMEPSEGEDLKSSEGEGVLPSDGEGLQTSEGEDMYPVGSSGLRIIKKG

SEQ ID NO: 157713 - protein, 133 aa, Glycine max
  Coding DNA Sequence Number=SeqID_66028
MFSEWPLRNQKKLLDWTFHNQKTFQNEHSIRKKVSAMRFWKWGSRKYYWAYEKPSLEETSFLEVTKAFWNSFPSRKCVLEWSFWKQKNYFGKPIPETCPQHEWETLKRTWRGELEKERDFCAGTSSMDSWKKT

SEQ ID NO: 157714 - protein, 189 aa, Glycine max
  Coding DNA Sequence Number=SeqID_66029
MSHTNSIMISSRIKESRLEQLDEIQVKAINTSNGKNLRPRPEDADISWKGADDHVGADNHKVCLRATGPLGHDSRIETFLRSRPEDADLFRKGADDHIGADNHKVCLRATEPLGHNSRIETFLRSRPEDAELSRKGVDNHKVCLRATGSLGHDSRNETFLRSQPEDADISGKGANDHIGLCWIKWPRNN

SEQ ID NO: 157715 - protein, 168 aa, Glycine max
  Coding DNA Sequence Number=SeqID_66030
MAFVRRTRGETCKTNDSDAQGRKFVEPPSMDNYCSVLRVATLTSGGHAFGFTGETRRVRHVQCTNNILAYMSLVEWAHTEDVVISIGVSSSKETHDGASDNESSSLERLRVRTVLVEALLTSMGGRNLSLLLCAELPSSPPVTASFEWVFVRGLGSDSPFDRILVCSA

SEQ ID NO: 157716 - protein, 159 aa, Glycine max
  Coding DNA Sequence Number=SeqID_66031
  Gene Ontology: Cellular component=nucleus; Biological process=cell division
  Homolog annotation: Hit_ID=Q8L6U0; Match level="QueryCoverage=64%, HitCoverage=27%, E-value=2e-16, Identity=45%"; Hit description =Cyclin D2
MEGSIDPATSSLLCLENNDMCFDDFDFKIHFDGLFLLNLSLHLKLKTFKEWNYWPSEIAAAVAISVSREMQAEEIDKTLTCFFIVGKERILKCLELIKDLSLIQDSANLGTNLASFVPQSPIGVLDAACLSSISDELTVGSYTDSSLNTPNSKRRRKSD

SEQ ID NO: 157717 - protein, 131 aa, Glycine max
  Coding DNA Sequence Number=SeqID_66032
MRHNLFSSFNVGKKEVKINLLQYVDDTIFICDVSLRNVITMKIIMRSFELASRLKSISIKVALEVPILEGWKLGKPIADKVKKKVVALVWLDGWLEGECLAMKYHRLFLISSQQQDEVGKMGVWCDHLRSW

SEQ ID NO: 157718 - protein, 43 aa, Glycine max
  Coding DNA Sequence Number=SeqID_66033
VLRERFPAEFRREEKEKSDFRQEEKEKSECKVFERAGCEVSMF

SEQ ID NO: 157719 - protein, 90 aa, Glycine max
  Coding DNA Sequence Number=SeqID_66034
MEQKNYEPATVACTITVWAQQQQHDDVGERIRANVTSMRSFNGDFPPWRCSGRQRRRGERRRHLLGNKPWKKELHHQDEPWIRSLERMLQ

SEQ ID NO: 157720 - protein, 83 aa, Glycine max
  Coding DNA Sequence Number=SeqID_66035
MVVFKVFIVLVSQPTLLRASEARLTGASSKGGKCAESPPMFICGKRQKNRRKPVMKNILDSGVEFTFEEGISTSHVCLKGLQP

SEQ ID NO: 157721 - protein, 86 aa, Glycine max
  Coding DNA Sequence Number=SeqID_66036
MERYLQHLVRQQAANHQGQVQIHECLYQLSLSQQGQGFAPFACPTPDQFRAEVAWLGDWPEAQMEEASVGVPDDAEEARMDEEMTD

SEQ ID NO: 157722 - protein, 217 aa, Glycine max
  Coding DNA Sequence Number=SeqID_66037
MEVNATTVIVASTATEVDPTHPSDLNQINHPALNMVGQGGKELGSVCGPHFVQFQNKHSFPPYGLPPNYTPPNVAHAPDKNVNNSTPILIKRQQPQSDHAHYHPQPQSLHFAVGRVPPAMVEKEKLDHIKERLRAIEEGGDYAFADMEELCLVPDVVIPLKFKESLTGATVTWYTNLEPSRVHSRKDLMGSGSSSSAPNNGKGDDNNDSRHITGVLL

SEQ ID NO: 157723 - protein, 37 aa, Glycine max
  Coding DNA Sequence Number=SeqID_66038
MALGTMGARPGELMLHPEKPVSNNIFRLARIKNINGW

SEQ ID NO: 157724 - protein, 60 aa, Glycine max
  Coding DNA Sequence Number=SeqID_66039
MVWIGNKLLFSSGQVCEAQLPWHFPYQLRQVSRAQFSVWCRRAGAREPAEEQGGNDNMEG

SEQ ID NO: 157725 - protein, 235 aa, Glycine max
  Coding DNA Sequence Number=SeqID_66040
  Homolog annotation: Hit_ID=Q69V30; Match level="QueryCoverage=66%, HitCoverage=16%, E-value=3e-08, Identity=30%"; Hit description =Hydroxyproline-rich glycoprotein-like
MTFWPNLISYKPQMPRRSEQKQDPSIKYGIDQQTWDEFAASRKTLAWQEIRKKAQQIQKNNGCLHVLSRGGYDLLEKKLIYKKRRKRQEEKMLTENTPLLEDPPSPIERHVKWKMARTKQYGQMTSQAAQEKSDRITTQGSFVPHGRDDILNTVIGRPEHTGRVRVAGSGMTISQYYGRASRGSSSSSTSITQQQLADIIGCLKEKWRNEIIRNLKEEVRHEIEEENRWSLEKLK

SEQ ID NO: 157726 - protein, 122 aa, Glycine max
  Coding DNA Sequence Number=SeqID_66041
MGFRELSGGREDQGMASTSGDATPPSPKTARLMVEIIKLGDQMRIMSYDNEERMERMRKENNKSLGRIHRSNKALSVRIENIERRREERSSNSSHGKDEGGWRNERYRERRNHKRYGGRQRE

SEQ ID NO: 157727 - protein, 659 aa, Glycine max
  Coding DNA Sequence Number=SeqID_66042
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=66%, HitCoverage=29%, E-value=1e-136, Identity=63%"; Hit description =Similarity to kinesin heavy chain
  Subcellular localization annotation: CTP_CleavageSite=52; ConfidenceScore=5.39e-01
MPYFQLSSPLAHGSANVQPRDIGRNGTNNNTSSRSMDVLPSPLATDKNDGTVALVKTGSEIVKTTPAGEYLTAALNDFDPDQYEGHAAISDGANKLLMLGNYTNPKVRAHYTRETPVVWDTTPVFVDCKVLAAVIKAGASREHEILAEIRDSVFSFIRKMEPKQVMDTMLVSRVRILYIRSLLARSPELQSIKVITVEAVGFLFEKKISSNKVFAVYFWDALLSLVVLPVECFLEKTNTGRSRSSSRGSSPGRSPVLYVDEQIQGFKVNLKPEKKSKFSSVVLKIRGIDEQVTGGKLREITEEAKSFAIGNRALAALFVHTPAGELQRQIRSWLAESFEFLSLTGEDASGGSTGQLELLSTAIMDGWMAGLGAALPPHTDALGQLLFEYSKRVYTSQLQHLKDIAGTLATEEAEDAAQVAKLRSALESVDHKRRKAMLSITGVAAERPPSAMGMDVAARFNVAVGTAAIAAERHGIWIGFLRRYTEAVEIPKMPSLNAGKLRHPGEAATPATLQHRQAPPPPPCPGARCESATLTCPRNTDTDHGTPPLAAMTAMGSHWSRSSLRDVREIMVVKTHTTTACYAWFERQQEGLFSWGGGAMTLLPLGVGGGVSVVSAAYVRNNRMRAKRRKVRVKKEGAVAAMSISMDREWLVEDGEAEH

SEQ ID NO: 157728 - protein, 138 aa, Glycine max
  Coding DNA Sequence Number=SeqID_66043
  Gene Ontology: Mol. function=aspartic-type endopeptidase activity; Cellular component=small subunit processome; Biological process=DNA integration
  Homolog annotation: Hit_ID=A5ACK0; Match level="QueryCoverage=100%, HitCoverage=36%, E-value=1e-30, Identity=45%"; Hit description =Putative uncharacterized protein
MASSGPVLSFSGTPTITTAKLNWKNYLSWSASVELWFLGQGHHDHLEKAAEEVPIDKRSEWEKLDYQLCAVLWQSVEPDVLEILRSFKTCCSFWKKAREIFANDIQSLFDATMKVTALKQTNHDMIAHIGKARAVVEE

SEQ ID NO: 157729 - protein, 106 aa, Glycine max
  Coding DNA Sequence Number=SeqID_66044
LGVKESRLEKLDEIQVKAINTSTGKNLWSWPEDADISGKGADDHIGLCVSTGADNHKVCLRATGPLGHNSRIETFLWSRAEDAELSGKGANDQIGLYVSTGSLASG

SEQ ID NO: 157730 - protein, 159 aa, Glycine max
  Coding DNA Sequence Number=SeqID_66045
  Homolog annotation: Hit_ID=Q949J7; Match level="QueryCoverage=54%, HitCoverage=64%, E-value=1e-08, Identity=43%"; Hit description =Putative uncharacterized protein
MGHGEGDEPLDVGDLYVDVITVAKEKSKMKVELVEVFVALALLRNSEGDKDKGLSQSPKRTTEKSKMRRCQVLYFVLKTLNESGHQYVYNAAEKPLLYAQTAAVLELFLTFFTFWCGVVLNCVVDSSWLGRIGEVSSNSNIATDKFKAFPGLGHLMEFS

SEQ ID NO: 157731 - protein, 57 aa, Glycine max
  Coding DNA Sequence Number=SeqID_66046
MRCEYPQNLSQKNDDLGLIHRWIIVKFEYHVRNQISSIFTVGNCKNMSELREIPFAP

SEQ ID NO: 157732 - protein, 72 aa, Glycine max
  Coding DNA Sequence Number=SeqID_66047
MEEGERVNLTIHGKNKVDQPKNKGKILAQPVIKKESKCFFCKKKGNMKKDYLKFKSWMDKKGYGKPKEASGK

SEQ ID NO: 157733 - protein, 57 aa, Glycine max
  Coding DNA Sequence Number=SeqID_66048
MAENLHGITHGNENEGGACHLACLDELGCFLQKAPPSRGTSWKAQVGLVAICTAPVY

SEQ ID NO: 157734 - protein, 183 aa, Glycine max
  Coding DNA Sequence Number=SeqID_66049
ADNHKVCPHATGPLGHDSRNETFLRSRSVVADIFGKGADDHIGADNHKVCPRATGSLDHDSRNDAFLRSRPEDTDISEKVQMTSLVYVCQRARLPLVDKRLACLWLTKGANNHKVCPRATEPLGHDSRIETFLHSWPEDAHIFGKGANDHIGLYVARMDILTLGQGLWDKGMSHTIYMTHMQQ

SEQ ID NO: 157735 - protein, 359 aa, Glycine max
  Coding DNA Sequence Number=SeqID_66050
  Homolog annotation: Hit_ID=A2YU48; Match level="QueryCoverage=34%, HitCoverage=12%, E-value=3e-07, Identity=27%"; Hit description =Putative uncharacterized protein
MDDISQIQIQNQITDCWIWKPETIGQYSTKSAYYLLQEATVGDTLDEALEDLWKLKISAKAQIFAWRMIKDRLPTKANLGRRQIQMNDTICPFCRNNISCSKQLAQMVESSILDGSAGRTIWVLWGSSNDNKGFPAVERFPADFKREEKEKSDFRQKEKREGKVFERAEGQGLMLQPCGIGTGLKEHSNRMTPKAYTPKSPLGPLPPDSAIVTFLVLSRAPPPVALLGFLCGQTNHNIRSCKNIGVPIRPKKYVAPPTSNQDEDLLAQDGQALNEAEEVAAHVQEGPLEINLSQPNLSQDSDMEFMVPASVVDVPPVARNKLNITRPTQKNISDTPTTPLLFMPTPRLTRRKATNKDPV

SEQ ID NO: 157736 - protein, 41 aa, Glycine max
  Coding DNA Sequence Number=SeqID_66051
MTTMMEVMMSMRRMMEVNAATVVAASTAIEVDLTHPSGFNQ

SEQ ID NO: 157737 - protein, 174 aa, Glycine max
  Coding DNA Sequence Number=SeqID_66052
  Gene Ontology: Mol. function=calcium ion binding
  Homolog annotation: Hit_ID=A2X141; Match level="QueryCoverage=96%, HitCoverage=28%, E-value=4e-37, Identity=50%"; Hit description =Putative uncharacterized protein
  Pfam annotation: Domain name=efhand; Domain location=13-41; Score =18.0; E_value=0.036; Accession=PF00036.23; Description=EF hand
  Pfam annotation: Domain name=efhand; Domain location=47-75; Score =20.4; E_value=0.0065; Accession=PF00036.23; Description=EF hand
  Pfam module annotation: Pfam domain module=efhand::efhand; Domain location=13-41::47-75
MKIESRSKEETKTYQEWFNLVDSDGDGRISGNDTTKFFALSNLSRSQLKRLWALADVKRQGFLGFTEFVTAMQLVSLAQVGQELNSDILKTQSKCTFIIFPSSLEIAKMSLFITWMLYECDTCDVDKENIKPPVLEGLDALVAQMSLTINAPPEVNGTPQPQVFQTNRWFGSKS

SEQ ID NO: 157738 - protein, 99 aa, Glycine max
  Coding DNA Sequence Number=SeqID_66053
MVLLKPVLKLLVQQRLRRCHLHSCVDPSSGHRAISIAPVVSRVTEAQIASCTQFWEFFVPERGRKWWICLLISQFSTRVALEVGLRYLPGAIVAAISSI

SEQ ID NO: 157739 - protein, 112 aa, Glycine max
  Coding DNA Sequence Number=SeqID_66054
MSFYLCGLGVKESRLEKLDEIQVKAINTSNGKNLWSWPEDADISGKGADDHIGLCVSTGADNHKVSPRATGSLGHDSRNETVLRSRSEDADISGKGADDHIGLCWIKWPRNN

SEQ ID NO: 157740 - protein, 48 aa, Glycine max
  Coding DNA Sequence Number=SeqID_66055
MGRVNLGLNVRMVVLKAWVEQMTKMSDKCERKEPFLRKMLVHCWLWER

SEQ ID NO: 157741 - protein, 198 aa, Glycine max
  Coding DNA Sequence Number=SeqID_66056
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=70%, HitCoverage=35%, E-value=2e-71, Identity=95%"; Hit description=NADH dehydrogenase subunit B
  Pfam annotation: Domain name=Oxidored_q1; Domain location=23-196; Score=-34.0; E_value=1.8e-05; Accession=PF00361.11; Description=NADH- Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRDYEYNRSIRHKRITLDDHLVAIENESNQMEQVIEIEKNRSFTTTDEGFLEKLRISNPFEN

SEQ ID NO: 157742 - protein, 75 aa, Glycine max
  Coding DNA Sequence Number=SeqID_66057
MTVSDGSDCDDDNDHDNGGSSSDGVANHTDKGGDDRDDGDGDDDSLEVICQDRRRLTCQITPTSILCYGNNVYKQ

SEQ ID NO: 157743 - protein, 69 aa, Glycine max
  Coding DNA Sequence Number=SeqID_66058
  Homolog annotation: Hit_ID=Q0ZCC2; Match level="QueryCoverage=60%, HitCoverage=11%, E-value=1e-07, Identity=61%"; Hit description=CCHC -type integrase
MWLEGIDEELKIQDEVITVHCDSQSAIDLSKNFVHHERTKHMILSCILSEKLLSRSVDRLYPEEGLFRV

SEQ ID NO: 157744 - protein, 271 aa, Glycine max
  Coding DNA Sequence Number=SeqID_66059
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARIRSSPGITGIGPRSPADIKICKCSRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 157745 - protein, 16 aa, Glycine max
  Coding DNA Sequence Number=SeqID_66060
MEVVFVIGSAVDRLCG

SEQ ID NO: 157746 - protein, 319 aa, Glycine max
  Coding DNA Sequence Number=SeqID_66061
  Homolog annotation: Hit_ID=UPI00016621D1; Match level="QueryCoverage =68%, HitCoverage=40%, E-value=6e-13, Identity=29%"; Hit description =UPI00016621D1 related cluster
MSHLRGLHVLAIRGLHALTFRGLHVLAFRESCTFIFRGLHVLAFKGLHALTFRGLHALAFRGLDVFAFRGRHAFAFRGLHIHAFRGSCTFTFRGLHVLAIRGLHALTFRGLDVLGFRGLHAFAFRGLHVLAFRGLHALIGLHILVFRGLHVLTFRGLHSLAFRGLYVLAFRGLYVLTFRELHVLTFRGLHSLAFRGLHVLVFRGLHVLIFRGLHVFAFRGRHVFNFRVLHSPSPFEGYASSLSENSRSSALNAYSRLALPVKGPVVSFYQFLGHPLILEGDQLCNQNQRWRLSRSYYAYRGKISPVPLQRDECGSCAPT

SEQ ID NO: 157747 - protein, 263 aa, Glycine max
  Coding DNA Sequence Number=SeqID_66062
  Gene Ontology: Mol. function=transferase activity, transferring glycosyl groups; Cellular component=integral to membrane; Biological process=metabolic process
  Homolog annotation: Hit_ID=A7PIG1; Match level="QueryCoverage=77%, HitCoverage=55%, E-value=1e-51, Identity=49%"; Hit description =Chromosome chr13 scaffold_17, whole genome shotgun sequence
LRQERGLRTIGRIELAYGRIEVKATRFLDLAQFLTKLHKISSTSSDMDNRSKEQLCACKLEASIITKLTTIFPKVYTIGPLHTLTKTQFITNNSSSSLHLRKEDKSCITWLDQQKAKSVLYVSFGTLAKVSHEQLLEIWHGLVGSLKPFLWVIRQGLIIGEGGLGHNVPMELELKTKERGLMVNWAPQEEVLAHPLVGGFFTHSGWNSTLECITKGVPMLCWPLIADQTVNSRLIVEKMVKNLMENQIERLTSSTNEIARKSS

SEQ ID NO: 157748 - protein, 65 aa, Glycine max
  Coding DNA Sequence Number=SeqID_66063
DLEAAATPGEEPRSFEASSSFPTQGQSHIEVRGDTIMDEQPRRVTLEDYSSSSVPQRFTSIAQPE

SEQ ID NO: 157749 - protein, 75 aa, Glycine max
  Coding DNA Sequence Number=SeqID_66064
MHRSPTGNLVPLDLEIEATLRRNRAERRRKLLQDRTFASILEEETHFSDSLPPNSPSSRKSATQLPEATIMAVSA

SEQ ID NO: 157750 - protein, 79 aa, Glycine max
  Coding DNA Sequence Number=SeqID_66065
MSGLTRDSPQISASPHQLDFAPYASRSYNAQRNAPGLLHDKPTLHSSRILGKMEVVFVIGSAVDRLVVDLGMTFVDNWV

SEQ ID NO: 157751 - protein, 310 aa, Glycine max
  Coding DNA Sequence Number=SeqID_66066
MTIAVAAAPYPAFHALPGAGAFLRCGIPRPADPRGGAVSTGQRVGGERHGDHFGGGNPGVAPLPGAADDDRGAFEPGYGGGVDPDPGVRAAQAGLLNRCVKDITAYHGTRPERAELLPRWAAVACSIYIDVGRRGFGFTRQRRAQPLRQDNAQQGDAAADQVVTVQLLMQEQHGNSGGKHRRQVHEDRGGVGAQAHHALDPQERGDDRSRNAGEQHQRQVMAVQADILRHQEIRQQQQHAEQDLHVQRLPVRQRDGPAFGQHAIQRVRGGGEQHHQFPLADTVLQQHAGLAAAEGSRPPPLGGGGGRRGD

SEQ ID NO: 157752 - protein, 180 aa, Glycine max
  Coding DNA Sequence Number=SeqID_66067
MPISPCRCIGWDRAHMMPSGPEEVQQGPGVSSSGCGPMSVLQGARSPSEESLPQRHPVDPEKSNRALGFPALVTGPCQSYRMPVSPGKESCPQDTLWTRRSPTGSWSCQALIMGLCQFYGVPVAPSKIIRPPTNRDFIKKYCVSRQAQGETPQQPGDGQQRATDAPPSPLEFTSAHPQKG

SEQ ID NO: 157753 - protein, 70 aa, Glycine max
  Coding DNA Sequence Number=SeqID_66068
MEIFIQSIDPGACNAIAKGLFIPTKEVNSESVPKEWDDIKDDEKRKMQDDQKAKNILTSGLSSDEFFRTA

SEQ ID NO: 157754 - protein, 207 aa, Glycine max
  Coding DNA Sequence Number=SeqID_66069
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=8e-23, Identity=98%"; Hit description=LacZ protein
MHVYSLFDGIYYSDNRSNSRANTCNKPRLLEGMHLLDKRSTQALPVALMIHDNSSDRTAFVPATHHSNFCPITFDGRIVAYHRSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 157755 - protein, 116 aa, Glycine max
  Coding DNA Sequence Number=SeqID_66070
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=84%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVRAA

SEQ ID NO: 157756 - protein, 314 aa, Glycine max
  Coding DNA Sequence Number=SeqID_66071
  Gene Ontology: Mol. function=motor activity; Cellular component=cell projection
  Homolog annotation: Hit_ID=UPI00006A2D9E; Match level="QueryCoverage =99%, HitCoverage=100%, E-value=3e-18, Identity=18%"; Hit description= UPI00006A2D9E related cluster
FRGLHALTFRGLPALTFRGLPALAFKGRHVLKFSGLHALPIRALHVLGTRGLHVLTLRGLHVLNFRGLHALAFRGIHVVISRGLHALTFRGLHLLTFRGLPVLTFRGLHALAFEGGLHVLATRGLHVLTFRGLHAFAFRGLHTLAFRGLHARTFKRQHVLNISGLHAHAFRGLHVLAFTRLHVLTIRGLHALTFRGLHVLTFRGLHVLTFRGLHALAFRGLHVLTSKGLHALACRGLHVLTSKGLHALACRGLHVLAFRGLHTLAFRGRHVLNFSGLHAHAFKGLHVLAIRRTTCPRLQRTSRPHLQRATRLRL

SEQ ID NO: 157757 - protein, 446 aa, Glycine max
  Coding DNA Sequence Number=SeqID_66072
  Gene Ontology: Mol. function=UTP:glucose-1-phosphate uridylyltransfera se activity; Biological process=biosynthetic process
  Homolog annotation: Hit_ID=P0A2K8; Match level="QueryCoverage=64%, HitCoverage=96%, E-value=1e-151, Identity=94%"; Hit description=UTP-- glucose-1-phosphate uridylyltransferase
  Pfam annotation: Domain name=Epimerase; Domain location=306-446; Score=15.1; E_value=2.8e-08; Accession=PF01370.12; Description=NAD dependent epimerasedehydratase family
  Pfam annotation: Domain name=NTP_transferase; Domain location=5-279; Score=19.4; E_value=1.7e-08; Accession=PF00483.14; Description =Nucleotidyl transferase
  Pfam annotation: Domain name=Polysacc_synt_2; Domain location=306 -439; Score=-170.1; E_value=0.0029; Accession=PF02719.6; Description =Polysaccharide biosynthesis protein
  Pfam annotation: Domain name=adh_short; Domain location=304-434; Score=-46.7; E_value=0.015; Accession=PF00106.16; Description=short chain dehydrogenase
  Pfam module annotation: Pfam domain module=Epimerase::NTP _transferase::Polysacc_synt_2::adh_short; Domain location=306-446::5 -279::306-439::304-434
MINLKAVIPVAGLGMHMLPATKAIPKEMLPIVDKPMIQYIVDEIVAAGIKEIVLVTHSSKNAVENHFDTSYELEALLEQRVKRQLLAEVQSICPPGVTIMNVRQAQPLGLGHSILCARPVVGDNPFIVVLPDIIIDTASADPLRYNLAAMVARFNETGRSQVLAKRMKGDLSEYSVIQTKEALETEGQVSRIVEFIEKPDQPQTLDSDLMAVGRYVLNADIWAELEKTEPGAWDRIQLTDAIAELAKKQSVDAMLMTGESYDCGKKLGYMQAFVNYGLRNLKEGAKRFQSASISTYLIDGTDNVKILVTGGAGFIGSAVVRHIIKNTQDEVVNVDKLTYAGNLESLTEVSDSDRYAFEHADICDKTAMDRIFAEHKPDAVMHLAAESHVDRSITGPAAFIETNIVGTYVLLESARAYWSTLDDNAKKAFRFHHISTDEVYGDLPHH

SEQ ID NO: 157758 - protein, 120 aa, Glycine max
  Coding DNA Sequence Number=SeqID_66073
  Subcellular localization annotation: CTP_CleavageSite=41; ConfidenceScore=5.34e-01
MAESMKKRKGSSSTTVVVGHRRHRPSEAPIALVPPSVSSPRSSTLFSSDDQRLSQGVPFEGTIVDDWKFDYSSHDARRMVYDDQANMTGERFDAMDTRLDAMDAHFNWMDTRGSLVSKMI

SEQ ID NO: 157759 - protein, 100 aa, Glycine max
  Coding DNA Sequence Number=SeqID_66074
  Subcellular localization annotation: CTP_CleavageSite=59; ConfidenceScore=5.75e-01
MAAAIAMAVVAVMAGWRKMASLPHPTRAPSRDTRSRTRTQPRRPPAATHRHKRRRRAPVATSSGSDAPVTNGGLQREVLAEKTKLSRRRRRRSFFFPFAI

SEQ ID NO: 157760 - protein, 48 aa, Glycine max
  Coding DNA Sequence Number=SeqID_66075
MCTKEHESFKEYAQGWRDLAAQVAPQRMEKEMITMIVDTLPVFYYEKM

SEQ ID NO: 157761 - protein, 119 aa, Glycine max
  Coding DNA Sequence Number=SeqID_66076
  Subcellular localization annotation: CTP_CleavageSite=14; ConfidenceScore=5.15e-01
MIFSLSFLDPRSPRLASSSSGPPNYFRMKEPAHLGEPVTSGVSIISPGRATIALSAHFPINRCAREAEERFQGSVLEGIEKIKREESERRGNEVEALLNCDCDQSLHRSSFDVLCATVG

SEQ ID NO: 157762 - protein, 30 aa, Glycine max
  Coding DNA Sequence Number=SeqID_66077
MNSQGFRLVGGGHMNSVRLDGGGHMNSAKQ

SEQ ID NO: 157763 - protein, 117 aa, Glycine max
  Coding DNA Sequence Number=SeqID_66078
VNKSGALAPMYPPSKRKSDLRSSSFKGESSDSFYLKGDHFKALDLKNDPFTCKIGEELATQLAQASKVASSRSNRLLEEFSGRPQWKLQKLTDCAKTSPFDFRHITEFHGLRKPASF

SEQ ID NO: 157764 - protein, 238 aa, Glycine max
  Coding DNA Sequence Number=SeqID_66079
MSLHSSSSVNGEGSTPKDLLYKILDELRSLKLWKEKQERKEKGRHRSHLRPYSHRREKERNPQEANINLPYFHGKDNVEANSDWEIRVEQQLKRKSTSKSYDSHSYPKKDQGQGILGVTPSKLKDDKGKTIEKQPLKVSMQEKTSSMKFFKCLGRGHITSQCPTKKTMIMRGQDIYSSQDEATTSPSSSESEEAKGEESSEEIYPPEEGQPFIVKEKCKEVLLGTKSLKYGLVHPTSS

SEQ ID NO: 157765 - protein, 107 aa, Glycine max
  Coding DNA Sequence Number=SeqID_66080
  Subcellular localization annotation: CTP_CleavageSite=51; ConfidenceScore=5.60e-01
MATSPVSPPPPLPPPLADASASPSTLKRTRKATRLQSLATRPPGAERPVVNVDHATGKADGPHKKKLRTYLGIVARDKKDLGIVARRSCYWQGRRTPGRKSLLLRRI

SEQ ID NO: 157766 - protein, 104 aa, Glycine max; identical to SEQ ID NO: 111659
  Coding DNA Sequence Number=SeqID_66081
  Gene Ontology: Mol. function=threonine endopeptidase activity; Cellular component=proteasome core complex; Biological process =ubiquitin-dependent protein catabolic process
  Homolog annotation: Hit_ID=A7P520; Match level="QueryCoverage=65%, HitCoverage=29%, E-value=2e-24, Identity=73%"; Hit description =Proteasome subunit beta type

SEQ ID NO: 157767 - protein, 289 aa, Glycine max
  Coding DNA Sequence Number=SeqID_66082
  Gene Ontology: Mol. function=ARF GTPase activator activity; Cellular component=integral to membrane; Biological process=regulation of ARF GTPase activity
  Homolog annotation: Hit_ID=A7P1F8; Match level="QueryCoverage=80%, HitCoverage=50%, E-value=2e-63, Identity=55%"; Hit description =Chromosome chr19 scaffold_4, whole genome shotgun sequence
MGNEKANCFWEAELPPNYDRVGIENFIRAKYDEKRWVPRDGNSKTPSGFREEKSPSHWQRPVERSGYAAVSENKFEERKKIQPSTAIPAARINVPAPPRASEQHVEKVESVAPQPQAPQPLAETSKQATDTVKNTPPKVDYATYLFNMLSMDGPNENGSEAAGTTTDDNHWAAAAEVSTAEKTSPLKAADSTPASASGIEDLFKDLHPVTPSLTPEKPQRDVKNDIMSLFEKVATIAWLEADSVCGSHSVAIPLVLVLPYLFRLNQCLRQYKDTGEKTTLLNGKNFVLF

SEQ ID NO: 157768 - protein, 176 aa, Glycine max
  Coding DNA Sequence Number=SeqID_66083
MLDKHVVVSPAKPADKPNLEVYDLLYLMTLAIPQFFLKPLQVMWDATVFGVFNEDFPLYIKHEDLSEIAHGGQCLNIFVIQLWILHLTETSMRTGNSDVYGFLEPQSIQRSGQSQFESKRYMKSWMQNSKRDVYLGAYLNGKPHDDESTMNQVVLMMTKKPKRMISRLSQQVQDQD

SEQ ID NO: 157769 - protein, 18 aa, Glycine max
  Coding DNA Sequence Number=SeqID_66084
MVMFNGGLGRGLAHKVLG

SEQ ID NO: 157770 - protein, 134 aa, Glycine max
  Coding DNA Sequence Number=SeqID_66085
PYASTLTLSTLFALCFCAAATSNKYEIYAAQKHKPKRVESVNADAETFGDHWETSDCSMYSEAEALEHMKKRDRGHQSVSLENKTEDSTMVKISEKNNNVDAGDCMILDDHEGQEHCCGKGTNARSVCQEAKRR

SEQ ID NO: 157771 - protein, 111 aa, Glycine max
  Coding DNA Sequence Number=SeqID_66086
CFENPVLEFSPSDVSSGMGAVYGIAKSGVGVASMGHARAGLILCLLHFVPKSNDVRRPLLTTRRTVMFSGHGRVLFAAKEAGGKLFKHVGVDGNGESFALTYLVELVKLLS

SEQ ID NO: 157772 - protein, 66 aa, Glycine max
  Coding DNA Sequence Number=SeqID_66087
MENCQWEQELQPYNLDNLLMQVKETYESTQHAFKNLKIQVGEENFVEVEAHEESLVEENDSREKDE

SEQ ID NO: 157773 - protein, 148 aa, Glycine max
  Coding DNA Sequence Number=SeqID_66088
MDICEDNGIPIILGRPFMLTASYIVDMGRKKLELGFEDQKIDFDLFVEDKPAPKQNVCLQGLKNDFKIFFLLKISPLAKCKPHAKHIFGHTLSQESQALSAQHLLMKRERRRHFKEKISLEEVHHHRRPWIRAWRKKEMNEGRGREEH

SEQ ID NO: 157774 - protein, 141 aa, Glycine max
  Coding DNA Sequence Number=SeqID_66089
  Homolog annotation: Hit_ID=A5BA03; Match level="QueryCoverage=78%, HitCoverage=33%, E-value=5e-09, Identity=35%"; Hit description =Putative uncharacterized protein
MVHTKRRNHLHQKKMNDLVYVMYNLKLKSRQTRKTIALPFEDMESDDEWMTEEGDDIFDEDNLQVEQEQPLGESGSESNIDLVGGSLTDQTLDAFDIDNFVLNDNVEDHFSTEEELEDDGDKDDGGGGDIGDDFIRGLMYI

SEQ ID NO: 157775 - protein, 90 aa, Glycine max
  Coding DNA Sequence Number=SeqID_66090
  Homolog annotation: Hit_ID=A7R8V0; Match level="QueryCoverage=97%, HitCoverage=20%, E-value=3e-08, Identity=28%"; Hit description =Chromosome undetermined scaffold_2988, whole genome shotgun sequence
MLISMLKKYTNGKDLVRSACLHEMKASLMRLFSYEEWKKNVSICLKVAAPLMVVLRLMDSDQQPTMGFIYIEMDRAKERIKSNFNNVKKN

SEQ ID NO: 157776 - protein, 230 aa, Glycine max
  Coding DNA Sequence Number=SeqID_66091
MEGLICSSKSLLRSWTTTSDMTGRIADNGGVHNKEMPITFFISSESYLLGFKLWSTNSKCLPLSYNVHACCSQNQGGQMSYRMSRHHASEHADYMCLYEQIKQVAHKRLKSQNSQNNSSIPDLVQNSCSLHDYIAVYDSGLQLLDAGGDLSSSEKSADIVSDIVDPAASLLHLTFILHCTATPVFSGRMSGHCIRHRGSCNFTSALDFYLALYSNSSILGQDVRTLYPTS

SEQ ID NO: 157777 - protein, 115 aa, Glycine max
  Coding DNA Sequence Number=SeqID_66092
MSLHSSSSVNGEGSTPKDPLYKILDELRSLKLWKEKQERKEKGKKRVEEISQDERGKIREEERRKIMKEMKREKHVSYSSHNSCKSLSEELRDYYEEDPRPTSSNGACITKHCQK

SEQ ID NO: 157778 - protein, 123 aa, Glycine max
  Coding DNA Sequence Number=SeqID_66093
MAFKKRKATTSQPQEPYDTTRFTFEGAWERHSQNIHSRNILLERNVNLFVTEYDEFRREMIRRNWHKVLTQFMDGHIDVALVKEFYSNLRTLEAPEEGSDDTGPDLECALILQPCPHFSHVQS

SEQ ID NO: 157779 - protein, 129 aa, Glycine max
  Coding DNA Sequence Number=SeqID_66094
  Homolog annotation: Hit_ID=A7QBY8; Match level="QueryCoverage=72%, HitCoverage=20%, E-value=2e-28, Identity=56%"; Hit description =Chromosome chr1 scaffold_75, whole genome shotgun sequence
MYDFEVECFVWQQVEKNLKQLEKLWKEMKTKRVAPDKVTYTTIIGAYSKEGIMVGMFSKVGLVDELVKLLQDMKVERTRLDQRLYQSALNAFKDVWLQIQARWIKESFFWPNVKLKYSKPVKPQARCKY

SEQ ID NO: 157780 - protein, 40 aa, Glycine max
  Coding DNA Sequence Number=SeqID_66095
MDKPPIQTVQVLDDSTDPAIKYQLGAMMDSFKHMGINLLS

SEQ ID NO: 157781 - protein, 37 aa, Glycine max
  Coding DNA Sequence Number=SeqID_66096
VLMDGRKERLGSQPIGRHPLPSPGQTESAAAKQPSIL

SEQ ID NO: 157782 - protein, 67 aa, Glycine max
  Coding DNA Sequence Number=SeqID_66097
MTASKGKPIFEVVLSLGFPFKVALDWRYPAPHKQRGKDQNTQLPLQKVTTFEKILLVRDPACDLLVR

SEQ ID NO: 157783 - protein, 191 aa, Glycine max
  Coding DNA Sequence Number=SeqID_66098
MLVFDAYSLEKVTKVMEMTTKLALNNSDTGESPLSVPITTKKLVVSKMPQTNTSSKTPKPRNQGVGSGYILCGTSKAYIYLGCNTENKRGYISCGSAQVERTSTWLFKENKGGYIPCGSLLVKDFIRLLEISRTVGCLGTGPSGVEILALVILILSNVASNVPTEVSFMMMNQVDSRSFDNDKDVDKKPKE

SEQ ID NO: 157784 - protein, 411 aa, Glycine max
  Coding DNA Sequence Number=SeqID_66099
  Homolog annotation: Hit_ID=A5BSR3; Match level="QueryCoverage=29%, HitCoverage=38%, E-value=7e-09, Identity=36%"; Hit description =Putative uncharacterized protein
  Pfam annotation: Domain name=Transposase_23; Domain location=173-243; Score=-9.7; E_value=0.014; Accession=PF03017.5; Description=TNP1ENSPM transposase
MAEKTKKKLEEAAQSGSTEGVIDPSSSIRRHVKWKMACTKKTRQMTFEATKEIAEKIDSLEEKASQGSFVPYGCQYILTAAIGRQEHPGRVRDARAGVTIKQYFGSAPRTSHSSFSIAPEELEQLTQQIRDQLEESITEKGLALPLEPEVGPSAARVSTKESCVDPSRNDLETDDSDKCGLYIEENPSRLVALGRVYEGSTVVHNIPLLHGQVKVSVEEVKDAEALIPVPIDEVSLVGQTLNTFLAWPTHLVKRLSKQPLQVMWDATVFGVFNQNFSLYIKHEDLSKIAHGESYMKSWMQSSKCDVYLGAYLNGPDSYLKGIINSALKGLDDTPQPKSKAGARWIVVKCNRQKGSTECGYYVMHLMSTIILGTFKNNWETYFNDVRPLEAERLKVFRIQWAQYYLKVRNQT

SEQ ID NO: 157785 - protein, 612 aa, Glycine max
  Coding DNA Sequence Number=SeqID_66100
  Homolog annotation: Hit_ID=A5ALP7; Match level="QueryCoverage=21%, HitCoverage=12%, E-value=1e-08, Identity=27%"; Hit description =Putative uncharacterized protein
  Pfam annotation: Domain name=zf-C2HC_plant; Domain location=441-495; Score=73.9; E_value=5.2e-19; Accession=PF07567.3; Description =Protein of unknown function, DUF1544
MAVANVTVSNIKGRLKLGGINIGASVMALFKVSKASWASSDQLSWSFLKSKDGTGQSHMALILLGFRATTTAEMICPKDSDELYIRMSSKNMTTNKRKNIFNNSFMHFWEYLLQPCDSGGISVRELCNPCRSANAILIFDKQNGGGKRAMAQLDEFEGGYSGQWYVEVVVHWVPETIGRNGEEGWLERLGRLGIRDKWNIAEMLWVCANLLIRWVEVLESRRGTCGKVQEAGYSWLDEIVSASSVYEYRHLVLMDSPKDAKGLDGLHPRVLQVFVRDEKMKSRLTAMTNDPLDPWEGGVTEGAREMSGRGWCELRVEKRRSYSLSSCNLDSAIVCGKDKGGKAWTSRRRSGVRPKMKKLRRKGAAAWRETKRDVTVGRETRRDVAAWCIGSVARRDRRCETIQIGSRKSHDEREKLAACVNEVPGPGAARRSKKALENRTDIGWKHVTDVLGNDKKVKCNYCSKINNGGIFRFKHHLDRTRWNSEPCASVPEEVKMLMMKVVAEGSQIPLKVEYKGYGFLLSKEEEKQNLFKLVQLLKRAVEKTNVMLQEFRDEWKKTECTIMSDGWTDKKRPSSSLARRRPSKKPKGAPSAKSHAKRVNASLSPDIIALSA

SEQ ID NO: 157786 - protein, 183 aa, Glycine max
  Coding DNA Sequence Number=SeqID_66101
  Gene Ontology: Mol. function=serine carboxypeptidase activity; Cellular component=cellulose and pectin-containing cell wall; Biological process=proteolysis
  Homolog annotation: Hit_ID=A7PT95; Match level="QueryCoverage=95%, HitCoverage=37%, E-value=4e-57, Identity=62%"; Hit description =Chromosome chr8 scaffold_29, whole genome shotgun sequence
  Pfam annotation: Domain name=Peptidase_S10; Domain location=11-183; Score=-69.5; E_value=6.8e-11; Accession=PF00450.13; Description =Serine carboxypeptidase
MGYGPFHCQEFGWGIVRSTWLVWEVANVLYLESPAGVGFSYSSNTSFYTLVTDEITAGDNLIFLPRWFTEFPEYSKNDFFITGESYAGHYAPQLAQLIVQTKTNFNLKGVAIGNPLMEFDTDLNSKAEFFWSHGLISDSTYNLFTRVCNYFTIRRQTIQGNLSDVCAKINGLVFTEQINRLMC

SEQ ID NO: 157787 - protein, 144 aa, Glycine max
  Coding DNA Sequence Number=SeqID_66102
  Homolog annotation: Hit_ID=A5B631; Match level="QueryCoverage=84%, HitCoverage=17%, E-value=3e-19, Identity=43%"; Hit description =Putative uncharacterized protein
  Pfam annotation: Domain name=DUF26; Domain location=84-136; Score =19.6; E_value=2.2e-05; Accession=PF01657.8; Description=Domain of unknown function DUF26
MVKLFKVVALTLLVLWSWWSFEGAVGDPQLFLLTNECSGFTTANFDLSTFFQNLNASFADLREQVTNQSKQFAIAQSTSGTSPVYAMFQCMNYLSIADCAACLAAADTEIRNCSTGTTDGARVVYDGCFLRICCYAADMLLGCF

SEQ ID NO: 157788 - protein, 184 aa, Glycine max
  Coding DNA Sequence Number=SeqID_66103
MEQSEPANKSASYTSRGLSPSPLSTTDQEDLALTPTYSSLVFLVLNHPYGYWCEVENCYAKGVFGLIWGCTGSSALAIGIGGVLGSEGRVVAIDLSLLVVVAVYNDKMTQDMSQSDNFIEISANDGVGLGGLHSVAFQSTTSFSGSGSSFSNSNSAEYCRLKEEEGHIPFETSAMFGHNTSNGV

SEQ ID NO: 157789 - protein, 169 aa, Glycine max
  Coding DNA Sequence Number=SeqID_66104
  Homolog annotation: Hit_ID=A5BBZ3; Match level="QueryCoverage=78%, HitCoverage=19%, E-value=1e-14, Identity=33%"; Hit description =Putative uncharacterized protein
MKTEEDELEEEVALNVLTADYQEYLQLKAAKESQTSSAISGHNSTTCTSQFGNNQSPWIIDSSASDHIAGNSSLFSSLSPPKIPHFITLADGSRVAATRISHECGTSRTIGIGHESHGLYYLKPNLSWRKAFSISPLVLILLNRMALPKGRIGTLANELTQTFFECDTF

SEQ ID NO: 157790 - protein, 28 aa, Glycine max
  Coding DNA Sequence Number=SeqID_66105
MQYFTDRRPLELERLKALRNQWAKYYLK

SEQ ID NO: 157791 - protein, 71 aa, Glycine max
  Coding DNA Sequence Number=SeqID_66106
MYARARHTCVATYPSAGGRRVTRGMRVPRKEYAWSRHQRLFEENVGKTGKDAIYELLSERLGSCIYARGRY

SEQ ID NO: 157792 - protein, 109 aa, Glycine max
  Coding DNA Sequence Number=SeqID_66107
  Homolog annotation: Hit_ID=A5BEV8; Match level="QueryCoverage=99%, HitCoverage=14%, E-value=3e-16, Identity=41%"; Hit description =Putative uncharacterized protein
MGEDSWSLVRNHLLKELGKWSDDYIRLFGGTGRFEELRRSLLVDGLSMWMDITEMRYVIASRYNVILVSLSLQQSMTFFPLRSQPPTDSSVHRIICIGYVYDNHFVHVH

SEQ ID NO: 157793 - protein, 286 aa, Glycine max
  Coding DNA Sequence Number=SeqID_66108
KALVDQGKWASFIDVSALLVFGESSVVAVLADAYDTFDRICKKSNVRIVCCTPALYVWLVSHIFHHESRPVCPLQGHRMCAEKGKANWEQLLAGFQNIPLMGMRGFSDPNARMLQRVRKAWIVVQRKDKDLRGSNNSVIGGYHQWLKAQTQGITWLPKLKSSSGEEAEVPKESEEVQALKAELERMRVVKEKFKTKAIRVRKECDKLRDVNGSNSELKLRRDERDESRVEIMILEDKLKACQRSKRSLTEQLSRMEENMWAIIDQYKEKLNLAANHDQRLEGEHAK

SEQ ID NO: 157794 - protein, 139 aa, Glycine max
  Coding DNA Sequence Number=SeqID_66109
MFKRLWFDGRARAVLAQLLIAGAFVGAVGWLAWNAHANLTQRGIAMGLRLPWRGGPFSHRRKPAGVPAYRQLRPRLPGGAGQHAVHLGAGDRGLDAAGLRPGAGAPQPPSAGDGRGHGLSGSRAQHAAGGATAVLVQPW

SEQ ID NO: 157795 - protein, 58 aa, Glycine max
  Coding DNA Sequence Number=SeqID_66110
MHTHDNAILPRKGPVTRAMSKRLQKDWARVAKEAPRVLMNLRVGYLRNIGFFSPCEGT

SEQ ID NO: 157796 - protein, 102 aa, Glycine max
  Coding DNA Sequence Number=SeqID_66111
  Homolog annotation: Hit_ID=Q0KIL1; Match level="QueryCoverage=95%, HitCoverage=10%, E-value=6e-07, Identity=32%"; Hit description =Gag/pol polyprotein, 3'-partial, putative
  Pfam annotation: Domain name=G-patch; Domain location=41-82; Score =22.2; E_value=0.00039; Accession=PF01585.14; Description=G-patch domain
MPYVEATKESLETAFQSFEVVRISSVDSFFGQPCLSDMAVMVARVMLGNGYEPEMGLGKDNGSITSLISAKGNRGKFGLGYKPTQADIRKSIAGRKNGSQGS

SEQ ID NO: 157797 - protein, 58 aa, Glycine max
  Coding DNA Sequence Number=SeqID_66112
MQKKTLVFACYRTLSLTDSERVFIRITTWVTIATGGVVDKSGAFAPMYPQFVMRNSDL

SEQ ID NO: 157798 - protein, 149 aa, Glycine max
  Coding DNA Sequence Number=SeqID_66113
MDAVQRKDKERRGSSDGIVDGYHKWLRVRTQKLDWLPRLKAARKEEVQTLEKSEEVQTLKAELERAQAVKEKFKSTTIKVRKEYDELRDVNMATTEALERETKRARKEEHGQNKFRGALWGSNSELKLRRAERDQSWVEGMILKDELKA

SEQ ID NO: 157799 - protein, 166 aa, Glycine max
  Coding DNA Sequence Number=SeqID_66114
  Pfam annotation: Domain name=DUF1723; Domain location=1-44; Score =29.7; E_value=1e-05; Accession=PF08330.1; Description=Protein of unknown function (DUF1723)
MSAFVERWHKETSSFHLPIEEVTITLDDVVSLLHLSVVGACHSFKLLHVDDAIEMLVELLEFSAVECWIYEHFSSVGSAVPAEDYDERRPSACRWTSGKALPISTYWRRPDKLILDAMCWIPYSDHRLFREFDVISLFSGHILLRLHSLLKKLMIDGCSLVNTLNL

SEQ ID NO: 157800 - protein, 73 aa, Glycine max
  Coding DNA Sequence Number=SeqID_66115
MEDAPLARPRGSFCTPTEGQVATKGVELKPILLSLIGSHPFAGMDHDNPYTHLSTFIELCSTMGASDEDVKAV

SEQ ID NO: 157801 - protein, 361 aa, Glycine max
  Coding DNA Sequence Number=SeqID_66116
  Homolog annotation: Hit_ID=Q9AVH2; Match level="QueryCoverage=42%, HitCoverage=54%, E-value=9e-53, Identity=68%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHEGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPADNVFRPDRPAEADLGSKKRGSAPLPIHGISKITFKVL

SEQ ID NO: 157802 - protein, 143 aa, Glycine max
  Coding DNA Sequence Number=SeqID_66117
MVILHLLSSRGGEPDDMWRQIMVIRTPFRHPETIESNGTQRQIMVILHLLSSRGGEPDDMRRQIMVICSPFRYPDTIESNGTQTQIMVILHLLSSRGGEPDDMRRQLMVIRTLFASRDDRVRWHAETNYGHSAPFVIQRRRAR

SEQ ID NO: 157803 - protein, 67 aa, Glycine max
  Coding DNA Sequence Number=SeqID_66118
MVMFVVEAGTTKVRCCGGGGGGGSGGGNGVAAMTGPWWWYMAMMDSDSLEGCFYPKDDKVANWYTFR

SEQ ID NO: 157804 - protein, 128 aa, Glycine max
  Coding DNA Sequence Number=SeqID_66119
MVKKECREVSVSSKRLGKKESHFAIKTNIKETSHLRQPPYLLLCKKTPVSTATPIGLEVIPQVKELLDEGLIRKSLNPCALLVPKIGILRHQIPKIGDMMNVSSGGTLFCKITHAPNIFMIHVHRDSL

SEQ ID NO: 157805 - protein, 266 aa, Glycine max
  Coding DNA Sequence Number=SeqID_66120
  Gene Ontology: Mol. function=phosphoinositide binding; Biological process=intracellular signaling cascade
  Homolog annotation: Hit_ID=P03851; Match level="QueryCoverage=31%, HitCoverage=100%, E-value=1e-43, Identity=98%"; Hit description =Uncharacterized 9.4 kDa protein
MRKEKIPHQAPFAIQPAQLLGRAIGAGLFAITPAGERGMCCKAIKLGNARVFPVTTLFRHFEELHRRLKEFAEYNLHLPPKHFLSTGLDVPVIQERRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 157806 - protein, 43 aa, Glycine max
  Coding DNA Sequence Number=SeqID_66121
MAEPSKKRKGSSSQSQQHFETQETSIPSFIPSASLFSSEEQRI

SEQ ID NO: 157807 - protein, 155 aa, Glycine max
  Coding DNA Sequence Number=SeqID_66122
MAPKKLSTKRSRRDAAAKGSSAAPEFDSHRFRSAEHQQRFEAIKGWSFHRERHVQLREDEYTYFQEEIARRHWTLLVTPMAKFDPEIVLEFYAHAWPTEEGVRDMRSWVRGQWIPIDADALSQFLGDPLVLEEGQQCEFNQRRNRADGFDEEEIT

SEQ ID NO: 157808 - protein, 420 aa, Glycine max
  Coding DNA Sequence Number=SeqID_66123
  Gene Ontology: Mol. function=binding; Cellular component=cell surface; Biological process=intein-mediated protein splicing
  Homolog annotation: Hit_ID=A4W4W3; Match level="QueryCoverage=99%, HitCoverage=17%, E-value=0.0, Identity=54%"; Hit description =Filamentous haemagglutinin family outer membrane protein precursor
  Pfam annotation: Domain name=Fil_haemagg; Domain location=218-293; Score=29.3; E_value=1.4e-05; Accession=PF05594.5; Description =Haemagluttinin repeat
  Pfam annotation: Domain name=Fil_haemagg; Domain location=295-352; Score=11.5; E_value=1.3; Accession=PF05594.5; Description =Haemagluttinin repeat
  Pfam annotation: Domain name=Fil_haemagg; Domain location=356-416; Score=16.2; E_value=0.13; Accession=PF05594.5; Description =Haemagluttinin repeat
  Pfam annotation: Domain name=Haemagg_act; Domain location=34-170; Score=166.1; E_value=9.2e-47; Accession=PF05860.4; Description =haemagglutination activity domain
  Pfam module annotation: Pfam domain module=Fil_haemagg::Fil _haemagg::Fil_haemagg::Haemagg_act; Domain location=218-293::295 -352::356-416::34-170
MDTRHPPVRFSQRLISWIVCGLMVWQPMAPAVAAALTPTGQTTVDRAGNGVPVVNIATPNGAGISHNQFGEYNVGKEGLILNNGTDRLTQTQLGGLIQNNPNLQAGREAKGIINEVTGASRSQLQGYTEVAGKAANVMVANPYGITCNGCGFINTPNVTLTTGKPQFDASGNLQALEVTKGAITVEGQGLDASKSDALSIIARATEVNAAIHANDLTVTAGANRVGADGSVRPIAGEGAAPVVAVDTGALGGMYANRIRLVSSETGVGVNLGNLTARQGDIQLDVGGKLTVTNSLASGSITANGAGVALNGSHQSGGALNVASSQDVELNNSTLASQGDMRLSAAGKVQTTGGGTNSAGALSVSSGQGMTLSNTALVSRGAATLDSKATLTVNGGGVSAQGGALTVTSKQGMALADATLT

SEQ ID NO: 157809 - protein, 76 aa, Glycine max
  Coding DNA Sequence Number=SeqID_66124
MAAEWRRKRERRRHFKEKMSLEEVHYHRRPWIRAWRKKEMNERRGREEHEILCSKRALKSEPTNPRSIPRFSTKCV

SEQ ID NO: 157810 - protein, 46 aa, Glycine max
  Coding DNA Sequence Number=SeqID_66125
MAQCRLKNISRGFTTADVGYGNVRSASSGDASFLNLDRTLFLADVG

SEQ ID NO: 157811 - protein, 214 aa, Glycine max
  Coding DNA Sequence Number=SeqID_66126
MAPRKLASKRSRKDKVAEGTTSAPEYDSHCFRSTEHQQRFEAIKGWSFLRERRVQLRDDEYTDFQEEIVRRRWASLVTPMAKFDPDIVLEFYANAWPTEEGVRDMRSWVREGQECEYGQRRNRADGFDEEAIAQLMCIPGQDFARTTAGRRVRIMRTNMTTLTQIWMTLLLSNIQPIDHNSDLPLPKCQLVYAILTRMSIHVAQLITDAIYLFA

SEQ ID NO: 157812 - protein, 314 aa, Glycine max
  Coding DNA Sequence Number=SeqID_66127
  Homolog annotation: Hit_ID=Q337F4; Match level="QueryCoverage=95%, HitCoverage=90%, E-value=1e-35, Identity=30%"; Hit description=F-box domain containing protein, expressed
  Pfam annotation: Domain name=F-box; Domain location=14-59; Score =22.1; E_value=0.0021; Accession=PF00646.24; Description=F-box domain
MDNSNSAATTGVWNDFRSIDIIITILMSLNVVDLAVASLVCKMWNKACRDPSLWRKIDLSELNNSYLFNIQNNKPGAYKHSRGKITQFLKYVLSLSNGNTNCLIFNYNVDLTDEQFIIAAERTPNLKRLVLPNTCVFSRKAVHTAMKSWGGLESITISFDDPNKYIFSAIAEYCKNITEMKFSHGCLLFEENYVEALLKCAPNLKALSIRCIMTSMGALCGVFTSFQHLEAVNICHSSIIDAPYSDFGVVDITYVQKHLPPSNYGKLIYCKEGSCLRCKNDRSIIPAGIFQITSFLIHASEDLWREDEITSLAH

SEQ ID NO: 157813 - protein, 564 aa, Glycine max
  Coding DNA Sequence Number=SeqID_66128
  Gene Ontology: Mol. function=oxidoreductase activity, acting on paired donors, with incorporation or reduction of molecular oxygen; Cellular component=integral to membrane; Biological process =carotenoid biosynthetic process
  Homolog annotation: Hit_ID=A7PUU8; Match level="QueryCoverage=99%, HitCoverage=99%, E-value=0.0, Identity=72%"; Hit description =Chromosome chr4 scaffold_32, whole genome shotgun sequence
  Pfam annotation: Domain name=Amino_oxidase; Domain location=29-557; Score=-19.6; E_value=9.6e-05; Accession=PF01593.15; Description =Flavin containing amine oxidoreductase
  Pfam annotation: Domain name=DAO; Domain location=19-559; Score= -22.2; E_value=0.00032; Accession=PF01266.15; Description=FAD dependent oxidoreductase
  Pfam annotation: Domain name=Pyr_redox_2; Domain location=19-542; Score=-49.5; E_value=0.1; Accession=PF07992.5; Description=Pyridine nucleotide-disulphide oxidore
  Pfam module annotation: Pfam domain module=Amino_oxidase::DAO::Pyr _redox_2; Domain location=29-557::19-559::19-542
MWRRSFSSSTAALKGKKWDALVIGGGHNGLTAAAYLARGGLSVAILERRHVIGGAAVTEELVPGFKFSRCSYLQSLLRPSVIKELELGKHGLKLLKSNPSSFTPCLDGRYLLLGPDKDLNHSEISKFSLKDAQAYPRYQTQLESFCKFMDLVLDSPPPESVHHKSSINEKLKNKLQNSVFWASCLRQVSSLGQKDMVDFMDLLLSPASKVLNNWFEADVLKATLATDAVIGSTFCTVHTKSVNIMLFIPCRYVEGGMGSISKAIGNAAIEAGAHVVTNAEVSRLLIENSSTVCGVALADGTEVHSSIVLSNATPYKTFMELVSNDVLPDDFVRAIKHTDYSSATTKINVAVDKLPEFHCCKLEHPHAGPQHVATIHIGSESMEEIHSACQDAVNGVPSRRPVIEMSIPSILDKTISPPGKHVINLFVQYTPYKPLDGDWQDHDYRVSASLYLIYPPIQESFAQKCFTLIDEYAPGFSTSVIGYDMLTPPDLEREIGLTGGNIFHGAMGLDSLFLMRPAKGWSNYKTPLKGLYLCGSGAHPGGGVMGAPGRNAARLVLQEVGERT

SEQ ID NO: 157814 - protein, 205 aa, Glycine max
  Coding DNA Sequence Number=SeqID_66129
MAVSLAYQDLFEWMIGRGSNWDQGILSFSDDLQNWNREITRVVAGIGASADTGGTIMASLVFKQSSGSSPCTTATIEQQTTDCDASTPPRGEDGAQTPPSCPRSYGDGEPDLKKDGDGGCELQCEHGLPRLLDAGNDGGLGGEVGGEEIGAFGATGDKATTIRGVEAEGVNIATGRDGDDGRGGGPNTTDNNLVRITKVNDEGKC

SEQ ID NO: 157815 - protein, 408 aa, Glycine max
  Coding DNA Sequence Number=SeqID_66130
  Gene Ontology: Mol. function=protein binding; Cellular component =cytoplasm; Biological process=regulation of transcription
  Homolog annotation: Hit_ID=Q9M3H9; Match level="QueryCoverage=100%, HitCoverage=100%, E-value=0.0, Identity=79%"; Hit description=Tubby -like protein
  Pfam annotation: Domain name=F-box; Domain location=53-108; Score =25.1; E_value=0.00026; Accession=PF00646.24; Description=F-box domain
  Pfam annotation: Domain name=Tub; Domain location=119-402; Score =397.0; E_value=2.8e-116; Accession=PF01167.9; Description=Tub family
  Pfam module annotation: Pfam domain module=F-box::Tub; Domain location=53-108::119-402
MSLRSIVRELKEMRDGIGSTSKRGAESKHRLSRTKSHVAPDVLATPFEPIQQGQWANLPSELLLDIIQRVEESETSWPARAVVVFCASVCKSWRSITREIVKTPEQCGRITFPISLKQPGPRDSPIQCFIRRNKETSTYLLYFGLVPSENDSNKLLLAAKRIRRATGTGFVISLAADDFSRASNKYVGKLRQFTVYDSQAPHDSAIQSNCQSSRRFHSKQVSPRVPACSYLVSTVSYELNVLCTRGPRRMHCVMNSIPVSAIQEGGNAPTPTSFPQIFDEPFSPSPALKEKAQVTDLNSASLSEPPVLSQGSTEQLALKNKAPRWHEQLQCWCLNFKGRVSVASVKNFQLVAAVDPSHNISAEEQEKVILQFGKIGKDIFTMDYCYPLSTFQAFAICLSSFDTKPACE

SEQ ID NO: 157816 - protein, 170 aa, Glycine max
  Coding DNA Sequence Number=SeqID_66131
  Gene Ontology: Mol. function=oxidoreductase activity; Biological process=electron transport
  Homolog annotation: Hit_ID=A7QE92; Match level="QueryCoverage=95%, HitCoverage=31%, E-value=5e-45, Identity=55%"; Hit description =Chromosome chr4 scaffold_83, whole genome shotgun sequence
MKQGASIYHEDLNSMRYGLKVFKETLRMSNVLLWFPRVALEDCTIEANYRRAFIISLSGLMTMLLTIQVAITGYDIKKGWHVNIDATYIQRFDEMQKPYSFIPFGSGPRTCLGINMAKVTMLVFLHRLTGGYTGTLDDSDTCLEKKAHIPRIRSGCPITLKSLSKSMPEA

SEQ ID NO: 157817 - protein, 97 aa, Glycine max
  Coding DNA Sequence Number=SeqID_66132
MDSVDDDGVSATGCRQGAKRRRYIWVDHFSNKGVDLEKVHVTLIGKLGYKKTKITHDNICHMPMCLVNSHVTETKEVKLRHRSNTVETLKLSAIDTY

SEQ ID NO: 157818 - protein, 457 aa, Glycine max
  Coding DNA Sequence Number=SeqID_66133
  Gene Ontology: Mol. function=methyltransferase activity; Cellular component=cytoplasm; Biological process=fatty acid biosynthetic process
  Homolog annotation: Hit_ID=A9PF83; Match level="QueryCoverage=61%, HitCoverage=84%, E-value=1e-88, Identity=55%"; Hit description =Putative uncharacterized protein
  Pfam annotation: Domain name=Methyltransf_7; Domain location=147-434; Score=335.4; E_value=1e-97; Accession=PF03492.6; Description=SAM dependent carboxyl methyltransferase
MRLDHRRLVLLVGVPGHDLWRLPLADSEGTLRGDDVRISKMASPPLVKSAQARWISFPDGTFDFDFADDNTLEEEEAVKLEVLKEGSFAINCLEGCVAESMLVSHFGEAIIDELFSPYQETLADPMSNEKTKFASEQKAICLSKPIREEAITGLYCNTVPRSLAIADLGCSYGPNTLSVVSEFIKTVEKLCRKLNHKSPEYKVFLNDLPGNDFNNIFMSLDNFKEKLCDEIETGVGPCYFFGVPGSFYSRVFPNQSLNFVHSSYSLQWLSKCRAEELVEGGRMVLTILGRRSDAENPAIKEGGYIIWELMATALNDMVMQGIIKEEQLDTFNIPQYTPSPSEVELEVLKEGSFAINRLELAEVNWNPLDDLNALDFESERSESLRDNGYSLAQCMRSVAEPMLVNQFGEDIIEEGVRKKEKRKNDGGTSHATKEVFREEMNATEGSVWGCGVTSLEL

SEQ ID NO: 157819 - protein, 345 aa, Glycine max
  Coding DNA Sequence Number=SeqID_66134
  Gene Ontology: Cellular component=integral to membrane
  Homolog annotation: Hit_ID=A7PV09; Match level="QueryCoverage=100%, HitCoverage=99%, E-value=5e-58, Identity=63%"; Hit description =Chromosome chr4 scaffold_32, whole genome shotgun sequence
  Pfam annotation: Domain name=DUF677; Domain location=42-340; Score =443.6; E_value=2.6e-130; Accession=PF05055.3; Description=Protein of unknown function (DUF677)
  Pfam annotation: Domain name=DUF793; Domain location=8-340; Score= -228.9; E_value=0.039; Accession=PF05633.2; Description=Protein of unknown function (DUF793)
  Pfam module annotation: Pfam domain module=DUF677::DUF793; Domain location=42-340::8-340
MGGQSSKMVSVESPTPIKMGTHSLYAADLSSYEAACVKDPNLQSFDVSIQEHTNRVISSLAHGVEVRSLSFDSLREMTDSLLEMNQEVVKVILDCKKDIWGNSELFSLVNDYFDNSLHTLEFCNSLEKCLRQARENQMIVKSVVTYFEEEVQNGAEGVTYVKTLQELKKFKDAGDPFTEEFYLLFQSGVKCHFVAAFVSVLIFSVVAASIAAPPVVTALAAALAVPIGSVGKWCNSLFKRYEKALKGQREVISSMQIGTYISLKDLDNIRVLINKLELVLESLLQNADFAIKNEDVMKFAIDEIKKKIETFSETMESLSAHADKCSRQIRRARTVVVQNIIKKPD

SEQ ID NO: 157820 - protein, 230 aa, Glycine max
  Coding DNA Sequence Number=SeqID_66135
  Gene Ontology: Mol. function=small conjugating protein ligase activity; Cellular component=cellular_component; Biological process =regulation of protein metabolic process
  Homolog annotation: Hit_ID=Q9SDY5; Match level="QueryCoverage=30%, HitCoverage=38%, E-value=4e-24, Identity=71%"; Hit description=NEDD8- conjugating enzyme Ubc12
  Pfam annotation: Domain name=UQ_con; Domain location=57-184; Score= -35.3; E_value=0.013; Accession=PF00179.17; Description=Ubiquitin -conjugating enzyme
MPLEAPVRRVDCIFSSPMKRGKGKPIRTLDWKLTHYLRLWFLPYYSVIQVFGYIGVSLLADISELNLPKSCSMQFPNGKDDLMNFKVSIRPDKGYYKGGTFLFTFQVSPIYPHEAPKVKVQDKANQDDVRLRVTGVEVGPREDLKEDVIAKDVSEGSGEEVIVDNEVSIGDNKNGKGRVVREIHDEVGDRGEEGDELGELRHGGEEGGEIVNVWRGRFRERSPYGKRKKV

SEQ ID NO: 157821 - protein, 176 aa, Glycine max
  Coding DNA Sequence Number=SeqID_66136
  Gene Ontology: Mol. function=binding; Cellular component =mitochondrial inner membrane; Biological process=transport
  Homolog annotation: Hit_ID=Q4A3R4; Match level="QueryCoverage=64%, HitCoverage=37%, E-value=2e-41, Identity=73%"; Hit description =Folate transporter precursor
  Pfam annotation: Domain name=Mito_carr; Domain location=32-126; Score= 107.1; E_value=5.3e-29; Accession=PF00153.18; Description =Mitochondrial carrier protein
MSAQASASRGSGVPLCVTASRMSTEAPKRDQWQWENATAGAAAGFATVAVMHPLDVVRTRFQVNDGRVSNFPSYKNTAHAVFTIARSEGLRGLYAGFLPGVLGSTISWSLYFFFYDRAKQRYARNREGKLSPGLHLASAAEAGAIWFHGHHGGMAWQIFCQPPWGKCEGMPAMAAP

SEQ ID NO: 157822 - protein, 270 aa, Glycine max
  Coding DNA Sequence Number=SeqID_66137
  Pfam annotation: Domain name=RRM_1; Domain location=3-62; Score=10.9; E_value=0.015; Accession=PF00076.13; Description=RNA recognition motif. (a.k.a. RRM, RB
MCEKDLRYEFKKWGDVREFFIAKNTNRSGKRYGFVRFKGVGDVGRLERQLDNLIIGGLKLHVNIPKHGRERTLNGEPNSEEKYKLNISMEERTWLNNAWVGRLRNLVMFDRVEDELMWDRGEYITSKYLGDDMVLLLGLTDSKAEQLCKEATDNELSLFHKSIKKIASAVGEVVEVDDDVEELQQLDRAREYMVHMAEETCYNSSRCKCWTGSLIGSSEEISSKESEIGTPLLADDVSPKNECSLIMTKVIADKGEPLGEVGELRLTNGQ

SEQ ID NO: 157823 - protein, 40 aa, Glycine max
  Coding DNA Sequence Number=SeqID_66138
MVQVGQTLLLNESSKNCWELVSSSSLTSEHVFISLLNYYY

SEQ ID NO: 157824 - protein, 69 aa, Glycine max
  Coding DNA Sequence Number=SeqID_66139
MGNVKWFDSAYNGRKTGVNLRTEKGRGVCLVRIIVGGIIGAGEAASVSSSGNQTKPAAPKKKRNLPGMP

SEQ ID NO: 157825 - protein, 77 aa, Glycine max
  Coding DNA Sequence Number=SeqID_66140
MASSNGNFPTSMPILIGKNYDDWCAQMKIIFRFQDVTKVVQEEMQMTFSTSFFITMTVLPPPTIVVPTPTTSQGQMP

SEQ ID NO: 157826 - protein, 349 aa, Glycine max
  Coding DNA Sequence Number=SeqID_66141
  Gene Ontology: Mol. function=phosphoribosylanthranilate isomerase activity; Cellular component=chloroplast; Biological process =aromatic amino acid family biosynthetic process
  Homolog annotation: Hit_ID=A6T7W7; Match level="QueryCoverage=60%, HitCoverage=46%, E-value=5e-75, Identity=66%"; Hit description =Bifunctional indole-3-glycerol phosphate synthase/phosphoribosylanthr anilate isomerase
  Pfam annotation: Domain name=PRAI; Domain location=18-209; Score =280.4; E_value=3.8e-81; Accession=PF00697.13; Description=N -(5'phosphoribosyl)anthranilate (PRA) isomerase
MEEHDLDAGVRRVLLGDNKVCGLTRPEDAQAAHQAGALYGGVIFAAGSPRQVNEAQAQAVIAAAPLKYVGVFRNQPISDVVTSASRLSLAAVQLHGDEDKAYVAELRQALPASVRIWKALSIKDRLPPRDWPHVDRYVLDNGQGGSGQRFDWSLLQGEDLADVLLAGGLSADNCVEAAQLGCAGLDFNSGVESAPGIKDASKVAAEEDTMTTLLNPYFGEFGGQYVPQILMPALRQLETAFVEAQRDPAFQAEFTDLLKNYAGRPTALTLCSNLTKGSKTRLYLKREDLLHGGAHKTNQVLGQALLAKRMGKNEIIAETGAGQHGVASALACALLGMKCRIYLGAKDVE

SEQ ID NO: 157827 - protein, 104 aa, Glycine max
  Coding DNA Sequence Number=SeqID_66142
MAQLAHLGVIMDAGLADYGDAMAETRGQLTRAIQVNRQITQIAVVDADHFSFQRDSPLQLFFVTDFGQHAHFQAVRHRSQLTILLIIQYGQHQQNGIGLVMARQ

SEQ ID NO: 157828 - protein, 174 aa, Glycine max
  Coding DNA Sequence Number=SeqID_66143
MENSVATASAVSLAAEAYLTLPANVHHPLPNVVGRERSTLGHISNPHLGYNRVAYPYGLPPNYTPPVMRDDVGHVHEDRREYAQGDIDFYPPVPVEGSAPNTLPHPNLTGEPRNLPSQPIFLSSEGPPSAAIEKRKLDLFEERLRVVEGFGDYPFTDMADLCLVPDVVIPPKFK

SEQ ID NO: 157829 - protein, 114 aa, Glycine max
  Coding DNA Sequence Number=SeqID_66144
  Gene Ontology: Mol. function=6-phosphofructokinase activity; Cellular component=6-phosphofructokinase complex; Biological process=glycolysis
  Homolog annotation: Hit_ID=A1XM06; Match level="QueryCoverage=59%, HitCoverage=13%, E-value=1e-25, Identity=79%"; Hit description=ATP -utilizing phosphofructokinase
MVWHLQSPFLLFYSAAIDLQEAKDFIDEEDPRPTSSTWSHINGIILMDKTFGFDTTIEEAQREINSAYVEAHSAYHGIGIMELMGRDRGFIAMHASLASGQIDICLIPKREVDK

SEQ ID NO: 157830 - protein, 93 aa, Glycine max
  Coding DNA Sequence Number=SeqID_66145
MSLRRDDVYVENDMCRNLPFYGRARRGSRKNRRKPVMKNIPDSGVVFTFEEGISTSQNFRVGIADEYAQVYVEKEARGRVIDSLHQEATMWMD

SEQ ID NO: 157831 - protein, 68 aa, Glycine max
  Coding DNA Sequence Number=SeqID_66146
MLRNLTDYVIIPFLPSGTLRNFMDCALTLPFNFRHVTELHELPNDGCQVPRSGQTRVAPQQRMIPGRN

SEQ ID NO: 157832 - protein, 226 aa, Glycine max
  Coding DNA Sequence Number=SeqID_66147
  Gene Ontology: Mol. function=hydrolase activity, hydrolyzing O -glycosyl compounds; Cellular component=cytoplasm; Biological process= carbohydrate metabolic process
  Homolog annotation: Hit_ID=A7MRL1; Match level="QueryCoverage=83%, HitCoverage=26%, E-value=4e-90, Identity=82%"; Hit description =Putative uncharacterized protein
NDLVSYNDKHNDANGEDNNDGHNDNRSYNYGAEGPTDDEGINAVRERQKRNFLATLFFSHGTPMLLAGDEFGRSQMGNNNGYCQDSEISWLHWEDLPASADALRDFTRQIIALRAQQPLLRRESWRDGMEIKWFNAGGGFQQAEQWDEGSTLGVYIGRPDLQTEEGIWHDVLMLFNPFEGNVPFRIPQCRFPGAHECAPYGNNGTCPPGFQVRMNTHPTEITGHAL

SEQ ID NO: 157833 - protein, 65 aa, Glycine max
  Coding DNA Sequence Number=SeqID_66148
ERKDIELVDEGEPRIGADCSSVTSNKFEIYKEEAGNAAQKHKPKRAGSVNADAEAFGLCILKLKH

SEQ ID NO: 157834 - protein, 41 aa, Glycine max
  Coding DNA Sequence Number=SeqID_66149
MAKIDGKMSNFYAGMCEGVVLGFNLRQLNESWNCEAFADNV

SEQ ID NO: 157835 - protein, 40 aa, Glycine max
  Coding DNA Sequence Number=SeqID_66150
MKEVGLKLIGTEFEKNIMEVKMEETYHKNEEERKQMEEAK

SEQ ID NO: 157836 - protein, 81 aa, Glycine max
  Coding DNA Sequence Number=SeqID_66151
FQSSFGAQNFVLFSPSPFIHLLLPPSSYPWPLMVGAKESIDEEDPRPTSSNGAYIRIIGGGCMNDNQFMGLRIKVENGELH

SEQ ID NO: 157837 - protein, 98 aa, Glycine max
  Coding DNA Sequence Number=SeqID_66152
MWPKASAKAPGRSVHFAPHEHTQHPTSERGPKQVQRPRKKISMQQGQADILIARFPDPNYGVKTVNFIITPLTYRELSVSSSLRHLEVSLSFALVGPT

SEQ ID NO: 157838 - protein, 144 aa, Glycine max
  Coding DNA Sequence Number=SeqID_66153
MDYAMMGVKCLKVINQGPHTDNNCPRTKLREESLHVIGLDRLWVTKTCLSLDGKRDFDSLWIGRVQTTICCLHVSSDLLSLDDEGANNHEVSPYAIGPSSHDSRIVCTDNHKVCMLSDPRFTIAKVRLFAVSTGRRRHLREGCR

SEQ ID NO: 157839 - protein, 137 aa, Glycine max
  Coding DNA Sequence Number=SeqID_66154
MEIISKWFEELDVCGKVTLKSKLREIVYPNQNSMCAPPEKVKTKVFLQSNVVHNHLSKKNHEGLCRSWINFIHAFMIPLKTLLMSKLMIHGLWCATIWLKNLQNGLMSISTSLMANKFKELKRSLLVDGLSMVTMDK

SEQ ID NO: 157840 - protein, 297 aa, Glycine max
  Coding DNA Sequence Number=SeqID_66155
MAPKKLSTKRSRKEAAGEGSSTALEFDSHRFQGVEHQQRFETIKGWSFHRERRIQLREDEYTDFQEEIARRRWTSLVTPMAKFDPEIVSKFYVNAWPTEEGVRDMRSWVRGQWIPFDADALSQFLGDPLVLEEGQQCEFSQRRNRADGFDEEAIAQLLCTPGQDFARTAAGRSLPILQSSSHPSKVIRPPITQVFIKKYCTPRQAQGDAPQGVGAPPPPRQADPAKPLGVERYLQHLVRQQAANHRGQFAAEVALPGDWPDAQAGEEPAGSPGKMDEPCMDEDMTDLFDFLGGSGAT

SEQ ID NO: 157841 - protein, 102 aa, Glycine max
  Coding DNA Sequence Number=SeqID_66156
  Gene Ontology: Mol. function=RNA-directed DNA polymerase activity; Biological process=regulation of transcription, DNA-dependent
  Homolog annotation: Hit_ID=A7QHE8; Match level="QueryCoverage=84%, HitCoverage=22%, E-value=4e-16, Identity=45%"; Hit description =Chromosome chr2 scaffold_97, whole genome shotgun sequence
MDDWSIPEIPRDILDIRHNKFKDSLIGTVETSLEQGPVYFNCYPNKTMSLMDRNLLDSLFLNIHFHGLDMKEGSIPAALIYRIQYKVMNTCASRVLLKPQRG

SEQ ID NO: 157842 - protein, 205 aa, Glycine max
  Coding DNA Sequence Number=SeqID_66157
MVHDIFVKVKLEVTRTLIVLNVFGSRRSNDVTQSIFCPNFCKVVTSILQLDSMNLFVKARAWFNPITQGMAILIANTSTTFHRDERFGNTHAIFVEEGTRIMYEQTCRTKRHESPKIISPYLRIWGRSAPCVQLRRRYGSSDFPRQKARPTYNACAMVSSLKIIILWRYGIPATTHLSYPNFVRGPLLDDMRPFFGPCEVLGTHH

SEQ ID NO: 157843 - protein, 125 aa, Glycine max
  Coding DNA Sequence Number=SeqID_66158
MGFKWTLRKSRPSKIGSPQKVWEILGASTEVTSFGYRKDRNGQWLKKDALPPQDERTPSPPPQREDSALMNEVLSELRGLRSYVGDRFDSLDSRFAGMDIRLTQLEEDVGYIRQSFDLPPPPPSS

SEQ ID NO: 157844 - protein, 104 aa, Glycine max
  Coding DNA Sequence Number=SeqID_66159
MSCPAIITPTSLCRSVSWCMPPTRHPLDPDKSNRALGFLALITGLCQSFKVPVTPSKVIRPPITRAFIEKYCTCRVFVWIVALVLTSLLSIMFVEIPEPCRVFI

SEQ ID NO: 157845 - protein, 138 aa, Glycine max
  Coding DNA Sequence Number=SeqID_66160
  Homolog annotation: Hit_ID=A5C070; Match level="QueryCoverage=78%, HitCoverage=10%, E-value=6e-08, Identity=29%"; Hit description =Putative uncharacterized protein
MLGDLKVATQGSDPDAYVDWEMKIQHAFSYNDYPEEQKGYAKEDKEMEMALVRANIEEDTKAVHDGFTNKISFQHHDQKIILKPQSLKEVCDDQIRMREKREQEKDNSEAPQRNRKRKSDTLERWSDTQGRESDTQDI

SEQ ID NO: 157846 - protein, 631 aa, Glycine max
  Coding DNA Sequence Number=SeqID_66161
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7MHM2; Match level="QueryCoverage=100%, HitCoverage=83%, E-value=0.0, Identity=76%"; Hit description =Putative uncharacterized protein
  Pfam annotation: Domain name=Glyco_hydro_3; Domain location=26-250; Score=356.1; E_value=5.7e-104; Accession=PF00933.12; Description =Glycosyl hydrolase family 3 N terminal domain
  Pfam annotation: Domain name=Glyco_hydro_3_C; Domain location=325 -580; Score=313.6; E_value=3.8e-91; Accession=PF01915.13; Description= Glycosyl hydrolase family 3 C terminal domain
  Pfam module annotation: Pfam domain module=Glyco_hydro_3::Glyco_hydro_ 3_C; Domain location=26-250::325-580
MIQHGQVGAIFNTVTRPDIRAMQDQVMQLSRLKVPLFFAYDVVHGQRTIFPIPLGLAASWDLQAVSEVGRISAYEAADDGLNMTWAPMVDVSREPRWGRGSEGFGEDTYLTSQMGSAMVKAMQGKSAADRYAIMTSVKHFAAYGAVEGGRDYNTVDMSPQRLFQDYLPPYKASLDAGSGGVMVALNSLNGTPATADSWLLKDILRNDWKFKGITISDHGAIKELIKHGVASDPQDAVRIALKSGIDMSMSDEYYSKYLPGLVKSGAVSMAEIDDAARHVLNVKYDMGLFNDPYSHLGPKGSDPQDTNAESRLHRAEARDVARRSMVLLKNWHETLPLKKEATVALVGPLADSQRDIMGSWSAAGVAKQSVSLLQGMRSAMAGKGTVLYAKGANISDNKGIQNFLNLYEQAVSVDARSPQQLIDEAVAQAKKADVVVAAVGEAQGMAHEASSRSDLVIPPSQQKLLAALKATGKPLVIVLMNGRPLALVNEDRMADAMLETWFSGTEGGNAIADVLFGDYNPSGKLPVSFPRSVGQIPIYYNHLPTGRPYNFEKPNKYTSHYYDAVNGPLYPFGYGLSYTQFSVSPVKMSAQTMPRNGTVEASVTVTNTGKRDGATVVQLYLNDPVASISRP

SEQ ID NO: 157847 - protein, 579 aa, Glycine max
  Coding DNA Sequence Number=SeqID_66162
  Homolog annotation: Hit_ID=Q8XB64; Match level="QueryCoverage=18%, HitCoverage=55%, E-value=4e-08, Identity=37%"; Hit description=No significant matches
MNPFSVTRIHDRVNFMVSLNFNNGKTAQQWRSIDCKQGKAQLLYKDLLNDKGLTIARYYGNSYLRYAPAQDDQQITADDIHKVCKLPIKEAQWEKLSATSEIGTTKLVDVNSIQHTGDILSVRLGYDYADIIWEPPYDAPLGLKTEHYLYNCKTHQGAVIAAMNFDSEGRVTDSLITADLVRRKSSFKIDTQMTQRFDQLCQLPAGKKFTAEGHFVSAANKPASTLMGPLMPDLSKNNSQWLDKYSLSAEIERQGQALINPRALPRFKQIRYTEVSTLGKVEVQLDAQPNGYVRKLEDYGIWKVQRLTLANQLQLKFTMSISTGASLLNKLQTDLRFPLVTGQQYQAQWESIDSDKKITSSGLRCKVTSMGDAKSIADEFSGKYLLVECQQTDSGQAGSRVRLAWLQDLNVFVTVAMQVGDKPESLVKLENEVKARFAHVVANEYNDWEKWFQIEFEYFLLNEKGFHTRRELKAKSDQRSKLNRFYMFVDLIFRKPNTAKDQYIYLEFKRAMKATTLVKGMLHDISKVNSIVKSHYIETEIKQRSFWKRSSNTPKAFTNRCIYARAGAHHIMMNAQKSA

SEQ ID NO: 157848 - protein, 131 aa, Glycine max
  Coding DNA Sequence Number=SeqID_66163
  Gene Ontology: Mol. function=transporter activity; Cellular component= integral to membrane; Biological process=transport
  Homolog annotation: Hit_ID=A4WCG5; Match level="QueryCoverage=99%, HitCoverage=42%, E-value=1e-52, Identity=77%"; Hit description =Substrate-binding region of ABC-type glycine betaine transport system precursor
MIKQGLLGMIAFAMSVGAVQAADPVKVGSKIDTEGSLLGNIILQVLNQHGVKTVNKIQLGTTQVVRGAITAGELDIYPEYTGNGAFFFNDEKDAAWKNAQQGYEKVKKLDAEKNHLVWLTPAPANNTWTIA

SEQ ID NO: 157849 - protein, 134 aa, Glycine max
  Coding DNA Sequence Number=SeqID_66164
MAPRKLASKRSRKDKAAEGTSSAPEYDSHCFRSAEHQQRFEAIKGWSFLQERRVQLRDDEYTDFQEEIARRRWASLVTPMAKFDPDIVLEFYANAWPTEEGVRDMRSWVRGQWIPFNVDAIGQLLGYPLVLEEG

SEQ ID NO: 157850 - protein, 255 aa, Glycine max
  Coding DNA Sequence Number=SeqID_66165
  Gene Ontology: Mol. function=two-component response regulator activity; Cellular component=cytoplasm; Biological process=two -component signal transduction system (phosphorelay)
  Homolog annotation: Hit_ID=A7MMN3; Match level="QueryCoverage=61%, HitCoverage=74%, E-value=2e-54, Identity=68%"; Hit description =Putative uncharacterized protein
  Pfam annotation: Domain name=Trans_reg_C; Domain location=102-179; Score=44.7; E_value=3.4e-10; Accession=PF00486.19; Description =Transcriptional regulatory protein, C t
MLPGKDGMTLCRDLRAHWQGPIVLLTSLDSDMNHILALEMGANDYILKTTPPAVLLARLRLHLRQAHVAKPEAAPAVQSSQKVLRFGSLTIDALNRQVILFDEPITLSTADFDLLWELASHAGEILDRDALLKTLRGVSYDGMDRSIDVAISRLRKKLPGIPAPDEKALHSVLSAAVRLLPGDDAAGGELREIPPRDWNKTIRNLDLDLSFELHIEPMSKYQLDEADMKRLRAGEIVALDDQYTFLQHIPRSHYV

SEQ ID NO: 157851 - protein, 87 aa, Glycine max
  Coding DNA Sequence Number=SeqID_66166
MRERKSETLERKKSETLEKEKRGKKKSETLEREKRENKKSETLEGKQLCLATKRELMRDFDDVILIRSGSLDTGYGDLDDATSSEGR

SEQ ID NO: 157852 - protein, 184 aa, Glycine max
  Coding DNA Sequence Number=SeqID_66167
MSRNFTDYATMLPFDFRHVTELHGLPNDGCQVPRSGQMRVASQQTDGPRTKLGPKVILLWAKVPKGQVNVAFKHLFNEWQGKMVLFGNLVQPPIVNADSPTVLHPSRNQLLLLIFDHGEADFLRNYLDGTHLLTSLASSSKFIRCIHVDGLIPGMSARVQPIAFLCFLITDNNFSSCSSAREAD

SEQ ID NO: 157853 - protein, 436 aa, Glycine max
  Coding DNA Sequence Number=SeqID_66168
  Gene Ontology: Mol. function=GTP cyclohydrolase I activity; Cellular component=cytoplasm; Biological process=aromatic compound biosynthetic process
  Homolog annotation: Hit_ID=A7QEB5; Match level="QueryCoverage=96%, HitCoverage=99%, E-value=1e-149, Identity=62%"; Hit description =Chromosome chr1 scaffold_84, whole genome shotgun sequence
  Pfam annotation: Domain name=GTP_cyclohydroI; Domain location=104 -198; Score=20.7; E_value=4.8e-06; Accession=PF01227.13; Description =GTP cyclohydrolase I
  Pfam annotation: Domain name=GTP_cyclohydroI; Domain location=309 -411; Score=59.8; E_value=9.1e-15; Accession=PF01227.13; Description =GTP cyclohydrolase I
  Pfam module annotation: Pfam domain module=GTP_cyclohydroI::GTP _cyclohydroI; Domain location=104-198::309-411
MDCFDEANGELENVVSVGCSEEGSEKEAKTDIGAIEDAVKVLLLALGEDINREGLRKTPLRVAKALREGTRGYRQKVKDIVEGALFPEAGLENNRIGHAGGTGGLVVVRDLDLYSYCESCLLPFQFKCHVGYVPSGQRVVGLSKLSRVVDVFAKRLQEPQRLADEVCSALHQEILPAGSGIFENKSEDAWSDFFCLLRFRGIKIENIHLRGSSDQCWCPSLTALSAKVSSKIVPVNPAMVTAVSSILDSLGEDSLRKELAGTPSRFVKWLLNFQSIDMDVKLNRSLCDGIDTLNLDREVNFNDRQIHSELNLPFWSQCEHHILPFHGVVHIGYFLSEGSNPIGKSLLQSVVHFYGFKLQVQERLTRQIAETIAPLLLGGHVIVVVEASHTCMISRGIEKFGSSTATIAVLGRFSTDLAARDAFLQCVASATTSGGQ

SEQ ID NO: 157854 - protein, 58 aa, Glycine max
  Coding DNA Sequence Number=SeqID_66169
MAITEVHEAKRQSWQLSEIHCDNAFSKELAKRAYHAKRVHPLRMNTHPLVELPVAKLG

SEQ ID NO: 157855 - protein, 100 aa, Glycine max
  Coding DNA Sequence Number=SeqID_66170
MEETSVVDARHKEEDGEEEQEENKQEEQHKLDVNGVQDEDSVDQETEENSENVTTQVEGEQHNEKFGEENDNIDNKENEENKSEGEDKEIGENKEEKILS

SEQ ID NO: 157856 - protein, 194 aa, Glycine max
  Coding DNA Sequence Number=SeqID_66171
  Subcellular localization annotation: CTP_CleavageSite=24; ConfidenceScore=5.26e-01
MKVRVQNSQEARGASNAKGSEKVRVQNTVKRLGASNAKVVRRWMRMDVPFCTLSPSMRIENSYIFQIPALSIIDPPHAEASQSRVQPSQDPASTTTTESTPPASQDLDTNSTTLCTCSLSTFSFAHYTRPNLYQIPLSPNSHALVCMHPNTSNDVYDDIPHTPFRVLIRLLSNTMQVGLNSLVTKCKFPTRLLL

SEQ ID NO: 157857 - protein, 59 aa, Glycine max
  Coding DNA Sequence Number=SeqID_66172
  Gene Ontology: Mol. function=protein dimerization activity; Cellular component=nucleus; Biological process=regulation of transcription, DNA-dependent
  Homolog annotation: Hit_ID=Q9XED8; Match level="QueryCoverage=64%, HitCoverage=5%, E-value=1e-10, Identity=73%"; Hit description=Auxin response factor 9
MTGHMTMIDIWTELLEYPQCDNSEKMFDIKGQLQLRNKWEIVFIDNEGDIMLVGDDPWL

SEQ ID NO: 157858 - protein, 72 aa, Glycine max
  Coding DNA Sequence Number=SeqID_66173
MIRTDVMDCPNTQQKFSIIVSRALTNPTSFCTNGAVLLCFLLQLVLYACDACQVIPKPLTFYIEGVTWIKVG

SEQ ID NO: 157859 - protein, 37 aa, Glycine max
  Coding DNA Sequence Number=SeqID_66174
  Homolog annotation: Hit_ID=A7QEU2; Match level="QueryCoverage=83%, HitCoverage=10%, E-value=5e-07, Identity=83%"; Hit description =Chromosome chr16 scaffold_86, whole genome shotgun sequence
MVSGPVTVELNVNMHCEACVEQLKRKILQMRGTIFLY

SEQ ID NO: 157860 - protein, 95 aa, Glycine max
  Coding DNA Sequence Number=SeqID_66175
MAPTRHPLDPDKSNRALRFPALIIGLCQSFGVLVAPSKFRAEVAWPGDWPEAQAGEAPVEAPAEAPAEAPGEADEAREDEEMTDLLDFLGGSGAT

SEQ ID NO: 157861 - protein, 945 aa, Glycine max
  Coding DNA Sequence Number=SeqID_66176
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=91%, HitCoverage=83%, E-value=0.0, Identity=57%"; Hit description=TIR
  Pfam annotation: Domain name=LRR_1; Domain location=575-593; Score =3.8; E_value=61; Accession=PF00560.24; Description=Leucine Rich Repeat
  Pfam annotation: Domain name=LRR_1; Domain location=620-641; Score =8.3; E_value=8.7; Accession=PF00560.24; Description=Leucine Rich Repeat
  Pfam annotation: Domain name=LRR_1; Domain location=643-665; Score =12.1; E_value=1.8; Accession=PF00560.24; Description=Leucine Rich Repeat
  Pfam annotation: Domain name=LRR_1; Domain location=667-689; Score =6.8; E_value=17; Accession=PF00560.24; Description=Leucine Rich Repeat
  Pfam annotation: Domain name=LRR_1; Domain location=691-713; Score =7.5; E_value=12; Accession=PF00560.24; Description=Leucine Rich Repeat
  Pfam annotation: Domain name=LRR_1; Domain location=715-736; Score =1.7; E_value=1.5e+02; Accession=PF00560.24; Description=Leucine Rich Repeat
  Pfam annotation: Domain name=LRR_1; Domain location=782-803; Score =9.1; E_value=6.3; Accession=PF00560.24; Description=Leucine Rich Repeat
  Pfam annotation: Domain name=NB-ARC; Domain location=171-464; Score =106.5; E_value=8.2e-29; Accession=PF00931.13; Description=NB-ARC domain
  Pfam annotation: Domain name=TIR; Domain location=15-147; Score =168.6; E_value=1.6e-47; Accession=PF01582.11; Description=TIR domain
  Pfam module annotation: Pfam domain module=LRR_1::LRR_1::LRR_1::LRR _1::LRR_1::LRR_1::LRR_1::NB-ARC::TIR; Domain location=575-593::620 -641::643-665::667-689::691-713::715-736::782-803::171-464::15-147
MASSSSNSYSKVNDVFLNFRGEDTRKTFVSHLYAALSNAGINTFIDHKLRKGTELGEELLAVIKGSRISIVVFSANYASSTWCLHELVEIIYHRRAYGQVVVPVFYDVDPSDVRHQTGAFGQRLKALMQKSKPIDFMFTSWKSALKEASDLVGWDARNWRSEGDLVKQIVEDISRKLDTRLLSIPEFPVGLESRVQEVIEFINAQSDTGCVVGIWGMGGLGKTTMAKVIYNKIHRRFRHSSFIENIREVCENDSRGCFFLQQQLVSDILNIRVGMGIIGIEKKLFGRRPLIVLDDVTDVKQLKALSLNREWTGTGCVFIITTRDVRLLNVLKPYHRVHVCRIKEMDENESLELFSWHAFRQAHPREDLIKLSMDIVAYCGGLPLALEVLGSYLCERTKEEWESVLAKLRKIPNDQVQEKLRISYDDLDCEEKNIFLDICFFFIGKDRVNVTEILKGCDLHAEIGITILVERSLIKLEKNNKIKMHNLLRDMGREIVRQSSLEEPEKRSRLWVHQEVLDLLLEHTGTKAIEGLALKLQRTSGLHFNTKAFEKMKKLRLLQLDHVQLVGDYEYLNKNLRWLCLQGFPLQHIPENLYQENLISIELKYSNIRLVWKEPQLLQRLKILNLSHSRNLMHTPDFSKLPNLAKLNLKDCPRLSEVHQSIGDLNNLLVINLMDCTSLSNLPRRIYQLKSLQTLIFSGCSKIDMLEEDIVQMESLTTLIAKDTAVKEMPQSIVRLKNIVYISLCGLEGLARDVFPSLIWSWMSPTANLRSCTHSFGSMSTSLTSMDIHHNNLGDMLPMLVRLSKLRSILVQCDSKFQLTQKLSKVMDDLCQVKFTELERTSYESQISENAMESYLIGMGRYDQVINMLSKSISELKYVLFLIISYAILAMNEKINFQLRNMIENNRTCAREMDVWTTTQTALENEKLRINPLGLAQKGQTQFTA

SEQ ID NO: 157862 - protein, 361 aa, Glycine max
  Coding DNA Sequence Number=SeqID_66177
MDPFDDVLVVALTSRTRSDSKFIPKAKSKQPSPKEIPVVHLANVMHSKDVVHNGTRGDWKNCVGKPALHSFIEMGVEEYFVTPYSSSINSFGKCDTTQNIQISRSVIGTAFWNRISHNCELSCSCSQAQAIQKQNTAPHVLSRGGYEYLEKKLMDEKRKKKLEETAQSGSTDTVIDPPSPIKRHVKWKLARTKKTGHMTSEAAKEIVDKIASQGFFVTHGCDDVLTVVIGRSEHPGRVRVAGVGVTIKQYFGSASSTSCTSSSMAPKDLQLLTQQIKDQLEDSITEKSQMQSQGLALPPEPEVGPSAARVNTKENCVDPSGNGPDTVDNIPLLHDQVKVGVEEVRDAYAPIPVPTKEVKVI

SEQ ID NO: 157863 - protein, 59 aa, Glycine max
  Coding DNA Sequence Number=SeqID_66178
MDQLKRLSIPSEMLRFSNHASYPRLGHPTRFFKGSIRHAMTVPKSEKMQRQDETNKKQA

SEQ ID NO: 157864 - protein, 87 aa, Glycine max
  Coding DNA Sequence Number=SeqID_66179
MDPFDDVLVVALASRTRSDSKFIPKAKSKQPSPKEIPVVHLANAMHSEDAVHNGTRGKSSREETIRDAIKVSITWPVNRDSLSNGMQ

SEQ ID NO: 157865 - protein, 111 aa, Glycine max
  Coding DNA Sequence Number=SeqID_66180
MERSMIDATSGGALGDMTPAETRNLIEKMASNSQQFSARNDVIVLRGVHEQQQQQQQRQQATKAPPQPSLEELVRQMTIQNMQFQQETRASIQSLTNQMGQIATQLNQAQS

SEQ ID NO: 157866 - protein, 173 aa, Glycine max
  Coding DNA Sequence Number=SeqID_66181
MAPKKLSAKRSRRRVWIMRTSMTTLTQMWMMLLLSNVLPSDHNSDLPLPKCQLLYAILTQMSVCVAQLIADALYLFAGMPPTRHPLNLDKSNRALGQSGFQAQGDAPQAAHAPPPPHQADPAGSLGMEWYLQHLVRQQAANHRGQVQIHECLYQLSLSQQGQGFVPFVCPTPD

SEQ ID NO: 157867 - protein, 1042 aa, Glycine max
  Coding DNA Sequence Number=SeqID_66182
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=94%, HitCoverage=95%, E-value=0.0, Identity=55%"; Hit description=TIR
  Pfam annotation: Domain name=LRR_1; Domain location=576-598; Score =1.2; E_value=1.8e+02; Accession=PF00560.24; Description=Leucine Rich Repeat
  Pfam annotation: Domain name=LRR_1; Domain location=642-663; Score =1.0; E_value=2e+02; Accession=PF00560.24; Description=Leucine Rich Repeat
  Pfam annotation: Domain name=LRR_1; Domain location=665-687; Score =7.9; E_value=11; Accession=PF00560.24; Description=Leucine Rich Repeat
  Pfam annotation: Domain name=LRR_1; Domain location=696-718; Score =9.9; E_value=4.4; Accession=PF00560.24; Description=Leucine Rich Repeat
  Pfam annotation: Domain name=LRR_1; Domain location=720-741; Score =3.3; E_value=74; Accession=PF00560.24; Description=Leucine Rich Repeat
  Pfam annotation: Domain name=LRR_1; Domain location=787-808; Score =10.0; E_value=4.3; Accession=PF00560.24; Description=Leucine Rich Repeat
  Pfam annotation: Domain name=NACHT; Domain location=229-383; Score= -40.7; E_value=0.09; Accession=PF05729.3; Description=NACHT domain
  Pfam annotation: Domain name=NB-ARC; Domain location=191-486; Score =111.4; E_value=2.8e-30; Accession=PF00931.13; Description=NB-ARC domain
  Pfam annotation: Domain name=TIR; Domain location=30-166; Score =158.6; E_value=1.7e-44; Accession=PF01582.11; Description=TIR domain
  Pfam module annotation: Pfam domain module=LRR_1::LRR_1::LRR_1::LRR _1::LRR_1::LRR_1::NACHT::NB-ARC::TIR; Domain location=576-598::642 -663::665-687::696-718::720-741::787-808::229-383::191-486::30-166
  Subcellular localization annotation: CTP_CleavageSite=51; ConfidenceScore=5.33e-01
MEFVASSSSFSQSKPSSSFSKSKPKRLYDVFINFRGEDTRGKFVSHLHYALSKAGVNTFIDDENLLKGMTLKDELMRAIEGSQISLVVFSKSYTESTWCLDELEKILECRKLHDQIVMPIFYDIEPSVVRHQKGAFGKALKSAVEKTYSGEHAEQVLWRWSSALNRAADLSGFHVVDRRNEAILVKEIVEDVLRKLVYEDLYVTEFPVGLESRVQKVIGLINNQFTKVCMIGIWGMGGLGKTSTAKGIYNQIHRKFIDKSFIEDIREICQTEGRGHILLQKKLLSDVLKTEVDILSVGMGKTTIKERLSGKRMLVVLDDVNELGQVEHLCGNREWFGQGTVIIITTRDVRLLKQLKVDSIYKLEEMDKNESLELFSWHAFGNAEPREDFKELARSVVAYCGGLPLALRVLGAYLIERPKQLWESVLSKLEKIPNDQVQKKLRISFDGLSDPLEKDIFLDVCCFFIGKDRGYVTEILNGCGLHADIGITVLLERSLIKVEKNNKLGMHPLLRDMGREIICESSRNKPGKRSRLWFQKDVLDVLTKNTGTETIVGLALKLHYSSRDCFNAYAFKEMKSLRLLQLDHVHITGDYQYLSKQLRWVCWQGFPSKYIPNNFNLEGVIAIDLKHSNLRLVWKKPQVLQWLKILNLSHSKYLTATPNFSGLPSLEKLILKDCPSLSKDCTSLSNLPREMYQLKSVKTLNLSGCSKIDKLEEDIVQMESLTTLIAENTAVKQVPFSIVSLKSIGYISLCGYEGLSRNVFPSIIWSWMSPTMNPLSCIHSFSGTSSSLVSIDMQNNDLGDLVPVLTNLSNLRSVLVQCDTEAELSKQLGTILDDAYGVNFTELEITSDTSQISKHYLKSYLIGIGSYQEYFNTLSDSISERLETSESCDVSLPGDNDPYWLAHIGMGHSVYFTVPENCHMKGMALCVVYLSTPEKTATECLISVLMVNYTKCSILICKRDTVISFNDEDWEGIMSHLGSGDKVEIFVAFGHGLEIKKTAVYLMCDESIDMKMVPSPEPKKVSKKNAFVRIIKKIVTSKIQEQ

SEQ ID NO: 157868 - protein, 48 aa, Glycine max
  Coding DNA Sequence Number=SeqID_66183
MKAQRQRHYQDYLMRIMKQAKYSLKAQVEKDEGLEAEALCGSLDTGYG

SEQ ID NO: 157869 - protein, 89 aa, Glycine max
  Coding DNA Sequence Number=SeqID_66184
MSKRERNTSNRCSTVPRFSALGFCEKHGHFAIDDNDIIEVRTKEWESMDFILYIPCVSPMPSAKERLWFQSTPRIHTSNHTLLSSSVFP

SEQ ID NO: 157870 - protein, 88 aa, Glycine max
  Coding DNA Sequence Number=SeqID_66185
METKRWSSCRNMTFCGRARRGSRVCFPKEERCAESPPMFICGKRRKNRRKLVKMKILSSGVVFTFEEGRQKRGFCSYVPSIEEEIRPT

SEQ ID NO: 157871 - protein, 102 aa, Glycine max
  Coding DNA Sequence Number=SeqID_66186
MMQYRHKCADSTKEERVEAKLHDESRLIQRCFDDNKGDDKKLKGQSKNELKMFKIESRTLQDSRGKLISRIKDQASKNQDQDSRIKRRLNQDKYEKVFSKTK

SEQ ID NO: 157872 - protein, 184 aa, Glycine max
  Coding DNA Sequence Number=SeqID_66187
MSKLSQSLDENGSGSNIDLVGGSLTDLTLNAFDIDNLVLNHNVEDHILRKSLKDDGNEDDGSGCEKNRDPTNAEKAIGYEHGLVVPEVPILGYVLGTNDDGVGVGVNLKHVFCEVNGDDADAAAHAAKVEAFGITAELVLVDDHGGERRGGVEEVAVDDKDANVFGVDKGEARMREMVSKKEGV

SEQ ID NO: 157873 - protein, 64 aa, Glycine max
  Coding DNA Sequence Number=SeqID_66188
MEAGSLSFNVRKAKEKRRGGHHPLGNKPWKKELYHQECALDKKLEDDALMEEKKERGGSTKLKE

SEQ ID NO: 157874 - protein, 404 aa, Glycine max
  Coding DNA Sequence Number=SeqID_66189
  Gene Ontology: Mol. function=nucleotide binding
  Homolog annotation: Hit_ID=A7QD48; Match level="QueryCoverage=97%, HitCoverage=99%, E-value=1e-101, Identity=49%"; Hit description =Chromosome undetermined scaffold_80, whole genome shotgun sequence
  Pfam annotation: Domain name=mTERF; Domain location=51-363; Score =108.7; E_value=1.8e-29; Accession=PF02536.5; Description=mTERF
MKKIQGLQAPHGATSVRGSFALWQGFWVLLHHTLPCHVTVTHLQVAIAESPIVKALRVFTSATCSTIGLTQTQVEFEDDKNKCSDAAELLSKWGCSDDDLVRIFSRCPSLRNADPMQVQSKLCLLSDLGLCASELVKIVNCRPRFFRSRINSCLEERMAHLTSLFETKEVLQKAIVRNPSLLLSAGRYNVKATVELYEKLGVKKEDLIQMLLLRPTVISRTSFDAEKLEYLSKTGLTKDSKMYKYVVTLIGVSRVETIRDKVANFVKFGFSEEEIFGLVGKSPNVLTLSTEKVQRNMTFILGTMKLDAKMVLKLPYLLYANVDTVLKPRVLLALKMQDMDAELQIMGPTIVSSLRMPEQRFLKLFIQCHDEDVANQLMEFYKRTKEVKRLGESSKKYSKSGFPF

SEQ ID NO: 157875 - protein, 95 aa, Glycine max
  Coding DNA Sequence Number=SeqID_66190
MGSLWENIDKKKEKGGIQLNMEAGLVKKNPKQPVATYPSAGGRRVTRGMRVPRKEYARSRHQRLFEENVGKTGKDAIYELLSERFGSCIYARGRY

SEQ ID NO: 157876 - protein, 113 aa, Glycine max
  Coding DNA Sequence Number=SeqID_66191
MASSKKGERGGVTTNIYLRKTLEKPKRRSANFKKKGSEKEVVKALDLEQSQVTLMKIVEAMPSKIILMMPKNQELSKFQRFKNQVSSFKNQDSRIKFQESRFKNQVSRIKIQE

SEQ ID NO: 157877 - protein, 300 aa, Glycine max
  Coding DNA Sequence Number=SeqID_66192
  Gene Ontology: Mol. function=nucleic acid binding
  Homolog annotation: Hit_ID=Q2R951; Match level="QueryCoverage=56%, HitCoverage=56%, E-value=1e-07, Identity=28%"; Hit description =Transposable element protein, putative, Retrotrans_gag
MSTVMELCSTMGAFDEDVEVVYLRAFSFSLTGFDEPLCETWERFRSLLWRCPNHSFDDAAQLQIFYNVLRPQTKMILDALAGEALTKQIDQVPQQFSQGRSQKTHQAYQVQQVLRCDFCGGDHRNGHYSTPDDCQQEDEAHYLHNQTRPQHNFQGNYQGYKGGLGSNQPYGWRQQNNNAYFGPTNSSYVNPKEQCKGIITRRGAVDGLKDDGEKKKNEGVVEKNDEKEGVEKEKEKNDEVVTNEEVEEKVINIPFSEELEHMPTYAKFMKDFLTKKRRIMDDETVELEAGCTAIIQKSIP

SEQ ID NO: 157878 - protein, 44 aa, Glycine max
  Coding DNA Sequence Number=SeqID_66193
MDKTLKIREDEWRERERRSTKFGASKEPTNPKSSPRFSTKSRGM

SEQ ID NO: 157879 - protein, 45 aa, Glycine max
  Coding DNA Sequence Number=SeqID_66194
MEPTTCWGLHCYRDKNLPRESKNWRSEFKNFIQLRNVTAQPKNKQ

SEQ ID NO: 157880 - protein, 1018 aa, Glycine max
  Coding DNA Sequence Number=SeqID_66195
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=97%, HitCoverage=98%, E-value=0.0, Identity=53%"; Hit description=TIR
  Pfam annotation: Domain name=LRR_1; Domain location=618-639; Score =3.2; E_value=78; Accession=PF00560.24; Description=Leucine Rich Repeat
  Pfam annotation: Domain name=LRR_1; Domain location=641-670; Score =6.3; E_value=21; Accession=PF00560.24; Description=Leucine Rich Repeat
  Pfam annotation: Domain name=LRR_1; Domain location=672-694; Score =7.5; E_value=12; Accession=PF00560.24; Description=Leucine Rich Repeat
  Pfam annotation: Domain name=LRR_1; Domain location=696-717; Score =1.4; E_value=1.7e+02; Accession=PF00560.24; Description=Leucine Rich Repeat
  Pfam annotation: Domain name=LRR_1; Domain location=763-784; Score =11.9; E_value=1.9; Accession=PF00560.24; Description=Leucine Rich Repeat
  Pfam annotation: Domain name=NACHT; Domain location=210-360; Score= -25.7; E_value=0.006; Accession=PF05729.3; Description=NACHT domain
  Pfam annotation: Domain name=NB-ARC; Domain location=172-463; Score =93.2; E_value=8.4e-25; Accession=PF00931.13; Description=NB-ARC domain
  Pfam annotation: Domain name=TIR; Domain location=13-147; Score =153.0; E_value=8.1e-43; Accession=PF01582.11; Description=TIR domain
  Pfam module annotation: Pfam domain module=LRR_1::LRR_1::LRR_1::LRR _1::LRR_1::NACHT::NB-ARC::TIR; Domain location=618-639::641-670::672 -694::696-717::763-784::210-360::172-463::13-147
MSSSSSQIMQYDVFLSFRGTDIRSGVLSHLIAALSNAGVNTFEDEKFERGERIMPSLLRAIAGSKIHIILFSNNYASSKWCLDELVKIMECHRTYGNEVLPVFYNVDPSDVRNQRGDFGQGLEALAQRYLLQGENDVLKSWKSALNEAANLAGWVSRNYRTDADLVEDIVEDIIEKLDMHLLPITDFPVGLESRVPKLIKFVDDQSGRGCVIGIWGMGGLGKTTIAKSIYNEFRRQRFRRSFIETNNKGHTDLQEKLLSDVLKTKVKIHSVAMGISMIEKKLFAERALIILDDVTEFEQLKALCGNCKWIDRESVLIITTRDLRLLEELKDHHAVHIWKIMEMDENESLELFSKHAFREASPTENWNKLSIDVVAYCAGLPLALEILGSYLRWRTKEEWESVLSKLKKIPNYKVQEKLRISFDGLRDPMEKDIFLDVCCFFIGKDRTYVTEILDGCGLHASIGIKVLIEHSLIKVEKNKLGMHPLLRDMGREIVCESSKNEPGKRNRLWFQKDVLDVLTNNTGTETIQGLAVKLHFTSRDSFEAYSFEKMKGLRLLQLDHVQLSGNYGYLSKQLKWICWRGFPLKYIPNNFHLEGVIAIDFKYSKLRLLWKTPQVLPWLKFLNLSHSKNLTETPDFSKLTSLEKLILKNCPSLCKGCTSLRNLPREVYKLKSVKILILSGCSKIDKLEEDIVQMESLTTLIADNTAVKQVPFSIVSSKSIGYISLCGFEGLSRNVFPSIIWSWMSPTMNPLSYIGHFYGTSSSLVSMDIHNNNFGDLAPTFRSLSNLRSVLVQCDTQIELSKLCRTILDDINGSDFTELRMTPYISQFSKHSLRSYSYLIGIGTGTGTYQEVFTTLNNSISKELATNVACDVSLPADNYPFWLAHTSEGHSVYFTVPEDCRLKGMILCVVYLSTPEIMASECLISVLIVNYTKCTIQIHKRDTVISFNDEDWQGIISHLGPGDEVEIFVTFGHRLVVKKTAVYLTYGESIDMEIEPSPEQKENALIRFIKKIVTCDFW

SEQ ID NO: 157881 - protein, 250 aa, Glycine max
  Coding DNA Sequence Number=SeqID_66196
  Gene Ontology: Mol. function=ubiquitin-protein ligase activity; Cellular component=ubiquitin ligase complex; Biological process =response to abscisic acid stimulus
  Homolog annotation: Hit_ID=Q9SRS9; Match level="QueryCoverage=30%, HitCoverage=27%, E-value=2e-26, Identity=75%"; Hit description=E3 ubiquitin-protein ligase CHIP
  Pfam annotation: Domain name=TPR_1; Domain location=11-44; Score =23.1; E_value=0.0011; Accession=PF00515.19; Description =Tetratricopeptide repeat
  Pfam annotation: Domain name=TPR_1; Domain location=45-78; Score =24.6; E_value=0.00037; Accession=PF00515.19; Description =Tetratricopeptide repeat
  Pfam annotation: Domain name=TPR_2; Domain location=11-44; Score =18.7; E_value=0.023; Accession=PF07719.8; Description=Tetratricopepti de repeat
  Pfam annotation: Domain name=TPR_2; Domain location=45-78; Score =16.8; E_value=0.081; Accession=PF07719.8; Description=Tetratricopepti de repeat
  Pfam module annotation: Pfam domain module=TPR_1::TPR_1::TPR_2::TPR _2; Domain location=11-44::45-78::11-44::45-78
MGPNAAAAKQAEKLRIDGNTYFKKDRFGAAIDAYTEAITLCPNVPVYWTNRALCHLKRNDWERVEEDSRKAIQLDSNSVKAHCDQSPCDIVVPFVVYALANNSSPENERQVGGGGKPLAKTLTGTQSSHESAAKRTNKQYLQQKKEAGKMNGDVEGGGSMPTKVLSGIGEQLVDGDADGGVTDRSGDRSSGGSTGMRKKEKGRGYREAGRNVKEVARKGDRVYRKRVASKRAHQGPTVLGEGWFFLIPST

SEQ ID NO: 157882 - protein, 89 aa, Glycine max
  Coding DNA Sequence Number=SeqID_66197
MDGLVSYGGRRGIVREFSQGLKGEGWRAVDTNDAKAVREGAVDTNDAKAAREGAEEEAGCCGEKKGFREHKGDEEVTPKVKDEDLLVDL

SEQ ID NO: 157883 - protein, 112 aa, Glycine max
  Coding DNA Sequence Number=SeqID_66198
  Gene Ontology: Mol. function=DNA-directed RNA polymerase activity; Cellular component=DNA-directed RNA polymerase II, core complex; Biological process=cellular metabolic process
  Homolog annotation: Hit_ID=O48890; Match level="QueryCoverage=90%, HitCoverage=73%, E-value=7e-46, Identity=88%"; Hit description=15.9 kDa subunit of RNA polymerase II
  Pfam annotation: Domain name=RNA_pol_Rpb4; Domain location=9-112; Score=111.8; E_value=2.1e-30; Accession=PF03874.7; Description=RNA polymerase Rpb4
MKYFSPEFLKAKCLMNCEVSLILEHKYEQLQQTSDDPMNQISQVFEKSLQYVKRFSRYKNPDAVRQVREILARYQLAEFELCVLGNLCPETVEEAIAMVPSIKEGNRGFNKK

SEQ ID NO: 157884 - protein, 119 aa, Glycine max
  Coding DNA Sequence Number=SeqID_66199
  Gene Ontology: Mol. function=hydrolase activity, acting on carbon -nitrogen (but not peptide) bonds; Cellular component=cytoplasm; Biological process=nitrogen compound metabolic process
  Homolog annotation: Hit_ID=Q9C723; Match level="QueryCoverage=68%, HitCoverage=11%, E-value=8e-34, Identity=86%"; Hit description =Putative uncharacterized protein T7N22.4
MSLIDVLMYAFLSLFQTLTGKRPRYKVDGGSNVENLSLQNIEARIRMVLAFMLPSLLPWVHSKPGFYLVLGSSNVDEGLRGYLTKARNDVERTSYYIDVGVGNDVESAGYYICASTKTI

SEQ ID NO: 157885 - protein, 92 aa, Glycine max
  Coding DNA Sequence Number=SeqID_66200
MTYILHLIASMIFFNKSSSTYVHVAYLLYLSNLTVFHKYAWGVATIVYLYDHRSVGYNEAKAYNVDGPLATRWKPLRGFGLALPVRDRLDDL

SEQ ID NO: 157886 - protein, 133 aa, Glycine max
  Coding DNA Sequence Number=SeqID_66201
  Homolog annotation: Hit_ID=A5BKT6; Match level="QueryCoverage=64%, HitCoverage=9%, E-value=2e-09, Identity=41%"; Hit description =Putative uncharacterized protein
MEIPREARDEEVANHYGIAREKLNNLLAQENAYWKQKAKDNLGNVDSKSDNGILLGYFETSKAYRVYKYRTLVVEKAIQVKFNDTKPNKELSKLNEFFANLRLEYGIKNFVSSRHNIETAASNPPLDCPQEKI

SEQ ID NO: 157887 - protein, 140 aa, Glycine max
  Coding DNA Sequence Number=SeqID_66202
MDDTKEIKALMHPTTYLGLDEESKNMDRTQYAMIGPFLYLTASIPDIMFSAINSWGSELDGGGCMNDNQFMRLRIRFVGGGCTNSGLDGGGRTNNARQSIRGAPDSMAINSWVSGLDAGGRTNSARQSIRAAPDSMVEDA

SEQ ID NO: 157888 - protein, 539 aa, Glycine max
  Coding DNA Sequence Number=SeqID_66203
MASPPTCPPPPPLVPSDASASPSAVKRHAKPYAYDHCLLDHLVLRDQWCMLILLPARLTDLIWEDIQAEFEIPEASDTDQDGVEDTVCEKYDINKEKWLQFCQTRKDPSWEDVCKKAQAIQKQNTTPHVLSREGYEYLEQRLLIEKTKKKLEEAAQSRSVDGVIDPTSPVRRHMKWKMARTKKIGEMTTEAAKEITEKIDVLTATIGHPEHPRRVHAAGAGVTIKQYFGSAPRTSCSSSSLPPEELQQLTQQIRDQLEESITEKVTWQLMASFNQMQSQIQSQMQSQGFTLPPEPLVRLVHQVDPACLVALGRVCEGSTVVHNTPLLPDQVKVDTSHIPCLADTSGQVFITAVVSPEKPPPKPDPEVDDSLYLMTLTIPELFLRPYQVTWDATVFRIFNPYFPLYIKHEDLSEIAHGGQCLSISVLQLWILMRAGNSDIYRFLEPQSIQRSGQSQFESKSYIKTWMQSSKHDVYLGAYLNGGHWQMVVILPKEHLVVWFCSLHNRPDNYLKGIINSDLKGLDDAPQPKSKAPDRWIVIK

SEQ ID NO: 157889 - protein, 82 aa, Glycine max
  Coding DNA Sequence Number=SeqID_66204
MVNLSLLAKWRWQFLQDTSVLWCDLLKHKYRAFQDELYAEYMNGWLVDVVDSWSWIVDGSNNFSVASTFKVLEQQPPQLSRC

SEQ ID NO: 157890 - protein, 192 aa, Glycine max
  Coding DNA Sequence Number=SeqID_66205
  Homolog annotation: Hit_ID=A5C0G0; Match level="QueryCoverage=36%, HitCoverage=12%, E-value=8e-13, Identity=51%"; Hit description =Putative uncharacterized protein
MENLSLVDEEEGELVFHVEKEQERRVVFLTSKSVRVQMMKEHMASVWQLKKGVTIKELENESQGWISLREHPSLSRAFLDIVRQPLAQNKKIKKPGEEWNMVHFKYEKLGQYCYLCRMLVHGEKLCDILFTTNGMSVVKGEEGGGYMRSAQFGMKEKITVGAINVDLMCEKKHIRVRTGQGHMDCNVVDDGV

SEQ ID NO: 157891 - protein, 66 aa, Glycine max
  Coding DNA Sequence Number=SeqID_66206
MATFKEEQEAVLDDLETESAHLLVQGDAKVNDSDDNVDFIAGNVKLITTKEVWDQYLEEARRDSKI

SEQ ID NO: 157892 - protein, 137 aa, Glycine max
  Coding DNA Sequence Number=SeqID_66207
MGGQHSYRNICKDESVEYNCKECDLRKRRLKNTNKKEDREDVRWGYDIRMEENNTNQLARSLIATVLVVKLIQNAKELSFFGRDAIDSNETLEVFSNNRSVWIRIEGLPLNLWKRKCFELITATIKDLVLVDEDTTD

SEQ ID NO: 157893 - protein, 96 aa, Glycine max
  Coding DNA Sequence Number=SeqID_66208
LFSFVEAKLHDESRLIQRCFDDNKGDDKKLKGQSKNEFKMFKIESRTLQNSRGKLISRIKIQGSSFQESRSIFKTQDSRIKRRLNQDKYEKVFFKN

SEQ ID NO: 157894 - protein, 386 aa, Glycine max
  Coding DNA Sequence Number=SeqID_66209
  Homolog annotation: Hit_ID=A7UQU7; Match level="QueryCoverage=85%, HitCoverage=59%, E-value=5e-29, Identity=29%"; Hit description=IMP dehydrogenase/GMP reductase, putative
  Pfam annotation: Domain name=DUF1723; Domain location=98-147; Score =39.8; E_value=9.7e-09; Accession=PF08330.1; Description=Protein of unknown function (DUF1723)
MVDVAAQKISAETDARDTSAKTDGDEPEGFPGGPRDPSVLTKYVDHVAGNVWSGKKRPKLKLCSHGRKVHNLGRPVPAIEDMVAGIRLCPLIACSIDTGDWGLISSFVERWHRVISSFHLPVGEVSITLDDVVSLLHLPIISAFHDFQPLRTDEAVLLLVELLMVNVVDHTYACSGCEMYTSADVRRNTRQLPLVLIFYIFWVALFLLIRVQPMFMSHTYRPYVTSLLLGGMHEELLASSICTISLMMPVSAPADSLLCWIYEHFSSVVKCNADLDYDEVSPRACRWIATKKTVKKVSTATYRQCLDRLRIPDVCWMPYAEHRPVQNFHLILCFSGQLRWGPIVVRYRPERVIRQFGYVQCIPAHPVHSWVSYDDVDDTWTHYSAI

SEQ ID NO: 157895 - protein, 99 aa, Glycine max
  Coding DNA Sequence Number=SeqID_66210
MYKDNWTQPWHMGSEIYPKGGLHQQGTTTNMNGDRKKKHRRKRKTNKKHRRKKTNHRRKRKMKGCKKRKRKRKRKRKRKKKDAHDGRRKRKKKDGATTI

SEQ ID NO: 157896 - protein, 169 aa, Glycine max
  Coding DNA Sequence Number=SeqID_66211
MIDISKPYTEEMRGTVHEPQANLETGQKFSPVDVLSFRGLHVLTFRGLDVLTFRGLKILAFRELKGQLCEHSQRRREVFGFEKEAIAQLLRIPGQDFTQTSVDRAHQHDHSYPDVDDGEAPQQLGDNQQWATDASPSPPESTSAPLQRLKRCLRHMADQQAANHRGRYE

SEQ ID NO: 157897 - protein, 93 aa, Glycine max
  Coding DNA Sequence Number=SeqID_66212
MREKILQEKREKEKESQTLESSKSEDKKRETQERKKLSEKHEVRENFLATKTEVLGPLTKQIDAIKDVSLIKDVSVFHAEGSSTKHRCLMSLA

SEQ ID NO: 157898 - protein, 73 aa, Glycine max
  Coding DNA Sequence Number=SeqID_66213
MVVALGGGGGLCYMGDQGTRNFERGVKNGGVEEIMHIFSVEQGILHRPNKGLLSSDHGHANYHDYGEWTTTII

SEQ ID NO: 157899 - protein, 124 aa, Glycine max
  Coding DNA Sequence Number=SeqID_66214
MGEVEEVQEQMKVDMEAMKEQMTTMMEAMMSMKKIMEANAVAVAAISAIAKVNPMPPSGLNQMNHPTSNMVGKDLGSTGDPHYVQIQNKHAFPPYGLPPNYNPPNVAYTPSENVNNSTPILIES

SEQ ID NO: 157900 - protein, 202 aa, Glycine max
  Coding DNA Sequence Number=SeqID_66215
  Gene Ontology: Mol. function=protein binding; Cellular component =cytoplasm; Biological process=keratinization
  Homolog annotation: Hit_ID=Q86AI8; Match level="QueryCoverage=90%, HitCoverage=35%, E-value=1e-19, Identity=28%"; Hit description =Similar to Homo sapiens (Human). Mucin 2
MPSPSEDYMPSPSEDYISSPSEDYTSSRSEGCMPSPSEDYTPSPLDGYTPSPSDDYMSSSLEDSTSSPSQDSTSSPLEGCKPLPSKNYTSSPLEGSTPSPSQDYTSSPLEGCTPLPLEDYMSLPSEGCTPSPSEDYTPSPSEDYTSSLSEGYSPLEGYTSSPSEGYMPSPLEDYIPHFQRTTRPHLQRVARARFQRAPHLRL

SEQ ID NO: 157901 - protein, 84 aa, Glycine max
  Coding DNA Sequence Number=SeqID_66216
  Homolog annotation: Hit_ID=Q2HW90; Match level="QueryCoverage=80%, HitCoverage=14%, E-value=6e-07, Identity=38%"; Hit description =Putative uncharacterized protein
MGSDQTPSFKKRFYHLELDLVMIEEAVEVITSLAQYYDQSLRCFTFGDFQLAPTIEEFEGVLGCPLGVRKPYLFSGFYHSMARI

SEQ ID NO: 157902 - protein, 591 aa, Glycine max
  Coding DNA Sequence Number=SeqID_66217
MVEREKFDHIEERLRAFEGGGDYPSVDMAKLCLVPGVIIPPKFKVPDFDKYKGTTCPKKGRKDRKDSPNVRNNPFSNHESSAVNAVEEWKSQELKQIGDVSTFRRFILEALREADVIELDDNKGDLCLMHPECKEGGMRGMHAIGGITTQIPQGFQPPIAKTQDASGICVGNGMLAAKIINTSSTSGMTRSRRIFAPPELPTRSKDKGKAKADIGEREKTTPTANNETPIGKIVEEGDNFSKREISAEEGTQQGFARVRQMHGPQWPKYSLAMGLPSMVVLPTLHQKLKFVVEGQLIIVSGEDDILVSCASSTPYVEAAEESLETSFQALEIVNNAYVEAPPVQPCLSGAFLMVARVMLRDGYEPIMGLGWNGDGTTSLVKFVENHGRPQMERVPICHISKSFVSAGWMHEDQVVVLGKETYQGQSNWEDHEDQGLPPRFEENGGARRKRGEAALRGDKGCEFRHWCKEKGIQGWHLYLLEHPRWVSDSVARLPRHLRLVLLGYVWFELRYYATHAIFESQVLPGKAKIEDNETRDVPKDKGGDEEAVQRWFLGRCSVPRMGRQYRASPGKEWEGANVRGLLGSKLSQSKG

SEQ ID NO: 157903 - protein, 500 aa, Glycine max
  Coding DNA Sequence Number=SeqID_66218
  Homolog annotation: Hit_ID=A7QYY4; Match level="QueryCoverage=64%, HitCoverage=91%, E-value=1e-130, Identity=75%"; Hit description =Chromosome undetermined scaffold_259, whole genome shotgun sequence
MFVASLACSCTYPSLLLRSLCPTFTSWSYQLKQLNRKKNRILASINGNSAYDVGGGYPELEQNQNGKLHSDMSSQREALLKGGDQVISVLEEMITLLEDMNMDEESEKVAVELAAQGVIGKRVDEMESDFMMALDYMIQLAENDQDDKRKSLLEVIKETVLSHLTKKCPPQVQVIGLLCRTPKKESRHELLRRVAAGGGVFKGENELKIHIPSANLNDIANQADDLLEAMETRPVIPDRKLLARLVLIREEARDMMGGGIMDERNHRGFYTLPQPEVDFLAKLVALKPGKNVLDMIRNVMQGKDEGADKSGNDNEDDTTNGEPAEFLGRPLVTGEKTLPVRPGMFLETVSKVLSGLYAGTDSGITAQHLEWEEELREIVCLQRSGDVSSASRNLTIAQKLTNLPKSSKLGSFTLFCASVFALFKLSFNYVIPDIKKGFLILMSCLVRVSELWLSANLALSLEGDKRIAERADNALSACLHGRLPFRFLLLAKRVDASLSG

SEQ ID NO: 157904 - protein, 180 aa, Glycine max
  Coding DNA Sequence Number=SeqID_66219
  Gene Ontology: Mol. function=glucose-1-phosphate adenylyltransferase activity; Cellular component=chloroplast; Biological process =glycogen biosynthetic process
  Homolog annotation: Hit_ID=Q84UT2; Match level="QueryCoverage=53%, HitCoverage=23%, E-value=1e-22, Identity=55%"; Hit description =Glucose-1-phosphate adenylyltransferase
MASACVILKVNTHLANSEKGFLGERIKGGFNNSVLVMNQLVIRSTSHKRVKHVPSILRRDDPKNVVSIILGGGPGTQLFPLTKCAATPTVPVDKQYCGLWHVEKKPIRPLSPWITDILRAAPLGITTDYFRWCSGVMGKYATGELKPPTIGTFSKELLLLTLPNNFCSFRALLTPLHVSI

SEQ ID NO: 157905 - protein, 698 aa, Glycine max
  Coding DNA Sequence Number=SeqID_66220
  Gene Ontology: Mol. function=calcium ion binding; Cellular component =cytoskeleton; Biological process=negative regulation of actin filament depolymerization
  Homolog annotation: Hit_ID=A5BUK7; Match level="QueryCoverage=86%, HitCoverage=99%, E-value=0.0, Identity=56%"; Hit description =Putative uncharacterized protein
  Pfam annotation: Domain name=CH; Domain location=186-302; Score=98.2; E_value=2.6e-26; Accession=PF00307.22; Description=Calponin homology (CH) domain
  Pfam annotation: Domain name=CH; Domain location=331-433; Score=98.5; E_value=2.1e-26; Accession=PF00307.22; Description=Calponin homology (CH) domain
  Pfam annotation: Domain name=CH; Domain location=469-545; Score=8.8; E_value=0.019; Accession=PF00307.22; Description=Calponin homology (CH) domain
  Pfam annotation: Domain name=CH; Domain location=548-655; Score=84.3; E_value=4e-22; Accession=PF00307.22; Description=Calponin homology (CH) domain
  Pfam module annotation: Pfam domain module=CH::CH::CH::CH; Domain location=186-302::331-433::469-545::548-655
MVIAAMRMTMKTTMIECGGGGGDSNDGVVVTTMQNVNQNKVKYKSKNYRLVVQNLVEKDAEDMSGHWGILVSDPWLQNQFTQVELRSLKSHFMSMRRESGRLVIADLASKMSRLKVVGENLSEEERASCVKDVYQNTEEEVDFELFLKVYLKLQTFVNSRTGSSPKNSSAFLKAATTTLLHTISESEKASYVAHINHYLAQDEFLKKYLPIDPSTNELFEIAKDGVLLCKLINVAVPGTIDERAINTKRILNPWERNENHTLCLNSAKAIGCTVVNIGTQDFIEGRRHLVLGVISQIIKIQLLADLDLKKTPQLLELLDDSKDMEEFMNLPPEKILLRWMNFHLKKAGYKKIVTNFSSDVKDAEAYAHLLNVLAPEHTNLSTLAVKNPFERAKLVLEHADKMGCKRYLTARDIVEGSPNLNLAFVAHIFQHRYIRLLTQLPSCRNGLSAQTKQQMSLLETFPDDTLDSREERAFRLWMNSFGNSTYINNVFEDLRNGWVLLETLDKVSPGIVNWKIANKPPIKMPFRKVENCNQVVKIGKQLKFSLEINDADILEWANSKVSSSRSQSRMDSFKDKSLSDGIFFLELLSSVTPRAVNWGLVTKGVTYQEKKMNATYIISIARKLGCSIFLLPEDITEVNPKMILTLTASIMSWCLKHPHEERTVGTSDNESGGQLETTSNSTLDDSASDSSLDENGNI

SEQ ID NO: 157906 - protein, 24 aa, Glycine max
  Coding DNA Sequence Number=SeqID_66221
MVVNDSASLLYNCGFWGECECMNT

SEQ ID NO: 157907 - protein, 200 aa, Glycine max
  Coding DNA Sequence Number=SeqID_66222
  Homolog annotation: Hit_ID=A5BBZ3; Match level="QueryCoverage=74%, HitCoverage=22%, E-value=4e-15, Identity=33%"; Hit description =Putative uncharacterized protein
MDSLITRLLRVPHVLKDENLAKVVETSAMVAPRGRGGGRNNRGGRSGRSGCPQYTYCKRMSHTQENCYSLHDFSDKVAHVSKSDKSESKFFDDLDRSMFFDEEYQEYLWLKFEKFSNQAQSSSVPCVSTTCISQSMEGPGPWILDSGVSDHIFGNKSSFSSISFPKIPHFVTIANGSKVASQGIVQEHGTGRLIGEGRES

SEQ ID NO: 157908 - protein, 310 aa, Glycine max
  Coding DNA Sequence Number=SeqID_66223
  Gene Ontology: Mol. function=structural constituent of ribosome; Cellular component=ribonucleoprotein complex; Biological process =translation
  Homolog annotation: Hit_ID=Q9M3V8; Match level="QueryCoverage=74%, HitCoverage=92%, E-value=4e-92, Identity=77%"; Hit description=40S ribosomal protein S6
  Pfam annotation: Domain name=Ribosomal_S6e; Domain location=1-129; Score=243.9; E_value=3.6e-70; Accession=PF01092.10; Description =Ribosomal protein S6e
MKFNIANPTTGCQKKLEIDDDQKLRAFWDKRISQEVNIDALGEEFKGYVFKITGGCDKQGFPMKQGVLTPGCVHLLLHRGTPCFRGYGRRNGERRRKFVRGCIVSPDLSVLNLVIVKKGESDLPRLTDVEKPRMRGPKRASKIRKLFNLSKEDDVRKYVNTYRRTFTTKVGKKVSKAPKIQRLVTPLTLQRKRARIADKKKRIAKAKSEAAEYQKLLASRLKEQRERRSETGEFGVDTANGAGEFGVASSCHSHWRLGLSNMLDGTGEAGYASDCFRVAVQGVAVQVGVGWSRQHCLRDELISANGIGDI

SEQ ID NO: 157909 - protein, 152 aa, Glycine max
  Coding DNA Sequence Number=SeqID_66224
MAYGLPRKLKIKASFMMMNQVDSSSFDNNKDDDKKPKRMISKIESTRFKNQEKFNFKIQEKMNSRSKRRNQEDFTREGTSFVVQVEGTSTWVVVTENKKRYISCGSVQVEGTSTWLFKENKGGYIPCGSLLVKDFTRLKRNLKDHRSLGDWV

SEQ ID NO: 157910 - protein, 233 aa, Glycine max
  Coding DNA Sequence Number=SeqID_66225
MDNTLNEGTKVVMAEIPNLQFPRIRELGLSRSKIEKMSFIHSALFHYMLATIWAISFGTEPPYSSRSASRSPEPALITDSCHFSDPTQQPPLFRRDFEKARKVKVAEVPRKCKELSKFILKSALTAAAEGGAHDGETAMATTWGWWRELGGKGRNGILYVEMMALFRGMELCWEKGLGGFRVKHFLHEGNAYADVLAKLGATSSSDWDLLQVPPLELTMHLLANMGGVMFSRI

SEQ ID NO: 157911 - protein, 201 aa, Glycine max
  Coding DNA Sequence Number=SeqID_66226
  Subcellular localization annotation: CTP_CleavageSite=33; ConfidenceScore=5.34e-01
MAKVLIENCSSMNVMPKSTLEKFPFNATHMRPSSMVVWAFDGSRREDVLVSFSSSTPYVEAAKESLETTFQSFEVPRMGLGKNNDGMAGLVDVKGNRGKFGLGYKPTQADKLRECGFKARRASRRDRRRRLPEAVKLGATMPSRFDDESREGTNTGDPAIDFEQETSQMEDEEDEDIELPLELERIIAQENREMKPHQEET

SEQ ID NO: 157912 - protein, 146 aa, Glycine max
  Coding DNA Sequence Number=SeqID_66227
MAPTRHPLDPKKFNRALGFQALITGLYQLYGVHVTPNKVQGDAQQATGAPPPPRQADSAGPLSVEQYLQHVVRQQVANHHGQVQLHECLYRFSLSQQGQGSTPFVCPTPEQFGTEVAWPGDWPDAQTGEGPTGSSMMQMNPIWTRI

SEQ ID NO: 157913 - protein, 156 aa, Glycine max
  Coding DNA Sequence Number=SeqID_66228
  Subcellular localization annotation: CTP_CleavageSite=76; ConfidenceScore=5.10e-01
MARGDQYGHLLSFVEGSMSIDRDRQKRTMWSFAPFPKMSASSGRDCKKGLTSAITTRGSDSMRRYLMLIRTFRQLEANEPVDTQRLGLIAYGDTSWLSAPLSSRDNKFDGTRRQHMVAEVNLVNRGVWVDKDLASQRSLLRKLLKEATRKLLEEAS

SEQ ID NO: 157914 - protein, 90 aa, Glycine max
  Coding DNA Sequence Number=SeqID_66229
MVERLVSTISEGDEGDQGDFGGNVQTECGKQNRGSFTYPSLKGIVVSEGYKNWRLSRIREEAKMEAIMVALEGDALSWFQWSQTCKYIRG

SEQ ID NO: 157915 - protein, 73 aa, Glycine max
  Coding DNA Sequence Number=SeqID_66230
MAPSSLSIFLLIKEKYNVFASTNRYLMDISGTAPVDEDLGHPKVRYADGENHEVILVDEVDALEVPVRKGDRR

SEQ ID NO: 157916 - protein, 1319 aa, Glycine max
  Coding DNA Sequence Number=SeqID_66231
  Gene Ontology: Mol. function=zinc ion binding; Cellular component =COPII vesicle coat; Biological process=ER to Golgi vesicle-mediated transport
  Homolog annotation: Hit_ID=A7QJV5; Match level="QueryCoverage=39%, HitCoverage=65%, E-value=0.0, Identity=76%"; Hit description =Chromosome undetermined scaffold_108, whole genome shotgun sequence
  Pfam annotation: Domain name=Sec23_BS; Domain location=419-524; Score= 167.8; E_value=2.8e-47; Accession=PF08033.3; Description=Sec23Sec24 beta-sandwich domain
  Pfam annotation: Domain name=Sec23_trunk; Domain location=125-409; Score=363.3; E_value=3.9e-106; Accession=PF04811.6; Description =Sec23Sec24 trunk domain
  Pfam annotation: Domain name=zf-Sec23_Sec24; Domain location=53-92; Score=85.5; E_value=1.7e-22; Accession=PF04810.6; Description =Sec23Sec24 zinc finger
  Pfam module annotation: Pfam domain module=Sec23_BS::Sec23_trunk::zf -Sec23_Sec24; Domain location=419-524::125-409::53-92
MAEFLDLESQDGVRMPWNVIPGTKQDAQNAVVPVSAVYTPIKHFTSMPLLNYSPLRCRTCRSVLNPFCIVDFAAKIWICPFCFQRNHFPPHYASISDDSLPAELFPQYTTVEYNSDAVGPTNTPSVPPVFLFVVDTCVIEEEIGFLRSALAQAVELLPENSLVGLITFGMFAHVHELGFGAVPKTYVFKGSKDVTKDQLLEQMSFFAKKPRPAVGVVAGARDGLSTESISRFLVPASECEFTLNSVLEELQKDPWAVPADQRAARCTSTALSIAASLLGACVPGSAARIMAFIGGPATEGPAPVRATHEACVVMYKLGNIVSKQLSEPIRSHKDLDKDSVPHYHNCVKFYDGLSKQLVHQGHVLDLFACALDQVGIAELKTAVERTGGLVVLAESFGHSVFKDSLKRVFQSGDYDLGLSSNGIFEINCSKDLKVQGIIGPCASLEKKGPLCSDVVIGQGGTSAWKMCGLDKSTSLCLFFDVVRKETPDATMQSTSNQFYFQFLTYQNNSGQMRLRVTTLSRRWVAGPESIQDQDLLSAKNLKWLKRCARFEMSDDLMGEQVYPVQFKEYYGQVCIFSSRGEARVRGRVSFHEDPRRTHAGNMDEQQQGYNRANWRDKKDWGDVREIFISKQKNKNGRRYDFARFKGVKDAHKLARELDQMVIGGLKMYVNIPKYGRDMARMVAAQPKPQRYEEKHQNTAAYWRQPHATPASTSYVAVVARNKRGVGQSKETHIQHHNRVPSLSSIHLDISLNDKKWFSEAWVGRLKNRAWFDRVEDDPLWDFGADITPKYMGDDMVLLLGLTDAKAKRMMQEAREGEESMFYSLEKWNPSLRMGQRLTWVQCWGIPLLAWDKTHIQKIVAAIGDLVDVDDDVDAARRVDRARVLIRTPWSPAIQRTITVYVGGEVYKVQVVEKYSQSIETCHCRRRSVLWSSEEVKSDDSSIRTSVSGMRRAPYNDDEAQAITVPPNTAGRRRTFSDFSIRRDDLGTAAIPNGLTIHLSPLGNCFNPRVTVTCIDKDEDQVARQGLVANEMSPVKERCKMYGAQAVGRVGSNEEANFFHKKGNIVAGKEGDMAVVQEFSGVETRDLHQDEGVGNSGLDFPIHTPTKAKGHISSSPQLKKSALSSNREDSNEEANFFHKNGNKIDGKEDDVAEVQDFSGEETRDLHLDEGVGNSESGFPIHTPTKPKGLISSSPQLKKNALSNNWKECTQVQHEMVNEKDGKNQLEEVAVIWNMAQELGATCLGRGVKWAAIRRMIKEEHIDMICIQETKKENIDKSICQALWGDAEVSWEVQPASNTAGGILCMWSEETFKLQSKVIRG

SEQ ID NO: 157917 - protein, 112 aa, Glycine max
  Coding DNA Sequence Number=SeqID_66232
MVACPGELRLSHEAIDSPRRAGYLTWKSFGGPGELEAILGERGARKLNEKTILPLLLAYFPFLIKTLNDPSFCAKQRISSPMKHKDKDIKSYKRPKTLKSYKSVKDGRHGSL

SEQ ID NO: 157918 - protein, 119 aa, Glycine max
  Coding DNA Sequence Number=SeqID_66233
MMQSYPTKALDRRLQVDWAKDPREGPREVSLVMRGVCVADASSIGACRPRIFFINGFLCFLEDEWQRNEERKRERRRHFKEKMSLEEAHHHRRPWIRAWRKKEMNEGRGREEHEILCSK

SEQ ID NO: 157919 - protein, 79 aa, Glycine max
  Coding DNA Sequence Number=SeqID_66234
MGRMHNCRLKFGPSFSIQLTNQKQSFKNYFDDAKEFKNYFDDAKEFKNYFDDAKEFQRSFKMNLKNEERKMSSKAKISR

SEQ ID NO: 157920 - protein, 115 aa, Glycine max
  Coding DNA Sequence Number=SeqID_66235
  Homolog annotation: Hit_ID=A5C0G0; Match level="QueryCoverage=80%, HitCoverage=14%, E-value=7e-20, Identity=46%"; Hit description =Putative uncharacterized protein
FMSQTIGQSIGNCLGEYLEYDEKNNNPWHPYLRIRVFIDVRKPLKTTKRIKKQGNEVVEVSFKFEHLGTFCYLCGLLGYSDDYCAKLLTLENDDGTHDNGGSSSKPSPMPDQKGG

SEQ ID NO: 157921 - protein, 102 aa, Glycine max
  Coding DNA Sequence Number=SeqID_66236
MDIIYLFQTLALKMMLSMGKEKWSVISESVVSLDKGGLSMWEVIAQDSWSGRRETHGCVFQGRKMRGVATNVYSRKTSEKLERCGLRTLSVKGSGVVFTHGE

SEQ ID NO: 157922 - protein, 147 aa, Glycine max
  Coding DNA Sequence Number=SeqID_66237
IIPFDTHIAAVGTTSNNMLSKRKTLDEGSLLSSKSETQHDHRFTSTPYVPMDPVESPTVATYPSARGRRETYGCVFHGRKMRGVATNVYLRKMLEKLEKCGLRTLSVKGSRVVFTHGEDISTARVRHKGRQPSIKVFPSLLRIPQFR

SEQ ID NO: 157923 - protein, 246 aa, Glycine max
  Coding DNA Sequence Number=SeqID_66238
PDGKKEGQECYARVKDSHAGHKTTRLPYERCTVEGYHRAFHRMRKDKELRGSSNGVIGGNQKWLKSRTQGITWLPKLKGLSRKEAKVPEESEEVQALKVELKETRVIKEKLKTTVTRVRKDNNELKLRRAKRDKSRMESMVLEDKLTACQRSKKSLTEQLSRTEENMLTIIDNYKEKMNLVASHRQRLEDEYAKVRSHSEWESRASKGACEEPWDHALANFEPYPRYATEGLAFGSTPQPNTSRGP

SEQ ID NO: 157924 - protein, 136 aa, Glycine max
  Coding DNA Sequence Number=SeqID_66239
  Pfam annotation: Domain name=zf-CCHC; Domain location=64-81; Score =29.1; E_value=1.6e-05; Accession=PF00098.14; Description=Zinc knuckle
KDLSSMSLVTLFGKLQEHEMELQRLNKNEETVKKSIALKVSSSMQEENEEEESEDEQDFSLFVKKCYKCNQLGHIKENCPSNEEWPEKSDKKRYEERRTKKAYIAWDDNDSSDGSEKEINLLTKDYESDENISQED

SEQ ID NO: 157925 - protein, 451 aa, Glycine max
  Coding DNA Sequence Number=SeqID_66240
  Gene Ontology: Mol. function=catalytic activity; Biological process =cellular metabolic process
  Homolog annotation: Hit_ID=A7PQX6; Match level="QueryCoverage=50%, HitCoverage=75%, E-value=3e-64, Identity=51%"; Hit description =Chromosome chr6 scaffold_25, whole genome shotgun sequence
  Pfam annotation: Domain name=3Beta_HSD; Domain location=77-294; Score= -130.0; E_value=0.031; Accession=PF01073.10; Description=3-beta hydroxysteroid dehydrogenaseisomerase family
  Pfam annotation: Domain name=AFT; Domain location=332-399; Score= -37.2; E_value=0.0078; Accession=PF08731.2; Description=Transcription factor AFT
  Pfam annotation: Domain name=Epimerase; Domain location=76-268; Score= -67.4; E_value=0.038; Accession=PF01370.12; Description=NAD dependent epimerasedehydratase family
  Pfam annotation: Domain name=FAR1; Domain location=346-401; Score= -26.8; E_value=0.044; Accession=PF03101.6; Description=FAR1 family
  Pfam module annotation: Pfam domain module=3Beta_HSD::AFT::Epimerase:: FAR1; Domain location=77-294::332-399::76-268::346-401
  Subcellular localization annotation: CTP_CleavageSite=31; ConfidenceScore=5.63e-01
MAFAQRHHSVTQRQVLFFTKFSNRVSLSSSLASKRSCNYNCFYAKAQNALNEEAVETKSSELKKDTQRTPSSSKLVLVAGGSGGVGQLVVASLLQQNIKSRLILRNPDKATELFGEQDKEKLQVFKGDTRKQGDLDPSMFEGVTHVICCTGTTAFPSRRWDDDNTPERVDWMGVKNLVSALPSSVKSVVLVSSIGVTKFNELPWRLTDGPYTSYDLNTLLKATAGQRRAVLIGQGDKLVGETSRIVVAEACVQALDLEVTENQVYEVNSVEVKFQWLGAVKVKVCCGGRRRQTRYAEGGAFVANVRITYGSACGANEPHVDCSDAFNTSQVFECQEDVLWWARSVAHENGFVVVILRSDRNTDTRTRKCGCPFKLRCKPVVGGEGWMVKLICGVHSHELAKSLVGHPYAVRLTKTEKTLIVVSQHALSRASECEAHGCAFQRRKDARSRHQ

SEQ ID NO: 157926 - protein, 226 aa, Glycine max
  Coding DNA Sequence Number=SeqID_66241
MYDDGNEEDNEYDSLDIKVEERKLGQYDSPTFILSKRATTGNEGPQASNDKVKGQGTIFEGPLDVVKKAWRPRKGMKKKDKLASSATLKNKVDKVVVKGIENITMVSRKEVLVIRENQMAMEEVVNSVQNHDGGSLMDIQRVEFHTTVIPEQNRGIGFIDNREGFHYSSRPPDQPIVKSSSHKPPDSQNIHMDCVNEGNSKIEVVMETTLSQGVARKDSKFDVFDQ

SEQ ID NO: 157927 - protein, 87 aa, Glycine max
  Coding DNA Sequence Number=SeqID_66242
MVVEWRRKKDDWRHHFKEKMSQEQAHHHRKSWIRAWSPLIQDQVQDSPLNVLRCHEASHGPKIYPKAFENPMAFFNSSGIIFLESSI

SEQ ID NO: 157928 - protein, 68 aa, Glycine max
  Coding DNA Sequence Number=SeqID_66243
MMITGFRLKWEGMVPRQSILESGYMEVASLGSYLGIPLLGKTPHQRVSSLFLIKFLISLLGGSRSNYL

SEQ ID NO: 157929 - protein, 53 aa, Glycine max
  Coding DNA Sequence Number=SeqID_66244
MHGKLKMLKHMTNHIVTHNMGDIKEHSHRSDKNSALHASVIGQHLATSRDSFT

SEQ ID NO: 157930 - protein, 134 aa, Glycine max
  Coding DNA Sequence Number=SeqID_66245
  Homolog annotation: Hit_ID=A5B8T8; Match level="QueryCoverage=50%, HitCoverage=10%, E-value=9e-11, Identity=47%"; Hit description =Putative uncharacterized protein
MAQALCELQLELQNGSPCTIAVSGNSKGETEGFIPKTSASKETRRNKVSTRISHFQQGETRSKKKKIEHLFDSVSSRNSLSIEIIKQKVDTMVKLCEVLESLKLKVIMANITSFSDTLLKTVVIKVNLPLIFPS

SEQ ID NO: 157931 - protein, 294 aa, Glycine max
  Coding DNA Sequence Number=SeqID_66246
  Homolog annotation: Hit_ID=A5B6Z4; Match level="QueryCoverage=55%, HitCoverage=66%, E-value=5e-14, Identity=30%"; Hit description =Putative uncharacterized protein
MEQIPLFNEKMKLAQKAAMAKRWEDFKKIMKDDQENLLKQFDLFENSAIHVATRSNSPRLLRELIEMLPKEERWQALCKENREGNTVLHEVVFCKKKKMADVVFEIEDELLLQQQSSSLEEKRTLLDMRNHRGETPLFMAAMHGKLKMLKHMANRTGTRNMEDFRKHLHRSDKYSALHASVMGQHFVLGSGDYPRGSSCGGFWFFLVANNTPFPKCHLVLKVVDFADLGPRFPGGVLGGLPFPLHQDHWGAVKGWVDARVRRKLEFICYCTYTSDNLEGSEEAFRELRMGWSGD

SEQ ID NO: 157932 - protein, 229 aa, Glycine max
  Coding DNA Sequence Number=SeqID_66247
  Homolog annotation: Hit_ID=A5ASR8; Match level="QueryCoverage=72%, HitCoverage=33%, E-value=3e-07, Identity=26%"; Hit description =Putative uncharacterized protein
  Subcellular localization annotation: CTP_CleavageSite=17; ConfidenceScore=5.07e-01
MAEPLKKRKGSSSTAAAAAHRRHGPSEASIAPIHPFLSSPRSSTLFSSDDQRLWYLSQFSSRIILDPRYLDVEFFNDETFDCYQVFQNSGLVDFMSLKLPYYPELVKVFYCNLKIQDDIIISEVHGISMVIDLSLFFSLTHLPSQGAPFEGTIVDDWKFDYSSHDARRMVCNDQAEMTGRLLVGLLTFDNRIMHYIIVRILLPRSSNLAQASEEDLILMWAFLTGRQID

SEQ ID NO: 157933 - protein, 185 aa, Glycine max
  Coding DNA Sequence Number=SeqID_66248
  Homolog annotation: Hit_ID=A5CBQ6; Match level="QueryCoverage=90%, HitCoverage=28%, E-value=3e-28, Identity=40%"; Hit description =Putative uncharacterized protein
MEHDGMLKEAQKWLKETAQSCSTVAILVATVVFAAAYTIPGGTENGTPVFLHSHVFLFFTIMDVVALATSLASVVVFLSILTSPCELWDFHKSLPRKLNLGFALLFLSLMTTMLAFSATMLLTIRLEWKNWTSTLIYSAAFFPVTIFAMIQFPVYVMTRSIVKHLWKQIKKVLPMRLVKCFTNLN

SEQ ID NO: 157934 - protein, 88 aa, Glycine max
  Coding DNA Sequence Number=SeqID_66249
MQDETYVEPYMPEYPAAVATMEEAPVDAPSDVEQPKHAVEVCQAIAERVERLLNLRIVTEGTEAHDVMQDCLRIARGVTIERNVYVKS

SEQ ID NO: 157935 - protein, 153 aa, Glycine max
  Coding DNA Sequence Number=SeqID_66250
MAHGGSHLGEDVAIWLVRMEKKLAMEKDEKGLTCLQLLSKMPQAFYIGSNDLSTSVMTRGGNPRSLNHNIGFMTIFEGRLFYIGCLATTDVEWVGFYSGSKAKTDVEWNGHEWKSFYIGLQSTYVEFEEFLHRLSPNRCRMRIFSTSFIVEPM

SEQ ID NO: 157936 - protein, 369 aa, Glycine max
  Coding DNA Sequence Number=SeqID_66251
  Gene Ontology: Mol. function=unfolded protein binding; Cellular component=cytoplasm; Biological process=response to stress
  Homolog annotation: Hit_ID=P55737; Match level="QueryCoverage=60%, HitCoverage=28%, E-value=7e-56, Identity=56%"; Hit description=Heat shock protein 81-2
  Pfam annotation: Domain name=Cyclin; Domain location=110-244; Score =36.3; E_value=2.5e-08; Accession=PF08613.2; Description=Cyclin
  Pfam annotation: Domain name=Cyclin_N; Domain location=126-237; Score= -3.7; E_value=0.00025; Accession=PF00134.14; Description=Cyclin, N -terminal domain
  Pfam annotation: Domain name=HSP90; Domain location=84-369; Score= -161.2; E_value=3.9e-09; Accession=PF00183.9; Description=Hsp90 protein
  Pfam annotation: Domain name=Vps4_C; Domain location=74-129; Score =49.7; E_value=1e-11; Accession=PF09336.1; Description=Vps4 C terminal oligomerisation domain
  Pfam module annotation: Pfam domain module=Cyclin::Cyclin _N::HSP90::Vps4_C; Domain location=110-244::126-237::84-369::74-129
MHPYFPNSEDPRFPTPLGVGHNDQKVLVLAATNTPYALDQARQHMFKAWAIYMMMFIGLLVYCEPSKWPYNVFFLVDKLNSAVQTTIQDLAAKGLASKILPPPISRTDFDKVLARQRPTVSKSDLDVHEVAESNDHNQQHQKISVFHGLTRPNISIQSYLERIFKYANCNPSCFVVAYVYLDRFTQRQPSLPINTFNVHRLLITSVMVAAKFMDDMRQWLGYHDLVYKLIKLKVEISCLSDQDINIHFEEDYNKFYEGFSKNLKLGIHEDSQNKTKLIELLKYDSSKSGDEMTSLKDYVTRMKEEQNDIYYITGESKKVVENSPFLEKLRKKGYEVLYMVDAIDEYAVGQLKEFEGKKLVSATKEGLKQ

SEQ ID NO: 157937 - protein, 380 aa, Glycine max
  Coding DNA Sequence Number=SeqID_66252
  Gene Ontology: Mol. function=glyceraldehyde-3-phosphate dehydrogenase (phosphorylating) activity; Cellular component=chloroplast; Biological process=glucose metabolic process
  Homolog annotation: Hit_ID=A9PHA3; Match level="QueryCoverage=86%, HitCoverage=78%, E-value=1e-163, Identity=86%"; Hit description =Putative uncharacterized protein
  Pfam annotation: Domain name=Gp_dh_C; Domain location=199-356; Score =384.7; E_value=1.4e-112; Accession=PF02800.11; Description =Glyceraldehyde 3-phosphate dehydrogen
  Pfam annotation: Domain name=Gp_dh_N; Domain location=51-194; Score =303.3; E_value=4.6e-88; Accession=PF00044.15; Description =Glyceraldehyde 3-phosphate dehydrogen
  Pfam module annotation: Pfam domain module=Gp_dh_C::Gp_dh_N; Domain location=199-356::51-194
MYDSEIAMLVTSSVLKPQQRKSLSPPSNQGALGRQELESMPPHLWVMFEEGFGRIGRLVLRVATSRDDVDVVAINDPFIDAKYMAYMFKYDSTHGPFKGTIKILDDSTLEINGKQVKVVSKRDPAEIPWSDFGAEYVIESSGVFTTVEKASSHLKAGAKKVVISAPSADAPMFVVGVNEKTYNPKMDIVSNASCTTNCLAPLAKVVHEEFIIVEGLMTTVHATTATQKTVDGPSMKDWRGGRGAAQNIIPSSTGAAKAVGKVLPELNGKLTGMAFRVPTPNVSVVDLTCRLKKNASYEDVKAAIKYASEGPLKGILGYTDEDVVSNDFVGDSRSSIFDAKAGIALSASFVKLVSWYDNEWGYSNRVLDLIEHMALVGAQN

SEQ ID NO: 157938 - protein, 130 aa, Glycine max
  Coding DNA Sequence Number=SeqID_66253
  Subcellular localization annotation: CTP_CleavageSite=70; ConfidenceScore=5.39e-01
MFSKQPNTGFHQTQNQTLRTNQDNKNKTSEQSKHSQVHSVSRYFTTKCRRKEAERERDFGEIGGGRSEKRGSEERVSGHWRRRRKQKSNPRKLKIPSGGYYGNEMVPMKAEARVEELAMSPTMRKLIFNR

SEQ ID NO: 157939 - protein, 190 aa, Glycine max
  Coding DNA Sequence Number=SeqID_66254
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=82%, HitCoverage=17%, E-value=1e-44, Identity=59%"; Hit description =Lipoxygenase
  Pfam annotation: Domain name=PLAT; Domain location=63-159; Score =67.1; E_value=5.9e-17; Accession=PF01477.14; Description=PLATLH2 domain
MVEDSSKTSEDLIKTTLTVHTKKPLQFKVRAVVTVRNKIKEDFKETMLKHLDAINDSIETRNVVLELISTEIDPKTKSPKKSSKAAGQRNPMSKQRVNYTTEFIVDSNFGVPGAITVTNKHQREFFLESITIEGFFSGAVHFPCKSWVQGERIFFSNKKNQCYNISEDTWQQVLAFNGFTYERTKCLVKT

SEQ ID NO: 157940 - protein, 53 aa, Glycine max
  Coding DNA Sequence Number=SeqID_66255
MTSNLKDVKEVLLGGNPVVIITWPGDRPTFSGGGKVSEDEDMADPIEYFIGGD

SEQ ID NO: 157941 - protein, 118 aa, Glycine max
  Coding DNA Sequence Number=SeqID_66256
MPSVNGEIMLRKWMMDKDTLGCSGQGGLQDLGELESGDHPTFRAFIWCEKLKGLTLLFLTGFETILFELGAGDRSVKINKVVGDFIDDEDLTPSEIAFYRGVCSEEISGGVMVSTDEE

SEQ ID NO: 157942 - protein, 52 aa, Glycine max
  Coding DNA Sequence Number=SeqID_66257
MGFFQNCPVVERPVPLCNTIIVEGINETLGLIRILGMDLKRANKVALTLVNF

SEQ ID NO: 157943 - protein, 153 aa, Glycine max
  Coding DNA Sequence Number=SeqID_66258
MAYADDVVRVSVEIFFDGDAQVSFPMFMDEWSSSLGHVSVYGFFEPQSIHNAKDIRGESQQYIETWVNESQQEVYLGAYLNQMLSSGSVHYSHIQTGGYVYGYYVMHWMWNIVSGELNIDWTMWFGDDTSLDKETMTTICKKRASYFLKVKII

SEQ ID NO: 157944 - protein, 193 aa, Glycine max
  Coding DNA Sequence Number=SeqID_66259
MDKSLKVGEDEWSKREKGGNEGKEVCIKGGNKGMDNTTQAMDIVVDGEAGNELLNHSRRVYAIVCNAKVGEGEELKGRFNNPWTLVGDFNDILIPSEQGGEVFLQLRATMFKECLALHNVSEEFWVFNKEEFGIIGSVATYPSAGANANRMKNEEWMKNERRTVKNDGMEVEQQLAQASWLLPPEVSLLAQAS

SEQ ID NO: 157945 - protein, 448 aa, Glycine max
  Coding DNA Sequence Number=SeqID_66260
MNLLSPSHRRTPVIIEEGETLCAYSRFALLRLDPQELVVKLYILGRGFELNADGLPLKILRKNMTTLAQTWSVLSYCNLVPTSHTSDITLERAKFIYGIIMKMDMNVGYLISHQISLIAQHDSSRLGFPALITTLCKARGVQSDSRSLEILSHAINLAYIKKKCWNLDDPTVTFRGPRKARGKRLEAPTTSVVPDTSTPSSSTAPDPPSLTPAQTPTILAPFPVQLPAPSSSGPSEFSFTLEMLHSMLQSLHRGQVILMQSLQSLDLPSIMTVEEFQTQMYLAQEKETSTDQRPEPSPAPVPEETLPSSPVMEPKQPIQDVPATPVLDLNEDQPHDEQDVVGEQHPQKLGSKQNCPKFGGVIAKVKERLNHEVLKVTVRLSSAFGLSAHTTLSVASTRLARQKNLAEHKYLGYALSAAVVFSQAQRMTELGNNNNRHTTQLLARASTP

SEQ ID NO: 157946 - protein, 104 aa, Glycine max
  Coding DNA Sequence Number=SeqID_66261
  Gene Ontology: Mol. function=metal ion binding; Biological process =metal ion transport
  Homolog annotation: Hit_ID=A7QDR7; Match level="QueryCoverage=45%, HitCoverage=20%, E-value=3e-07, Identity=51%"; Hit description =Chromosome chr15 scaffold_82, whole genome shotgun sequence
  Pfam annotation: Domain name=HMA; Domain location=18-80; Score=39.7; E_value=1e-08; Accession=PF00403.17; Description=Heavy-metal -associated domain
MAAGKEEKKKEDIEVITAIYKVNLHCEECGSKIKKHLMVTQGVQSVEIEFEKGEIKAKGKIDPLNILKLIEKKSKKKVELISPKVKPKDITTTEQKTKEIKDKI

SEQ ID NO: 157947 - protein, 77 aa, Glycine max
  Coding DNA Sequence Number=SeqID_66262
MVWVRGCSTLGKLWLYRLRGHNWFPESTGQPFAIIGRPTRSTFCQVMTVEVYEDVGDFNDDEDLTPPEITFYWDVYG

SEQ ID NO: 157948 - protein, 67 aa, Glycine max
  Coding DNA Sequence Number=SeqID_66263
MKEQEGNEDDNANKKQEEKKPRFIHNKVRVCTSIGLKRIKDTSSNDSMPSKSPHENYHQHYLHQPKK

SEQ ID NO: 157949 - protein, 353 aa, Glycine max
  Coding DNA Sequence Number=SeqID_66264
  Gene Ontology: Mol. function=nucleotide binding; Biological process =defense response
  Homolog annotation: Hit_ID=Q7XA39; Match level="QueryCoverage=84%, HitCoverage=62%, E-value=1e-15, Identity=36%"; Hit description =Putative disease resistance protein RGA4
  Pfam annotation: Domain name=LRR_1; Domain location=200-222; Score =5.9; E_value=25; Accession=PF00560.24; Description=Leucine Rich Repeat
  Pfam annotation: Domain name=LRR_1; Domain location=304-326; Score =7.8; E_value=11; Accession=PF00560.24; Description=Leucine Rich Repeat
  Pfam annotation: Domain name=LRR_1; Domain location=328-350; Score =8.8; E_value=7.1; Accession=PF00560.24; Description=Leucine Rich Repeat
  Pfam module annotation: Pfam domain module=LRR_1::LRR_1::LRR_1; Domain location=200-222::304-326::328-350
MKNLANNVIQIWLQKLEDASLELKDIMDEHDYETLWLEYEEVKCCLPLPEMVQSSCLSSFHPIHAIFLLKLAKRMKSISERLDEIVEERKKFHFIETVHERKSGVIEERRSGVIKWNQTSSLIIEPKVYGREKDKDQIVNFFVDIEIDEFYKVTSFKIHDLVHDFAQFVANEACCITCYNDITTFAGKVHHLCYLYEEPLIQILKLDYCCSLQKLPNSLICLNAQQRLSFKGCSSLSSLPPKIGKLTYLKVLSMYIVGKEKGFLLAKLGAWELKENIYINNLGKVKSVTDAKKANMSSFQFLTCLEKLSITRCRKVEGFPKALQHMISLKDLWLSNLPNLQSYPDNFGNLSLL

SEQ ID NO: 157950 - protein, 88 aa, Glycine max
  Coding DNA Sequence Number=SeqID_66265
MTIGTLAKSPNRIPFPVQLGKWLDDWVVVGNGGRESCWRIGQGTVVRLQQRNMENKRMLSTILTREGIALSEKGRAKHNSNLRGNCNE

SEQ ID NO: 157951 - protein, 74 aa, Glycine max
  Coding DNA Sequence Number=SeqID_66266
  Subcellular localization annotation: CTP_CleavageSite=43; ConfidenceScore=5.38e-01
MAITIFWSSCKVSFGGNWRMCFFRKKFFGFRSLDVGGLSMVIRIQNTFTPKLLNFDPSSDRINPSFVLRSLLLD

SEQ ID NO: 157952 - protein, 197 aa, Glycine max
  Coding DNA Sequence Number=SeqID_66267
MNVEERKIGEELATQLAQASKVASSRSNRLLEEETGRPKWASLLFVPPFLLNAPPYFFAFEEVTETHGLRKNTSYRFPSHYGISRIAVPSILKRPIKGCISSNNNPQTKLGYDNYRYPPSPEESTSILTNNNSVMSDGAIEAKCLESRCPSESIKADLGKRSGFKVCGNLLVMDFVNGDNVGSTSSSMIMRWRRGWK

SEQ ID NO: 157953 - protein, 59 aa, Glycine max
  Coding DNA Sequence Number=SeqID_66268
MVDGNATIENPREEWTEEERRLVQYNLNAKNIITSALGMDEYFRVSNCKNAKDMWDTLQ

SEQ ID NO: 157954 - protein, 212 aa, Glycine max
  Coding DNA Sequence Number=SeqID_66269
MALRKLPAKRSQKGTTEKGSSVAPQANTDFERHRFRSAEHQQCFETIKGWHWAPLVSPMAKFDPEIVMEFYANARPTRRGCPQPIPGPPPDLRGGPTVRGEAPQQPGDGQQQAADTLPPPPESTSARLQRLECYMQHGASQCVANHRGQGQGSTLYTWPTPEKFEVAVAWPEDWPDSQTGEGLVGTSGEADKAQEDEDMADLFDFLGGSEAI

SEQ ID NO: 157955 - protein, 24 aa, Glycine max
  Coding DNA Sequence Number=SeqID_66270
MEPPRKKKERRESLISNRFGLGLL

SEQ ID NO: 157956 - protein, 267 aa, Glycine max
  Coding DNA Sequence Number=SeqID_66271
MPFRTYEKDFKRKSSLSKFRLILWTGVRILAVQKNACVWLAVERVVQNEFWMFSSRSQQSKLRKAVILVGVFSRVFCLCPVFLAVLGRIDGDPVLRETRIWATWEYVSSNGGGQQGMVGLCALCGCGKLVVHHRPTATYGTWRYVAGVRRPWGRQASSWQSTDKRNKDHKARGLVVAGQLLKNEDMRLRWSLVIDYHGKGDWNIVEASGNRLPACVIDYTEGWVTGNRLPASGNRLPRLCNRLPEMKSLKIPILIACSGYETYCAAA

SEQ ID NO: 157957 - protein, 193 aa, Glycine max
  Coding DNA Sequence Number=SeqID_66272
MGLMKLSFDFLGIALRNARLAVDRLDTLREIEVAKLVVDTPLPFSTNAEIGGYLFGFLFAAQDASASSLLAEVVGIWSPESDELITVDMLREMKYTQAVACEVGRIERGSWHSDASSIGACRPRIFFINGFLCFLEDEWQRNGERKRERRRHFKEKMSLEEAHHHRRPWIRAWRKKEMNEGRGREEHEILCSK

SEQ ID NO: 157958 - protein, 136 aa, Glycine max
  Coding DNA Sequence Number=SeqID_66273
  Subcellular localization annotation: CTP_CleavageSite=50; ConfidenceScore=5.64e-01
MATPPSSPPPPPTGAASQSPSTLKWTRKATRLRSLATRLVGAKRLLVHVDPMSGKADNPHSKKLRTYLGIIARDKAEIDIPEASDLMTKKKILQTMGEWWRQFKFDLTSKWALVADKESVDDTVCEKYIISKKKWA

SEQ ID NO: 157959 - protein, 125 aa, Glycine max
  Coding DNA Sequence Number=SeqID_66274
MMTFKNEFKIESRTLQGSRANLISRIKNQDSRFKDSRIIKIKIQDSEIQESREDLIKIKGTSTWAVVTKNKRGYISCGSVLVEGTSTRLFKENKGGYIPYGSLLVKDFTRLKRNLKDHRSLGDWM

SEQ ID NO: 157960 - protein, 50 aa, Glycine max
  Coding DNA Sequence Number=SeqID_66275
  Gene Ontology: Mol. function=1-acylglycerol-3-phosphate O -acyltransferase activity; Cellular component=membrane; Biological process=phospholipid biosynthetic process
  Homolog annotation: Hit_ID=A5BAW7; Match level="QueryCoverage=100%, HitCoverage=18%, E-value=2e-17, Identity=82%"; Hit description =Putative uncharacterized protein
MWILGNPKKIEGAEYSNERAIYISNHASPIDIFLIMWLTPIDTIGIAKEE

SEQ ID NO: 157961 - protein, 168 aa, Glycine max
  Coding DNA Sequence Number=SeqID_66276
  Gene Ontology: Mol. function=peptidase activity
  Homolog annotation: Hit_ID=A7PCM7; Match level="QueryCoverage=44%, HitCoverage=20%, E-value=8e-18, Identity=62%"; Hit description =Chromosome chr17 scaffold_12, whole genome shotgun sequence
MEENYGAKQEDIILYGQSVGSSRTLDLAPRLPRLRDVVLHSPILSGLRVMYPVKRTYWFDIYKLSLLSPVATCPFAGERRRGSRVRFPKAERCAESPPTFICGKRRKNRRKPVKMKILSSGVVFTFEEGISTSYVDKSGAFAPTYPPSKRKSDLRSSFLRVNQAILLT

SEQ ID NO: 157962 - protein, 88 aa, Glycine max
  Coding DNA Sequence Number=SeqID_66277
MDPAEKMIESYGVVGWIAETEHAISSIRTVYSYVYGLCKGVGVGMYGSLRGFKGWCDNYAHDFIAKLPSGYETQLKGRKKQFALFGKH

SEQ ID NO: 157963 - protein, 257 aa, Glycine max
  Coding DNA Sequence Number=SeqID_66278
MEEPSKKRKGTSSRSQRHSGAQETSMPSSIPSGSLFSSKEQRIREGVPFEGALIDDWKFDFSIHDDRRLVCTNQADMTGRLLAGSLAFESRILHYLIVHILLPRSSNLAQAFHKGLQIDWAHLVRYRMHKALRLNSPLPYPHLVTLFLQHFNIPLDSEPYVPMKRSFLIGASVIASFGYIKEHDDSWIKKGARNVGEEGHEGEDSSLLSKILEKFDGLQTFVGERFDTLELQVDMRFNEMESRMTKLKNDLCCLRLG

SEQ ID NO: 157964 - protein, 116 aa, Glycine max
  Coding DNA Sequence Number=SeqID_66279
  Subcellular localization annotation: CTP_CleavageSite=25; ConfidenceScore=5.24e-01
PDLGGGGVSSSSSCFLYYRRRPFIRASAGASPCEFSSLNSPLEPRSMVGKFLSAVLQNHPQMFHVAVGEELKLLAEDRDAAHARMVLGSASDEALLHSFMWVVMGGSLNVEMLIML

SEQ ID NO: 157965 - protein, 94 aa, Glycine max
  Coding DNA Sequence Number=SeqID_66280
  Homolog annotation: Hit_ID=P35016; Match level="QueryCoverage=42%, HitCoverage=4%, E-value=3e-07, Identity=70%"; Hit description =Endoplasmin homolog precursor
MKKKTKIHRMYQANAEGDSDELVDQPKVKDKIGVVPHGLSIDSDVIKRCSRVSFRSSGCGKNLQMEEMKVASDLLVGDPASLENKIDAIHFGGP

SEQ ID NO: 157966 - protein, 269 aa, Glycine max
  Coding DNA Sequence Number=SeqID_66281
PHPEAFTMVDANRSRLNIQEVEQTLTRMINDSNTEMQLKLDQVTASLVELKSLFTQQPLNQPGSSMINNIERTQYGSRLNTQVFVGIPQTQSFPSQTHYSTRFSKVEFLRFDGMKVKEWLYKCKQFFALDNTPPKSKKRQRGELKDSIILFTPGHQLKHKRSQLLVIEIEDDELVDEGIEVIKENGVLAKKLGCKLESITPLPVSVANGTRLETLYVRMVEWLSTLNLIVWDFAKLHMEFSMEGRRFVLRGAKPYNIKLINNKTLSQAI

SEQ ID NO: 157967 - protein, 370 aa, Glycine max
  Coding DNA Sequence Number=SeqID_66282
MVIHACRSDDFPFLRVTLGSLPFFFMYKCLFEVLGLILLLTAFQCALLEHLNVAPSQLHPNSWAMPRAFKILCPFLNIRPNVSVFLFFLQMKLNGKIGWASLNRMGSPASCSTDNLTPPGIMGDFHWGPLVKQVDPTGGTMRPSAIPPIAGEVGQPAGEAKRRQDDNVRVSGHKNLRASISLCALRQVAGLTAAIEALALDIVIVATSTPLPPFAVVVQEVTPAAKVDASATLAGSIAAFLSTVVILLLSVNVVTTSALVMSSPLTTTPPVPPSTVLVAASPSCFSRPHVSLNQLYASNDVDSLWVAYYKPVEKCYGLRQSLHLKKFGDSGGERTTIPRDSTQGGILGGRGHQVESYYSHSLETGAPQGS

SEQ ID NO: 157968 - protein, 414 aa, Glycine max
  Coding DNA Sequence Number=SeqID_66283
  Homolog annotation: Hit_ID=A5B5V0; Match level="QueryCoverage=63%, HitCoverage=58%, E-value=5e-14, Identity=25%"; Hit description =Putative uncharacterized protein
MEPSKKRKGTSSRSQRHSGSQETPIPSSISFGSLFSSEEQWIRYTNLFSYRSIIDPKFIDMDFFSNESFECFQAFENSNLIPFMSLKLPVYSDLVKAFYSNLEIQEGTLMHEVYGIKIVIDQSLFYDLTQLPSEGVPFEGALIDDWKFDFSVHDAHRLVCTNQVDMTGRLLASSLAFESRILHYLIVRILLPRSSNLAQVSEEDLIVMWAFHKGLQIDWAHLVRYRMHKALRLNAPLPYPHLVTLFLQHFNIPLDYEPYVPIKRSFLTGASVIASFGYQKKHDGSWVKKGARHVGEEGHDGEDSSLLSKILDRFNGLQTFVGERSCHHQKEGDYRNKLHNESRLIQRSFDDNKGDDKKLKESRNEFKMFKIESRTLQGSRGNLISRIKNQDSRFKLPRIKIKIQDTRFKNQEKN

SEQ ID NO: 157969 - protein, 132 aa, Glycine max
  Coding DNA Sequence Number=SeqID_66284
MVERGGEGNRPPRRTLGYYAYQQGPKHYNNIAIPPFSNKVMELKPTLISLIGSHPFAGMDHEDPYTHLSTFMELCSTMGASDEDVEAVRQKHGDAILPARALDRRLQVDWARDPREGPRVLMSLRVDFEPMG

SEQ ID NO: 157970 - protein, 244 aa, Glycine max
  Coding DNA Sequence Number=SeqID_66285
  Gene Ontology: Mol. function=binding
  Homolog annotation: Hit_ID=A7P637; Match level="QueryCoverage=65%, HitCoverage=52%, E-value=7e-33, Identity=41%"; Hit description =Chromosome chr4 scaffold_6, whole genome shotgun sequence
MAQVKILKQSEVAPPPCSLPSTIISLTFFDIPSFYCNPIRCIFFYDFPHPTHHFLQTALPILNIRDLVDTLHDQQQQQQVKDLVLRAKVFTLLECMLFENFSSERVKEEAAMTIAAMVKFNKNVFVGPLVDEILCNSEIPKIVGFLRSSDLGLGVAALDCVLELGYIGRREVVEAMLKIDLVEILMDLQREEGCCESDCDFAFECCISRFAIQVEVGEGLSGEEKREVKSEILRIVKEASQSEA

SEQ ID NO: 157971 - protein, 50 aa, Glycine max
  Coding DNA Sequence Number=SeqID_66286
MEEIHGEEDEEQGIKALDLLHQWSPLLLEDQWKQNGEGGKVIGDATSRRR

SEQ ID NO: 157972 - protein, 286 aa, Glycine max
  Coding DNA Sequence Number=SeqID_66287
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=30%, HitCoverage=18%, E-value=4e-31, Identity=58%"; Hit description=Mini -chromosome maintenance protein MCM3
  Pfam annotation: Domain name=MCM; Domain location=104-271; Score= -190.4; E_value=4.8e-05; Accession=PF00493.14; Description=MCM235 family
MLHKKKNGSENGNNKENEDTTITNVLKVEAHYEGCAPFRDCRFSVSVHMESVSRANFFSFERFWLPFQFRYPENSAPGQLPRTVDVIAEVENKEANAPMYSAEDVKNIKEIAARDDEFDLLSNSLAPSIYGHSWIKKAVVLLMLSGVEKNLKNGTHLRGLEFSLDLLSVSSYLSILDFDIPFPILSLTLSPLSYSLLNPTEFLGNIVVEHDYAECTGSAIQALVLFKKLYPRHRETEIKNSIANAVHVASKTYTNCAAIRKAIKFLLSTLKEDNGWGESYLSCPKQ

SEQ ID NO: 157973 - protein, 161 aa, Glycine max
  Coding DNA Sequence Number=SeqID_66288
  Gene Ontology: Mol. function=nucleic acid binding; Cellular component= nucleus; Biological process=regulation of transcription
  Homolog annotation: Hit_ID=A2Q2U3; Match level="QueryCoverage=100%, HitCoverage=33%, E-value=3e-82, Identity=92%"; Hit description=CENP -B protein; Homeodomain-like
  Pfam annotation: Domain name=CenpB-DNA-bind; Domain location=77-141; Score=88.9; E_value=1.6e-23; Accession=PF09091.2; Description =Centromere binding protein B, DNA bind
MASHLKGVAKSTMLDQIRKELCEYKRDNPASTQKDLQRWLEGKFELKVSQGTISNTLKRSDDYLSAEIEKGRAEIKRHKPIKYPGMEKVVYEWFLQHQEHVNITRELILQKARDTMKLVYPHDDSDFNFSIGWLGKFKHRHGIKSFHRFGESGSVDVQDME

SEQ ID NO: 157974 - protein, 589 aa, Glycine max
  Coding DNA Sequence Number=SeqID_66289
  Gene Ontology: Mol. function=transcription regulator activity; Cellular component=nucleus; Biological process=regulation of transcription
  Homolog annotation: Hit_ID=A5AD41; Match level="QueryCoverage=93%, HitCoverage=97%, E-value=1e-106, Identity=44%"; Hit description =Putative uncharacterized protein
  Pfam annotation: Domain name=HLH; Domain location=387-437; Score =35.2; E_value=2.4e-07; Accession=PF00010.17; Description=Helix-loop -helix DNA-binding domain
  Subcellular localization annotation: CTP_CleavageSite=50; ConfidenceScore=5.36e-01
MENQFFLASGVSQTQQHPLHFEPSPPNPSSVPSWQSLSPPNMGIQLTVMNCAPEQTQDCFYNPNWDKSTADHGLHHFDSSALSSMVSSPAASSNPNNKSNENFIIRELVGKLGPIGSSDEIPQHSPHPLVVASSCMNSNGNNSTYTSCYSTPLSSPPKVNIVHSLVNERLANLGGGKSTMALNSSVAEFSADPGFAERAAKFSCFGSRSFNDRSVQLGVNNAELAQRSAPAMEHGGKLPRVSSSPLLKTLGSQMGAQENKNSAIHQEQEKMEGANSQEESTISEQAPNGEIGVKTSQDMMNSRKRKASSKGKAKETSNSFNPTKGVEGSEDSNSKRSKPNEGDGNENGQVKVEEESKAEEEKQNKSNSKPPEPPKDYIHVRARRGQATDSHSLAERVRREKISERMKLLQDLVPGCNKVTGKALMLDEIINYVQSLQRQVEFLSMKLASVNTRMDLSIENLISKDVFQSNNSLATLPNAVFPLDSSAQTFYGHQPQQNNPVAHNNIPNRSVTHCSVDPLDTSLCQNLAMQLPPLNVFNDGGSQFPLAFLEDDLHTIVQMGFGQAANRKTPIQSPSFNGSNNVPQMKVEL

SEQ ID NO: 157975 - protein, 139 aa, Glycine max
  Coding DNA Sequence Number=SeqID_66290
  Gene Ontology: Mol. function=ATPase activity, coupled to transmembrane movement of substances; Cellular component=integral to membrane; Biological process=transport
  Homolog annotation: Hit_ID=A7QXY6; Match level="QueryCoverage=50%, HitCoverage=9%, E-value=5e-26, Identity=81%"; Hit description =Chromosome undetermined scaffold_235, whole genome shotgun sequence
MRVYGTEEEEHGRYKWWLEKLADISLRQSAAYGVWNFSFNILYHSTQVIAVLFGGMSILAGHITAEKLRRSWSNKAPESITLSFNCPSYKKLSIALKASSGTSLKVTSEDMLSFGHEKTYASGFLDLCKSSWYKHTSYI

SEQ ID NO: 157976 - protein, 148 aa, Glycine max
  Coding DNA Sequence Number=SeqID_66291
MLKSPAFRNAFFVLLLHLLLALVSARGSHITTWNILTSYSNNSGFGKEVVEEIKRKIESYNQSCQGSEGIMFQDITTLLLSVVATCIMFQDITTFYYTVGDEIVPLEKIFQTLRCDSNGLTIASAESILESEMWNPVSSSSVIDELHA

SEQ ID NO: 157977 - protein, 294 aa, Glycine max
  Coding DNA Sequence Number=SeqID_66292
MENLFLRISSTCSFGVTITDSRIVENPRIHLKLRSFFTLSLILYEAISKLLKEVLCFLNGNRTGSCSGEVAASTQLRPPLLEMGRQRQEQHHHRFRRPSDPDSRPHRLGSRTARNRFSLPLKPLPPPQLHKAEHDDADDAVQKPWNQRPRKPTLLPKATIKIGTGPSRNHHHATNNGEFHDGGGGGGGDNNNPAPKSLWLRGFSVKSGNFFFVNCLSVGSFLFYLVLVLVSYVEVSCILADTVYFIFCKAIMHLFLCFHSFSFVVEGFKKGFRLREIVEASIKSWVYTLYKAYS

SEQ ID NO: 157978 - protein, 83 aa, Glycine max
  Coding DNA Sequence Number=SeqID_66293
MKGRAESILGFTKRHHFEILITPINKHRITVTSRKTTKVRPGFVLNRNREASLEDSTSVKGFLSVWGFNGEQRRFVVATSGCG

SEQ ID NO: 157979 - protein, 383 aa, Glycine max
  Coding DNA Sequence Number=SeqID_66294
MAKFGASSSVGMLATVGDGEGVDVGTRDGPRGSIGDGDGGDGLGATSGGLTGIDIKDGDVVDDVRLSRGGSSLTTYHFFFAVVPFPLESSDRASAKRNTHGLSARKTLEEDELYSLDWNSELFMSRVSRERKVQVPESFERFCYVKICRDQSLKQEPEVSGLWKAKSSVESSLGKMNILTAHDQGWKQELSPYNQYEEERTPNLESVFKEFVAYHASSKANQNSMKNHEIHFGKSYSIENFHGGPKLQPYYQNEAEKGSNLDKLLMQFMEATKSTQRALQSIEIQKSTVEAQEKSPVKEHVSREKDEEQVQQQWEKYSTVEKQLENILQINNLPHQLIIKKGRQGEHEETLSAILSLITNTFLEMIWNVLPDYMKFMEFLAKR

SEQ ID NO: 157980 - protein, 185 aa, Glycine max
  Coding DNA Sequence Number=SeqID_66295
MTLDSVTLSKIMRKKRGSSDSSITSLNLMKVKHVEAKLHGESKVIQRGYIYLGLTENKRGYLSCGSVLVEGTSTRFKENKGGYIPCGSLPVKGFLQVTRSNKAEVVELGDRMRHAARALVVGEVAVTLEEAIDDIEGCGDNEVVVVGKGNGVDEGGEERVEGVFIGETQHELGLGENLDDNDRDS

SEQ ID NO: 157981 - protein, 54 aa, Glycine max
  Coding DNA Sequence Number=SeqID_66296
MEVTEQSLPLSSFTIKVVGLGLVLWQIAGNDAGAQGVGIGVHEGVERERAKKFK

SEQ ID NO: 157982 - protein, 70 aa, Glycine max
  Coding DNA Sequence Number=SeqID_66297
MSEKPERCGLRTLIVKGSGVVFTHGEGIVATYPSAGGRRVTRGSVFQERNTRGVATNVYLRKTSEKSEKT

SEQ ID NO: 157983 - protein, 59 aa, Glycine max
  Coding DNA Sequence Number=SeqID_66298
  Homolog annotation: Hit_ID=Q9ZQE4; Match level="QueryCoverage=89%, HitCoverage=4%, E-value=5e-07, Identity=52%"; Hit description=Copia -like retroelement pol polyprotein
MNHILMYLKDLDAWVSVTGYACMIGNFHVSWKTILQPIVVLFTTKAEYMALVEVVMKGI

SEQ ID NO: 157984 - protein, 68 aa, Glycine max
  Coding DNA Sequence Number=SeqID_66299
MNAKCRNMPFCGACEARLTGALSKGGKMRGVATNVDKSGALAPTYPPSKRKSDLRSSFLRVNQAILFT

SEQ ID NO: 157985 - protein, 195 aa, Glycine max
  Coding DNA Sequence Number=SeqID_66300
QEDKLQNDLCHEEREDSKVSKLGMVFSTLVQMKGTFYPKLVKVFYTCAKVGMEGNLYSIVNGVEMVIDVVVWKAVAGIDIGGVRKFEESVDGYNKMAIYRGMLLDLARNLRNKLGVGGLTAEVRMLVYIIMYILAPRSNNHARVTDDDLQIMYGLKSDSPNALNVILKFGITKAKKREIVRDKGSSNLEQPKAKA

SEQ ID NO: 157986 - protein, 38 aa, Glycine max
  Coding DNA Sequence Number=SeqID_66301
EKGGGGCRPARLGELSLPRRAGLLPPEAIQLREIVWKA

SEQ ID NO: 157987 - protein, 157 aa, Glycine max
  Coding DNA Sequence Number=SeqID_66302
  Subcellular localization annotation: CTP_CleavageSite=21; ConfidenceScore=5.21e-01
MVVWDNRGRWGHMTTNLAKVMNSELKRTRSLPIFALVNNTKTSVVKLNESQTQALCNKYTRLKPTCNVVPFLMKNLVEHLGVHARHASQCDVSSIGASEWRRKRERRRHFKEKMSLEEAHHHRRPWIRAWRKKEMNEGRGREEHEILCSKRALKSEV

SEQ ID NO: 157988 - protein, 82 aa, Glycine max
  Coding DNA Sequence Number=SeqID_66303
  Gene Ontology: Mol. function=metalloendopeptidase activity; Cellular component=mitochondrial inner membrane; Biological process =proteolysis
  Homolog annotation: Hit_ID=Q9AXQ2; Match level="QueryCoverage=78%, HitCoverage=12%, E-value=2e-29, Identity=95%"; Hit description =Mitochondrial processing peptidase beta subunit
MMINLKMIAQPDPYPFCNLLTYGRRIPFAELFARIDAVDASTIKRVANRFIYDKDIAIAAMGPIQRLPDYNWFRRRTYWNRY

SEQ ID NO: 157989 - protein, 181 aa, Glycine max
  Coding DNA Sequence Number=SeqID_66304
MDRGEGFDDGDFGDEGRGMGTRFSNIVGAEVGAGGGEGGWMVRGSLYCISIFMLKRTESLKDLSKDSKTHRWSKGGQKSYLTCSIGSDNRCKGIFNNRLGRDFNKRRFNCIHLGSKMSVSTTIPCPGTQGFLSGENKLPLSSGCLAQVVTITLHIAALGSNGGNLKAILFGMNLMVVVGGM

SEQ ID NO: 157990 - protein, 991 aa, Glycine max
  Coding DNA Sequence Number=SeqID_66305
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=97%, HitCoverage=98%, E-value=0.0, Identity=54%"; Hit description=TIR
  Pfam annotation: Domain name=AAA; Domain location=215-402; Score= -35.7; E_value=0.028; Accession=PF00004.20; Description=ATPase family associated with various cellular activities (AAA)
  Pfam annotation: Domain name=LRR_1; Domain location=561-583; Score =1.0; E_value=2e+02; Accession=PF00560.24; Description=Leucine Rich Repeat
  Pfam annotation: Domain name=LRR_1; Domain location=627-648; Score =1.8; E_value=1.4e+02; Accession=PF00560.24; Description=Leucine Rich Repeat
  Pfam annotation: Domain name=LRR_1; Domain location=650-672; Score =11.2; E_value=2.5; Accession=PF00560.24; Description=Leucine Rich Repeat
  Pfam annotation: Domain name=LRR_1; Domain location=674-696; Score =7.6; E_value=12; Accession=PF00560.24; Description=Leucine Rich Repeat
  Pfam annotation: Domain name=LRR_1; Domain location=698-720; Score =8.0; E_value=10; Accession=PF00560.24; Description=Leucine Rich Repeat
  Pfam annotation: Domain name=LRR_1; Domain location=722-743; Score =3.8; E_value=62; Accession=PF00560.24; Description=Leucine Rich Repeat
  Pfam annotation: Domain name=NACHT; Domain location=214-368; Score= -25.3; E_value=0.0056; Accession=PF05729.3; Description=NACHT domain
  Pfam annotation: Domain name=NB-ARC; Domain location=176-471; Score =137.9; E_value=2.9e-38; Accession=PF00931.13; Description=NB-ARC domain
  Pfam annotation: Domain name=TIR; Domain location=16-151; Score =140.8; E_value=3.8e-39; Accession=PF01582.11; Description=TIR domain
  Pfam module annotation: Pfam domain module=AAA::LRR_1::LRR_1::LRR _1::LRR_1::LRR_1::LRR_1::NACHT::NB-ARC::TIR; Domain location=215 -402::561-583::627-648::650-672::674-696::698-720::722-743::214 -368::176-471::16-151
MSSSSFSTKPQWIYDVFINFRGGDTRRNFVSHLYYALSNAGVNTFFDEENLLKGMQLEELSRAIEGSQIAIVVFSETYTESSWCLSELEKIVECHETYGQTIVPIFYDVDPSVVRHPTGHFGDALEAAAQKKYSAKDREYGFSRWKIALAKAANFSGWDVKNHRNKAKLVKKIVEDILTKLDYALLSITEFPIGLEPRVQEVIGVIENQSTKVCIIGIWGMGGSGKTTIAKAIYNQIHRRFMDKSFIENIREVCETDGRGHVHLQEQLLSDVLKTKEKVRSIGMGTTMIDKRLSGKRTFIVLDDVNEFGQLKNLCGNRKWFGQGSVIIITTRDRRLLDQLKVDYVYDVDKMDENESLELFSWHAFNEAKPKEDFNELARNVVAYCGGLPLALEVLGSYLNERRKKDWESVLSKLERIPNDQVQEKLRISFDGLSDHMEKDIFLDICCFFIGKDRAYITEILKGCGLHADIGITVLIDRSLLKVEKNNKLGMHQLLRDMGREIICESSRKEPGKRSRLWFHEDVLDVLTNNTGTVAIEGLALKLHFAGRDCFNAYAFEEMKRLRLLQLDHVQLTGDYGYLSKQLRWISWQGFPSKYIPNNFYLEGVIAMDLKHSNLRLFWKEPQVLKWLKILNLSHSKYLTETPNFSKLPNLEKLILKDCPRLCKVHKSIGDLCNLHLINLKDCKTLGNLPRGVYKLKSVKTLILSGCSKIDKLEEDIVQMESLTTLIAENTALKQVPFSIVNSKSIGYISLCGYEGFARNVFPSIIRSWMSPTLNPLSYISPFCSTSSYLVSLDMQSYNSGDLGPMLRSLSNLRSILVRCDTDSQISKQGLTTSESSDVFLPSDNDPYWFAHMGEGHSVFFTVPEDCRMKGMTLCVVYLSTPESKAIEYLISVLMVNYTRCTIQIFKRDTVISFNDVDWHDIISHSGPGDKVEIYVIFGHGLVVKKTAVYLMCDESIDKGMDPSPEPKIEPKKNAFVKFIKKIVSSKNEEQ

SEQ ID NO: 157991 - protein, 137 aa, Glycine max
  Coding DNA Sequence Number=SeqID_66306
MMHGEMTSELDANHKSNIFLFENLRGLATHLALFYPFPSLEAIVSAIKLSDHAGDQAAQGQRVGIDIGGNNDNQEANEHMEPTTKVVPVVDVEPKEGELNDVVVKENSAKGIIVVEVASKEIDEVDSIIRSVISSID

SEQ ID NO: 157992 - protein, 73 aa, Glycine max
  Coding DNA Sequence Number=SeqID_66307
GTSFVVQVEVTSTWVVVTENKRGYISYGSVQVEGTSTWFFKENKGGYIPIGSLACKGFYKVEKNLKNRRLLGD

SEQ ID NO: 157993 - protein, 81 aa, Glycine max
  Coding DNA Sequence Number=SeqID_66308
MEKQCGKQIKIVRFDRGREYYVHYCRNVPFCGRAKARLTGAFSKGGNMCGVATIVYLWKTSEKPKETGRNENSKFGSCIYV

SEQ ID NO: 157994 - protein, 64 aa, Glycine max
  Coding DNA Sequence Number=SeqID_66309
MGLSDQSGSRCFARMLQPYGISIDIKEHSNPVTPKAYTPKSSSGPLPPDSGPTPKIILAHKHCS

SEQ ID NO: 157995 - protein, 72 aa, Glycine max
  Coding DNA Sequence Number=SeqID_66310
MMILQCPSLGWPSLPSPMSSTGMANLECVVLPPGNNNEAIPLEATVKTIPPLERTTDDKVFHINVLPIPPYP

SEQ ID NO: 157996 - protein, 190 aa, Glycine max
  Coding DNA Sequence Number=SeqID_66311
  Gene Ontology: Mol. function=helicase activity; Biological process =viral genome replication
  Homolog annotation: Hit_ID=Q9LTU4; Match level="QueryCoverage=73%, HitCoverage=11%, E-value=6e-26, Identity=36%"; Hit description =Helicase-like protein
MYNNKDVLDEDIIIAMKNMLDNNNHYAQKFRMTRDKLQSSIVSDLKLKLVYDRQLRSRNNEAQTILHSRRLFQQWIVDGYCMIESQKLNYVRQHQQQLRVDKYINLNVCNNAPETLGNEKEICGHIGFPDLFLTLTCNPTWPEIQRKVRKSNLTPHDCPDVVSRIFKMKLNQLMNDLKRGHVFGPILGCK

SEQ ID NO: 157997 - protein, 250 aa, Glycine max
  Coding DNA Sequence Number=SeqID_66312
MGYVGVRELSWRWATRDGGFMRDLWMWKTCYAPSPDRHLVPHVRVVPGDMSRGSGDLGDVRRAPDSQQIKGTKTTKQGGLCGGWPAVNLGGQSITRLKNEDRRLRWSLVIDYQGVVEVSGNRLPVSVIDYTEEWVTGNRLPDEPARTLQRTMEWILPTPTPYRLVEPVQVIEVTSSEEDPEEDLEELPPEPAVDALDFLEGDEDPLPEVDFPEDVMSASEADSTEDSGPREMAISEDSSSYHHCGHLCSG

SEQ ID NO: 157998 - protein, 185 aa, Glycine max
  Coding DNA Sequence Number=SeqID_66313
MGLLSWWWALMFLQDRDMKHWVNAKFDSQGETIGKRPIKSLGQFGVRWSEGGLLVRPEFNVKPITDVKVDFTMMYSKTIPPWTGNRTIGKDDRGHRNEGIVPDVLIHSLVSLNLNSSCQKVLRNRGSLSETKLLGKPLNWVENALKCAPLENRPTMTKITMKSLEGGKLVTKSKERSAQIDEEGV

SEQ ID NO: 157999 - protein, 69 aa, Glycine max
  Coding DNA Sequence Number=SeqID_66314
MDHLTDPPTKLMLVQWSGLALKDTSWENWVTLNDSYNLEDKVVLPEWGDVSHGSNQPGNKPKSSTKRPA

SEQ ID NO: 158000 - protein, 1109 aa, Glycine max
  Coding DNA Sequence Number=SeqID_66315
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=83%, HitCoverage=90%, E-value=0.0, Identity=53%"; Hit description=TIR
  Pfam annotation: Domain name=LRR_1; Domain location=509-531; Score =3.1; E_value=81; Accession=PF00560.24; Description=Leucine Rich Repeat
  Pfam annotation: Domain name=LRR_1; Domain location=575-596; Score =3.0; E_value=87; Accession=PF00560.24; Description=Leucine Rich Repeat
  Pfam annotation: Domain name=LRR_1; Domain location=598-620; Score =9.8; E_value=4.7; Accession=PF00560.24; Description=Leucine Rich Repeat
  Pfam annotation: Domain name=LRR_1; Domain location=622-644; Score =7.9; E_value=11; Accession=PF00560.24; Description=Leucine Rich Repeat
  Pfam annotation: Domain name=LRR_1; Domain location=646-668; Score =10.8; E_value=3.1; Accession=PF00560.24; Description=Leucine Rich Repeat
  Pfam annotation: Domain name=LRR_1; Domain location=737-758; Score =8.4; E_value=8.5; Accession=PF00560.24; Description=Leucine Rich Repeat
  Pfam annotation: Domain name=NACHT; Domain location=162-316; Score= -30.6; E_value=0.015; Accession=PF05729.3; Description=NACHT domain
  Pfam annotation: Domain name=NB-ARC; Domain location=124-419; Score =159.8; E_value=7.4e-45; Accession=PF00931.13; Description=NB-ARC domain
  Pfam annotation: Domain name=TIR; Domain location=2-99; Score=45.1; E_ value=2.5e-10; Accession=PF01582.11; Description=TIR domain
  Pfam module annotation: Pfam domain module=LRR_1::LRR_1::LRR_1::LRR _1::LRR_1::LRR_1::NACHT::NB-ARC::TIR; Domain location=509-531::575 -596::598-620::622-644::646-668::737-758::162-316::124-419::2-99
MNYPKGEELNEGLLRTIEGCRICVVVFSTNYPASSWCLKELEKIIECHRTYGHIVLPIFYDVDPSHIRHQRGAFGKNLKAFQGLWGKSVLSRWRTVLTEAANFSGWDVSNNRNEAQLVKEIAEDVLTKLDNTFMHMTEFPVGLESHVQEVIGYIENQSTKVCIVGIWGMGGLGKTTTAKAIYNRIHRRFMGRCFIEDIREVCETDRRGHLHLQEQLLSNVLKTKVNIQSVGIGRAMIESKLSRRKALIVLDDVIEFGQLKVLCGNRKWFGQGSIVIITTRDVRLLHKLKVDFVYKMEEMDENKSLELFSWHAFGEAKPTEEFDELARNVVAYCGGLPLALEVIGSYLSERRKKEWESVLSKLKIIPNDQVQEKLRISYNGLGDHMEKDIFLDICCFFIGKDRAYVTEILNGCGLHADIGITVLMERSLVKVAKNNKLEMHPLIRDMDREIIRESSTKKPGKRSRLWFQEDSLNVLTKNTGTKAIEGLALKLHSSSRDCFKAYAFKTMDQLRLLQLEHVELTGDYGYLPKHLRWIYWKRFPLKYMPKNFFLGGVIAIDLKHSNLRLVWKEPQVLPWLKILNLSHSKYLTETPDFSNLPSLEKLILKDCPSLCKVHQSIGDLQNLLLINLKDCTSLSNLPREIYKLKSLETLILSGCSKIDKLEEDIVQMEYLTTLIAKNTAVKQVSFSIVRLKSIEYISLCGYEGLSRNVFPSIILSWMSPTMNPVSRIRSFSGTSSSLISMDMHNNNLGDLVPILSSLLNLLTVSVQCDTGFQLSEELRTIQDEEYGSYRELEIASYASQIPKHYLSSYSIGIGSYQEFFNTLSRSISEGLATSAVSDVFLPSDNYPYWLAHMEDGHSVYFTVPDDFHMKGMTLCVVYLSTPEDTAIECLISVSMVNYTKGTIQIFKRDTVISFNDEDWQGIISHLGPGDEREFTWDWEQLREAEEESSSKKVICRTPFWMLFRVSPVFSSDGGAVVHFVVVQVPLQKKEGSEVRDFGFGCCRKEVCVDSLVEMITFVHWSNCSNMMSEASDDEKRSVVTAMDCIFSVLTHYSEATRRLVAYFVGVQIEDNNKNDDSHCLSPEKRQLSVVSVVKVAVRTLSMTAVSSES

SEQ ID NO: 158001 - protein, 88 aa, Glycine max
  Coding DNA Sequence Number=SeqID_66316
  Gene Ontology: Mol. function=unfolded protein binding; Cellular component=endoplasmic reticulum lumen; Biological process=protein folding
  Homolog annotation: Hit_ID=P35016; Match level="QueryCoverage=57%, HitCoverage=6%, E-value=3e-09, Identity=58%"; Hit description =Endoplasmin homolog precursor
MKETMKKKTKIHRMFQANAEGDSDELVDPPKVEDEIGAVPHGLSTDLDVIKSCGKNLQMEDMKVVLDLLVGDPTSLEKKIDAIRFGGP

SEQ ID NO: 158002 - protein, 109 aa, Glycine max
  Coding DNA Sequence Number=SeqID_66317
  Gene Ontology: Mol. function=sequence-specific DNA binding; Cellular component=nucleus; Biological process=regulation of transcription, DNA-dependent
  Homolog annotation: Hit_ID=Q8GXM7; Match level="QueryCoverage=76%, HitCoverage=47%, E-value=6e-11, Identity=48%"; Hit description =Homeobox-leucine zipper protein ATHB-X
MTPNTSSLHFPQKRAIGFESYFNGSILSPKQGLCGREKISVRSKLKHMEMECEYLKRWFGSLTVEQNRRPTHRDLPSLLRAAPSSTLSMCPRYEHVTSTADKPLAAAAI

SEQ ID NO: 158003 - protein, 836 aa, Glycine max
  Coding DNA Sequence Number=SeqID_66318
  Gene Ontology: Mol. function=ATPase activity; Cellular component =chromosome; Biological process=chromosome organization and biogenesis
  Homolog annotation: Hit_ID=Q8H2D2; Match level="QueryCoverage=99%, HitCoverage=69%, E-value=0.0, Identity=57%"; Hit description=SMC3 protein
  Pfam annotation: Domain name=ABC_tran; Domain location=618-808; Score= -54.3; E_value=0.022; Accession=PF00005.18; Description=ABC transporter
  Pfam annotation: Domain name=SMC_N; Domain location=233-813; Score =49.7; E_value=2.3e-15; Accession=PF02463.10; Description=RecFRecNSMC N terminal domain
  Pfam module annotation: Pfam domain module=ABC_tran::SMC_N; Domain location=618-808::233-813
MEREKKLSILYQKQGRATQFSSKASRDKWLQKEIDDLERVLSSNKGQATVKLCLGDLLVMGSNPETASLHMQGSSACLTGRNDHFCQLPKEQKLLDEIDRLKEELQDCDENINRRKSEITTLESLIAQSREGLNRYKEERDKLHGERKSLWGKENELTAEIDKLRAEVEKAEKSLDHAIPGDVRRGLNSVRKICREYNISGVHGPIIELLNCDEKFFTAVEVTAGNSGRSARYCSRATVTCDADFFRVAIGVAGIVLLTMKPKDNSFSQWRHELTKSMVSDGSVICKNLDVASRVARSDGLDCITLDGDQVSKKGSMTGGFYDHRRSRLRFMNIIKQNADTIHIREEELEKIDQKINEIVAEQQKSDAKCAHDKSVIEQLKQDIANANKQKLLISKALAKKEKSVGDVQNQIEQLNASNAMKNAEMGTELIDHLTPEEKKLLSDLNPEIKDLKEKLVACKTDRIETEARRAELDTNLTTNLRRRKQELEAVISSVDADSLVADAESKQQELSDAKILVDDATGQLRSVTESINDRTRQIKKIKDELNKLKDEYERKLQEDAKELEQLQSKKNTYAAKEEEYAKKIRELGPLTSDAFEACNEQLQQFSHVNKKALDQYINFTEQREELQKRQAELDAGDEKIKELISVLDQRKDESIERTFKGVARHFREVFSELVQGGHGHLVMMKKKDGDHDDDEDEDGPREANPEGRVEKYIGVKVKASVSFTGQGETQSMKQLSGGQKTVVALTLIFAIQRCDPAPFYLFDEIDAALDPQYRTAVGNIANTQFITTTFRPELVKVADKIYGVTHKNRVSRVNVVSKEDALEFIEHDQTHNAAE

SEQ ID NO: 158004 - protein, 269 aa, Glycine max
  Coding DNA Sequence Number=SeqID_66319
  Gene Ontology: Mol. function=2 iron, 2 sulfur cluster binding; Cellular component=peroxisome; Biological process=electron transport
  Homolog annotation: Hit_ID=B0LB01; Match level="QueryCoverage=97%, HitCoverage=19%, E-value=1e-123, Identity=85%"; Hit description =Aldehyde oxidase 3
  Pfam annotation: Domain name=Ald_Xan_dh_C2; Domain location=1-171; Score=-292.9; E_value=0.038; Accession=PF02738.9; Description =Aldehyde oxidase and xanthine dehydrogenase, molybdopterin binding domain
LLDKVRVVQSDTVSLTQGGFTAGSTTSESSCEAVRLCCNILVERLKPLKEKLQEEMDSIKWETLILQAYMQAVNLSASSFYVPSNDSMGYLSYGAAVEIDLLNGETRFLQTDIIYDCGQSLNPAVDLGQIEGAFVQGLGFFMLEEYETNLDGLVLQDGTWNYKIPTIDTIPKQFNVQILNSGHHQKRVLSSKASGEPPLLLAASIHCATRAAVKEARKQLLSWSNQDEEDSTFQLGVPATMPVVKELCGLDIVERYLKWKMGKDIMVLT

SEQ ID NO: 158005 - protein, 89 aa, Glycine max
  Coding DNA Sequence Number=SeqID_66320
FSQTRVENIIHESSGKYCSSCTMCGKILLDLGRNPRRIKKRRKSNVKIVKKELDAASKGPLIKEAKQPINSDTTQVSLKIVEESLFSVL

SEQ ID NO: 158006 - protein, 94 aa, Glycine max
  Coding DNA Sequence Number=SeqID_66321
MQLLISNFIVGKAFAVATAFVFGGAALVFGMVASKLELQNMSDIKTKGKDYVEPKLENIKEQFVPLKIWASFKLLRICQGSGMWKGTMLSRRLS

SEQ ID NO: 158007 - protein, 586 aa, Glycine max
  Coding DNA Sequence Number=SeqID_66322
  Gene Ontology: Cellular component=integral to membrane
  Homolog annotation: Hit_ID=A7NUT8; Match level="QueryCoverage=98%, HitCoverage=76%, E-value=1e-136, Identity=49%"; Hit description =Chromosome chr18 scaffold_1, whole genome shotgun sequence
MEEANSFVMFDPDIVRGLCKRGLVYFDVPIYPEDRFKVSRLEGFVSKREQSYEDPIEELLYAVFVVSNENVTVRDLATTLQADLSQLQAAAAFGCRLGWATKVLDPESIIGDSTILASPVASTTSDENAFVASQNYKNTLFANDSIQQGDASASGNNGPRSSYTRVAFIVDANITSYLMMGSVSPGLKSHAITLSCKDLSTLEGATYEGEIQEFANHLFSLRCVLECLQSGGIVTNIKEEGSSDKLSMITSSNDGPKLVEASIYTDRVSSGIDDETRSITLEDSSDHIHEADKAHTKFDVPLPHSTILPRPTGPVHFGPPAYSSMSPWMKLVLHSTAGQCLRLLPAPLAGCEKALIWSWDGSTIGELGRKLEGNLVKGSILLQCLNSLLKHSAVLVLPLGRCDLNEYGKLTTLDIPLPLKNADGSIPSVGKELGLNEKEDSKLNSLLTNLANKMKLWTVGPITKLLYQKEQAFGQPVDPASGRWNSLVDLSPISGALSVRQRSYTLLPAHEAATKPIKESLEAVTTNTIKTEPEENDSKEAILRGVNLIFDGSRLLPFDIGACLQARQPISLIIDAAAASTYAPFQ

SEQ ID NO: 158008 - protein, 461 aa, Glycine max
  Coding DNA Sequence Number=SeqID_66323
  Gene Ontology: Mol. function=alkaline phosphatase activity; Biological process=metabolic process
  Homolog annotation: Hit_ID=A7QPK1; Match level="QueryCoverage=85%, HitCoverage=89%, E-value=1e-170, Identity=71%"; Hit description =Chromosome chr18 scaffold_137, whole genome shotgun sequence
  Pfam annotation: Domain name=PhoD; Domain location=1-372; Score= -197.6; E_value=0.00024; Accession=PF09423.1; Description=PhoD-like phosphatase
MGIDQLRWRWWNAVVLIGMVGVTVVTVTGSDSHEKQEQVVSRIAFGSCSNQSAPQPIWDAVVDFHPQIFIWLGDNIYGDFKRPFKIFGQERTVGPWKNVPRFVPSSEQEMKAGYEKAKSNPGYARLQQNAKVIGTWDDHDYGLNDAGKEFHGKITNQKLLLDFLDEPQDSPRRKQAGVYASYTYGPVGRDIKIVLLDTRYHRDPVGSDGTILGNSQWLWLETELKGPPTALTIIGSSIQVISNLSATIHPLFAMESWGRFPKERDRLFKLIADSKRAGVFFISGDVHFGEITRYDCALDYPLYDLTSSGVTQSVEEVVPPFLRSFVRFVAWLTPSTMRVKDENCRYKSCIYGQPNFGTIEIDWDSHPVTLKFKVRDKDSVTVTGVDVSLTELQPSNSEILDRVKAEHNNSKHCTLEVSLPWIFTLASDFADLKAAKESTIDTHRYVHSQQKGACVIISSPL

SEQ ID NO: 158009 - protein, 313 aa, Glycine max
  Coding DNA Sequence Number=SeqID_66324
  Gene Ontology: Mol. function=identical protein binding; Cellular component=extracellular region; Biological process=negative regulation of catalytic activity
  Homolog annotation: Hit_ID=A7Q9H4; Match level="QueryCoverage=99%, HitCoverage=42%, E-value=9e-78, Identity=47%"; Hit description =Chromosome chr19 scaffold_66, whole genome shotgun sequence
QSGGTLLAEPYPIPGANVDVSQDKDIDEHEWFEKGGSDTNNSRKLVAYMTVARTYLGIKPAPIVAGFSSRGPNAVQPLILKPDIIAPGVNILAANSLAASPSNQPSDRRRVPFNIQQGTSMSCPHVAGVVGLLKTLHPDWSPAAIKSAIMTTDSNSFDYGSGHIQPNLAMDPGLVYDMRTRDYLNFICAHDHNQYFLKYFHRSSYNCPKSYNIENLNYPSITVANRGMKPISVTRTVTNVGTPNSTYVVKANVLEGFKVLVQPSSLAFKTIGEKKSFRVILEGTSWPSHGFPVFGNLSWTDGNHTVTSPIVIL

SEQ ID NO: 158010 - protein, 589 aa, Glycine max
  Coding DNA Sequence Number=SeqID_66325
  Gene Ontology: Mol. function=identical protein binding; Cellular component=extracellular region; Biological process=negative regulation of catalytic activity
  Homolog annotation: Hit_ID=A7Q2V8; Match level="QueryCoverage=99%, HitCoverage=75%, E-value=1e-175, Identity=54%"; Hit description =Chromosome chr12 scaffold_47, whole genome shotgun sequence
  Pfam annotation: Domain name=PA; Domain location=192-296; Score=56.7; E_value=7.7e-14; Accession=PF02225.13; Description=PA domain
  Pfam annotation: Domain name=Peptidase_S8; Domain location=2-428; Score=-8.2; E_value=2.5e-06; Accession=PF00082.13; Description =Subtilase family
  Pfam module annotation: Pfam domain module=PA::Peptidase_S8; Domain location=192-296::2-428
KLIGARIFLKSREAGGGKVDQTLRSGRDLVGHGTHTLSTAGGNFVPGANVEGNGNGTAKGGSPRARVVAYKACWNKLDEGGCYDADILEAFDHAIYDGVDVISASLGGSNPYPEALFTDGISIGAFHAVARNIVVVCSAGNDGPAPLSVTNVAPWSFTVAASTMDRDFRSRISLSNNQSIIGASLNRGLPSSSPSKKFYPVIYSVDARLPSVSIDDARLCKPGTLDPTKVKGKILVCLRGNKLTSASEGEQGKLAGAVAVLVQNDDPSDNLLLAENHVLPAASISGTGSHNIKNGTGNNGNNKEILAYLSAAETYIGVKPAPIIAGFSSRGPSSVQPLILKPDITAPGVNVIAAFTQGAGPSNLPSDRRRSLFNVQQGTSMSCPHVAGIAGLLKTYHPTWSPAAIKSAIMTTATTLDNTNQPIRNAFHKVATPFEYGAGHIQPNLAIDPGLVYDLRTTDYLNFLCASGYNQALLNLFAKLKFPYTCPKSYRIEDFNYPSITVRHPGSKTISVTRTVTNVGPPSTYVVNTHGPKGIKVLVQPSSLTFKRTGEKKKFQVILQPIGARRGLFGNLSWTDGKHRVTSPITILP

SEQ ID NO: 158011 - protein, 608 aa, Glycine max
  Coding DNA Sequence Number=SeqID_66326
  Gene Ontology: Mol. function=identical protein binding; Cellular component=extracellular region; Biological process=negative regulation of catalytic activity
  Homolog annotation: Hit_ID=A7Q9H4; Match level="QueryCoverage=96%, HitCoverage=76%, E-value=1e-171, Identity=53%"; Hit description =Chromosome chr19 scaffold_66, whole genome shotgun sequence
  Pfam annotation: Domain name=PA; Domain location=222-316; Score=34.2; E_value=4.8e-07; Accession=PF02225.13; Description=PA domain
  Pfam annotation: Domain name=Peptidase_S8; Domain location=7-446; Score=9.0; E_value=3e-07; Accession=PF00082.13; Description =Subtilase family
  Pfam module annotation: Pfam domain module=PA::Peptidase_S8; Domain location=222-316::7-446
MHMFRTWEQHRKPHDEYWPVKLIGARTFLKNHESEVGKVGRTLRSGRDLVGHGTHTLSTAGGNFARGANVEGNGKGTAKGGSPRARVVAYKACWHKLDTGGCHEADILQAFDHAIHDGVDVISASIGSSNPYTEALLTDGMSIGAFHAVARNVVVVCSAGNDGPSPLSVTNVAPWSFTVAASTLDRDFLSDISLSDNQSITGASLNRGLPPSSPSNKFYPIINSVEARLPHVSINDARLCKPGTLDPRKVRGKILICLRGDKLTSVSEGQQGALAGAVAVFVQNDEQSGNLLLAENHVLPAASISGTWNQSQGGAFNISSKGVLAYLSAARTHIGVKPAPIIAGFSSRGPSSVQPLILKPDITAPGVNVIAAFTQGAGPSNIASDRRRSPFNVQQGTSMSCPHVAGIAGLLKAYHPTWSPAAIKSAIMTTATTLDNTNQPIRNAFDEVATPFEYGAGHIQPNLAIDPGLVYDLRTSDYLNFLCASGYNQALLNLFAKLKFPYTCPKSYRIEDFNYPSITVRHSGSKTISVTRTVTNVGPPSTYVVNTHGPKGIKVLVQPCSLTFKRTGEKKKFQVILQPIGARHGLPLFGNLSWTDGRHRVTSPVVVL

SEQ ID NO: 158012 - protein, 175 aa, Glycine max
  Coding DNA Sequence Number=SeqID_66327
  Gene Ontology: Mol. function=identical protein binding; Cellular component=extracellular region; Biological process=negative regulation of catalytic activity
  Homolog annotation: Hit_ID=A2Q1V2; Match level="QueryCoverage=55%, HitCoverage=14%, E-value=4e-16, Identity=48%"; Hit description =Peptidase S8 and S53, subtilisin, kexin, sedolisin
MAAKAKEENLKIWEEWSLRSEHRIRPINESLVKTMFDLLGDYCEVQNVGRSELPRSKSRASRGSKLFGKLKFPYTCPKSYRIENFNYPSITVRHPGSKTVSVTRTVTNVGPPSTYVVNTHGSKGIKVLVQPCSLTFKRTGEKKFQVILRPIGASHGLPLFGNLSWTDGRHRLCHK

SEQ ID NO: 158013 - protein, 54 aa, Glycine max
  Coding DNA Sequence Number=SeqID_66328
MVSPLATGLQTFNAHAQDYPVLQIFNSPIFFLRSMDNDEDTGHNTDKEDQVPCG

SEQ ID NO: 158014 - protein, 551 aa, Glycine max
  Coding DNA Sequence Number=SeqID_66329
  Homolog annotation: Hit_ID=A7PUF6; Match level="QueryCoverage=98%, HitCoverage=68%, E-value=6e-63, Identity=33%"; Hit description =Chromosome chr7 scaffold_31, whole genome shotgun sequence
  Pfam annotation: Domain name=Ank; Domain location=135-168; Score=8.3; E_value=2.1; Accession=PF00023.21; Description=Ankyrin repeat
  Pfam annotation: Domain name=Ank; Domain location=16-46; Score=1.5; E_ value=20; Accession=PF00023.21; Description=Ankyrin repeat
  Pfam annotation: Domain name=Ank; Domain location=435-467; Score=3.3; E_value=11; Accession=PF00023.21; Description=Ankyrin repeat
  Pfam annotation: Domain name=Ank; Domain location=61-97; Score=22.6; E_value=0.0015; Accession=PF00023.21; Description=Ankyrin repeat
  Pfam annotation: Domain name=Ank; Domain location=98-131; Score=4.2; E_value=8.2; Accession=PF00023.21; Description=Ankyrin repeat
  Pfam module annotation: Pfam domain module=Ank::Ank::Ank::Ank::Ank; Domain location=135-168::16-46::435-467::61-97::98-131
MYNEVEVCHTAMINESMGTALHVAVDLDEEGVVEELVKAIIRHRQGEQSVKIKALEMENDHGDTPLHVAASRGFAKICKLIIGTNNERMYLVSRKNKHGETPLFQAAINWKKQAFAYLSHISNHSATLQDLERGNGDTILHCAIRREYFGLIIVVLMVEGSDLAVIIVQYYDFLSTHKNIEGLTPLTVLATRPSAFRSASKLSWWKQILYHCILVESLDPEGQMKANLGKMEDPKSDKMNYPKNYATLYDLFGGLLSVAALIGVLDSQKSIYFLSIFLWAGKMPSENNQHDTENPSTNKYTFGFGTSQVGFLPPNYATFQQFVRSAYVHTLGLSGAELKEIKKTKKRHQWSSQLLKALLKRPYAAFTGSGGKPTDLEVEADMYNVYSQYKQGETTGLGGLEEEKKTEADDKKNSSPSETIRKETDERADEKNIDKKETAFLVAARNGIVEMVNEILYRIPSVIHNANSKKENVLLVAVKNRQPLVVECLKMKMQSKPEVWNNLILAVDDDENTMLHLAAYAPGGDKPWQIAGSALQMMWDIKWFQTHNIQK

SEQ ID NO: 158015 - protein, 129 aa, Glycine max
  Coding DNA Sequence Number=SeqID_66330
  Subcellular localization annotation: CTP_CleavageSite=14; ConfidenceScore=5.20e-01
MKTLLTIHQLGTQKASSNSNTTTHTNTNVNKNIINNSNNIRKKAEGLEEGEVGGFGEAGAENAIINHGEVEGRNEEILAVVSDGVSGDGVIGDSELDLAAHGGGVLLLPLPLVAVMGALEFCRQLHIKV

SEQ ID NO: 158016 - protein, 1032 aa, Glycine max
  Coding DNA Sequence Number=SeqID_66331
  Gene Ontology: Mol. function=transferase activity, transferring glycosyl groups; Cellular component=integral to membrane; Biological process=metabolic process
  Homolog annotation: Hit_ID=A7Q9P7; Match level="QueryCoverage=98%, HitCoverage=98%, E-value=1e-167, Identity=60%"; Hit description =Chromosome chr5 scaffold_67, whole genome shotgun sequence
  Pfam annotation: Domain name=UDPGT; Domain location=549-1012; Score= -72.5; E_value=5.9e-07; Accession=PF00201.9; Description=UDP -glucoronosyl and UDP-glucosyl transferase
  Subcellular localization annotation: CTP_CleavageSite=55; ConfidenceScore=5.07e-01
MAETPKKKKKGHVVMVPFMAQGHIIPFLALARQIQQSTSFTITIANTPFNIQYLRSALSSSTSPNHQIRLAELPFNSTLHDLPPNIDNTEKLPLTQLMKLCHASLTLEPPLRSLISQITEEEGHPPLCTISDVFLGWVNNVAKSLCIRNLSFTTCGAYGTLAYVSIWFNLPHRKTDSDEFCVPGFPQNYKFHRTQLHKFLLAADGTDDWSRFIVPQIALSMKSDGWICNTVQEIEPLGLQLLRNYLQLPVWPVGPLLPPASLMDSKHRAGKESGIALDACMQWLDSKDESSVLYISFGSQNTITASQMMALAEGLEESGRSFIWIIRPPFGFDINGEFIAEWLPKGFEERMRDTKRGLLVHKWGPQLEILSHSSTGAFLSHCGWNSVLESLSYGVPMIGWPLAAEQTFNLKMLVEEMGVAVELTQTVETVISGKQVKKVIEIVMEQEGKGKAMKEKATEIAARMREAITEEGKEKGSSVRAMDDLNLNDNKVACKAYLLCTAQQSLAIDYAETKTTRVEYSVLVPQTAQGVAHHSSIELAPMAETPNKGHIVMVPLMAQGHLIPFLALARQIQQNTSFTITIANTPQNIQHLRSALSSSTSPNHQIHLAELVPFNSTQHSNKDNNTQKAPLTDLLKLGYASLTLEPPFRSLISQITEEDGHPPLCIISDMFLGWVNNVAKSLGTRNLTFTTCGAYGILAYISIWSNLPHRKTDSDEFHVPGFPQNYRFHKTQLHRFLQAADGTDDWSRFLVPQIQLSMKSDGWICNTIEKIEPLGLKLLRNYLQLPVWAVGPLLPPASLMGSKHRSGKETGIALDACMEWLDSKDENSVLYISFGSLHTINASQMMALAEGLEESGKSFIWVIRPPVGFDINGEFSPEWLPKGFEERMRDTKRGLLVHKWGPQLEILSHTSTGAFLSHCGWNSVLESLSYGVPMIGWPIVADQPYNVKMLVEEMGVAVELTRSTETVVSREKVKKTIEIVMDYEGKGKVMKEKANEIAAYIREAKTEKGKEKGSSVRAMDDLVTTILSPKVL

SEQ ID NO: 158017 - protein, 153 aa, Glycine max
  Coding DNA Sequence Number=SeqID_66332
  Gene Ontology: Mol. function=ATPase activity; Cellular component =chromosome; Biological process=chromosome organization and biogenesis
  Homolog annotation: Hit_ID=A5ALP1; Match level="QueryCoverage=74%, HitCoverage=10%, E-value=2e-57, Identity=96%"; Hit description =Putative uncharacterized protein
  Pfam annotation: Domain name=SMC_N; Domain location=22-148; Score= -5.0; E_value=2.6e-11; Accession=PF02463.10; Description=RecFRecNSMC N terminal domain
MSIKRRVKETQEFYCEAENHGMISSYLIAMLIVGANGSGKTNFFHAIRFVLSDLFQNLRGEDRQALLHEGAGHQVLSAFVEIVFDNSDNRIPVDKEEVRLRRTIGFKKDEYFLDGKHITKTEVMNLLESAGFSRSNPYYVVQQGKVLTDGDSA

SEQ ID NO: 158018 - protein, 227 aa, Glycine max
  Coding DNA Sequence Number=SeqID_66333
MAKFDPEIVLEFYANAWPTEEGVRDMRSWVRGQWIPFDANALNQFLGDPLVLEEGQQCEFSQRRKRADGFDEEAIAQLLCTTGQDFARTAVGRRRSQLREVIRPLITRAFIEKYCTPRQAQGDAHQATNALPPPRQADPTGSLGMERYLQHLVHQQAANHRGQVQIHECLYRFSLSQQGQVPPLLHALLRSSLGQRSHGLETSPRPRQGRSLQDSPVRQMNPIWMKR

SEQ ID NO: 158019 - protein, 154 aa, Glycine max
  Coding DNA Sequence Number=SeqID_66334
MAHGGQCLSISVLQLWILYLTEISMRAGNSYLYGFLEPQSIQRFRQSQFEIESYIKSWMQSSKHDVYLGAYLNGEHWQMVVIAPKEHLVVWFCSLHNRPDNYLKGIINSALKGLDDAPQPKSKAPTRWIVIKYFNDPRPLESERLKALRIQWTL

SEQ ID NO: 158020 - protein, 134 aa, Glycine max
  Coding DNA Sequence Number=SeqID_66335
  Subcellular localization annotation: CTP_CleavageSite=31; ConfidenceScore=5.35e-01
MQVSSPGRATPARNGLKRGRGKVSAPKTLPPHSKKQELTGFTDFAALRSPFFAFLIPFCSIIHLQQEMAPKKLSAKRSRRDAAAEGTSATPEFDSHRFRSAEHQQRFEAIKGWSFHRERRAQLRDNEYTDFRKK

SEQ ID NO: 158021 - protein, 188 aa, Glycine max
  Coding DNA Sequence Number=SeqID_66336
MTDLVSAEDDVNLRVSTGLSAAIDEGRRRRHSKKNVYTDNHSGISARQRDSNVSMTDLVSADDDVNLHVSTGLSAAIDKRAQKTTLVSVLSGFSSYRQQKRMFIRIKHSGISARQRDSNVSMTDLVSAEDDVNLRVSTGLSARLTKGAEDDVSLCVLSGFSSYRQQKRMFLRITTRVFPPVSVTQMSV

SEQ ID NO: 158022 - protein, 280 aa, Glycine max
  Coding DNA Sequence Number=SeqID_66337
  Gene Ontology: Mol. function=protein kinase activity; Cellular component=chromatin; Biological process=protein amino acid phosphorylation
  Homolog annotation: Hit_ID=Q2A9E0; Match level="QueryCoverage=91%, HitCoverage=17%, E-value=4e-70, Identity=51%"; Hit description =Putative uncharacterized protein
  Pfam annotation: Domain name=DUF889; Domain location=167-279; Score =2.8; E_value=1.1e-11; Accession=PF05970.5; Description=Eukaryotic protein of unknown function (DUF889)
MTESLLLLFMMLMIYFSISLPINTDEQKTIYHRIIQAINNNEGGMFFLYGFGGTGKTFIWRTLASSLRAENQIVIIVASSGIASLLLPGGRTAHSRFKIPVPIFEDSTCNIHQGTKLAELLNQTSLIIWDEALMAHKFCFEALDQSLRDIITNKSSSNQIFGGKVIVFGGDFRQILPVIPRGTHSDIVNAAINSSYLWDSCEILTLTKNMRLHSNLELVDEQETATFAKWILDIGDGIIDYENDGYATIQVPAHLLITQYDDPINAIVKSTFPDLDQHHN

SEQ ID NO: 158023 - protein, 103 aa, Glycine max
  Coding DNA Sequence Number=SeqID_66338
MLRDGYEPGMGWGQNSDCLTNLVEFAENCGRFGLGYKSMNADKRRISLERKERSLARLQGWGPQVERIPICRINESFVNAGWMHEDQVVVLDEETNQDQSNWV

SEQ ID NO: 158024 - protein, 233 aa, Glycine max
  Coding DNA Sequence Number=SeqID_66339
  Gene Ontology: Mol. function=protein binding; Cellular component =extracellular region; Biological process=defense response to fungus
  Homolog annotation: Hit_ID=Q949G8; Match level="QueryCoverage=70%, HitCoverage=15%, E-value=2e-38, Identity=52%"; Hit description =HcrVf2 protein
  Pfam annotation: Domain name=LRRNT_2; Domain location=27-67; Score =51.1; E_value=3.9e-12; Accession=PF08263.3; Description=Leucine rich repeat N-terminal domain
  Pfam annotation: Domain name=LRR_1; Domain location=116-139; Score =9.3; E_value=5.9; Accession=PF00560.24; Description=Leucine Rich Repeat
  Pfam annotation: Domain name=LRR_1; Domain location=141-163; Score =5.8; E_value=26; Accession=PF00560.24; Description=Leucine Rich Repeat
  Pfam annotation: Domain name=LRR_1; Domain location=165-184; Score =2.8; E_value=92; Accession=PF00560.24; Description=Leucine Rich Repeat
  Pfam module annotation: Pfam domain module=LRRNT_2::LRR_1::LRR_1::LRR_ 1; Domain location=27-67::116-139::141-163::165-184
MNSSMIYILVFVQLWLFRLPCRESVCIPSERETLLKFKNNLNDPSNRLWSWNHNHTNCCHWYGVLCHNVTSHLLQLHLNSSPSTAFYRYYDGYDWEGYRGFQFGGEISPCLADLKHLNYLDLSANDFEGMAIPSFLGTMTSLTHLDLSYTGFIWKIPFQIGNLSNLVYLDLGSDFLEPLFAENLEWVSRVMNSQVRFLVVFETSHFFKILTCLKIHSHLLYPIAYTVFIISSS

SEQ ID NO: 158025 - protein, 69 aa, Glycine max
  Coding DNA Sequence Number=SeqID_66340
MAQEEVPSPDPMPEPSLAPISEYTMPSLPAMELEQPILQNVPAAPVLDLNEDQPQDDQDECIDRILVRV

SEQ ID NO: 158026 - protein, 43 aa, Glycine max
  Coding DNA Sequence Number=SeqID_66341
MMIQKQRAKLVMATARWALKTTFLNEKLYTVPEFQQTLLTTTK

SEQ ID NO: 158027 - protein, 223 aa, Glycine max
  Coding DNA Sequence Number=SeqID_66342
MPPFSKDIPSTIVEQQENDVYANRTNHDEGLWENIRTAMATPPTSSPQSKNPPEVTSKRTRQSTRLRSLTTRCLDGSRPVVNVNPATGQQIFDPTIKYGLDPKTWAEFAKSHKTPNWQGIQKKAQEIKKFNDCPHILSRGGYELLDKKLMEEKSKRRHEEHLFIENPTLNVDPPSPVARHLKWKIAHTKRYGQMTSEVAQEIADKIDSLQEQATQGSFVSHGR

SEQ ID NO: 158028 - protein, 154 aa, Glycine max
  Coding DNA Sequence Number=SeqID_66343
MHHVIVIGKAQPRAIRTEHMHVRATTQRTRRIGRGDIAGVEVLCDALLNNHAAPVMKVIMPVRIGMLRPMNTDIARRQIRTHGHHADVRAIARLIQHLDRAAVHVDALNGQAGKRSAGRPHIKCQPLAVGGPDVDIGQLMMALSKDVTVAGQIT

SEQ ID NO: 158029 - protein, 86 aa, Glycine max
  Coding DNA Sequence Number=SeqID_66344
  Gene Ontology: Mol. function=aminoacyl-tRNA ligase activity
  Homolog annotation: Hit_ID=A9C0R9; Match level="QueryCoverage=93%, HitCoverage=49%, E-value=9e-14, Identity=49%"; Hit description =YbaK/prolyl-tRNA synthetase associated region
  Pfam annotation: Domain name=YbaK; Domain location=3-86; Score=-4.8; E_value=0.00014; Accession=PF04073.6; Description=YbaK  prolyl-tRNA synthetases associated domain
MPDGAAPRYLLAIVPGDCKINFKHAARAIGGKKSTFATPEQAQALTQCVMGAVPPFSFDDRLALRVDARLRDVGTLWFNAGALDRS

SEQ ID NO: 158030 - protein, 191 aa, Glycine max
  Coding DNA Sequence Number=SeqID_66345
  Homolog annotation: Hit_ID=A8G7Y2; Match level="QueryCoverage=70%, HitCoverage=30%, E-value=3e-44, Identity=63%"; Hit description =Transcriptional regulator, GntR family with aminotransferase domain
MAGETQEQESQSSRYRQIAEQIKQAIHSGSLAARQPFAVGAHAGDADEHYAVARPKSGFFVAPRPTEKKVPAVFSEQPREVAPLDEQTELHLAMLGSDCRVRLDLANGDISLYPVKKIGLLMRQMGYSKPALLGNTVKGTGYAPLKAEIARRAAISLALRSHHAAGRYRGGGVAVLLRAATDVAQPQPARH

SEQ ID NO: 158031 - protein, 177 aa, Glycine max
  Coding DNA Sequence Number=SeqID_66346
ADNHKVCPRATRPLGHDSKIETFLRSQPEDAGIFGKGADDHIGADNHKVCPRATGPLGHDSEIEIFLRSRLEDANISGKGVNNHKVCLRATGPLVHNSKIETFSRSRSNDTNISGKDADDHIGADNHKVCLCATGPLGHDSEIETFSWSRPEDADIFGKGADDHIGLCMSKGSLASS

SEQ ID NO: 158032 - protein, 64 aa, Glycine max
  Coding DNA Sequence Number=SeqID_66347
  Homolog annotation: Hit_ID=A6FJQ2; Match level="QueryCoverage=59%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARRWLAQASSARPGRS

SEQ ID NO: 158033 - protein, 46 aa, Glycine max
  Coding DNA Sequence Number=SeqID_66348
MTIQRKHWVQQNQEKITQSVSISHSAGRESRWRTGFWLEIKGRGPL

SEQ ID NO: 158034 - protein, 252 aa, Glycine max
  Coding DNA Sequence Number=SeqID_66349
  Gene Ontology: Mol. function=motor activity; Cellular component=cell projection
  Homolog annotation: Hit_ID=UPI00016621D1; Match level="QueryCoverage =98%, HitCoverage=41%, E-value=2e-12, Identity=27%"; Hit description =UPI00016621D1 related cluster
MSSPSEGYTSATSDDIYVLPMRGLDVLAFGGLHALAFRGLHILAFRELHVLTFRELHILIFRGLYVLPLRGLHVLAISGLHVLAFRGLHVLTFRGLHTLNFRGHIRPPLERTTRLHVLAIRGLHVLAFRGLHVLTFRGLHALIFSGLYVLPLRGLHALAFGGLHAFAFRGLHVLSITGLHILAFRGLHVLTFRGLHALIFKGLYILPLRWLHGLAFVGLHTLTYRGLHVLTIGGLHALAFRGLHALAFRGRH

SEQ ID NO: 158035 - protein, 117 aa, Glycine max
  Coding DNA Sequence Number=SeqID_66350
MMRGDRVRADGPLARHCPCPRQIYAVSNQCSSYYMDWFYMISHSFMSLAQPRDPPRVPSNGFVAIVDKLEKLLNLRILTEGTEAYTVAEECLGITRNYISQSTVGHRSRRRRRTDGL

SEQ ID NO: 158036 - protein, 316 aa, Glycine max
  Coding DNA Sequence Number=SeqID_66351
  Gene Ontology: Mol. function=oxidoreductase activity, acting on NADH or NADPH; Cellular component=chloroplast; Biological process =electron transport
  Homolog annotation: Hit_ID=A4GGF2; Match level="QueryCoverage=100%, HitCoverage=96%, E-value=1e-150, Identity=74%"; Hit description=NADH- plastoquinone oxidoreductase subunit 7
  Pfam annotation: Domain name=Complex1_49kDa; Domain location=110-316; Score=301.6; E_value=1.5e-87; Accession=PF00346.10; Description =Respiratory-chain NADH dehydrogenase,
MGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGSNKLGFIRTHASGFRNTWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 158037 - protein, 34 aa, Glycine max
  Coding DNA Sequence Number=SeqID_66352
MEDMQLFELQEQGGTQEEFVVGSNLLLLSITHFN

SEQ ID NO: 158038 - protein, 269 aa, Glycine max
  Coding DNA Sequence Number=SeqID_66353
MVQELDGHMQGPIMSLALDGHLLISKGEAIVGGNIVDDGPEALHGYVLGDVGLIQDLDLKCPMRLGVHDGVLLRCSITLNSLCWMIRRNSFASSADIFFLLKSSSPLANLAAEIASSRIGFALSLSSMPTFAFPFMSLDRTNGLGAAKIHPLRVILLVPEMLVTLAEDRFLRGVPPWDRLGTLVRGKGRLLTQDRLEASGLLGGSISGEVDHQWFRLARAFVSQLHAQMLLPLASTTNFKPTLIHYPLQQILCHRAYLYIGRRPWVYQA

SEQ ID NO: 158039 - protein, 35 aa, Glycine max
  Coding DNA Sequence Number=SeqID_66354
MSTSSRRLGDSSPESYSLHPAAVIQLPQTMFVIIT

SEQ ID NO: 158040 - protein, 93 aa, Glycine max
  Coding DNA Sequence Number=SeqID_66355
MVLESILNPSLGHLHLAHSRLKVLGVSPPNLSQKNDDLGLIHCWLIVKFEYHVGNPILSILTVGDCKNMSELREIPFAPCSFLFSRRNPKRSQ

SEQ ID NO: 158041 - protein, 44 aa, Glycine max
  Coding DNA Sequence Number=SeqID_66356
MVKARQNGVQKGKRGRWLPPSSPGLLPPEGTAFCWNTLEGPSGL

SEQ ID NO: 158042 - protein, 93 aa, Glycine max
  Coding DNA Sequence Number=SeqID_66357
  Subcellular localization annotation: CTP_CleavageSite=42; ConfidenceScore=5.10e-01
MIQMILHLQSCHTPLNAPQFSNLFVFCPLHIFTNHCVNFNIYSSQATSSADIQCSFLEQKILKQLRECLQSYRLTQPRQTPVLIHQQLQARCM

SEQ ID NO: 158043 - protein, 38 aa, Glycine max
  Coding DNA Sequence Number=SeqID_66358
MTMITNSSSVPPRALDRRLQEDWVKDAREGPRILMSLR

SEQ ID NO: 158044 - protein, 108 aa, Glycine max
  Coding DNA Sequence Number=SeqID_66359
MVSKVWSFDGGFNGEEEEGNSNSLAFLCTRRGPFSKDVTEVSSSEEDFEEDPEELPPEPAVDALDFLEDDEDPLPDVDSPEDVMSASGANSTEESGPGGTANSDDSSS

SEQ ID NO: 158045 - protein, 392 aa, Glycine max
  Coding DNA Sequence Number=SeqID_66360
  Gene Ontology: Mol. function=alkaline phosphatase activity; Cellular component=periplasmic space; Biological process=metabolic process
  Homolog annotation: Hit_ID=A6T5A8; Match level="QueryCoverage=73%, HitCoverage=60%, E-value=1e-144, Identity=89%"; Hit description =Alkaline phosphatase
  Pfam annotation: Domain name=Alk_phosphatase; Domain location=151 -391; Score=199.9; E_value=6.2e-57; Accession=PF00245.11; Description= Alkaline phosphatase
MKNLIAELLVNLAQKEEEAKELTVQVEALEIVVTALLRHMAEDAQQRLIQDIETAMEQVKPGPLVDDRDTQLLQQYIKKLLRHPHDKVKLSALFIALLPLLAPPVIHAQTTSSPVLENRAAQGDITTPGGARRLTGDQTEALRASLINKPAKNIILLIGDGMGDSEITAARNYAEGAGGFFKGIDALPLTGQYTHYSLDKKTGKPDYVTDSAASATAWTTGVKSYNGALGVDIHEKDHQTILELAKAAGLATGNVSTAELQDATPAAQVAHVTSRKCYGPSVTSEKCASNALEKGGKGSITEQLLNARPDVSLGGGAKTFAETATAGEWQGKTLHEQAVARGYQIVTDAASLAAISEANQGKPLLGLFSDGNMPVRWEGPKASYHGNIDKPP

SEQ ID NO: 158046 - protein, 128 aa, Glycine max
  Coding DNA Sequence Number=SeqID_66361
  Subcellular localization annotation: CTP_CleavageSite=39; ConfidenceScore=5.84e-01
MGSPPASTTPPPPSPSSPPRPLPTSDASASTSAVKRTRKASRLRSLSTRPPGVERPVVHVDPATGKADGPHRKKLRTYLGIVARDKVEITYENWKEVPTAQKDLIWEDIQAEFDIPEASDSRTKRKLI

SEQ ID NO: 158047 - protein, 70 aa, Glycine max
  Coding DNA Sequence Number=SeqID_66362
  Subcellular localization annotation: CTP_CleavageSite=53; ConfidenceScore=5.18e-01
MIRPLDELISYKGGPLGTRPHLQRTTRPHLQRAARPRLQRAMRPRLQRTTCPRLQRAACPHLQRVACPRL

SEQ ID NO: 158048 - protein, 1047 aa, Glycine max
  Coding DNA Sequence Number=SeqID_66363
  Gene Ontology: Mol. function=protein binding; Cellular component =nucleus; Biological process=regulation of transcription, DNA -dependent
  Homolog annotation: Hit_ID=A7Q2L0; Match level="QueryCoverage=97%, HitCoverage=68%, E-value=0.0, Identity=64%"; Hit description =Chromosome chr1 scaffold_46, whole genome shotgun sequence
  Pfam annotation: Domain name=HDAC_interact; Domain location=98-198; Score=222.0; E_value=1.4e-63; Accession=PF08295.3; Description =Histone deacetylase (HDAC) interactin
SYDADGGFLAGVMNKKSLWNDGHGLKQIKVDDGDRDRDRDRDRDRYRDDGMKERDREFRERDKSTVIANKDVLGSKMSLYPSKEKYLSKPINELDLSNCDQCTPSYRLLPKNYPIPVASQKTELGAGVLNDHWVSVTSGSEDYSFKHMRKNQYEESLFRCEDDRFELDMLLESVNVTTKRVEELLDKINSNIIKGDSLIRIEEHLTAINLRCIERLYGDHGLDVMEVLRKNAPLALPVILTRLKQKQEEWARCRADFSKVWGEIYAKNYHKSLDHRSFYFKQQDTKSLSTKELSIARYSAVALWLWHNFDEWLKTPVYLHNTASFKRCRIVAMGHSKPIMLLLAVVPGVAQIMAILTAICGISKTTLLAEIKEISEKKRKEDDVLLAIAAGNRRPILPNLEFKYSDPDIHEDLYQLIKYSSGEICTTEHVDKVMKGAEDTEDVVKAKNNHVKNGTATVAESDCSPVVGAIIMNPKHINVSRNGDDCMPLDQSTSNKAWQSNGGHGKMNRIAFTPDGPSGFNNKQDQSSERLVNANVSPASGMEQSNGRTNIDNLSECMELIHFFVQGLTATPTRPGNASVEGGLDIPSSEGGDSTRLGTSTNGAITGGTKVHRYQEESVRAFKSEREEGELSPNGDFEEDNSEVYGGNGLDAVHKGKDGGVSRQYQNRHGEEVCGETRGENDADADDEGEESPHRSSEDSENASENVDVSGSESADAEECSREEHEDGEHDNKAESEGEAEGIADAHDVEGDGMPLPYSERFLLTVKPLAKHVPPMLHEKDMNSRVFYGNDSIYVLLRLHQTLYERIQSAKINSSSADRKWKASSDTSSTDQYDRFMNALYSLLDGSSDNTKFEDDCRAIIGIQSYVLFTLDKLIYKLVKQLQAVAADEMDTKLLQLYAYEKSRKPGKFVDMVYHENARVLLHDENIYRIEYSPGPMKLSIQLMDSGHDKPEVTAVSMDPNFSTYLHNDFLSVVPDKKEKSGIFLKRNKRRYAGNDEFSSQAMEGLQIINGLECKIACSSSKPKWLILLISLIPAFEYSMMPVRLCF

SEQ ID NO: 158049 - protein, 125 aa, Glycine max
  Coding DNA Sequence Number=SeqID_66364
  Gene Ontology: Cellular component=nucleus; Biological process =regulation of transcription, DNA-dependent
  Homolog annotation: Hit_ID=A7Q2L0; Match level="QueryCoverage=60%, HitCoverage=5%, E-value=3e-28, Identity=85%"; Hit description =Chromosome chr1 scaffold_46, whole genome shotgun sequence
  Subcellular localization annotation: CTP_CleavageSite=42; ConfidenceScore=5.17e-01
MRISLAILFSVVSGFGSSEGLGFALRVDSSRLDLNCARCSCSCSNEKPEMKRSRDEVFTSCSQLKRPVVSSRGEASGQPQIMNGGAQKLTTNDALAYLKAVKDIFQDKRDKYDDFLEVMKDFKAQ

SEQ ID NO: 158050 - protein, 605 aa, Glycine max
  Coding DNA Sequence Number=SeqID_66365
  Homolog annotation: Hit_ID=A9PF52; Match level="QueryCoverage=86%, HitCoverage=85%, E-value=1e-171, Identity=55%"; Hit description =Putative uncharacterized protein
  Pfam annotation: Domain name=DUF23; Domain location=316-575; Score =180.2; E_value=5.3e-51; Accession=PF01697.18; Description=Domain of unknown function
  Subcellular localization annotation: CTP_CleavageSite=12; ConfidenceScore=5.07e-01
MDPELQRRKRKRVVAARHLHISSSRSLFLCFSFLIFLLFWYSHHHFFFFTPSTFRPSLTASTLSLLYSSASNSVLDPFQPTAPSYSLQHRILFPDHHLLIITNPQQQKLHELECVYYTLHPNASSSGSPEPVFQVHVRPVLSTDRYDESRSIVRCPLTQTNSSAGDASKAVDMRRRGEVGHRNLGVLMNQTAQSWDRVAYEATLDGDTVVVFVKGLNLRPHKISDPTRIRCHFGLKSFDKDNAFLLTTRAVSVAQEVVRCMLPQSMRNNPDKARGIRVTVSYLGGNVRHPVRVLVRSVSRVSSPGGGGKVQKRNRKKYELCACTMVWNQASALREWVMYHAWLGVERWFIYDNNSDDDIEKVVQDLDLQGFNVSRKSWPWIKTQEAGFSHCALRAREECKWVGFFDVDEFFYFPSEFRQPLGEGVPGENYLRSVVANFSSSKFIGEIRTACHSFGPSGLKSPPKQGVTLGYTCRLQSPERHKSIVRPDLLDISLLNVVHHFQLKEGFRYHNMPEGTAIVNHYKYQVWETFKAKFFRRVATYVVDWQEDQNKGSKDRAPGLGTEAIEPPNWRQQFCEVWDTGLKNFLVSYFTDPATGLMPWERSSQ

SEQ ID NO: 158051 - protein, 603 aa, Glycine max
  Coding DNA Sequence Number=SeqID_66366
  Gene Ontology: Mol. function=nucleotide binding; Cellular component =intrinsic to membrane; Biological process=defense response
  Homolog annotation: Hit_ID=Q7XBQ9; Match level="QueryCoverage=96%, HitCoverage=61%, E-value=1e-109, Identity=41%"; Hit description =Disease resistance protein RGA2
  Pfam annotation: Domain name=LRR_1; Domain location=305-326; Score =9.7; E_value=4.9; Accession=PF00560.24; Description=Leucine Rich Repeat
  Pfam annotation: Domain name=LRR_1; Domain location=328-350; Score =12.9; E_value=1.2; Accession=PF00560.24; Description=Leucine Rich Repeat
  Pfam annotation: Domain name=LRR_1; Domain location=352-374; Score =12.0; E_value=1.9; Accession=PF00560.24; Description=Leucine Rich Repeat
  Pfam annotation: Domain name=LRR_1; Domain location=484-505; Score =4.6; E_value=43; Accession=PF00560.24; Description=Leucine Rich Repeat
  Pfam annotation: Domain name=LRR_1; Domain location=507-529; Score =7.2; E_value=14; Accession=PF00560.24; Description=Leucine Rich Repeat
  Pfam annotation: Domain name=LRR_1; Domain location=531-553; Score =10.6; E_value=3.3; Accession=PF00560.24; Description=Leucine Rich Repeat
  Pfam annotation: Domain name=LRR_1; Domain location=555-577; Score =7.2; E_value=14; Accession=PF00560.24; Description=Leucine Rich Repeat
  Pfam annotation: Domain name=LRR_1; Domain location=578-600; Score =0.8; E_value=2.2e+02; Accession=PF00560.24; Description=Leucine Rich Repeat
  Pfam annotation: Domain name=NB-ARC; Domain location=1-174; Score= -41.1; E_value=1.2e-07; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::NB-ARC; Domain location=305-326::328 -350::352-374::484-505::507-529::531-553::555-577::578-600::1-174
MISQIIGKKFERVLAFGANGASILVTTRLPKVATIMGTMPPHELSMLSEDEGWELFKHQVFGPNEEEQVELVVAGKEIVKKCGGVPLAIKALGGILRFKRKENEWLHVKESNLWNLPHNENSIMPVLRLSYLNLPIKLRQCFAHLAIFPKHEIIIKQYLIECWMANGFISSNEILDAEDVGDGVWNELYWRSFFQDIKTDEFGKVRSFKMHDLVHDLAQSVAKDVCCITKDNSATTFLERIHHLSDHTKEAINPIQLHKVKYLRTYINWYNTSQFCSHILKCHSLRVLWLGQREELSSSIGDLKHLRYLNLCGGHFVTLPESLCRLWNLQILKLDHCYHLQKLPNNLIQLKALQQLSLNNCWKLSSLPPWIGKLTSLRNLSTYYIGKEKGFLLEELRPLKLKGGLHIKHMGKVKSVLDAKEANMSSKQLNRLSLSWDRNEESELQENMEEILEALQPDTQQLQSLTVLGYKGAYFPQWMSSSPSLKKLVIVRCCKLNVLASFQCQTCLDHLTIHDCREVEGLHEAFQHLTALKELELSDLPNLESLPNCFENLPLLRKLTIVNCPKLTCLPSSLNLSSLERLTIDACPELKKLTFPILDHDDE

SEQ ID NO: 158052 - protein, 180 aa, Glycine max
  Coding DNA Sequence Number=SeqID_66367
  Gene Ontology: Biological process=regulation of transcription
  Homolog annotation: Hit_ID=A7PXM0; Match level="QueryCoverage=44%, HitCoverage=16%, E-value=1e-29, Identity=82%"; Hit description =Chromosome chr12 scaffold_36, whole genome shotgun sequence
MGHVYIEKLLLHCASALESNDVTLAQQVVWVLNNVASPVGDTNQRLTSWFLRALISRASRICPTAMSFKGSNTIQRRLMCATELAGNVKSRSAAPSIPTSSAARPEGEVDTSKKRRRRASKSEFIDVNENQVSVSSGLAPIVQSAYESGVGGGLVPLWHGNTAVSGPFFMFSNASNPVLP

SEQ ID NO: 158053 - protein, 148 aa, Glycine max
  Coding DNA Sequence Number=SeqID_66368
MKEQQMGMASCSHRGLSEKRLPGLLIAVSDFTGGSPQPGGSSKELLWSPEEANAREERKGHVVNEANAKALAKVLKFHGNIKMLKLGWCQLFMVLPGGVDSAVSPCFVASSPDSMGRVASPTSGLVADVVLWMNWRGAVAVLVYATAL

SEQ ID NO: 158054 - protein, 241 aa, Glycine max
  Coding DNA Sequence Number=SeqID_66369
MLKGEGFYMEEAIVVNKILDEYVLAYGQLINLEKSKIAYSKNVGGAVRNLITSFLGVRDGMGSGKEYNACVITPMMDVGQDMKVSSIIDPINHCWDINTISHILSPQDVQVIVRTPLLPMVEGDSRIRALNQNVSKHFSTAANIYGVMEYVETKERSEPSHYSMVQHSQVLHWIPPEPGCVRDERGRQMMARAETKMPCMDAQLGEAWGLLEVINFMQAKGGSRQFEEFDKDESDIGSVIQ

SEQ ID NO: 158055 - protein, 93 aa, Glycine max
  Coding DNA Sequence Number=SeqID_66370
  Subcellular localization annotation: CTP_CleavageSite=58; ConfidenceScore=5.60e-01
MTLALLPITTIIKTNRPPPSSNTKHHPSNLVESGSTTRVAHAHCDRMRRSNKRRRRAKSPMEKSLSLGEERIWWMRFWRGLKEKESRKKKEKI

SEQ ID NO: 158056 - protein, 434 aa, Glycine max
  Coding DNA Sequence Number=SeqID_66371
  Gene Ontology: Mol. function=metalloendopeptidase activity; Cellular component=proteinaceous extracellular matrix; Biological process =metabolic process
  Homolog annotation: Hit_ID=Q93Z89; Match level="QueryCoverage=56%, HitCoverage=69%, E-value=1e-104, Identity=76%"; Hit description =Matrix metalloproteinase MMP2
  Pfam annotation: Domain name=PG_binding_1; Domain location=184-246; Score=34.0; E_value=5.4e-07; Accession=PF01471.9; Description =Putative peptidoglycan binding domain
  Pfam annotation: Domain name=Peptidase_M10; Domain location=271-431; Score=49.2; E_value=1.4e-11; Accession=PF00413.15; Description =Matrixin
  Pfam module annotation: Pfam domain module=PG_binding_1::Peptidase _M10; Domain location=184-246::271-431
QPASHAGDPCVSQIAITICDLATDALCFTAALPWQELGSAIGTRHATSDLLSDTKLAIANGSLGPAWHTVHMGKFAALVMPAKLMRQSDKERGKLKSKDIKKLPSVEYLKKIHEGVKDLSQDLFIPKIPFLNPKNPKLPRIPLFKSPPPPMYRLQLKSDPPPPMYRLQPKSPPPLPNAPPKQINIKGLSVVKDYLSDYGYIESSGPFNDSFDQEIISAIKTYQKFSNLQVTGGLNKQLIQQMLSIRCGVPDVNFDYNFTDDNISYPKAGHRWFPNRNLTYGFLPENQIPDNMTKVFRDSFARWAQASGTLSLTETTYDNADIQVGFYNFTNSRIEVYGGSLIFLQPDSSKKGVVLLNGNMGWLLPSENATLSKDDGVLDLETAAMHQIGHLLGLDHSHKEDSVMYPYILSSQQRKVQLSNSDKANIHLQFAKHD

SEQ ID NO: 158057 - protein, 297 aa, Glycine max
  Coding DNA Sequence Number=SeqID_66372
  Homolog annotation: Hit_ID=A7Q2N2; Match level="QueryCoverage=85%, HitCoverage=68%, E-value=1e-103, Identity=65%"; Hit description =Chromosome chr1 scaffold_46, whole genome shotgun sequence
MDFTNPSLLLSIFLLLLPSLISSQICQRNCGKETLKYPFGSGPGCGDPRFQPHVTCSNQKLTFTTHTGSYPITSIDYTNQIIHISDPTMSTCSCTVPSKGFGLNWDAPFTFADSTIFALVDCSMNSSSICQSNGYDDGSNSNSKLLCDQETPICSLLYSCRPISTTINLPISTCCVYTPVNLGPAFEMDLQKLQCPSYTGFYNFNDQEMDPEKWNYGIALKYKFSVTNDYPGSCDACERSHGVCGYGGTYNSFICNCPNGINTTADCFFISSYNNGFRNGVAWLIYPVACSLVWFFL

SEQ ID NO: 158058 - protein, 61 aa, Glycine max
  Coding DNA Sequence Number=SeqID_66373
METDLSLGWVAHIWWVRGRFRRVYIRKGRLKHRPRSRHDASSSGDKRLRPGAGRRGGGGGS

SEQ ID NO: 158059 - protein, 117 aa, Glycine max
  Coding DNA Sequence Number=SeqID_66374
MENVINRQSRPATFSPTIPLLRKAHFDASEETNKLWLKAKTKGFCYSLTDWMQNPIVCLGCRNYEKAPTLQERLEFCSVIIDVNDWFVETSGAGCYVDGVWKGYVLVTYGLFWNSKQ

SEQ ID NO: 158060 - protein, 144 aa, Glycine max
  Coding DNA Sequence Number=SeqID_66375
MSNRKYKSSYEKLKKKQKVEKLIESQRGALDKFVIIHKNDVEASSIGENVIEQPLIDHTNNEENVIEQPSMDNTDNGVEQPPKDDTDNGKNLIEQPLINNTHNTNNYNFNQELEDNILEIGVEGNVEHNNTSSEVPTNIYDLRL

SEQ ID NO: 158061 - protein, 371 aa, Glycine max
  Coding DNA Sequence Number=SeqID_66376
  Gene Ontology: Mol. function=hydrolase activity, hydrolyzing O -glycosyl compounds; Cellular component=cAMP-dependent protein kinase complex; Biological process=carbohydrate metabolic process
  Homolog annotation: Hit_ID=A7Q2Q6; Match level="QueryCoverage=94%, HitCoverage=66%, E-value=2e-68, Identity=45%"; Hit description =Chromosome chr1 scaffold_46, whole genome shotgun sequence
MDELDVTSSDKQYPGCYFLVCRGIEAGKSGIEGILSRLEKQRNRSFGLDLDNVSFENNEDKDEWDPRTTTDTMAAGLENGSRASSSSSTSSHLSGSQIKHDPHGSQLGTENLRNSLKPETWRSWIIQRTGFLDTDFEDAEIVPNETEKGGMSDASRQPDILNRRELSSEHINRETGLYSLDGNANHSDIKSRIQNLESELSSILHLLRSSSDKITMQMVQKSSSDDLAKLSDAWEFQENEIMNAQDRLRSIRAKLSVLEGKMALAIMDAHKVVEEKQKKINNAQKALQILKTTCVVWPNSASEVLLTGSFDGWSTKRKMERLSSGIFSLNLQLYPGRYEMKFIVDGEWKIDPLRPVVTSNGYENNLLIIYD

SEQ ID NO: 158062 - protein, 67 aa, Glycine max
  Coding DNA Sequence Number=SeqID_66377
  Gene Ontology: Mol. function=oxidoreductase activity; Cellular component=anchored to membrane
  Homolog annotation: Hit_ID=A7QYZ0; Match level="QueryCoverage=64%, HitCoverage=14%, E-value=1e-17, Identity=88%"; Hit description =Chromosome undetermined scaffold_259, whole genome shotgun sequence
MATTVQSYHMDGYAFFVVGMDFGVWAENSRSTYNKWDGMARCTTQEIMRQLCWNEPFSYITRKGTYD

SEQ ID NO: 158063 - protein, 435 aa, Glycine max
  Coding DNA Sequence Number=SeqID_66378
  Gene Ontology: Mol. function=metalloendopeptidase activity; Cellular component=proteinaceous extracellular matrix; Biological process =metabolic process
  Homolog annotation: Hit_ID=A7Q2J9; Match level="QueryCoverage=75%, HitCoverage=88%, E-value=1e-112, Identity=61%"; Hit description =Chromosome chr1 scaffold_46, whole genome shotgun sequence
  Pfam annotation: Domain name=PG_binding_1; Domain location=66-132; Score=53.7; E_value=6.2e-13; Accession=PF01471.9; Description =Putative peptidoglycan binding domain
  Pfam annotation: Domain name=Peptidase_M10; Domain location=172-332; Score=271.0; E_value=2.4e-78; Accession=PF00413.15; Description =Matrixin
  Pfam module annotation: Pfam domain module=PG_binding_1::Peptidase _M10; Domain location=66-132::172-332
  Subcellular localization annotation: CTP_CleavageSite=60; ConfidenceScore=5.70e-01
MSTSQQRYLLFAFTTLIVVFSFNTSPVSARLFPNVSSIPTWNSSHAPPGGAWNAYRNFTGCRPGKTYNGLSNLKNYFQYFGYISKALSKSSNFTDDFDDALEAAIKAYQKNFNLNITGELDDPTMNQIVKPRCGVADIINGTTTMNSGKSNTTDSPKFHSVAHYSFFDGQPRWPEGTQELTYAFDPDNALDDVSKTVFGNAFSRWSEVTTISFRETSSYAAADIRIGFYGGDHGDGEPFDGVLGTLAHAFSPTNGRFHLDSAEDWVASGDVTKASLSNAVDLESVAVHEIGHLLGLGHSSVEDAIMYPTITARTRKVELNEDDILGIQVLYGSNPNFTGTPATSSRQSDTSDGGVRHVGVTGAVLFTFLLFFFVFGLHPSNANVASFAQDAPTDSECGPATLGGVCNIYPVDTTHVSGAWWHCFHLDGAGSRDLV

SEQ ID NO: 158064 - protein, 334 aa, Glycine max
  Coding DNA Sequence Number=SeqID_66379
  Gene Ontology: Mol. function=metalloendopeptidase activity; Cellular component=proteinaceous extracellular matrix; Biological process =metabolic process
  Homolog annotation: Hit_ID=P29136; Match level="QueryCoverage=58%, HitCoverage=74%, E-value=2e-62, Identity=56%"; Hit description =Metalloendoproteinase 1 precursor
  Pfam annotation: Domain name=PG_binding_1; Domain location=22-79; Score=30.2; E_value=7.5e-06; Accession=PF01471.9; Description =Putative peptidoglycan binding domain
  Pfam annotation: Domain name=Peptidase_M10; Domain location=113-234; Score=105.4; E_value=1.7e-28; Accession=PF00413.15; Description =Matrixin
  Pfam module annotation: Pfam domain module=PG_binding_1::Peptidase _M10; Domain location=22-79::113-234
MAHGMNSLLTPVATTTKAYPTSKTTSTILATSLTLMHHLLDDKFDDTLVSAIKTFQKNYNLDITGKLDNNTLRQLTTPRCGVPDIINTNTTTQHTQLHIHTVSHYSFFNGAPRWPAGTRQLTYAFSPELNLNCAAKSLFARAFNSGDHNDGLPFDGPLGEWAHAFAPTNGWCHFDADEYWVASGDVTQSPVARAVDLESIAVHEIGHLLGLHHSSDQRAIMYAYLPPRTRKVAGGLQFEILLVGLDGCYCFLVKRNVEWRRGLKGKLLFDIVHVILPYSLLERLAPFCPSHFGSGRRMETEIRQKGLVDKEKECIRYGFMLTAISFSLSELEST

SEQ ID NO: 158065 - protein, 402 aa, Glycine max
  Coding DNA Sequence Number=SeqID_66380
  Gene Ontology: Mol. function=transferase activity, transferring hexosyl groups; Cellular component=integral to membrane; Biological process=carbohydrate biosynthetic process
  Homolog annotation: Hit_ID=A7Q2K7; Match level="QueryCoverage=87%, HitCoverage=92%, E-value=1e-150, Identity=71%"; Hit description =Chromosome chr1 scaffold_46, whole genome shotgun sequence
  Pfam annotation: Domain name=Glyco_transf_8; Domain location=96-358; Score=328.2; E_value=1.5e-95; Accession=PF01501.11; Description =Glycosyl transferase family 8
  Subcellular localization annotation: CTP_CleavageSite=29; ConfidenceScore=5.16e-01
TQQQQHPFCFLPPRTDFATDPFLQMLLLRQSAVVSSLILCFFFPPLLCLGIRSFPTTADDGAFFHYTEAPEYRNGAGCPVSSTRNFLPSCDPSLVHIAMTLDSGYLRGSIAAVHSVLRHSSCPENVFFHFIAAEFDPASPRVLTRLVRSIFPSLNFKVYIFREDTVINLISSSIRQALENPLNYARNYLGDMLDTCVSRVIYLDSDVVVVDDVGKLWRAAITHGRVIAAPEYCHANFTKYFTDEFWNDPLLSRVFNTREPCYFNTGVMVMDLAKWREGNYKRKIENWMELQRKKRIYELGSLPPFLLVFGGNVEAIDHRWNQHGLGGDNVNGVCRSLHPGPVSLLHWSGKGKPWVRLDEKKPCPLDRLWEPYDLYKQVKDSVRDQNWGFSSSILVGYAHDLL

SEQ ID NO: 158066 - protein, 89 aa, Glycine max
  Coding DNA Sequence Number=SeqID_66381
MVSMNEGEKRIDEEKQQLVTEQKIDPVVEPLSETEEEVEAEGDTNNSLGSSSLMDSFASWKMNGRRMEKEEREETPLQGEDESRKSSPP

SEQ ID NO: 158067 - protein, 137 aa, Glycine max
  Coding DNA Sequence Number=SeqID_66382
MAHLELSIHGAAQQSSRTVLLFKVENRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 158068 - protein, 236 aa, Glycine max
  Coding DNA Sequence Number=SeqID_66383
  Gene Ontology: Mol. function=motor activity; Cellular component=cell projection
  Homolog annotation: Hit_ID=UPI00006A2D9E; Match level="QueryCoverage =68%, HitCoverage=85%, E-value=2e-17, Identity=17%"; Hit description =UPI00006A2D9E related cluster
GYTPSPSEGYTSSPLEGYTCSPSEDYTSSPSEGYTSSPSEGHTPSPLEDYMSSPLEDYTSSPIEDYTSSPSEGCTPSPSDDYTGLHALVFRGLHVLAFRGLHTLTFRGLHVLTIRGLHILAFRGLHILAFRERHVLAFGGLHVLIFRGLHVLTLRGLHALAFRGLHTLAFRGLHALAFVGLHARAFRGLHVLAFRGLHIIAFKGLHALAFRGMHALAFRGLHAFAFSGLHVLAFKG

SEQ ID NO: 158069 - protein, 251 aa, Glycine max
  Coding DNA Sequence Number=SeqID_66384
  Gene Ontology: Mol. function=ribonuclease activity; Cellular component=integral to membrane; Biological process=tRNA processing
  Homolog annotation: Hit_ID=A7MQD5; Match level="QueryCoverage=99%, HitCoverage=85%, E-value=6e-85, Identity=63%"; Hit description=tRNA -processing ribonuclease BN
  Pfam annotation: Domain name=Ribonuclease_BN; Domain location=1-247; Score=237.7; E_value=2.6e-68; Accession=PF03631.6; Description =Ribonuclease BN-like family
  Subcellular localization annotation: CTP_CleavageSite=68; ConfidenceScore=5.00e-01
MTTQAGNLAYVSLLALVPLIAVVFALFAAFPVFSDISVQLKNFIFTNFMPAAGDVIQRYLDQFVANVNKMTAVGAVGLIVTALLLMHSVDSALNAIWRSDKPRPMVYSFAVYWMILTLGPLLAGASLAISSYLLSLRWVNVTGVTSLIDQALRIFPLVLSILAFWLLYSIVPTRRVPGRDALIGAVVAGLLFELGKKGFALYVTMFPSYQLIYGVLAVIPILFLWVYWTWCIVLLGAEVTVTLDDYRQLNS

SEQ ID NO: 158070 - protein, 452 aa, Glycine max
  Coding DNA Sequence Number=SeqID_66385
  Gene Ontology: Mol. function=glutamate-ammonia ligase activity; Cellular component=cytoplasm; Biological process=nitrogen compound metabolic process
  Homolog annotation: Hit_ID=Q6DB71; Match level="QueryCoverage=100%, HitCoverage=100%, E-value=0.0, Identity=87%"; Hit description =Glutamine synthetase
  Pfam annotation: Domain name=Gln-synt_C; Domain location=85-366; Score=577.5; E_value=1.3e-170; Accession=PF00120.15; Description =Glutamine synthetase, catalytic domain
  Pfam annotation: Domain name=Gln-synt_N; Domain location=14-87; Score= 93.6; E_value=6.2e-25; Accession=PF03951.10; Description=Glutamine synthetase, beta-Grasp domain
  Pfam module annotation: Pfam domain module=Gln-synt_C::Gln-synt_N; Domain location=85-366::14-87
MSAEHVLSMMNEHEVKFVDLRFTDTKGKEQHVTIPAHQVNADFFEEGKMFDGSSIGGWKGINESDMIQRSSSAVTFSSQARCRATIATRSIAKRAEEFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGVNLFSGDKYGGLSETALFYIGGIIKHAKAINALANPTTNSYKRLVPGYEAPVMLAYSARNRSASIRIPVVASPKARRIEARFPDPAANPYLAFTALLMAGLDGVINKIHPGDAMDKNLYDLPPEEEAEIPKVAGSLEEALNALNEDREFLTRGGVFTDDAIDAYIELRKADNDRVRMTPHPVEFELYYSV

SEQ ID NO: 158071 - protein, 127 aa, Glycine max
  Coding DNA Sequence Number=SeqID_66386
MTRGNPSDLQPFDPEIDRTFHRLVRHHFTPFDHYEHSITGESVHSVIGDFEHPDLEHYNFEHSDSEHSDFAHSENMAQPPPRERTLREMAALDFTYESLCIQYPDEDVPYVLKTGLIHLLPKFHGLA

SEQ ID NO: 158072 - protein, 145 aa, Glycine max
  Coding DNA Sequence Number=SeqID_66387
GEVAETLQYMVSPQGRNTWIVDNLMPYVENITILSEEQERITEPMTHGPASEPEDFSQQMEQRGHGIYYTPPTFSQYPSQMYQYPFEGHDTDMSTSEHSFGGVVETHPHFSWLTMTPSQQHDAPMATPNAPLALQWNVPEAIPDM

SEQ ID NO: 158073 - protein, 327 aa, Glycine max
  Coding DNA Sequence Number=SeqID_66388
  Gene Ontology: Mol. function=nucleoside-triphosphatase activity; Cellular component=chloroplast
  Homolog annotation: Hit_ID=Q2PMM5; Match level="QueryCoverage=98%, HitCoverage=18%, E-value=1e-77, Identity=80%"; Hit description =Protein ycf2
  Pfam annotation: Domain name=AAA; Domain location=77-274; Score= -35.6; E_value=0.027; Accession=PF00004.20; Description=ATPase family associated with various cellular activities (AAA)
MIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLLVAGWNLESNLLFVSRVYSELQTEFEKVKSLMIPSYMIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSKQSIP

SEQ ID NO: 158074 - protein, 97 aa, Glycine max
  Coding DNA Sequence Number=SeqID_66389
MHTETGPGGCSQAADAPPPHQAGPAGSFDTEYLQSQGFTSFLCPTPDQFRAEVAWPGDWPEARAGEAPAEAPDEADEAREDEEMADLLDFLGGSGAT

SEQ ID NO: 158075 - protein, 62 aa, Glycine max
  Coding DNA Sequence Number=SeqID_66390
MRVHWCVFQERKMREVTTNVYLRKTSEKPERCGLRTLIVKGSRVVFMHGEGVSLAPTYPQLR

SEQ ID NO: 158076 - protein, 94 aa, Glycine max
  Coding DNA Sequence Number=SeqID_66391
MGAKYLEMVKQRLQAIKQWSPDEIRAINSWGSELDGGGCMNGNQFMGLRIRFDGGGCMNGNQFMGLRIIFDGGGCTNNARQSIRGAPDLMVEDA

SEQ ID NO: 158077 - protein, 60 aa, Glycine max
  Coding DNA Sequence Number=SeqID_66392
PFAKRKPRAKRIFGHALSRESQVLSAQPLHLRLIRSAKLAKAKLSLIEFDLNSAKRQPSR

SEQ ID NO: 158078 - protein, 57 aa, Glycine max
  Coding DNA Sequence Number=SeqID_66393
MVACQSELRLSHEATSSPKRAGYLTWKSFGAPGEPEASLGELGARKLNEKTLSPFLL

SEQ ID NO: 158079 - protein, 224 aa, Glycine max
  Coding DNA Sequence Number=SeqID_66394
  Homolog annotation: Hit_ID=A5ASR8; Match level="QueryCoverage=75%, HitCoverage=34%, E-value=4e-07, Identity=26%"; Hit description =Putative uncharacterized protein
  Subcellular localization annotation: CTP_CleavageSite=41; ConfidenceScore=5.32e-01
MAESSKKRKGSSSTTAPAGHRHHGPSEAPTTPIYPSLSSPRSSTLFSSDDQCLRYLSQFSSRIILDPKYLDIDFFNDETFDCYQVFQNSDLVDFMYLKFPYYPELVKVFYCNLKIQDGIISSEVHGISMIIDQSLFFSLTKLPSQGAPFEGTIVDDWKFDYSSHDARRMVCNDQAEMTGRLLAGSLTFDNRIMHYIIVGILLPRSSNSAQASEEDLILIWAFLT

SEQ ID NO: 158080 - protein, 23 aa, Glycine max
  Coding DNA Sequence Number=SeqID_66395
MRPPPSGAVPPKKEEGETGVVID

SEQ ID NO: 158081 - protein, 242 aa, Glycine max
  Coding DNA Sequence Number=SeqID_66396
  Gene Ontology: Mol. function=phosphoprotein phosphatase activity
  Homolog annotation: Hit_ID=A2Q4S5; Match level="QueryCoverage=79%, HitCoverage=33%, E-value=4e-22, Identity=33%"; Hit description=IMP dehydrogenase/GMP reductase, putative
  Pfam annotation: Domain name=DUF1723; Domain location=111-160; Score =57.7; E_value=3.9e-14; Accession=PF08330.1; Description=Protein of unknown function (DUF1723)
MTENVPHMTEDVPHMAEDAPKMTADVQADDGAEGSHADDAEGFPSGPCDPSVLTSFADHVAHAIWSEHERPELKLVLHRRKVTLIGRPVPEIEGLVAATGLSPLIGCSVVIDDPRLISAFVERWHRETNTFHLPVGELTITLDDVSSLLHLLISGAFHSFHALSVDEAIFFLTELLEVSAEEARAETTRSRGAYVRLGWVRDIYEIRCQARRWIVAARAYLLHLVGCTLFSNKSATYVHVCI

SEQ ID NO: 158082 - protein, 147 aa, Glycine max
  Coding DNA Sequence Number=SeqID_66397
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=65%, HitCoverage=10%, E-value=1e-09, Identity=37%"; Hit description =Gag/pol polyprotein, 3'-partial, putative
  Pfam annotation: Domain name=G-patch; Domain location=57-101; Score =27.2; E_value=6e-05; Accession=PF01585.14; Description=G-patch domain
GHLVTVSGEEDILVSCPSSMPYVEAAEESLETTFQSFEVVSIASVDSFSGQPCLSDTAIMVARVMLGNGYEPGMGLGKDNGGRTSLISSRGNRGKFGLGYCRNLPFGGRATRDLWVRVPRKEYMRSHHQRLFEENVEKTGEDVIYEL

SEQ ID NO: 158083 - protein, 199 aa, Glycine max
  Coding DNA Sequence Number=SeqID_66398
  Gene Ontology: Mol. function=nucleoside-triphosphatase activity; Cellular component=chloroplast
  Homolog annotation: Hit_ID=Q2PMM5; Match level="QueryCoverage=65%, HitCoverage=5%, E-value=8e-73, Identity=100%"; Hit description =Protein ycf2
MVLRTWNEYEEINDTSLPFELFCRIVAQDLWSLPGPDEKNGITSYGLVENNSDLVHGLLEVEGALVGSSRTEKDCSQFDKDRVTLLLRSEPRNPLNMIQNGSYSIVDQRFLYEKYESEFEEGGGVLDPQQIEEDFFNHIVWAPRIWSPWGFLFYCHFGTSGSFMMKRMSFKRMIQSSCRVEPCSTRHEIDLPKNRAFFE

SEQ ID NO: 158084 - protein, 143 aa, Glycine max
  Coding DNA Sequence Number=SeqID_66399
MAPKKLIAKRARKDAAREGSSGAPQVDVEFDGHRFQSEEHQCRFEAIKGWSFLKERREGQRYEFSQRRSQAWGFDEEAISQRLCVPGIMPPRHPVEPEKSNRALGFLALITGLCQFYGVSVTPARLIWPPINRAFIEKYCMPR

SEQ ID NO: 158085 - protein, 99 aa, Glycine max
  Coding DNA Sequence Number=SeqID_66400
MSSTAPLSSRDGKSDDMWRYLTVIRTFCQLEASKPVDTQRLTTSSAPFLEMCFDDNKDDDKKPMRMISRLSQEQFKNQEKGSRESFIKKIQDSRFKIQE

SEQ ID NO: 158086 - protein, 46 aa, Glycine max
  Coding DNA Sequence Number=SeqID_66401
MVEDARTTLALGNQFMGLRIRFDGGGCTNNARQSIRGALDSMVEDA

SEQ ID NO: 158087 - protein, 26 aa, Glycine max
  Coding DNA Sequence Number=SeqID_66402
MEEIHGEDDEEQGIKINDNGMEKEGR

SEQ ID NO: 158088 - protein, 25 aa, Glycine max
  Coding DNA Sequence Number=SeqID_66403
MENEQLLIEQTWRSTQEHSVISIFC

SEQ ID NO: 158089 - protein, 346 aa, Glycine max
  Coding DNA Sequence Number=SeqID_66404
MASKKRKAPSTPSQAIYDRSKFTSQEAWERYTNITVPRKFLLERNVVVYYTEFDEFKEEPERRHWDKELTDFANNNINVAIVKEFYTNLYDTEDKSPKQVLVAKLCIPGRGFKLNANGQPLKILRKNMTTLAQTWSVLSFLELIPTSHTFDVTLDRAKLIYGIIMKMDMNLGYLISHQISLIAQHDTSRLGFPTMITSLCIARSVQSDSRSLENLSPAINMAYIKKNCWNLDDPIVTFGGLRKARGKRSEVPTTSTPPETPIPSSSTAPVPLIQTPAISPTFTQLPLPAPLSAGPSNFIFTPQMLHFMLQSIHRGQSIIIQSLQGLSLPSIMSMDEFDLQVAWLGA

SEQ ID NO: 158090 - protein, 114 aa, Glycine max
  Coding DNA Sequence Number=SeqID_66405
MNKNDEYTKGVCAAKRALCAKPECHSGEAELRVPCSTKLKWHQIRERHLPHLPKSDMTDPSSLLLRPGKELERRKWDEELTSFNEGNIDVAIVKEFYANFYDPEDKSPKQARVR

SEQ ID NO: 158091 - protein, 70 aa, Glycine max
  Coding DNA Sequence Number=SeqID_66406
  Homolog annotation: Hit_ID=A6FJQ2; Match level="QueryCoverage=54%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARTRAQGNHTLNHNLSLYLNHS

SEQ ID NO: 158092 - protein, 44 aa, Glycine max
  Coding DNA Sequence Number=SeqID_66407
MTLVSARQRARLPLVDKRMTEGAEDDVSLCASTAHLPLVDERCG

SEQ ID NO: 158093 - protein, 136 aa, Glycine max
  Coding DNA Sequence Number=SeqID_66408
MGANTSKWSNEGRIPTTDGPWTKLGYDRNVVKLYGLRNDACLFFWNVAKLYELRNNALFDSRNVAELYGLCNNACFFPSGMLQNFTNYITMGVKHFEAVKRRSHANKQWSPNKIRGNEIPASAPGRQPKVLNLDPS

SEQ ID NO: 158094 - protein, 207 aa, Glycine max
  Coding DNA Sequence Number=SeqID_66409
MQGEVAEALQYMVSPQGRKTCTFDDLVPYVEKITILSEEQERVTEPVSHGPASERQFPAQQFHMLQSSIETQGIARRRDTVEAEEYSQQMAERGHGMYYTPQKFAEYPTQMYQYPFQGHDTDTSATQQSFGGFCGNTSSFSWPTMTPSQQYHGPIPTPNAPLGTQWNVPGQIPNTGDLFGVDLRHAFSAEADEEEAGRHRGRRNPDR

SEQ ID NO: 158095 - protein, 111 aa, Glycine max
  Coding DNA Sequence Number=SeqID_66410
MARQPELGSTQEWRWHWYLAPFVAQYVKFRDMPKIKRKHCYAIREIPMFLQEAVASGGSNLARLGELGGKLLPYFPINRGRSEGERGSALLIFNRSSSFVVRSSSFFGLQP

SEQ ID NO: 158096 - protein, 44 aa, Glycine max
  Coding DNA Sequence Number=SeqID_66411
MAFFQCYLDYKAQNAQVSNALGNGNVTHTPDIFSKTATYLLTTS

SEQ ID NO: 158097 - protein, 136 aa, Glycine max
  Coding DNA Sequence Number=SeqID_66412
MSLFLFWLVSVILLLLTTPPLKNPPFPQGGKLDEAHPNFPKLYPRVQDRAIAPRPGGSEDLWSYPIWRREWIVVPIRGCYLQHLGVEGLNLEQEDHGEGKARNNETHDESSNFPATGSNGHLPNVFNDFEGSIVAF

SEQ ID NO: 158098 - protein, 48 aa, Glycine max
  Coding DNA Sequence Number=SeqID_66413
MPTSSRRLGGSSPESYSLHPATVILLPQTMFVIITGDQPGGPKEFPTR

SEQ ID NO: 158099 - protein, 33 aa, Glycine max
  Coding DNA Sequence Number=SeqID_66414
MYSSSSFLIILVLQIGKWGCSEWYKKWRKKDSA

SEQ ID NO: 158100 - protein, 136 aa, Glycine max
  Coding DNA Sequence Number=SeqID_66415
MVKEKCKEVSVSSKRLAKKESHFAINTNIKETSLLRQPQHLLLCKRTLVSIATPLGLEFIPQVLIWDTLGLSYFLVGVINMKIQKRDQGVPIDPKRIKHHSLSWCGTMFCHGKMPKKGVFRPYPTLTYPTPLKGIL

SEQ ID NO: 158101 - protein, 105 aa, Glycine max
  Coding DNA Sequence Number=SeqID_66416
  Homolog annotation: Hit_ID=A9PHL4; Match level="QueryCoverage=71%, HitCoverage=27%, E-value=7e-14, Identity=44%"; Hit description =Putative uncharacterized protein
MVVGNTNDFIIFYETDVSVVSLDEQLEDWTDKEISDFSSLIGGSYAPDALEPLNGVLTIPLTNDASVNLHMSKSAKGPTELLTGCFNGFKWITGFPALPGERIRT

SEQ ID NO: 158102 - protein, 90 aa, Glycine max
  Coding DNA Sequence Number=SeqID_66417
MTKARQKGVQKEKEGDACHPPRPGELGCFLQKQPPSGETSWKAQVVLIVLRHFSFGFRHVSELHKLPNDGCQIPRSGQTRVASQQRMVPG

SEQ ID NO: 158103 - protein, 262 aa, Glycine max
  Coding DNA Sequence Number=SeqID_66418
MNFQDLHDFNLVLLGKQEWRLLKHLDSLVSRTHILLMVADGALEMEPQQGSRKTHGSGDLIDQDKGNWNLDILNSILDWEDDNAYLVCTTYHGDRALIDMHYLKEIVYPPGYISNIEVFLALPLVSLSMWKALGNLFFVLITAADNNQVARLTRCIVSGGMRKKPSLKLSSLPLLPNLKPIGPFQLLALLKCNVDATFFEDRRAFGMVFCLCDDNGSFVQACIQTENFLLFVAEGEAIAVLEAIKWLLNLGVENVIVESNCI

SEQ ID NO: 158104 - protein, 76 aa, Glycine max
  Coding DNA Sequence Number=SeqID_66419
THPRGFSRVRSLYAFNGCQGMTEDLGAIVEDLERVINLRMVTEGTDLYDIMTHCLRRARGDAADGSLRPRQRRRID

SEQ ID NO: 158105 - protein, 117 aa, Glycine max
  Coding DNA Sequence Number=SeqID_66420
MPHTQARPAAHRMQPAATTHGANDDDEHNANGGDDPHVVNIAIQLNGNVATFKKTPPNVVEELKEYMATKKSGTTYSTSGSGNMANIRDFEFGEPIGCDGSEDEFADSCNSTASAKT

SEQ ID NO: 158106 - protein, 107 aa, Glycine max
  Coding DNA Sequence Number=SeqID_66421
MIEKSSWKVFTFHDDDFKDDFRIVVECAKELTWKTLFLVVLENPFKQLLVGRGGEKENSLGEWSKWRDINSLQGDNLCVASGWIFRSLLRSVGVGEKLLSGMIVGLE

SEQ ID NO: 158107 - protein, 220 aa, Glycine max
  Coding DNA Sequence Number=SeqID_66422
  Homolog annotation: Hit_ID=A9PHV6; Match level="QueryCoverage=65%, HitCoverage=75%, E-value=3e-25, Identity=47%"; Hit description =Putative uncharacterized protein
  Subcellular localization annotation: CTP_CleavageSite=85; ConfidenceScore=5.88e-01
MAAASRRSSGPVLRTLSPAGRFRNSRPSPATTAFASSTSTFSARSTAFFQNRSSSPTRDNLYGSSSGSVPSVRFGSITPNSSISVAGAGRHSHHQKRTCMCSPTSHPGSFRCSLHKSFGSRSAVAAASPNRLNARRSAMTNSLVRIRGVEGELGIVVLGTWWHSSMKFVLDTYNYVGTKSYKCDYKSQIEDKFHSWPKGLKAYKDISGFYWGAKDPNYSG

SEQ ID NO: 158108 - protein, 68 aa, Glycine max
  Coding DNA Sequence Number=SeqID_66423
MSQGWAQVMLEGLASTSDLEVDMTLDVEGRWRDWCATICTSECGGIVVRRQWWSLMVSVVSVDVDGTI

SEQ ID NO: 158109 - protein, 245 aa, Glycine max
  Coding DNA Sequence Number=SeqID_66424
MAAEWRKEERERRRHFKEKMSLEEAHHHRTPWIRAWRKKEMNEGRGREEHEILNSYVGRAHCGPRGSWDSRLPNEQGCLLPSWTIARCCVACRLVSRVVASNKTREKEKMHEQAQRKSLNQSQQKRRRFAGFFFQLNSRNSDQTREFARVHSESTESTLSLLKNEFAFELTCGTEVNSEVMEALNWARGLRALSLLSVACHSWDVENKRSHACDDNESPTQLQRGAAGNIEYSLVVTRDSSVTKV

SEQ ID NO: 158110 - protein, 225 aa, Glycine max
  Coding DNA Sequence Number=SeqID_66425
MDCDMFGSDNRGNGDNEAEKSIGSKGESQKEHSLEVPLPTNMGSLRVEKDKVVVRDLFGVTTLDDVVATIKHLGQKMENIENYNKRRLDAMERTNTTMLKAMCNLVKQDYNQLAKDVAEDAAMNGARNSSTYDETLRCGNPNKAMSKATARCGTKEAYRKCRVDLKNIETIFILGGDDDDFPMLKNNAVKAKFLGQENNNKYSYPEIVNLSRPNEVKTIDDSSPQ

SEQ ID NO: 158111 - protein, 230 aa, Glycine max
  Coding DNA Sequence Number=SeqID_66426
  Homolog annotation: Hit_ID=A7PL35; Match level="QueryCoverage=83%, HitCoverage=71%, E-value=4e-51, Identity=54%"; Hit description =Chromosome chr7 scaffold_20, whole genome shotgun sequence
MPKRDRTKKTAKATESVPEPQPQLQPPQFIDLEIQAMERQIGAIRAVRDVEIEHLLTELRFLRSRFSSEELRKPVLQVFEETLPNLAVVNDERSKKLEVKWRETEGCNDGVDLHASLLQRLSMASIPRFPGFEYSTNEGASLVSGRMSFIGADDLHFKDIALEEPSDTQTLAVQEGLQTPGVTSQRLSVGMTPKTLRLPKPGEMLLSVHGSPLGVYKDNNMEAIHGMKNG

SEQ ID NO: 158112 - protein, 168 aa, Glycine max
  Coding DNA Sequence Number=SeqID_66427
MGVLTPPTISKSSLGHQYSRGRSEIHIQHWAWDTCMLLGLTSRVHNELQIIAEDGVWVKEIGGIPLVDRVRFFNVSEKNTENTQKGGQKGHLEDFSYSWFAQASLWLAWAPRKLRGVRGLKERVQDFNIERFSEIKEKKEKGQDKTRFRCFRLASVIDSYIVLRSSTG

SEQ ID NO: 158113 - protein, 96 aa, Glycine max
  Coding DNA Sequence Number=SeqID_66428
  Gene Ontology: Mol. function=transferase activity, transferring glycosyl groups; Biological process=metabolic process
  Homolog annotation: Hit_ID=Q8S997; Match level="QueryCoverage=69%, HitCoverage=14%, E-value=2e-17, Identity=65%"; Hit description =Glucosyltransferase-12
MASEKAVGWSMSSDIGDHQPHDPTYLQVLICWPSFGDRHVNSMFVNEVCKVGLDMKDVVCDRNLIENMVNDLMGHRKKEFLNLAREVAMLANHSVR

SEQ ID NO: 158114 - protein, 133 aa, Glycine max
  Coding DNA Sequence Number=SeqID_66429
MAPKKLPAKMVRKDAAGEGSSAVPQVDVKFDGHWFRSEEHQRRFEAIKGWSFLKERWVQFREEEYAEFQEEITRRQWTQLAAPMAKESGTSAPGCGANGSLLMKMPFVTTYPSAGVRKSRNNGPKHLSPPTFI

SEQ ID NO: 158115 - protein, 64 aa, Glycine max
  Coding DNA Sequence Number=SeqID_66430
MDTYLRVISDPMKGVQRNTKIKFDGVVPFLIPMTRGGGHKPLYEGSPSECGGGATTVRYGLISK

SEQ ID NO: 158116 - protein, 138 aa, Glycine max
  Coding DNA Sequence Number=SeqID_66431
MWMLRVIKKNFKPARYPNATNVNDHDEGDNFINIEEEEEQQEIDQAEIDETACIATAKSGTRVGIAIRIGGTRAGTEQAEVTSRHSCWRNKLTGHSASSSSETQVPSFLLQLGHGMLRFTWVQFDSHAPVIIVEKIMG

SEQ ID NO: 158117 - protein, 75 aa, Glycine max
  Coding DNA Sequence Number=SeqID_66432
MKNNKVATTVVSLSEGYALSEQHPLSKTIAGEENLEENLPCMHTLSAPSVCPASHLSLLVPSAPDSLSQKSLTCA

SEQ ID NO: 158118 - protein, 77 aa, Glycine max
  Coding DNA Sequence Number=SeqID_66433
MEIMTLQAQGSAQSIKNKLNMGARDLSFMNRDQHHRHYMEVPEGVGVGADGGGVEGAGGVEIEAEGAEEDGPSDPLA

SEQ ID NO: 158119 - protein, 138 aa, Glycine max
  Coding DNA Sequence Number=SeqID_66434
  Homolog annotation: Hit_ID=Q69FA7; Match level="QueryCoverage=78%, HitCoverage=35%, E-value=2e-07, Identity=31%"; Hit description =Retrovirus-related pol polyprotein
MALGVMTGCLGELLLQSEVTLLAWVSKLCDIDVKMEDKDLIMIMLVSLPLFYENFVSSLSVGKDSITLEEVKCNIYSRELQLRASRDGDEVSVFKLSVSNSFKGQEKKNYNYYKVDPKDIYNYYKELGHWKQDYSCSA

SEQ ID NO: 158120 - protein, 81 aa, Glycine max
  Coding DNA Sequence Number=SeqID_66435
  Homolog annotation: Hit_ID=A9PCB6; Match level="QueryCoverage=44%, HitCoverage=10%, E-value=2e-07, Identity=72%"; Hit description =Putative uncharacterized protein
MSVILTVKEENEYLDGKTFTSASTLSKIVCNSLDNETHIYIDAILPRKGPVTTAKRKRLQEDLARAAEEGLRVLMNLKVDF

SEQ ID NO: 158121 - protein, 133 aa, Glycine max
  Coding DNA Sequence Number=SeqID_66436
MVKLNEDEPLRRIVVVFVTLMINMIARARSRSKTQCSELSPVVSESAVSRAPKFIVETPVSPEFRAEPLVSRFFGHRQPGPSPIIPMRLDQLQLTCPLRGSSSPSSPSSTYIKGYYGRKSNLIVVIITRIGRI

SEQ ID NO: 158122 - protein, 242 aa, Glycine max
  Coding DNA Sequence Number=SeqID_66437
  Gene Ontology: Mol. function=cysteine-type peptidase activity; Biological process=ubiquitin-dependent protein catabolic process
  Homolog annotation: Hit_ID=A7QYJ6; Match level="QueryCoverage=65%, HitCoverage=62%, E-value=1e-46, Identity=54%"; Hit description =Chromosome undetermined scaffold_248, whole genome shotgun sequence
  Pfam annotation: Domain name=DUF1055; Domain location=68-184; Score =83.0; E_value=9.3e-22; Accession=PF06337.3; Description=Domain of Unknown Function (DUF1055)
MWLMSVMISNFRLWEQMSSNQTNTSYEASSLSEHCDLANSSALKRPNGIDNSDLIDDAMSEDFGTGIEIHDTLLEGCDYVLLPQEVWKQLFRWYGGDLHWQGKLFSSGLSQTELAVEETIGQLHIKACGIFNLQPDQVCIWDYYVRRKHALMNDMNKTLDNANLQMDQDPSKSSLSIVGGLSASRGASRGYNMDLSTSRNLNSPVRDVENPYGTIGVTTRGSFGGLIGLLNLGNTCYMNSAI

SEQ ID NO: 158123 - protein, 67 aa, Glycine max
  Coding DNA Sequence Number=SeqID_66438
MTARGGHRWSMVVEEEVGGVEGRFRGRRRRYNGCFMLLDNWVASLYSKFESDLTVNKSKIAVLTEQV

SEQ ID NO: 158124 - protein, 107 aa, Glycine max
  Coding DNA Sequence Number=SeqID_66439
  Gene Ontology: Mol. function=nucleic acid binding; Biological process= apoptosis
  Homolog annotation: Hit_ID=Q2R1G5; Match level="QueryCoverage=81%, HitCoverage=7%, E-value=7e-09, Identity=37%"; Hit description =Transposon protein, putative, Mutator sub-class, expressed
MTTNLAKCMNSVLKGARALPIAALVNETFNKINDSFVTNGIKIMNMIKAGHRYSKDVYVMMQENQHIATSHYVRMYVRETWEFEVQEIENTRLDRRAMACTVKLNEW

SEQ ID NO: 158125 - protein, 98 aa, Glycine max
  Coding DNA Sequence Number=SeqID_66440
MFAYSPFAKRISVHVLSRESQALSAQPLHLRLIWSAKLAKVELSELKFDLNSAKLQPDRYATTYPWLSGTYCRQAQFLMALIEVHDTKRQSWQLSEIH

SEQ ID NO: 158126 - protein, 181 aa, Glycine max
  Coding DNA Sequence Number=SeqID_66441
MQMGDRGRGSGRRTFNRGTRRGTHSLRAPIIVNPSPSSIHISTSESIIHVVAQTPNTLPTAQDQPNPTFVRESIPTTPVRDASPSAPDDSVTLEYPTNPNCEHIVDERPFIRAYKGEFQPTHGCCNIILNIIRTKFDEPAPSWLNVSVDLRDRWFGEFKKEYRWHPQEERAIRVVFETKCS

SEQ ID NO: 158127 - protein, 108 aa, Glycine max
  Coding DNA Sequence Number=SeqID_66442
MQQQQQQSQQRQQATEAPPQPSLEELVRQMTIQNMQFQQEIRASIQSLTNQMGQMATPMNQAQSQNSDKLPSQTVQNSKNVNNTRELLTQFGATSPTSGGYQAREEIH

SEQ ID NO: 158128 - protein, 139 aa, Glycine max
  Coding DNA Sequence Number=SeqID_66443
  Homolog annotation: Hit_ID=Q51617; Match level="QueryCoverage=24%, HitCoverage=49%, E-value=6e-11, Identity=94%"; Hit description =Putative uncharacterized protein
MTVKTSDTCSSRRRSQLVCKRMPGADKPVRARQRAPFAIQAAQLLGRAIGSGLFAITPAGERGMCCKAIKLWGRSSSIVSQPTLWREGDARAHGCVFHGRKMRGVATNVYSRKTSKKPERRGLRTLSVKGSEVVFTHGE

SEQ ID NO: 158129 - protein, 67 aa, Glycine max
  Coding DNA Sequence Number=SeqID_66444
  Homolog annotation: Hit_ID=A5ATL8; Match level="QueryCoverage=94%, HitCoverage=49%, E-value=5e-14, Identity=66%"; Hit description =Putative uncharacterized protein
MPRILLKERGAFGNADTGGAWLSSARAVRLPVISRRKVRMTSSHHAPYALGDTRATMDGTKDRGGIL

SEQ ID NO: 158130 - protein, 58 aa, Glycine max
  Coding DNA Sequence Number=SeqID_66445
METPEKLKLTLLFTRMSDSGTSDIETLEIEQRKLSRNSNGRNFSHGGPIQAHHIFRRW

SEQ ID NO: 158131 - protein, 266 aa, Glycine max
  Coding DNA Sequence Number=SeqID_66446
  Homolog annotation: Hit_ID=Q6WAY6; Match level="QueryCoverage=88%, HitCoverage=41%, E-value=7e-08, Identity=27%"; Hit description =Putative uncharacterized protein
MGTRGCISYNPVLAIRQLGYPMRGAPLKQELSPVISRGFNKTSMETLQKVRKAWEVVQKKDKELRGSNNGPIGGYQWWLKAHVQGLDWLPSLRTAKREEVEAPEEDEEENAELRDINIATIKALEQETKRARREEHGRNKFRGALWGSNSELKLRREERDQSRVHSMILKEELAACSRSKKSLAQHLEATEQAIIGQYEEELNQSLTHEQKLVEDFAQAYAEKEARGRVIDALHQEATMWMDRFALTLNRSQDLLRLLAKARAMAE

SEQ ID NO: 158132 - protein, 96 aa, Glycine max
  Coding DNA Sequence Number=SeqID_66447
  Gene Ontology: Mol. function=histidine ammonia-lyase activity; Cellular component=cytoplasm; Biological process=histidine catabolic process
  Homolog annotation: Hit_ID=A1FS85; Match level="QueryCoverage=100%, HitCoverage=18%, E-value=9e-27, Identity=67%"; Hit description =Histidine ammonia-lyase
MSNTLVLRPGHVTLAQWRQVYRGAPLALDPAALPLVRASAAAVAAIVAKGAPVYGINTGFGKLASVRIEREDLATLQRNIVLSHAAGVGEPMPASV

SEQ ID NO: 158133 - protein, 203 aa, Glycine max
  Coding DNA Sequence Number=SeqID_66448
MARIAKVVKISAQELDRVKQNRNGIVGIPRRHLEEKAKVLAVQVVLLPNVDGIVDLAAIDAFLAYHQRKESSVVAILADTYDTFDRRCEKSGARIVCCTLTLYVWLVSHLFFHESRPACPLQGHRIYADKWKENWEQLLASVLVPTVEEFEEILGCPLGGRKPYLFSRFYPSMARIAPIGMSPHRVVFGKACHLPIEIEHKAY

SEQ ID NO: 158134 - protein, 385 aa, Glycine max
  Coding DNA Sequence Number=SeqID_66449
WPPGSVRALGQGQLFNMILDGSICLMLGTVMQITFLEGASCQRKVEIYHTEFDDFKTELERSNLHKHLTNLADGTIDVALVKEFYANLYSSEDPSPKQAREGETLPTYSRYCRLPTDQREIEAALCIPGMRFILNAKGHPGRILKKDLTTLAQVWSVLSYSNLAPTSHTSDLIVDKARLRFPALITPLCRARGVISDSLTFERLSRAINLAYIRKNCWNIIDLIVAFRGARRARPAVIPSTSVASTPTPASNFTAPSVPARVDTHCFEAMLQSIHQGQILLLQSLSVDASSETTIPEPFTLHPEAGEEQVRPETTTTPERSLKGTSEPPTPVAGLSSPQPAVDTSTLLLDIPEDQTTPVLALNTSPPATPVHHLIDEKDAQTQNT

SEQ ID NO: 158135 - protein, 100 aa, Glycine max
  Coding DNA Sequence Number=SeqID_66450
  Pfam annotation: Domain name=G-patch; Domain location=2-43; Score =23.5; E_value=0.00028; Accession=PF01585.14; Description=G-patch domain
MMVTHVMLGHGYEPGMGLGKNNDGKANLVDIKENRGKFGLGYKPTRTDMRRSVLERRNRGMGPQLRPQVREAPPCHISESSVSAGLRHKEKVSMTHEEAP

SEQ ID NO: 158136 - protein, 279 aa, Glycine max
  Coding DNA Sequence Number=SeqID_66451
  Gene Ontology: Mol. function=nucleoside-triphosphatase activity; Cellular component=chloroplast
  Homolog annotation: Hit_ID=Q2PMM5; Match level="QueryCoverage=91%, HitCoverage=11%, E-value=1e-140, Identity=94%"; Hit description =Protein ycf2
MNIPDSEGKNLHQYLNFNSNMGLIHTPCSEKYLPSEKRKKRSPCLKKCLEKGQMYRTFQQDSVFSTLSKWNLFQTYIPWFLTSTGYKYLNFIFLDTFSDLLPILSSSQKFVSIFHDIMHGSDILWRIRQIPLCLPQWNLISEIWNLISEIPGNCLHNLLLSEEIIHRNNELLLISTHLRSLNVQEFFYSILFLLLVAGYLVRTHLLFVSRVYSELQTEFEKVKSLMIPSYMIELRKLLDRSLSSALEQLGDSLEEYGVLLLVATCYGVVSHLWGQINTF

SEQ ID NO: 158137 - protein, 24 aa, Glycine max
  Coding DNA Sequence Number=SeqID_66452
MAPKTCSVAASAPDHASSIKRYVN

SEQ ID NO: 158138 - protein, 278 aa, Glycine max
  Coding DNA Sequence Number=SeqID_66453
  Gene Ontology: Mol. function=oxidoreductase activity; Cellular component=integral to membrane; Biological process=beta-lactam antibiotic catabolic process
  Homolog annotation: Hit_ID=A8GAP1; Match level="QueryCoverage=100%, HitCoverage=85%, E-value=1e-110, Identity=71%"; Hit description =Aldo/keto reductase
  Pfam annotation: Domain name=Aldo_ket_red; Domain location=1-270; Score=163.9; E_value=4.2e-46; Accession=PF00248.12; Description =Aldoketo reductase family
ALDAGINFFDTANSYSDGSSEEILGRALKDYAQRDRVVVATKVYFPLSNLSQGLSRTNILQSIDDSLTRLGMEYVDLLQIHRWDYATPIEETLEALDQVVRSGKARYIGASSMHATQFAQALQLQQQHGWARFVSMQDQYNLIQREEEKEMHPLCQREGIAVLPWSPLARGKLTRPWGETTARSVSDNVMEKLYTGTEENDAAIAQRLATVAADKGVTRAQVALAWLLHKPVVTAPIIGASREQQFAELVKAVDVELSSTDIAELESVYQPHPVVGFE

SEQ ID NO: 158139 - protein, 78 aa, Glycine max
  Coding DNA Sequence Number=SeqID_66454
MAGNRTGGARGIIGLRPLPKPVASSVKVIKSLVMETARLAVLQQRQPFCFRRDLADAGIRHAQMAQRHIQCTTIDFRH

SEQ ID NO: 158140 - protein, 168 aa, Glycine max
  Coding DNA Sequence Number=SeqID_66455
MSVHVTQVIADAIYLFVCMPPSRHPLDPDKPNRALGFLALITSLCQSFGVQVTPGKVIRQPITRAFIEKYCTPRQAQGDAPQGADAPPPPRQADPAEPLGMERYLQHLVRQQAANHHRQFAAEVAWPGDWPDAQAGEEPTRSPGRMDEPCMDEDMTDLFDFLGGSGAT

SEQ ID NO: 158141 - protein, 129 aa, Glycine max
  Coding DNA Sequence Number=SeqID_66456
MEDRVTTDRSSSLSRRWASGGRRCKAAQYPLNSQLARLGELSSPRRATPVRKYERGGGGTFSSPKTLPPHFKNSQAHGNYKNSSPQASVVEFCFSFHALIHSPQDCGTVLYIWGQHRGSEMGAQVQFQA

SEQ ID NO: 158142 - protein, 113 aa, Glycine max
  Coding DNA Sequence Number=SeqID_66457
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=18%, E-value=1e-50, Identity=76%"; Hit description =Photosystem I P700 chlorophyll a apoprotein A1
MQSDVWGSISDQGIVNHITGGNFAQSSITINGWLRDSYGHRHPSLMFLFSGRGYWQELIESIVWAHNKLKVAPATQPRALSIVQGRAVGVTHYLLGGIATTWAFFLARIIAVG

SEQ ID NO: 158143 - protein, 53 aa, Glycine max
  Coding DNA Sequence Number=SeqID_66458
MAKLTLMQKYMKIQWEASLRRKEASLGELSSPGRARLLQVEGMKRKIGVREAE

SEQ ID NO: 158144 - protein, 92 aa, Glycine max
  Coding DNA Sequence Number=SeqID_66459
MGLRSRIVLGDGQMPGQIQRQRQIKVNGNAATVCCAMSFPALRYLGTDASRGYAHDRWIIVPCPASDKREAQLGGNLVSFKFPVIITVVSLR

SEQ ID NO: 158145 - protein, 169 aa, Glycine max
  Coding DNA Sequence Number=SeqID_66460
MGDIEEVQEQMKANMEALKDQVASMMEVMLSMKRMMESNAAIVAAASTVAKADPTHPSAINQANQPAQDMVGQGGAVLGSTGGSHLGYNRNAYPYDLPLNYTPPTMHMPNENVNHVVPVTFEGQQPQPIGGTREEPRKRAQGDFDPYPTFTTEGLAYNVMPQPNTVGTP

SEQ ID NO: 158146 - protein, 66 aa, Glycine max
  Coding DNA Sequence Number=SeqID_66461
MFILTPIVINSSLTSKRAHKKLRCKVMRILKLAKYRLKAQVEKDEDPSGEGQSPRVEKDEGLSGER

SEQ ID NO: 158147 - protein, 120 aa, Glycine max
  Coding DNA Sequence Number=SeqID_66462
  Homolog annotation: Hit_ID=A5AZG1; Match level="QueryCoverage=69%, HitCoverage=26%, E-value=4e-08, Identity=38%"; Hit description =Putative uncharacterized protein
  Pfam annotation: Domain name=zf-CCHC; Domain location=62-79; Score =22.6; E_value=0.00058; Accession=PF00098.14; Description=Zinc knuckle
MGCKQQLKRKSTSKSYGSHSYPKKDQAQGILGVTPSKPKYDKGKMIEKQSLKDSMQENNSSIKCFKCLGRGHITSQCPTKKTMIMRGQDIYSSQDEANTSPSSTESEEAKGEEFSEEIYP

SEQ ID NO: 158148 - protein, 74 aa, Glycine max
  Coding DNA Sequence Number=SeqID_66463
  Gene Ontology: Mol. function=catalytic activity
  Homolog annotation: Hit_ID=A7NTU5; Match level="QueryCoverage=74%, HitCoverage=12%, E-value=3e-19, Identity=81%"; Hit description =Chromosome chr18 scaffold_1, whole genome shotgun sequence
MPQSDLRLISNKGNKLIHVEFIVPVPHVKQVKLSTAGGRIILSSDGVWDALSAEMALDCCRGMSPEAAATHIVK

SEQ ID NO: 158149 - protein, 100 aa, Glycine max
  Coding DNA Sequence Number=SeqID_66464
MAEVSTEAIASLAQYYDQSLRCFTFGVFQLSLMVEEFEEILGCPLGGRKPYLFSGFYPSLARISKIVQISMQELDHRKQVQNGVDGVPRKYLEAKARILA

SEQ ID NO: 158150 - protein, 300 aa, Glycine max
  Coding DNA Sequence Number=SeqID_66465
  Homolog annotation: Hit_ID=Q5XM22; Match level="QueryCoverage=26%, HitCoverage=44%, E-value=8e-19, Identity=61%"; Hit description =Resistance-like protein HAAS-2
  Subcellular localization annotation: CTP_CleavageSite=34; ConfidenceScore=5.47e-01
MALLVCLPLPTTLHLPLPTTLLVGLPLPRALLVRGSSSSTYPSSSSVVVVFVVGAIGKALGRRDASDDDDVPQQHRPASARRQRQQERAVEDPPTAGFPGGPYDTSVLREYENYIALRVWNGEEHPELELSSHGRKMAKFGRLAPEIEGLVAASGLSPLIICSLDTGDRGIIEVTITLDDITSLLHLPVVGVFHSFELLDVNHAVDMLVELLEVSAVEVGAETIQCHGSYVRLLWLPDVYQMKIEACDWIVAARTYLLHLLGCTLFANKSATHVHVVFLDALCDLSRSVGYAWGVAALVH

SEQ ID NO: 158151 - protein, 357 aa, Glycine max
  Coding DNA Sequence Number=SeqID_66466
  Homolog annotation: Hit_ID=Q5XM22; Match level="QueryCoverage=22%, HitCoverage=44%, E-value=3e-19, Identity=62%"; Hit description =Resistance-like protein HAAS-2
EHPELELSSHGRKMAKFGRLAPEIEGLVAASGLSPLIICSLDTGDRGIIEVTITLDDITSLLHLPVVGVFHSFELLDVNHAVDMLVELLEVSAVEVGAETIQCHGSYVRLLWLPDVYQMKIEACDWIVAARTYLLHLLGCTLFANKSATHVHVVFLDALCDLSRSVGYAWGVAALVHMLLDRLIPDVVCWIPYGDHRSFREFEFGYIEIILPYLVMSSLSDEEIDDRWMQFSEYIAHVGKLCAAPDHCSSYYMDWFYMISHPFMSPAQPRDPPRVLLVQQYDTFVEPDVYQQPMVAVAPNEADVDVHHLERLLNLRILTVVTEAYTVAEECLGIARSYIGQPTVGHRSRRRWRMDGH

SEQ ID NO: 158152 - protein, 90 aa, Glycine max
  Coding DNA Sequence Number=SeqID_66467
MTRTIGSVQIPWSFWSRKQLHSQTKFLLFQPPSRSQRIKEEPRSGVIYWNIKIKKEGNNKMEAILIQHGCAEALEGEEKMSESLSSKEKS

SEQ ID NO: 158153 - protein, 281 aa, Glycine max
  Coding DNA Sequence Number=SeqID_66468
MARAIVYSSFSPYPYLHITGGIVMTGKIGNHLCLVGRFKLTDYDAQEDVVVSLIQNLILRNGRFANAAEHSVRPSARVECTTWRGAVIKVGRILDSLPCSHTAIALDVIVDVVGIDNFLDELMEKSTSLYFYEYGSGLARSQSEFTLRSLTFTVEGLRAAMDKLTCKIQSYMRSIVPCSGARKKLQMQQEEPSKINEPFGDDDIMVVNTKSVRSVSVLNNLETIQLDDFDVNIPQGQSREGLSAPFTRSMAKMSAKGKKMGKSVVDKGQGDSNATSKNIVD

SEQ ID NO: 158154 - protein, 115 aa, Glycine max
  Coding DNA Sequence Number=SeqID_66469
  Subcellular localization annotation: CTP_CleavageSite=61; ConfidenceScore=5.07e-01
MFQSIHQGQIVLLRSLQLVAPPDSIPFAEQFKPGPGLSPPFTGRTKVSPLRKRVVETQEAAATSEKSLEATSEPLEPVTTPVLSSNTSPLATPVLHLTDEEDVQTQDTQDKSHDF

SEQ ID NO: 158155 - protein, 103 aa, Glycine max
  Coding DNA Sequence Number=SeqID_66470
MSPSPLGSHNHSKTHLKLSERLPLQALVLYTKVSRIHRLTTMHQQSQDPSPFPWPTLEQFEAIIVWPGDEPDFEIGARPAGAPGDEDGAQEDDDMADVLDFFT

SEQ ID NO: 158156 - protein, 401 aa, Glycine max
  Coding DNA Sequence Number=SeqID_66471
DGGEEKETLEETTKSGNTDTIIDPPSPIRRHMKWKMVCTKKTRQMTSEEAKEIADKIEQATQGSFFAHGRQDVLTTAIGRLEHPSRMRAAGVSVTIKRYFGSAPRTSCTSSSMAPEDLEQLTQKIRDKLEESITEKSNDPDTGDSEKYGLYIEENPPHLVALGRLYEGSTTVHNIPLSYDQVKVGVEEFRDADAHIPLPTKESLLVMLDATVFGVFNDNFPLYIKHEDLSEIAHGGQCLSISVIQLWILHMTKTNMRAGNADVYGFLKPQLDNYLKGIINSALKGLDNTPQSKSKAAARWIVVKFVFVANWPALPSLQPHCGVRVCGVHLCHLSIEEKVPERVGIDFGSALWFALRLPGRSSSFSFCPKFVFVANWVAFPVGSDFGSPLLLALRLPGKPLK

SEQ ID NO: 158157 - protein, 30 aa, Glycine max
  Coding DNA Sequence Number=SeqID_66472
MDAPEARKIVKVQVGMIGRLKNKAQWIRIE

SEQ ID NO: 158158 - protein, 79 aa, Glycine max
  Coding DNA Sequence Number=SeqID_66473
MMRLRTLKDLSFHGHNQTPLYQYYNYKNPSGSYKCKEKAKQRHFTKNRTLVLSTVQLIQRKKTPLKDRLFPPHDDTTRL

SEQ ID NO: 158159 - protein, 61 aa, Glycine max
  Coding DNA Sequence Number=SeqID_66474
  Subcellular localization annotation: CTP_CleavageSite=21; ConfidenceScore=5.00e-01
MAISPLALAIPSQTPNSPVPLADNVYGPINLKQVQKNDQSTLRSSGPYGNSSNLDQEDAAS

SEQ ID NO: 158160 - protein, 221 aa, Glycine max
  Coding DNA Sequence Number=SeqID_66475
MEWLGGGDKAQGPAEEQVGSRWAWGRRREWGRTSCPLMELDALSCPALAGAPATGALAVTPVLSTLTNNNTLVKASYASTTVTRNNGCARPLHFTQETTRVLSHLFTIHRRSVELAAVKDPLIATSSGFQELGRRARRASDNMDLFDNFVMVVILVIQIGTLGLSVFGGCVEDGVIIFEVGSKGAVIDEVVIVGYIDEAMLVMDWRTLLWTVMILTPSWSW

SEQ ID NO: 158161 - protein, 69 aa, Glycine max
  Coding DNA Sequence Number=SeqID_66476
MLVATPRVFLSWNTHPQVTRRPPAEGPSPKCARHALSIHGSTGAKRGVKHEDARFVTRAKREAHAKPAA

SEQ ID NO: 158162 - protein, 194 aa, Glycine max
  Coding DNA Sequence Number=SeqID_66477
  Homolog annotation: Hit_ID=A7PL25; Match level="QueryCoverage=41%, HitCoverage=19%, E-value=7e-13, Identity=55%"; Hit description =Chromosome chr7 scaffold_20, whole genome shotgun sequence
MDMRPRSHYVHETKITKTKCVYSLSKFVPIADCHSVEDIEHSIISCKSYHHSIFSSGSSSTIRSYTKQSSYGNRSRENNSLSDFGSSSKIYIYMQLDGLTLYYFYQPFKEDEFEQSTEVQIIFLAEPKPVFYEFDWEFDELEIKLARLYFVKIRKNDFCDTLISSRDHLFVGMRPSFDHFEILGTHHQAIREVL

SEQ ID NO: 158163 - protein, 183 aa, Glycine max
  Coding DNA Sequence Number=SeqID_66478
MEILPLYKVIVGLQGCVYKIVSVYGGSLKLEDRDFPSYLSLLGSIRNEGSYPYLYYSISTMNGGDYLYPRVEINSLECSTHSRSLYTLLLFFISFHKVPEADHQVEQPGSNTTVGKNSMGGNIGEILLPDVGLHLTLSLHALATCGTCTAAPSAGHAAWTHCLEDFRYKGSPRLRSITAILLV

SEQ ID NO: 158164 - protein, 233 aa, Glycine max
  Coding DNA Sequence Number=SeqID_66479
  Gene Ontology: Mol. function=hydrolase activity, acting on acid anhydrides, catalyzing transmembrane movement of substances; Cellular component=mitochondrion; Biological process=metabolic process
  Homolog annotation: Hit_ID=A7P0R9; Match level="QueryCoverage=81%, HitCoverage=6%, E-value=1e-54, Identity=56%"; Hit description =Chromosome chr19 scaffold_4, whole genome shotgun sequence
MEFSGIVGLNGTTDLESDTSKVPLRTVEILASCHALVFVENKLAYVAPVEFAGSGLLAIAFVSLSSPDQGIRRLAYGTLDKFKNAVEKVPAGKVQLENLMRLNQNVLQKCQKRKDVMGLRLLLNSVQNSIEEPWQRIPSVIALFAAEASCVLLDPAHDHYAAISTFFIHSSKLNMRVMFDNFFWSTSVNFKAERSWMLCLVYAGMNSDDDVAIYIRNSILEKLMSFYVSPLSD

SEQ ID NO: 158165 - protein, 60 aa, Glycine max
  Coding DNA Sequence Number=SeqID_66480
GEIVEAMPSKIILMMPKNQELSKLERFKNQVSRIKIQEQSRSRFKTQDSRIKRRLNQDKY

SEQ ID NO: 158166 - protein, 97 aa, Glycine max
  Coding DNA Sequence Number=SeqID_66481
MAEPSSNAATASATRKNKVDPGWKYCHSLVEGDTNTIVSCKKTPPNVVEELKEYMATKKSGTTYSTSGSGNMANIRDFEFGEPIGYDGSEEDEFADS

SEQ ID NO: 158167 - protein, 98 aa, Glycine max
  Coding DNA Sequence Number=SeqID_66482
MKISDSFTWIVVKFMHQEKDASYVGPWNGGFNSFSFSLTFGNPNRATGGGALENTINATIDNGEHIEVRDEIIHNWRLVRTCVGILRVSIGMSFEIFL

SEQ ID NO: 158168 - protein, 226 aa, Glycine max
  Coding DNA Sequence Number=SeqID_66483
  Gene Ontology: Mol. function=heat shock protein binding
  Homolog annotation: Hit_ID=P93739; Match level="QueryCoverage=21%, HitCoverage=18%, E-value=1e-08, Identity=61%"; Hit description =Putative uncharacterized protein At2g42080
MNKAIFTRFFHSTPLLERKSRTFGESRCNNYSKRFRKLRAKQTLLHDVNAYAQFMCQGAVIFFIFNCLALNRENELLCKVVVVPLPLQSFFIELLVQGVLKTVGRVREERMESIRLSSAVNLDKVCIAMLLPNMLLKLDQTGQFDRKSVPRLLRVSYRIGSASEPDQPHVSFVNLRLCSQASALISHKSSPIPLFDLSSQTHTTPRHFRSCKVAAPHRFVTVAPGF

SEQ ID NO: 158169 - protein, 261 aa, Glycine max
  Coding DNA Sequence Number=SeqID_66484
  Subcellular localization annotation: CTP_CleavageSite=89; ConfidenceScore=5.61e-01
MPKIPTNPSQPTYQYSSHQPNYSANVGTLPNLASVQQRLPTQPQWSPPQNLFPAQSQPTGNTNPNTNTNPRRNFTERKPSKLTLIPMPYADLLPSLISNQMAVVSPRKVYQSPFPRWAFYRVVCGLQEQEDSPNVRTNPLTSHGGSMVNAMEEWEPRGLKQMRDVSTSRRFILEALREVGMIRLDGDKGDSYLMHSRASHNVDTCLMAEELLQGMMDNDQFEVCSAKKGKGDVCMQLDDKNRSKPKPLVIHFTRDVATQKP

SEQ ID NO: 158170 - protein, 107 aa, Glycine max
  Coding DNA Sequence Number=SeqID_66485
MVKCLVKLQTKFREDPTVNEGWAAFLLRLLHASSRSFIKRLLAHSRHLLKDPNGQIMEMCFVKLQTKFREDPTVNEGWEAFLPRQLHVAFSRSFIKRLPLEASLWLL

SEQ ID NO: 158171 - protein, 156 aa, Glycine max
  Coding DNA Sequence Number=SeqID_66486
MDWIGMVDDRVIRLALSGKEEVVVRWELTHEIKEEVIVDEARGFGASVSVVDADEDGVGAGLDLAVILDDLVLPPDERVADGGHVIEIVALAHACISPHRQREKGIKRWIMKCTQMGERGECDVKRGRIRIMKCNQMGEKEWNKIFGDGEGKRLEL

SEQ ID NO: 158172 - protein, 341 aa, Glycine max
  Coding DNA Sequence Number=SeqID_66487
  Gene Ontology: Mol. function=helicase activity; Cellular component =chromatin; Biological process=viral genome replication
  Homolog annotation: Hit_ID=Q2A9I1; Match level="QueryCoverage=100%, HitCoverage=25%, E-value=6e-89, Identity=49%"; Hit description =Putative uncharacterized protein
MMLTVCKGPTSFEDLRTVDNVQYPTYKEACFAMGFLQDDKEFIEAIKEAKDQGSTHYIRMLFVLLLLTATMSKPEQVWDQTWHWMADDIVYNYKKIINRFRTLQNPVLLEIEELLQANQRSLRDYPSMPYPEDANCPSYLDNSLILAELNYNNQELRSEFKHLFSHMTDEQASIYNQIVEVVNKDEGDMFFLYGYGGTGKTYIWKTLASSLRADNKIVIMVASSGIASLLLPGGRTAHSKFKIPIPVFEDLTCNIHQGTQLAELLNQTSLIIWDEAPMAHKFCFEALDHSLRDIIKHNSKDNKIFGGKVMVFGGDFRQILPVIPRGSRSDIVNATINSSYL

SEQ ID NO: 158173 - protein, 212 aa, Glycine max
  Coding DNA Sequence Number=SeqID_66488
MKLEIDIGEREVSQVDEQEIARRRREHIANVLVDDDDALSQFGISNRNDIIYKAEQEPAQRQFVIVTPTPWMRQASFLDVHSQSSHYLSSKIIDYVMQVYEDLKSKREKWERAIQAKLIAKIAKEKTTKVTQVKPSNEATSLQKKDHNAVVVFLSNSSNTKDVDPISYVAPNVDALSKYKVQAMVTLAMRKQREETKELVTQAIMKQREETK

SEQ ID NO: 158174 - protein, 349 aa, Glycine max
  Coding DNA Sequence Number=SeqID_66489
  Homolog annotation: Hit_ID=A5B5V0; Match level="QueryCoverage=68%, HitCoverage=53%, E-value=2e-10, Identity=26%"; Hit description =Putative uncharacterized protein
MGSSSNTTSVGRRRHGTSGDPPALAPPSLSSPRVILDRKYLDLEFFDGETFDCYQVFQNYALVDFMSLKLPYFPKLVKVFYNNLKIQDGVLYSEVHNIPIIVYQSLCFSLTKLPSQGVPFEGTFVDDWKFDYSSRDARKMVCNDQTNMTGRSLAGSFTFDCCIMHYIIVHILLPRSLNLAQASEEDLILLWAIQTGRQIDWAHLVWYWMHKALRANAHLLYPHLVTLFLHHFNVPLDDEPYVKAKRSFSIGAGVVTSFGYRKDVDGQWVRKQDLPPPIPDEHTPSPPPQRDASSSLLTEVLTELCNLRAFVGEHFDVMDTRFDGMDTHITRLKDYVSFIRRCFNPLTDS

SEQ ID NO: 158175 - protein, 55 aa, Glycine max
  Coding DNA Sequence Number=SeqID_66490
MVMVVLCTEERETVMSRAKERENDGGDATMKVVVGGGGVKIVVRKEESKERSVIK

SEQ ID NO: 158176 - protein, 138 aa, Glycine max
  Coding DNA Sequence Number=SeqID_66491
  Gene Ontology: Mol. function=transketolase activity; Cellular component=chloroplast; Biological process=metabolic process
  Homolog annotation: Hit_ID=Q42676; Match level="QueryCoverage=98%, HitCoverage=33%, E-value=1e-50, Identity=65%"; Hit description =Transketolase, chloroplast
  Pfam annotation: Domain name=Transket_pyr; Domain location=1-94; Score=-60.8; E_value=0.051; Accession=PF02779.15; Description =Transketolase, pyrimidine binding dom
MPFVFTDYMRDAIRIFALCEARFIYVMTHDSIGLREDGPTHQPIEHLASFRAMPNTLMLRPAVGNEKGGYTISDNSSGNKPDVILIGTGSQLEIVVAAIEDLRKEGKVVTVVSIVSWELFYKQLDEYNESVLPASVTA

SEQ ID NO: 158177 - protein, 159 aa, Glycine max
  Coding DNA Sequence Number=SeqID_66492
  Homolog annotation: Hit_ID=A5BSR3; Match level="QueryCoverage=50%, HitCoverage=25%, E-value=1e-07, Identity=40%"; Hit description =Putative uncharacterized protein
DVWKKAQAIQKQNTVPHVLSRGGYEYLEQKLLAEKTKKKLEEAAQPGSVDGIIDPPSPVRHHVKWKMARTKKIGEMTTEAAKEITEKIDSFKEQATQESFVPRGRQDVLTVSIERPEHPRHVCAAGAGVTINQYFGSAPWTSHNSSSLPLEELQQLTQT

SEQ ID NO: 158178 - protein, 173 aa, Glycine max
  Coding DNA Sequence Number=SeqID_66493
MEAMKEQMTIMMEAMMSMRKMMKVNTATVVATSTATDVDPTHPSGINQVNHPVLDMVGHGGEALGSTGGPYFVQIQSKHPFPPYGLPPNYAPPNVAHAPDENVDNSALIPIESQQSQSGHAHASQPMGETHEVPRDHTLADFEPHLGYATEGQTFGGVPMPNTLGGRQYRPQP

SEQ ID NO: 158179 - protein, 161 aa, Glycine max
  Coding DNA Sequence Number=SeqID_66494
  Gene Ontology: Mol. function=ligase activity, forming aminoacyl-tRNA and related compounds; Cellular component=cytoplasm; Biological process=alanyl-tRNA aminoacylation
  Homolog annotation: Hit_ID=Q5PF17; Match level="QueryCoverage=77%, HitCoverage=16%, E-value=2e-30, Identity=55%"; Hit description =Alanyl-tRNA synthetase
  Pfam annotation: Domain name=CsrA; Domain location=133-161; Score= -1.8; E_value=0.0026; Accession=PF02599.7; Description=Global regulator protein family
  Pfam annotation: Domain name=DHHA1; Domain location=74-128; Score =22.6; E_value=0.0012; Accession=PF02272.10; Description=DHHA1 domain
  Pfam module annotation: Pfam domain module=CsrA::DHHA1; Domain location=133-161::74-128
NPERESARTGRKRACAWRKELQQLRDQQAAQESASLSSKAVEVKGAKLLVSELSNVEPKMLRTMVDDLKNQLGSAVIVLATVAEGKAGELIGELAAQVGGKGGGRPDLAQAGGTDAQALSGALAGVPEWEQRMLILTRRVGETLMIGDEVTVTVLGVKGNQ

SEQ ID NO: 158180 - protein, 847 aa, Glycine max
  Coding DNA Sequence Number=SeqID_66495
  Gene Ontology: Mol. function=mismatched DNA binding; Cellular component=cytosol; Biological process=response to DNA damage stimulus
  Homolog annotation: Hit_ID=A8G9Z9; Match level="QueryCoverage=99%, HitCoverage=98%, E-value=0.0, Identity=80%"; Hit description=DNA mismatch repair protein mutS
  Pfam annotation: Domain name=MutS_I; Domain location=7-119; Score =252.4; E_value=9.6e-73; Accession=PF01624.11; Description=MutS domain I
  Pfam annotation: Domain name=MutS_II; Domain location=127-252; Score =172.7; E_value=9.8e-49; Accession=PF05188.8; Description=MutS domain II
  Pfam annotation: Domain name=MutS_III; Domain location=260-560; Score= 341.0; E_value=2e-99; Accession=PF05192.9; Description=MutS domain III
  Pfam annotation: Domain name=MutS_IV; Domain location=424-515; Score =148.2; E_value=2.3e-41; Accession=PF05190.9; Description=MutS family domain IV
  Pfam annotation: Domain name=MutS_V; Domain location=563-795; Score =567.6; E_value=1.2e-167; Accession=PF00488.12; Description=MutS domain V
  Pfam module annotation: Pfam domain module=MutS_I::MutS_II::MutS _III::MutS_IV::MutS_V; Domain location=7-119::127-252::260-560::424 -515::563-795
MDFSGHTPMMQQYLRLKADHPDILLFYRMGDFYELFYDDARRASQLLEISLTKRGASAGEPIPMAGVPYHAVEGYLAKLVQLGESVAICEQIGDPALSKGPVERKVVRIVTPGTISDEALLQERQDNLLAAIFQSQRGFGYATLDISSGRFRLSEPGDVETMAAELQRTNPAELLYPEDLQAMTLIDQRRGLRRRPLWEFEIDTARQQLNLQFGTRDLSGFGVEQAHLALRAAGCLLQYVKDTQRTSLPHIRSLSMERQQDSVIMDAATRRNLEITQNLAGGSENTLAAVLDKTVTPMGSRMLKRWLHMPLRDVATITRRQESIAELQSLSEELQPVLRQVGDLERILARLALRTARPRDLARMRHAFQQLPELNTQLADVAAPHLNVLRDRMGDFSELRELLESAIIESPPVLVRDGGVIAPGYNAELDEWRALADGASDYLDRLEIREREKLGLDTLKVGFNAVHGYYIQVSRGQSHLVPIHYVRRQTLKNAERYIIPELKEYEDKVLTSKGKALALEKSLYDELFDRLLPHLEALQQSAAALAELDVLANLAERAWTLNYCRPVLQEKAGIRITAGRHPVVEQVLKEPFIANPLSLSMQRRMLIITGPNMGGKSTYMRQTALIALMAWIGSYVPAEETVIGPIDRIFTRVGAADDLASGRSTFMVEMTETADILHNATENSLVLMDEIGRGTSTYDGLSLAWACAESLANRIKAMTLFATHYFELTSLPEKMEGVVNVHLDAVEHGDSIAFMHSVQDGAASKSYGLAVAALAGVPKEVIKRARHKLKELEALSGSSAGSTVEGSQLPLLVAETSPAVEALEALDPDSLTPKQALEWIYRLKTLM

SEQ ID NO: 158181 - protein, 375 aa, Glycine max
  Coding DNA Sequence Number=SeqID_66496
  Gene Ontology: Mol. function=mismatched DNA binding; Cellular component=MutSbeta complex; Biological process=response to DNA damage stimulus
  Homolog annotation: Hit_ID=A8G9Z9; Match level="QueryCoverage=100%, HitCoverage=44%, E-value=1e-174, Identity=83%"; Hit description=DNA mismatch repair protein mutS
  Pfam annotation: Domain name=MutS_V; Domain location=91-323; Score =572.8; E_value=3.5e-169; Accession=PF00488.12; Description=MutS domain V
VSRGQSHLVPIHYVRRQTLKNAERYIIPELKEYEDKVLTSKGKALALEKSLYDELFDRLLPHLEALQQSAAALAELDVLANLAERAWTLNYCRPVLQEKAGIRITAGRHPVVEQVLKEPFIANPLSLSMQRRMLIITGPNMGGKSTYMRQTALIALMAWIGSYVPAEETVIGPIDRIFTRVGAADDLASGRSTFMVEMTETANILHNATENSLVLMDEIGRGTSTYDGLSLAWACAESLANRIKAMTLFATHYFELTTLPEKMEGVVNVHLDAVEHGDTIAFMHSVQDGAASKSYGLAVAALAGVPKEVIKRARHKLKELEALSGSSAGSTVEGSQLPLLVAETSPAVEALEALDPDSLTPKQALEWIYRLKTLM

SEQ ID NO: 158182 - protein, 388 aa, Glycine max
  Coding DNA Sequence Number=SeqID_66497
  Homolog annotation: Hit_ID=A6TFE1; Match level="QueryCoverage=38%, HitCoverage=26%, E-value=4e-68, Identity=85%"; Hit description =Putative uncharacterized protein yhjU
ATLDRCYSLPRSSTRRVRDFYNTLPLHDGNHYPGQSKTADYKARAQKFFDELDAFFTELEKSGRKVMVVVVPEHGAALKGDKMQVSGLRDIPSPSITNVPAAVKFFGMKAPHQGAAVEITQPSSYLAVSELVVRALDGKMFTEDNVNWQQYTANLPQTAALGAISAVKTKKAAGGFLRPVRAQIANAADSRPPVRHFWLCIQLTIILTTMPAIIGAARSSHKIRPNCVSVIEPPQRARVFSFQQLIYAAGVQAPATLRLTGRTRLGVDSTAPCYRLHHALWQSARRIPALPRRNHHATTRLPSRPRFLRILILINGKAGHQLAAVILKLRLKLGAWAKASAATRIKGAARRRIQRARQFAGQLDALAPIVRVQSRRRRQQRLSIRMTR

SEQ ID NO: 158183 - protein, 54 aa, Glycine max
  Coding DNA Sequence Number=SeqID_66498
MVPSGGSNLVRLGELGGEQKCSTLLIFNRSLTLFVRSSSFFGLQPISKRPKINM

SEQ ID NO: 158184 - protein, 147 aa, Glycine max
  Coding DNA Sequence Number=SeqID_66499
LGAGAATGGDTSICLPDLKPSAPSDLSDSEWRLLSLAEIAYSGRSFASLTPLRKVKKGPQLLVVFVVATSLEEEHMACLDQQHSGKEGQAIVAAVVVVKDLPISDLDDSSNLDCICCLKDHNYSVVVGFAAEGVYYKCLQHRLQVAH

SEQ ID NO: 158185 - protein, 165 aa, Glycine max
  Coding DNA Sequence Number=SeqID_66500
  Gene Ontology: Cellular component=mitochondrion; Biological process =protein complex assembly
  Homolog annotation: Hit_ID=A6KWF4; Match level="QueryCoverage=99%, HitCoverage=18%, E-value=1e-54, Identity=62%"; Hit description =Putative uncharacterized protein
MMFTPQGKKLIIIGSLDSRYIKMLIKNGKINEKELKNKNEKYIMVVVNNSLPGVDEALVIVGSDRRGTVYGTYELSEQIGVSPWYDWADVSVKKQQNLSIKPGKYTADEPAVKYRDIFLNDEASCLTTWVHNTYGTNYGDHRFYARVFELLLHLRANYLWPAMWS

SEQ ID NO: 158186 - protein, 179 aa, Glycine max
  Coding DNA Sequence Number=SeqID_66501
MEENHKKTLKFLDVTSATKKRYDERRTKKAYIAWDDNDSSDEPSKKRKGSSSRSQRHSETQEMPIPSSIPSASLFSSEEQRIRYKNLFSSHSIIDPKFIDMDFFSNESFKCIQAFENSNLIPFMSLKLPVYSDLVKAFYSNLEIQEGTLIFEVYGIKMVIDQSLFYDLTQLFSEGVPFE

SEQ ID NO: 158187 - protein, 110 aa, Glycine max
  Coding DNA Sequence Number=SeqID_66502
MATPPNSPPPPPSTNATTQLPPVGAERPVVHVDAITGKANDPHKKKFRTYLGIVARDKVDVTYENWKQVSAAHKDLIWEDIQALVANNDNVDDTVCKKYGISKEKWTQFC

SEQ ID NO: 158188 - protein, 38 aa, Glycine max
  Coding DNA Sequence Number=SeqID_66503
MVSCLTRDVNAEAIRVLSIKVPPLAASIKLLSININPS

SEQ ID NO: 158189 - protein, 108 aa, Glycine max
  Coding DNA Sequence Number=SeqID_66504
  Subcellular localization annotation: CTP_CleavageSite=27; ConfidenceScore=5.68e-01
MGSPPASTPPPPLDASASPSIVKRTRKASRLRSLSTRPPGAERPVVHVDPATGKADSPLRKKLRTYLGIVACDKVDVTYENWKEAEFDIQEASDSRTKRKLLQTVGER

SEQ ID NO: 158190 - protein, 159 aa, Glycine max
  Coding DNA Sequence Number=SeqID_66505
MAASDHAILCVRAHIPTKRSLMELSSQDALLARNKLLSKQLKALTETLSCVICGGAHDSGCCIPTEDIAHEVNYMGNQPRPNFNANQGGPSNRPQQQGPSLYDRMMKLKETLAQFMQASMSNQEHRVRHQESRSPGGTIGKTTGRPTVKQLWCQHREES

SEQ ID NO: 158191 - protein, 80 aa, Glycine max
  Coding DNA Sequence Number=SeqID_66506
  Subcellular localization annotation: CTP_CleavageSite=22; ConfidenceScore=5.16e-01
MWGANTFPVRKYNSRTFHLKVRRSRLFRFFRRFPQINIGGDSARIPLVEHASRESRVALPPKGRLRQLATEYSKCSKWKE

SEQ ID NO: 158192 - protein, 115 aa, Glycine max
  Coding DNA Sequence Number=SeqID_66507
  Subcellular localization annotation: CTP_CleavageSite=30; ConfidenceScore=5.76e-01
MASPPTSPPPSPSPPPPPSSDASASPSIVKRTRKASRLRSLSTRPPGAERPVVHIDPATGKADDPHKKKLITYLGIVVRDKMDVTYENWKEAEFEIPEASDSRTKKKLLQTVNER

SEQ ID NO: 158193 - protein, 165 aa, Glycine max
  Coding DNA Sequence Number=SeqID_66508
MLQSIHQGQIILLQSLQVMAPPGSIPTVEQFLASVTWPGAQPSLHRENEGPTAQVPQHMEDESSEDTIPEPFIVEEEAGETQIRQEAAATPERSIKVTLEPPAPVVDLSSPQHVVDPSTPILEIPEDLTTLVLTLNTSPLATPVLHLTDEEAVQTQDTQDQSQEF

SEQ ID NO: 158194 - protein, 53 aa, Glycine max
  Coding DNA Sequence Number=SeqID_66509
MMNGLSTTNILIVIVWSYLPVPFYSSGMINDKDDSQSQSSQSNVWKNFCRMLK

SEQ ID NO: 158195 - protein, 221 aa, Glycine max
  Coding DNA Sequence Number=SeqID_66510
KTHLTERKVEIYHTELDECKDELERRNFHRRLTNLVDNNIDLALVKDFYANLYIFEDPSPKKVRVRGHQVRIDADSLNTFLERPHVVEGETLPAYSRYCRLPTDYKEIEVALCIPGRGFVFNSEGHPGKILRKDLMTLAQVWSVLSYSNLAPTSHTSDLTVDRARLIFGLDSQMDINVGALISGQITSIAQSNSSRLGFPTLITACVRPEGLIMIAWLSSA

SEQ ID NO: 158196 - protein, 73 aa, Glycine max
  Coding DNA Sequence Number=SeqID_66511
MGWYKGPCGSHHAQQCKFPDLAQITHHVQKVLDGKDTPMHTRDMADHLFSQQQTGTCNIIPTMKAQTTTPLYS

SEQ ID NO: 158197 - protein, 283 aa, Glycine max
  Coding DNA Sequence Number=SeqID_66512
  Gene Ontology: Mol. function=arsenate reductase (glutaredoxin) activity; Biological process=response to arsenic
  Homolog annotation: Hit_ID=A7MRG2; Match level="QueryCoverage=43%, HitCoverage=89%, E-value=9e-44, Identity=73%"; Hit description =Putative uncharacterized protein
  Pfam annotation: Domain name=ArsC; Domain location=79-189; Score =160.1; E_value=6e-45; Accession=PF03960.6; Description=ArsC family
MPTVLVGALAIDASTAQGSGNAAMAARTGAKRDSHQLGLLFSRRHHPDVTGAGRDAGSSGAAPFPLTVKRLTMTNITIYHNPDCGTSRNTLALIRNSGVEPTIVLYLVTPPTRETLQQLIDAMGIGLRALVRQNTDAWQALGPVRETLSDEQLLDAMLAQPILINRPIVVTPLGTRLCRPSEQVLDILPDAQRGPARQSLVGQKSSGIICFNRVYLVITAKQAIAIAGNQVVDQQLFAAFALNRRKVIIARQAVAQQKNHPGIAQLALSIIKNDRLAGLGLYG

SEQ ID NO: 158198 - protein, 299 aa, Glycine max
  Coding DNA Sequence Number=SeqID_66513
  Gene Ontology: Mol. function=transcription factor activity; Cellular component=membrane; Biological process=regulation of transcription, DNA-dependent
  Homolog annotation: Hit_ID=A7MRI5; Match level="QueryCoverage=98%, HitCoverage=98%, E-value=1e-137, Identity=82%"; Hit description =Putative uncharacterized protein
  Pfam annotation: Domain name=HTH_1; Domain location=7-66; Score=84.7; E_value=2.9e-22; Accession=PF00126.18; Description=Bacterial regulatory helix-turn-helix protein, lysR family
  Pfam annotation: Domain name=LysR_substrate; Domain location=90-297; Score=169.0; E_value=1.2e-47; Accession=PF03466.11; Description=LysR substrate binding domain
  Pfam module annotation: Pfam domain module=HTH_1::LysR_substrate; Domain location=7-66::90-297
MPVNFDLNDLYAFRALVEYGNFRLAAESICLSQSALSRRIEKLEAALGTRLFDRTTRRVTLTLYGQNFAQRSEQLLDNVESMLADVERASQDRTGLITVATVPSGAYYFMPEVIRRFQARYPRVRIKLIDSSVGNVMDAVSSGQADFGICFARNLPPELTFTPLVEDVYVAACRHDHPLATRQQLSWQEYFAQDYVALDKVSGNRNLLDSALAHLTPARQSICETRHVTTLLGMVEAGIGIAAVPAMSMPANGHPLLRQLALTDPQVTRSVGLIRRSGRMQSYVAAELEKLIIEQSQHA

SEQ ID NO: 158199 - protein, 234 aa, Glycine max
  Coding DNA Sequence Number=SeqID_66514
MASLGGYHEWLKVRTRGLDWLAKLKIINEENFEAPEEDEEVRALKTELGKARLAKEKFKLVATDVWKECSGLQEENVATAKALEQETKRARKEQHGRDKFREALWGSNSELKLRREESDQSRAQSMVLKEELVACSRSKRNLTQRLCETETNMLAIITKYQEELSLATHEHRVADEYAQVYAEKEARGRVIDSLLQAATMWMDRFALTLNGSQELPRLLAKAKAMADTYSAPDC

SEQ ID NO: 158200 - protein, 285 aa, Glycine max
  Coding DNA Sequence Number=SeqID_66515
  Gene Ontology: Mol. function=transcription factor activity; Cellular component=cytoplasm; Biological process=regulation of transcription, DNA-dependent
  Homolog annotation: Hit_ID=P45600; Match level="QueryCoverage=97%, HitCoverage=85%, E-value=1e-147, Identity=93%"; Hit description=HTH -type transcriptional regulator cysB
  Pfam annotation: Domain name=HTH_1; Domain location=3-64; Score=60.1; E_value=7.6e-15; Accession=PF00126.18; Description=Bacterial regulatory helix-turn-helix protein, lysR family
  Pfam annotation: Domain name=LysR_substrate; Domain location=88-284; Score=134.7; E_value=2.7e-37; Accession=PF03466.11; Description=LysR substrate binding domain
  Pfam module annotation: Pfam domain module=HTH_1::LysR_substrate; Domain location=3-64::88-284
MKLQQLRYIVEVVNHNLNVSSTAEGLYTSQPGISKQVRMLEDELGVQIFARSGKHLTQVTPAGEEIIRIAREVLSKVDAIKSVAGEHTWPDKGSLYVATTHTQARYALPGVIKGFIERYPRVSLHMHQGSPTQIAEAVSKGNADFAIATEALHLYDDLIMLPCYHWNRAIVVTPDHPLAGKSNVSIEELADFPLVTYTFGFTGRSELDTAFNRAGLTPRIVFTATDADVIKTYVRLGLGVGVIASMAVDPVSDPDLVRIEASEIFTNSTTKIGFRRSTLPAQLYV

SEQ ID NO: 158201 - protein, 256 aa, Glycine max
  Coding DNA Sequence Number=SeqID_66516
  Gene Ontology: Mol. function=oxidoreductase activity; Cellular component=cytoplasm; Biological process=metabolic process
  Homolog annotation: Hit_ID=A7MN96; Match level="QueryCoverage=95%, HitCoverage=96%, E-value=1e-93, Identity=71%"; Hit description =Putative uncharacterized protein
  Pfam annotation: Domain name=Epimerase; Domain location=17-246; Score= -63.5; E_value=0.019; Accession=PF01370.12; Description=NAD dependent epimerasedehydratase family
  Pfam annotation: Domain name=KR; Domain location=17-199; Score=-17.7; E_value=2.6e-06; Accession=PF08659.1; Description=KR domain
  Pfam annotation: Domain name=adh_short; Domain location=15-186; Score= 121.7; E_value=2.1e-33; Accession=PF00106.16; Description=short chain dehydrogenase
  Pfam module annotation: Pfam domain module=Epimerase::KR::adh_short; Domain location=17-246::17-199::15-186
MPAGGTECADLLDNRIILVTGASDGIGREAALTYARYGARVILLGRNATTLQQTAEAINQLNKQPAATLLLDLAHATPESCQQLAQQVAALVPRLDGVLHNAGILGEIVPLAELDPAVWQQVMQINLDATFYLTQALLPLLLKSDAGSLVFTTSSVGRTGRAGWGAYAVSKFATEGMMQVLADEYKNRHLRVNCINPGGTRTKMRASAFPEENASLLKTPADLMPLYLYLMGDDSRRKTGISYDAQPGRKPGPASA

SEQ ID NO: 158202 - protein, 218 aa, Glycine max
  Coding DNA Sequence Number=SeqID_66517
  Gene Ontology: Mol. function=catalytic activity
  Homolog annotation: Hit_ID=Q2NQ77; Match level="QueryCoverage=68%, HitCoverage=78%, E-value=3e-18, Identity=37%"; Hit description =Putative uncharacterized protein
MRTSLLWPALAALVLSGCSVGHTEYSRTALQHVDMSVTGIPTVLGLGILGTTIPLTPEYSLTAAHVAKTAVQRVKAYHPYCDVAIIYHKNSPDTLAKFRSSAVGEPIKMYGYSFISAMPVESSGVNLARTAINNRWNKKPCMAMASDAGVVQGMSGGAVYNADQTISGVIVGYSHEIANVRSKKVILKDVSLYIPYGDFKRWLEANIGQTPQTAPGPA

SEQ ID NO: 158203 - protein, 520 aa, Glycine max
  Coding DNA Sequence Number=SeqID_66518
  Gene Ontology: Mol. function=anthranilate synthase activity; Cellular component=ribonucleoprotein complex; Biological process=biosynthetic process
  Homolog annotation: Hit_ID=A4TJ63; Match level="QueryCoverage=100%, HitCoverage=99%, E-value=0.0, Identity=74%"; Hit description =Anthranilate synthase, component I
  Pfam annotation: Domain name=Anth_synt_I_N; Domain location=16-193; Score=89.5; E_value=1.1e-23; Accession=PF04715.4; Description =Anthranilate synthase component I, N terminal region
  Pfam annotation: Domain name=Chorismate_bind; Domain location=241 -510; Score=546.3; E_value=3.2e-161; Accession=PF00425.9; Description= chorismate binding enzyme
  Pfam module annotation: Pfam domain module=Anth_synt_I_N::Chorismate _bind; Domain location=16-193::241-510
MANAKPTLKLITGTAPYREDPAAVFHQLCGARPATLLLESADIDSKQNLKSLLIVDSALRISALGNVVTLQALSENGRALLPLLDEALPPEVRIAVRPDGRELHFTPVEGLHDEDSRLKALSVFDALRLIPHLVNSPAEEREAMLLGGLFAYDLVAGFEDLPPLRNDQSCPDYCFYLAETLLVIDHQQRSARLQASLFAPSTSEFQRLQSRIEQLHGQMTQPAPALPVQRVEQMTLSTSQSDEAYCNVVSELQQAIRIGEIFQVVPSRRFSLPCPSPLAAYDTLKNSNPSPYMFFMQDQDFALFGASPESSLKYDASSRQIEIYPIAGTRPRGRHADGSLDRDLDSRIELEMRTDHKELAEHLMLVDLARNDLARICVPGSRYVADLTKVDRYSFVMHLVSRVVGTLRNDLDVLHAYRACMNMGTLSGAPKVRAMQLIAEKEGTRRGSYGGAVGYFTASGDLDTCIVIRSAWVEGGVATVQAGAGVVLDSQPQAEADESRNKARAVLRAIATAHHCKEIF

SEQ ID NO: 158204 - protein, 293 aa, Glycine max
  Coding DNA Sequence Number=SeqID_66519
  Gene Ontology: Mol. function=iron ion binding; Cellular component =cytoplasm; Biological process=iron ion transport
  Homolog annotation: Hit_ID=O51900; Match level="QueryCoverage=75%, HitCoverage=51%, E-value=4e-76, Identity=60%"; Hit description =Enterochelin esterase
  Pfam annotation: Domain name=Esterase; Domain location=1-229; Score =172.5; E_value=1.1e-48; Accession=PF00756.11; Description=Putative esterase
  Pfam annotation: Domain name=MbtH; Domain location=225-291; Score =111.9; E_value=1.9e-30; Accession=PF03621.4; Description=MbtH-like protein
  Pfam module annotation: Pfam domain module=Esterase::MbtH; Domain location=1-229::225-291
ERLGTQRRVWLYASGDAAVKANRPLVLLLDGQNWIERHALLPVIENETATGRLPPACWLLIDAIDGEHRENELPCNAAFWQAIIDELLPQAQKREAFSEEGARTVLAGQSYGGLAALYAGVHWPERFGHVLSQSGSFWWPTVQFVTQFEKRHELEEGWLIRQVRQRDAAAPALNVIQQAGDREADIEFVNRQMHEALTAAGHRADYRVFSGGHDALCWRGGLEQQNPFDDESLRFSVLVNAQQQYSLWPQFADAPQGWRVLMGPASRGECIDYIETHWQDMRPAALKAADAAR

SEQ ID NO: 158205 - protein, 46 aa, Glycine max
  Coding DNA Sequence Number=SeqID_66520
MVQLKHQEENKGVEGRNPEYEEPRDLRSNPFQGGGDDAILPPKGIG

SEQ ID NO: 158206 - protein, 296 aa, Glycine max
  Coding DNA Sequence Number=SeqID_66521
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=95%, HitCoverage=41%, E-value=1e-145, Identity=80%"; Hit description =Photosystem I P700 chlorophyll a apoprotein A1
  Pfam annotation: Domain name=PsaA_PsaB; Domain location=44-296; Score= -47.2; E_value=1e-05; Accession=PF00223.10; Description=Photosystem I psaApsaB protein
LFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNW

SEQ ID NO: 158207 - protein, 154 aa, Glycine max
  Coding DNA Sequence Number=SeqID_66522
  Homolog annotation: Hit_ID=Q8GEG1; Match level="QueryCoverage=76%, HitCoverage=87%, E-value=7e-67, Identity=100%"; Hit description =Putative uncharacterized protein
MMEIDFLVQHYSYMLVAMNQGITQERTCEQKASKRPGTVKRPRCWRFSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYSGNYRLESNP

SEQ ID NO: 158208 - protein, 140 aa, Glycine max
  Coding DNA Sequence Number=SeqID_66523
  Homolog annotation: Hit_ID=A7QG59; Match level="QueryCoverage=84%, HitCoverage=53%, E-value=1e-33, Identity=62%"; Hit description =Chromosome undetermined scaffold_91, whole genome shotgun sequence
MFSPYGKIISEDFLWHTRGPKRGEPRGFAFIQYSTKEQFLISIVKVRMQEAELAKEKMHGRLACGRPLFVRLAGEKFMLETADNSTKAAGEGHKMHLTGGGGAMGQTSRHAKIAAIKNKLKSLEEESSRSKKQKRSDNIS

SEQ ID NO: 158209 - protein, 516 aa, Glycine max
  Coding DNA Sequence Number=SeqID_66524
  Gene Ontology: Mol. function=transferase activity, transferring glycosyl groups; Cellular component=membrane
  Homolog annotation: Hit_ID=A7NZB0; Match level="QueryCoverage=81%, HitCoverage=92%, E-value=0.0, Identity=74%"; Hit description =Chromosome chr6 scaffold_3, whole genome shotgun sequence
  Pfam annotation: Domain name=DUF604; Domain location=234-489; Score =593.2; E_value=2.5e-175; Accession=PF04646.3; Description=Protein of unknown function, DUF604
  Pfam annotation: Domain name=Fringe; Domain location=100-336; Score= -96.3; E_value=0.048; Accession=PF02434.7; Description=Fringe-like
  Pfam module annotation: Pfam domain module=DUF604::Fringe; Domain location=234-489::100-336
MYYSSKQRIITWLILIMIVLYILYSSNFLLLTKVKKDCSTSIHLDEATQEHLEMSGNISSTTKTIERSNVEEGNNEKEEEEEEEEEEEEEVSLDQLSQRQDTKLKHIVFGIAASSNLWDIRKEYIKVWWKPNQTRGVVWLDSKVRTQANEGLPEIRISGDTSKFKYTNTQGQRSALRISRVVTETLKLGMEDVRWFMMGDDDTIFIVDNVVRILSKYDHTQFYYVGSSSESHVQNIHFSYAMAYGGGGFAISYPLAKELAKMQDRCIQRYPALYGSDDRMQACMAELGVPLTKEPGFHQYDVYGDLLGLLGAHPVAPLVTLHHLDVVQPIFPMMNRVQSLQQLMKSVKQDSGSVMQQSICYDKKRYWTISISWGYVVQVLRGVLSPRELEMPTRTFLNWYKRADYTAYSFNTRPVTNKNPCQKAFLFYMNRTRYDPVRKQIIGTYYRFKSRPPYCTWKMESPEKINSIIISKRPNPLRWQMSPRRDCCRVLPSRKNSTMYIWVGKCQQGEVSELSL

SEQ ID NO: 158210 - protein, 203 aa, Glycine max
  Coding DNA Sequence Number=SeqID_66525
  Gene Ontology: Mol. function=metal ion binding; Biological process =metal ion transport
  Homolog annotation: Hit_ID=Q1SWG9; Match level="QueryCoverage=100%, HitCoverage=100%, E-value=6e-28, Identity=58%"; Hit description =Heavy metal transport/detoxification protein
  Pfam annotation: Domain name=HMA; Domain location=4-71; Score=33.3; E_ value=8.8e-07; Accession=PF00403.17; Description=Heavy-metal -associated domain
  Pfam annotation: Domain name=HMA; Domain location=85-152; Score=34.8; E_value=3.1e-07; Accession=PF00403.17; Description=Heavy-metal -associated domain
  Pfam module annotation: Pfam domain module=HMA::HMA; Domain location =4-71::85-152
MKKVVLKVDLHGDRTKQKAMKTASGLSGVESVSVDMKDMKMIVVGDIDPVSAVSKLRKCCRTEIVSVGPAKEEKETEKEEPAKKVVLQLDLHGDRIKQKAMKTASGLSGVESVSVDMKDMKMIVLGDIDPVSAVSKLRKCCHTEIVSVGPAKEEKKENVEPAKVPVPLKLHEAYPLYYQMTPHYGQSHYVTSYEEDPSGCVIC

SEQ ID NO: 158211 - protein, 375 aa, Glycine max
  Coding DNA Sequence Number=SeqID_66526
  Homolog annotation: Hit_ID=A7QG98; Match level="QueryCoverage=63%, HitCoverage=93%, E-value=6e-76, Identity=54%"; Hit description =Chromosome undetermined scaffold_91, whole genome shotgun sequence
  Pfam annotation: Domain name=PPR; Domain location=110-144; Score=5.0; E_value=2; Accession=PF01535.11; Description=PPR repeat
  Pfam annotation: Domain name=PPR; Domain location=146-180; Score =22.3; E_value=0.0018; Accession=PF01535.11; Description=PPR repeat
  Pfam module annotation: Pfam domain module=PPR::PPR; Domain location =110-144::146-180
MAAVAWNLTAMGASIMIMIVVQVLKMLALTDSPLLIAKTFEAIKIPTSTRGTVIKELSNVKEEVYGALDSYVAWELEFPLITVKKALKTLESEQEWKRWMLSKGQGKTMGSYFTLLNALVEDDRLDEAEELWTKLLMQYMESLPRRFFDKMISIYHKRGMHEKMFEIFADMEELCLRPNIAVVSMIGDAFKELGMLDKYQKLHAKYPPPQWEYRYIRGKRVKVKVEVQSNQVNTYIERHGNVEPNSDLNKNYRLSEKTSEIVDQQLRQDANVISMKPEQISGINNNYRSEETSDMIDDQQLGQEADVISMELEQISDDSYDIGIIISMCISYKLLGDKSEDTLGIGLEEHVLKNFTKCEIENLVMAISSTQKFSC

SEQ ID NO: 158212 - protein, 114 aa, Glycine max
  Coding DNA Sequence Number=SeqID_66527
  Subcellular localization annotation: CTP_CleavageSite=57; ConfidenceScore=5.12e-01
MKGMPKCLEAAMSPVPERSHKLNTSPKKTGPPPPFPLAPSRAMRTDFAGGWAGLEVAESTVEEPESGGAKKRGRETERGEVGGGGLEEGGDVVVVVAATAVRLGRQSHATGIDG

SEQ ID NO: 158213 - protein, 408 aa, Glycine max
  Coding DNA Sequence Number=SeqID_66528
  Gene Ontology: Mol. function=sequence-specific DNA binding; Cellular component=nucleus; Biological process=regulation of transcription, DNA-dependent
  Homolog annotation: Hit_ID=Q9FLX8; Match level="QueryCoverage=44%, HitCoverage=55%, E-value=1e-44, Identity=52%"; Hit description =Probable WRKY transcription factor 27
  Pfam annotation: Domain name=WRKY; Domain location=197-257; Score =125.6; E_value=1.5e-34; Accession=PF03106.6; Description=WRKY DNA -binding domain
  Subcellular localization annotation: CTP_CleavageSite=38; ConfidenceScore=5.18e-01
MTHEDWDLFAIVRSCKAATFTATTNTETPPTPAPNTTSCLDLSQENGSFSFPNLVQPTTNGFQELQHQQLVINFNPTNTTSTTSSTSTITSGLGINPNSTFSEVAGFIGQQQGYHHHLLPAPTNHTSIGTPTTTGFDRFQHHQQQQLQSPEQNQPPLQAPQTSPILSPTTQPQTPRSRKRKSHQKKMVCHVTADNLSSDLWAWRKYGQKPIKGSPYPRNYYRCSSCKGCVARKQVERSTTEPNTFIVTYTGDHKHAKPVQRNSLAGSTRTKPSTTRLSEPNESVTCPKRENACSSNSELSPMLSVSDTPKNEETVSAGEPDCPDMEIEPSENDDDDVLIPNTGAMSDAVLLGLTNVDRDGVSTLGIDQKNTSGSCQSYPEPDPFSKPGLYSSALGPAKLADLLDDCNL

SEQ ID NO: 158214 - protein, 216 aa, Glycine max
  Coding DNA Sequence Number=SeqID_66529
  Gene Ontology: Mol. function=sequence-specific DNA binding; Cellular component=nucleus; Biological process=regulation of transcription, DNA-dependent
  Homolog annotation: Hit_ID=Q9FLX8; Match level="QueryCoverage=70%, HitCoverage=47%, E-value=9e-41, Identity=55%"; Hit description =Probable WRKY transcription factor 27
  Pfam annotation: Domain name=WRKY; Domain location=11-71; Score =125.6; E_value=1.5e-34; Accession=PF03106.6; Description=WRKY DNA -binding domain
MVCHVTADNLSSDLWAWRKYGQKPIKGSPYPRNYYRCSSCKGCVARKQVERSTTEPNTFIVTYTGDHKHAKPVHRNSLAGSTRTKPSTTRLSEPNESVSCPKKENACSSNSELSPMLSVSDTLENEETVSASEPDCPDMEIEPSDNDDVLIPNTGAMSDAVLLGLTNVERDGVSTSEKHFRVGTVLSGTRPDFQPGLDSSALRRTKLADLHDDCNL

SEQ ID NO: 158215 - protein, 273 aa, Glycine max
  Coding DNA Sequence Number=SeqID_66530
MADHTTRKTTMERLEDAVARLSNSQASLNDKYAELSGKVDSILDHLHLRSPNHNHLNSNTHLHQRNVAKLDILRFSITHLPPMTASTSTPGHAITHHPQPPLQEPSLPSLSVHPAQSIGIDFASTRHRLLSLFSTTALQTMPPSMDSTVPTALLEHHHTMDPNTSPWCPDTITVPWRARVTPQTMPQSFHLPKITPFPNDNVLSTAQTLETPPTPLPKPENKNLKVFLQIRPLLLSPVQAPCKRPKSAWPQNPVKNNAPPGAEFPRTRIPPRA

SEQ ID NO: 158216 - protein, 157 aa, Glycine max
  Coding DNA Sequence Number=SeqID_66531
  Gene Ontology: Mol. function=protein binding; Cellular component =mitochondrion; Biological process=defense response to fungus
  Homolog annotation: Hit_ID=A7PBE0; Match level="QueryCoverage=82%, HitCoverage=14%, E-value=4e-36, Identity=55%"; Hit description =Chromosome chr16 scaffold_10, whole genome shotgun sequence
  Pfam annotation: Domain name=LRRNT_2; Domain location=28-66; Score =58.1; E_value=3.1e-14; Accession=PF08263.3; Description=Leucine rich repeat N-terminal domain
  Pfam annotation: Domain name=LRR_1; Domain location=120-142; Score =15.9; E_value=0.15; Accession=PF00560.24; Description=Leucine Rich Repeat
  Pfam annotation: Domain name=LRR_1; Domain location=71-93; Score=0.6; E_value=2.4e+02; Accession=PF00560.24; Description=Leucine Rich Repeat
  Pfam annotation: Domain name=LRR_1; Domain location=95-118; Score =12.6; E_value=1.4; Accession=PF00560.24; Description=Leucine Rich Repeat
  Pfam module annotation: Pfam domain module=LRRNT_2::LRR_1::LRR_1::LRR_ 1; Domain location=28-66::120-142::71-93::95-118
MAIGSAKVIIIILKSSVVVSAQDHIMCIQTEREALLQFKAALLDHYGMLSSWTTSDCCQWQGIRCSNLTAHVLMLDLHSLGLRGEIHQSLMELQQLNYLNLSWNSFQGRGIPEFLGSLTNLRYLDLSHSDFEGKIPTQFGSFSHLKYLNLAGNYYLE

SEQ ID NO: 158217 - protein, 474 aa, Glycine max
  Coding DNA Sequence Number=SeqID_66532
  Gene Ontology: Mol. function=transferase activity, transferring glycosyl groups; Cellular component=cytoplasm; Biological process =metabolic process
  Homolog annotation: Hit_ID=A6BM07; Match level="QueryCoverage=98%, HitCoverage=99%, E-value=1e-168, Identity=67%"; Hit description=UDP -glucose:isoflavone 7-O-glucosyltransferase
  Pfam annotation: Domain name=UDPGT; Domain location=23-470; Score= -52.6; E_value=5.9e-08; Accession=PF00201.9; Description=UDP -glucoronosyl and UDP-glucosyl transferase
MKDTIVLYPNVLRGHLVSMVELGKLILTHHPSLSITILILTPTTTSSTTSVSCNSNARYIATVTATTPAITFHHAPFATLPPSTPSLPSHILSIELTRHSTQNLAVALQTLAKASNLKALVIDFMNFNDPKALTENLNNNVPTYFYFASCASFLSLLLRLPTIHQTVTREKVKDQPLQIQIPGLPTISTDDFPNEAKDPSSESYQSLLQVAENMRCSVGIIANTFEALEEKSIRALCKDGTLPPLFFIGPLISAPYEEDKGCLSWLDSQPSQSVVLLSFGSLGRFSRAQLKEIAIGLEKSEQRFLWVVRSRLDDADSMEELSLDELMPEGFLERTKEKGLIMRNWAPQVQLLSHDSVGGFVTHCGWNSVLEAVCEGVPMVAWPLYAEQKMNRVIMVKEMKVALEVNENKDGLVSATELGDRVRELMDSVKGKEIRQRVFEMKKRAEEAMAEGGTSCVTLDKLAIKLWKGNMIDI

SEQ ID NO: 158218 - protein, 88 aa, Glycine max
  Coding DNA Sequence Number=SeqID_66533
  Homolog annotation: Hit_ID=A5BAF2; Match level="QueryCoverage=65%, HitCoverage=6%, E-value=5e-09, Identity=37%"; Hit description =Putative uncharacterized protein
MDAMDMEASLWHQRLSHISEKGLNCLAKKDMLPGLKNVDLEKCSHCMVDVCGPLKVKSFSDADMMTKALLRWKFEACSEIISLAVTFT

SEQ ID NO: 158219 - protein, 473 aa, Glycine max
  Coding DNA Sequence Number=SeqID_66534
  Gene Ontology: Mol. function=transferase activity, transferring glycosyl groups; Cellular component=integral to membrane; Biological process=metabolic process
  Homolog annotation: Hit_ID=Q8S9A6; Match level="QueryCoverage=100%, HitCoverage=100%, E-value=0.0, Identity=76%"; Hit description =Glucosyltransferase-3
  Pfam annotation: Domain name=UDPGT; Domain location=25-473; Score= -50.6; E_value=4.7e-08; Accession=PF00201.9; Description=UDP -glucoronosyl and UDP-glucosyl transferase
MTMKDSIVLYSALGRGHLVSMVELGKLILSHHPSLSITILFLTPPPNQDTPTSPTAFTCDATAKYIAAVTAATPSITFHRIPQISILTVLPPMALTFELCRATGHHLRRILSYISQTSNLKAIVLDFMNYSAARVTNTLQIPTYFYYTSGASTLAALLYQTIFHETCTKSLKDLNTHVVIPGLPKIHTDDMPDGAKDRENEAYGVFFDIATCMRGSYGIIVNTCEAIEESVLEAFNEGLMEGTTPKVFCIGPVISSAPCRKDDNGCLSWLNSQPSQSVVFLSFGSMGRFSRTQLREIAIGLEKSEQRFLWVVRSEFEEGESAEPPSLEELLPEGFLDRTKEKGMVVRDWAPQAAILSHDSVGGFVTHCGWNSVLEAICEGVPMVAWPLYAEQKLNRVILVEEMKVGLAVEQNNNGLVSSTELGDRVKELMNSDRGKEIRQRIFKMKNSATEAMTEGGSSVVALNRLVEIWREH

SEQ ID NO: 158220 - protein, 279 aa, Glycine max
  Coding DNA Sequence Number=SeqID_66535
  Gene Ontology: Mol. function=citrate transmembrane transporter activity; Cellular component=integral to membrane; Biological process=citrate transport
  Homolog annotation: Hit_ID=Q1RU51; Match level="QueryCoverage=94%, HitCoverage=48%, E-value=1e-90, Identity=66%"; Hit description =Transporter, putative
  Pfam annotation: Domain name=CitMHS; Domain location=1-227; Score= -65.6; E_value=0.00039; Accession=PF03600.7; Description=Citrate transporter
TLRNRSAAIDGEIDRVLSNTLDSTRNSNASKEETNGMPPLTKEEINGSPSKDDGIVDKPVEAHVLLTLEEKDYTSVRWKYILWKSCVYIITLGMLIAMLLGLNMSWTAISAALALVVLDFKDARPSLEKVSYSLLIFFCGMFITVDGFNRTGIPGALWDVMEPYSRVNQASGVAILALVILILSNVASNVPTVLLLGGPVAASAAAISQADEKKAWLILAWASTVAGNLSLLGSAANLIVCEQARRAPNIAYTLTFWSHLKFGLPSTLIITAIGLTLIR

SEQ ID NO: 158221 - protein, 205 aa, Glycine max
  Coding DNA Sequence Number=SeqID_66536
  Gene Ontology: Mol. function=citrate transmembrane transporter activity; Cellular component=integral to membrane; Biological process=citrate transport
  Homolog annotation: Hit_ID=Q1RU51; Match level="QueryCoverage=100%, HitCoverage=37%, E-value=4e-94, Identity=83%"; Hit description =Transporter, putative
  Pfam annotation: Domain name=CitMHS; Domain location=16-205; Score =26.7; E_value=1.9e-07; Accession=PF03600.7; Description=Citrate transporter
  Subcellular localization annotation: CTP_CleavageSite=41; ConfidenceScore=5.08e-01
MALAPVPKLVLGSVAFAIFWVLAVFPAVPFLPIGRTAGSLLGAMLMVIFRVISPDQAYEAIDLPILGLLFGTMVVSVYLERADMFKYIGKLLSWKSRGAKDLLCRICVISAVSSALFTNDTACVVLTEFILKIAKQHNLPPHPLLLALATSSNIGSAATPIGNPQNLVIAVQGRISFGQFLIGILPAMLVGVVVNALILMAMYWK

SEQ ID NO: 158222 - protein, 42 aa, Glycine max
  Coding DNA Sequence Number=SeqID_66537
MDKQDASFLALFRCQNEEIRPNLFRSGNGGSDGGLKRRRKTG

SEQ ID NO: 158223 - protein, 100 aa, Glycine max
  Coding DNA Sequence Number=SeqID_66538
GGGCRPARPGELSSPRRAGLLPPEATAFWRNIPEGPSGPGKWPRGSLPQRGPGRTRQPKELVPLRSMTVTALGALYTSSALRPSRDGHFSGSDASSSGTT

SEQ ID NO: 158224 - protein, 144 aa, Glycine max
  Coding DNA Sequence Number=SeqID_66539
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=39%, E-value=3e-45, Identity=79%"; Hit description=DNA -directed RNA polymerase subunit beta'
  Pfam annotation: Domain name=RNA_pol_Rpb1_2; Domain location=93-144; Score=-61.7; E_value=0.0053; Accession=PF00623.11; Description=RNA polymerase Rpb1, domain 2
GAGAIREQLADLDLRILMDSSLIEWKELGEEGSPDNENEWEDRKEKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRL

SEQ ID NO: 158225 - protein, 127 aa, Glycine max
  Coding DNA Sequence Number=SeqID_66540
MRSWVRGQWIPFDADAISQLLGYPLVLEEGQECNYGQRRNQSDGFNEEAIAQLLCIPGQDFARTATGRRVRIMRTNMTTLTQIWMTLLLSNIQPSDHNSDLPLPKCMAPTRHPLDPDKFTGPWDFPP

SEQ ID NO: 158226 - protein, 28 aa, Glycine max
  Coding DNA Sequence Number=SeqID_66541
MRKLIKVKWWLDRNIEMAITEATGLQMR

SEQ ID NO: 158227 - protein, 90 aa, Glycine max
  Coding DNA Sequence Number=SeqID_66542
  Subcellular localization annotation: CTP_CleavageSite=42; ConfidenceScore=5.33e-01
MMMVWVFFPRSNSQPLGLLANFTSLSHFLCSSSFVSQFLKVRDNHHGRVILVESNNYDYYFKVLLIGDSGVGKMMQSYTPRALNRRLQED

SEQ ID NO: 158228 - protein, 51 aa, Glycine max
  Coding DNA Sequence Number=SeqID_66543
MKSLRGKEIALVKVQWGTDEGDSTWELEDRCICIYVLGRSRNSGGKIRGLG

SEQ ID NO: 158229 - protein, 161 aa, Glycine max
  Coding DNA Sequence Number=SeqID_66544
MENASNAAFLRFCLLLAFCSHVLSALSPDSVDNRITAFDWHDRFPDWKAGSERNAINETAMTMITNSSSVPCSNSVSVCVYQMNKYLPQASPSPVESPTVATYPSAGGRRVTRGMRVPRKEYARSRHQRLFEENFGKTGKDAIYELLSERLRSCIYARGRY

SEQ ID NO: 158230 - protein, 121 aa, Glycine max
  Coding DNA Sequence Number=SeqID_66545
MTTSDSTQFQMAKWVPCLCRQGCLITKPTYLRLRKPGAASFVHLLHLSNMWVATILARGTKRSRGERKERKEKKNKLDIGEDLTHIWSRLYDGADGIFPIVHGDNLAVVYVKGLDQTFRLY

SEQ ID NO: 158231 - protein, 531 aa, Glycine max
  Coding DNA Sequence Number=SeqID_66546
  Gene Ontology: Mol. function=protein binding; Cellular component =ubiquitin ligase complex; Biological process=ubiquitin-dependent protein catabolic process
  Homolog annotation: Hit_ID=Q2ULT2; Match level="QueryCoverage=100%, HitCoverage=33%, E-value=0.0, Identity=95%"; Hit description =Uncharacterized conserved protein
  Pfam annotation: Domain name=RCC1; Domain location=155-206; Score =12.6; E_value=0.032; Accession=PF00415.9; Description=Regulator of chromosome condensation (RCC1)
  Pfam annotation: Domain name=RCC1; Domain location=272-323; Score =12.3; E_value=0.034; Accession=PF00415.9; Description=Regulator of chromosome condensation (RCC1)
  Pfam module annotation: Pfam domain module=RCC1::RCC1; Domain location=155-206::272-323
YGATIASRDIKSIVSSTADVSKLADLDNADTASIASSQLDDFDGDGHFAKRVLKPRTNVLGDEVFTFGSNKNLNLGVGDQDDRQYPERITFRRPDHLLQRFFSDFQEQQLDEGSSDFQQVRGVTDLPALIKNKPIKIQNIAMSKLHTAILTNDPESNLFLCGFGPGGRLGTGDESTRFSFVCIETGGLASKKVISVALGQDHTLAITENGEIFSWGSNKFGQLGYGLPRTNNRDDVPMQKTPRQIFNPFKKETILGAAASAIHSVVFSNFGLYTFGKNEGQLGLVDSDARSLETQTTPRRVGASLFSAPIQSVSAIDQATTILLQNHEVWVFSQYGYSRLSFPLDISSSFIRNSFMSTRYDTSINRIVKVTSGGNTICALSSSGEVFTVQVNRTENPPSSTSTTNPTKTRNSLSTPARVWSVKKAHMAVKDVDVGQDGSIIICTASGSAWRKEKRGKAKDSSSKDHKFARVPGLSRVVSVCSNAFGAFAAVQQNCDVTREQINVDQSTLWKDMLPLSPFNSVVGSLATDHD

SEQ ID NO: 158232 - protein, 46 aa, Glycine max
  Coding DNA Sequence Number=SeqID_66547
MALKSITKAQNRARKPKTSAFKRILGLGVISRFLEAKFDETSENEV

SEQ ID NO: 158233 - protein, 54 aa, Glycine max
  Coding DNA Sequence Number=SeqID_66548
MDPKRIKVIPEWPTPPSVEERIHEFQEPLDLRSNPFQGGGNDAILPDRGRTRIK

SEQ ID NO: 158234 - protein, 36 aa, Glycine max
  Coding DNA Sequence Number=SeqID_66549
MAIYRKRPFGAREARPGMKKFHGPSEPHACLGEFRS

SEQ ID NO: 158235 - protein, 98 aa, Glycine max
  Coding DNA Sequence Number=SeqID_66550
MRVELETTNKVQETKKLREEAAKLRVARRYNTKVQTRAFNLVTSYGESEVKPEKIFEQESLAPTGKAHSGSLQAWTTEYTYYNNWMAKQFQEHGMPLT

SEQ ID NO: 158236 - protein, 119 aa, Glycine max
  Coding DNA Sequence Number=SeqID_66551
DEAATSPSSSESEEAKGEESSEEIYPQEEGQPLVVKRSTLASIATPLGLEFIPQVKKLLDEGLVCKSLNPCALLVPKIAPLIELVRNHVPSWEDVHERGVEGRSPEYEEPQDLRSNPFP

SEQ ID NO: 158237 - protein, 19 aa, Glycine max
  Coding DNA Sequence Number=SeqID_66552
MEDRRTVARQSIRGAPDSL

SEQ ID NO: 158238 - protein, 490 aa, Glycine max
  Coding DNA Sequence Number=SeqID_66553
  Gene Ontology: Mol. function=nucleoside-triphosphatase activity; Cellular component=membrane; Biological process=transport
  Homolog annotation: Hit_ID=A1G0G1; Match level="QueryCoverage=87%, HitCoverage=79%, E-value=0.0, Identity=70%"; Hit description=ABC transporter related
  Pfam annotation: Domain name=ABC_tran; Domain location=87-282; Score =174.2; E_value=3.3e-49; Accession=PF00005.18; Description=ABC transporter
STLEDPQKRCRSNHLAWIGACGEGPGRRAARTWERETSAAAHPGALLTSTFHSVIWTPPPMISLRNFALRRGERLLLSNVDLTLHAGYRVGVVGRNGAGKSSLFAAVKGELEADKGDVDLPGKVRIASVAQETPSLPDPALSFVLGGDIEVAAVLAAEAEATAREDWEAVAEAHTKMAELNAYDAEARAGKLLHGLGFPAETHHRAVSSFSGGWRVRLNLARALMMPSDLLLLDEPTNHLDLDAVYWLEQWLLKYPGTLLLISHDREFLDNVATHTLHLHGGGAKLYPGGYTDFERQRAEQLRQQQIAHEKEQAERAHLQSFIDRFKAQASKAAQAQSRMKRLAKLAGTEAVRAEREFRIEFAPPAKLPFSLIRLNHVEAGYGKDAVILHNVGFGLEAGQRIGLLGPNGAGKTTLVKTLVGELAPIVGERMAHPDLKIGYFAQHTVESLHEGQSPMEHFREIAPDAPNQSFRDFLGKWNFPGDRAFEPVD

SEQ ID NO: 158239 - protein, 66 aa, Glycine max
  Coding DNA Sequence Number=SeqID_66554
MQLARQVSRLESGQFDGTEAWRVMLNDETQADDAARTREENRALYWIEKSEITCMHDRLISYACRR

SEQ ID NO: 158240 - protein, 294 aa, Glycine max
  Coding DNA Sequence Number=SeqID_66555
  Homolog annotation: Hit_ID=Q8GEG1; Match level="QueryCoverage=38%, HitCoverage=83%, E-value=8e-62, Identity=98%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARRVSGCKGDNLDCSSFHIKDELIPSDDEGTELEFVIMNQGITQERTCEQKASKRPGTVKRPRCWRFSIGSAPLTSITKIDAQVRGGETRQDYKDTRRFPLEAPSCALLFRPCRLPDTCPPFSLREAWRFLIAHAVGISVRCRSFAPSWAVCTNPPVQPDRCALSGNYRLESNPVRHDLSPLAAATGNRISRARYVGGATEFLKWWPNYGYN

SEQ ID NO: 158241 - protein, 367 aa, Glycine max
  Coding DNA Sequence Number=SeqID_66556
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=38%, E-value=0.0, Identity=87%"; Hit description=DNA -directed RNA polymerase subunit beta
  Pfam annotation: Domain name=RNA_pol_Rpb2_6; Domain location=1-276; Score=353.3; E_value=4.2e-103; Accession=PF00562.19; Description=RNA polymerase Rpb2, domain 6
  Pfam annotation: Domain name=RNA_pol_Rpb2_7; Domain location=278-355; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-276::278-355
MPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 158242 - protein, 74 aa, Glycine max
  Coding DNA Sequence Number=SeqID_66557
MNVKLQIYNKALINEDMQIIHFGVRDVVRMCHMVDPIFVLGDQDFFCPDASPLLLRQPPQKMRAANQHRISHPY

SEQ ID NO: 158243 - protein, 163 aa, Glycine max
  Coding DNA Sequence Number=SeqID_66558
MKVDPSIPFKVIACAPRKGRQFGNISWLVWWGHPLIGSPNGRKEELGFCPCAWSTVQRKDKELRGSNNGIIVGYHKWLKARTQELDWLLKLKASSEEEAKTPEENEEVQALKAELEKAQAVKERFKMTAIKVRKECDELRDVNVATTEALELETKRARKEEWG

SEQ ID NO: 158244 - protein, 201 aa, Glycine max
  Coding DNA Sequence Number=SeqID_66559
MDIAIVKEFYANLYDLEDKSPKHVRVRGHLVKFDEDILNTFLKTPVVLEEGENLCTYSRFALLRPDPQELAARLCIPGRGFELNADGLPLKILRKNLTTLAQSWSVLSFSNMVPTSHISDITLDRARLIYGIIQKMDMNLGYIISAQISMIAQHDSSRLGFLALITALCKARGVISDSLTLESLSSTINVDYVKKNYWKPR

SEQ ID NO: 158245 - protein, 390 aa, Glycine max
  Coding DNA Sequence Number=SeqID_66560
  Gene Ontology: Mol. function=DNA binding; Cellular component=nucleus; Biological process=polarity specification of adaxial/abaxial axis
  Homolog annotation: Hit_ID=A7PC32; Match level="QueryCoverage=87%, HitCoverage=86%, E-value=2e-86, Identity=53%"; Hit description =Chromosome chr2 scaffold_11, whole genome shotgun sequence
  Pfam annotation: Domain name=Myb_DNA-binding; Domain location=213 -264; Score=41.8; E_value=2.5e-09; Accession=PF00249.22; Description =Myb-like DNA-binding domain
LVWMELFPAQPDLSLQISPPNAKPTSSWRRSTEEDMDLGFWKRALDSRNSIQSMAKQDSCFDLSLSNPKASDNNNNHHSNTTTSNLIHHHHFQNGATPTNATTTTTNPFQLPFQKNHYFHQQQQPLFQPQHQSLSQDLGFLRPIRGIPVYQNPPPIPFTQHHHHHHLPLEASTTTPSIISNTNNGSTPFHSQALMRSRFLSRFPAKRSMRAPRMRWTSTLHARFVHAVELLGGHERATPKSVLELMDVKDLTLAHVKSHLQMYRTVKTTDRAAASSDVYDNGSSGDTSDDLMFDIKSSRRSDLSVKQGRSSVNQDKEYHGLWGNSSREAWLHGKTKTDSVGNVPFSLEKEMDPKCLSYERISDGSSSSNLSGSSPKKPNLDLEFSLGQPL

SEQ ID NO: 158246 - protein, 352 aa, Glycine max
  Coding DNA Sequence Number=SeqID_66561
  Gene Ontology: Mol. function=catalytic activity; Cellular component =plastoglobule; Biological process=cellular metabolic process
  Homolog annotation: Hit_ID=Q9FVR6; Match level="QueryCoverage=99%, HitCoverage=99%, E-value=1e-64, Identity=45%"; Hit description =Uncharacterized protein At1g32220, chloroplast precursor
  Pfam annotation: Domain name=Epimerase; Domain location=72-341; Score= -33.9; E_value=0.00012; Accession=PF01370.12; Description=NAD dependent epimerasedehydratase family
  Pfam annotation: Domain name=NAD_binding_4; Domain location=74-325; Score=-107.8; E_value=0.088; Accession=PF07993.3; Description=Male sterility protein
  Pfam module annotation: Pfam domain module=Epimerase::NAD_binding_4; Domain location=72-341::74-325
  Subcellular localization annotation: CTP_CleavageSite=44; ConfidenceScore=5.62e-01
MASFLSSLPAVSARPIPTSAFPLRKPLFQTPPTLHFKNHRFAVSCSYAEAGVNADSSSNTIDVVADVRSERIVVLGGNGFVGSAICKAAVSRGIEVISLSRATYLFGCLGRPRDVFYVNWDEVLVGATAVVSTLGGFGSEEQMKRINGEANVVAVNAAKEYGEPSAHLIEHEFSDKLTCVQPLFIEKTGRLCSEESRPDGEKTNNSRQRKTQKDYKRGIPKFILISVHDYNLPSFLLSSGYFTGKRKAESEVLSKYPNSGIVLRPAFIYGKRRVNGYELPLDLVGEPAEKILRAIENFTKPLSSLPASDLLLAPPVSVDDVALAVINGVTDDDFFGVFTIDQIKDAANKVRV

SEQ ID NO: 158247 - protein, 196 aa, Glycine max
  Coding DNA Sequence Number=SeqID_66562
  Gene Ontology: Mol. function=dolichyl-diphosphooligosaccharide -protein glycotransferase activity; Cellular component=integral to membrane; Biological process=apoptosis
  Homolog annotation: Hit_ID=Q75QH0; Match level="QueryCoverage=82%, HitCoverage=93%, E-value=5e-40, Identity=58%"; Hit description =Defender against apoptotic death 1
  Pfam annotation: Domain name=DAD; Domain location=32-196; Score =175.1; E_value=1.8e-49; Accession=PF02109.7; Description=DAD family
MIRPKAQERLKCTPDPEKVAKRMGGSSSSSSSSSKDAQDLFRALWSAYASTPTNLKIIDLYVIYAVFTALIQVVYMALVGSFPFNSFLSGVLSCVGTAVLAGYLVLHVLVHYESSKSTRYICAAQHGTYKPATYIGINLVLVFLIIVILLHFGPVCLRIQVNKDNKEFKDLAPERAFADFVLCNLVLHLVIMNFLG

SEQ ID NO: 158248 - protein, 131 aa, Glycine max
  Coding DNA Sequence Number=SeqID_66563
MDISLCIVISLTNIVYGLSPPQELLKHIPRRLSCTNNQILNEIHALFKEQPSGESEIEEVVEKIKDERKKSDVKGQVILEELDSEPSSNAPKIMCSSEAFLLSIASRTLKRTKVREALERGAAELIGWKPK

SEQ ID NO: 158249 - protein, 266 aa, Glycine max
  Coding DNA Sequence Number=SeqID_66564
  Homolog annotation: Hit_ID=A5C3G4; Match level="QueryCoverage=94%, HitCoverage=71%, E-value=2e-23, Identity=28%"; Hit description =Putative uncharacterized protein
  Pfam annotation: Domain name=Ank; Domain location=141-175; Score =19.9; E_value=0.0096; Accession=PF00023.21; Description=Ankyrin repeat
  Pfam annotation: Domain name=Ank; Domain location=177-210; Score=4.6; E_value=7; Accession=PF00023.21; Description=Ankyrin repeat
  Pfam annotation: Domain name=Ank; Domain location=218-251; Score=2.0; E_value=17; Accession=PF00023.21; Description=Ankyrin repeat
  Pfam module annotation: Pfam domain module=Ank::Ank::Ank; Domain location=141-175::177-210::218-251
MEATNVASWEKVKDNYEIWKTLMKNYLVGNDLWDAIETPSTPRHDAHRMNAMALHIIQRSCGSKNFDEIWQFDKAQAAWNHLCVRYSDNELKAKPDIEQGVVGDDDFENKELYKYVEDGDWKKTESFISGNKVEVSRLAPDSGSVLHVAAMAGHANIVRELISTSGGKELLKKTDQRGFTALALVAHLTGNIDVARCMVDNIDDNNVRQDLLTTKKSNVEIPLLLAADKGHTEITRFLYEKTPTDELSQPDLVLLLERCIKAEIFG

SEQ ID NO: 158250 - protein, 698 aa, Glycine max
  Coding DNA Sequence Number=SeqID_66565
  Gene Ontology: Mol. function=cysteine-type peptidase activity; Cellular component=nucleolus; Biological process=ubiquitin-dependent protein catabolic process
  Homolog annotation: Hit_ID=A7PC87; Match level="QueryCoverage=51%, HitCoverage=64%, E-value=1e-115, Identity=56%"; Hit description =Ubiquitin carboxyl-terminal hydrolase
  Pfam annotation: Domain name=UCH; Domain location=121-398; Score =204.3; E_value=2.9e-58; Accession=PF00443.20; Description=Ubiquitin carboxyl-terminal hydrolase
MAAEEPLDASPSPNLFSETLSAAELVADLAGYYAQSPTGGGSTLPEDSDEDTAADDTGVPSSFRQLNHDDSSSLWSSALGSNSRVSSVAPESWIAAQGNWLLPETKGSDGAEPASEAVPSKMGAGLLNLGNTCFLNAILQCFTHTVPLVQGLRSSTHLIPCSVLLGVTDDKMFRRYQQEDAHEFMQCALDKLERCFLDLKKSNLNFEDDNLVEKVFGGRFISKLQCSTCGHTSNTFEPLIDMSLEIDNVDSLPSALESFTKVENIDENFRCDNCKEEVSMEKQLMLDQTPSVAALHLKRFKTNGILVEKIDKHIDFPLELDLQPYTIKVMEDLVAENDVPLKYDLYAIVVHTGLSSTSGHYFCFVRSAPDTWHKLDDSMVTKVSVDSVLSQEAYILFYARQGTPWFSSIMEEKTQCLDPNIMTTSPKSVLDVGDNMSKSNPILLPNIERGVADVSKEYSEPRFDYYCQEDHNFLEINDTEDATHGFGQLLSGSNQVIFDSNGSKDVDVQKLFSNRGHNDNTLGCGQFPSGSNQESVDLNSSKDVDAQKLFRNRTTLDDSAMLDMGNSYIENSSLDNNNRQEGGDFRENAGFHSLTPPNSPPDDASDKFHNSRGNLKRENLRSCKRSSNKLTGVSEERREAVKYLCKNRSRRGLLLKFVTSNKVLDKKRKKMDSSQCKKSTKKSNHTSVSPPVAAGSSQ
